United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 84

SEQ ID NO: 163420 - DNA, 8520 bp, Artificial Sequence
  Description of Artificial Sequence: Synthetic coding sequence
atgcccatcacccaggacaatgctgtgctgcacctgcccctgctgtaccagtggctgcagaacagcctgcaggagggcggagatggccctgagcagaggctgtgccaggccgccatccagaagctgcaggagtacatccagctgaactttgctgtggatgagagcacagtgcccccagaccacagccccccagagatggagatctgcaccgtgtacctgaccaaggagctgggggacacagagaccgtgggcctgagctttggaaacatccctgtgtttggagactatggagagaagaggcggggcggcaagaagaggaagacccaccagggccctgtgctggatgtgggctgcatctgggtgacagagctgaggaagaacagccctgctgggaagagcggcaaggtgcggctgagagatgagatcctgagcctgaatggccagctgatggtgggcgtggatgtgtctggggccagctacctggccgagcagtgctggaatggaggcttcatctacctgatcatgctgcggcgcttcaagcacaaggcccacagcacctacaacggcaacagcagcaacagcagcgagcctggagagacccccaccctggagctgggggacagaacagccaagaagggcaagaggaccaggaagtttggagtcatcagccggcccccagccaacaaggcccctgaggagagcaaaggatctgctggctgtgaggtgtccagtgaccccagcacagagctggagaatggaccagaccctgagctgggcaatggccacgtgttccagctggagaatggaccagacagcctgaaggaggtggccggcccccacctggagaggtctgaggtggaccggggcacagagcaccgcatccccaagacagatgcccccctgaccaccagcaatgacaagaggcgcttcagcaagggcggcaagacagacttccagagcagtgactgcctggcccgggaggaggtgggccgcatctggaagatggagctgctgaaggagagtgatggcctgggcatccaggtgtctgggggccggggcagcaagaggagcccccacgccatcgtggtgacccaggtgaaggagggcggggccgcccacagagatggccgcctgagcctgggagatgagctgctggtgatcaatggccacctgctggtgggcctgagccatgaggaggccgtggccatcctgcggagcgccaccggcatggtgcagctggtggtggccagcaaagaaaattctgctgaggacctgctgcggctgaccagcaagagcctgcctgacctgaccagctctgtggaggatgtgtcctcctggacagacaatgaagaccaggaggctgatggagaggaggatgagggcaccagcagctctgtgcagagggccatgcctggaacagatgagccccaggatgtgtgtggggctgaggagagcaagggcaacctggagagccccaagcagggcagcaacaagatcaagctgaagagccggctgagcggcggcgtgcaccggctggagagcgtggaggagtacaatgagctgatggtgagaaatggagacccccgcatccgcatgctggaggtgtccagagatggcaggaagcacagcctgccccagctgctggacagcagcagcgccagccaggagtaccacatcgtgaagaagagcaccaggagcctgagcaccacccaggtggagagcccctggaggctcatccggcccagcgtcatcagcatcatcggcctgtacaaggagaagggcaagggcctgggcttcagcattgctgggggccgggactgcatccggggccagatgggcatctttgtgaagaccatcttccccaacggcagcgctgctgaagatggccgcctgaaggagggagatgagatcctggatgtgaatggcatccccatcaagggcctgaccttccaggaggccatccacaccttcaagcagatccgcagcggcctgtttgtgctgactgtgaggaccaagctggtgagccccagcctgaccccctgcagcacccccacccacatgagccgcagcgccagccccaacttcaacaccagcggcggggccagcgctgggggcagtgatgagggcagcagcagcagcctgggcaggaagaccccaggccccaaggacagaattgtgatggaggtgaccctgaacaaggagccccgggtgggcctgggcattggagcctgctgcctggccctggagaacagccccccaggcatctacatccacagcctggcccctggctctgtggccaagatggagagcaacctgagcagaggagaccagatcctggaggtgaacagcgtgaatgtgagacatgctgccctgagcaaggtgcacgccatcctgagcaagtgccccccaggccctgtgcggctggtgattggccgccaccccaaccccaaggtgtctgagcaggagatggatgaggtgattgcccggagcacctaccaggagagcaaggaggccaacagcagccctggcctgggcacccccctgaagagccccagcctggccaagaaggacagcctcatcagcgagagcgagctgagccagtactttgcccatgatgtgcccggccccctgagtgacttcatggtggccggctctgaagatgaggaccaccctggcagcggctgcagcaccagcgaggagggcagcctgccccccagcaccagcacccacaaggagcccgggaagccccgggccaacagcctggtgaccctgggcagccaccgggccagcggcctcttccacaagcaggtgacagtggcccggcaggccagcctgcccggcagcccccaggccctgaggaaccccctgctgcggcagaggaaggtgggctgctatgatgccaatgatgccagtgatgaggaggagtttgaccgggagggggactgcatcagcctgcccggggccctgcccggccccatccggcccctgtctgaagatgacccccggcgggtgtccatcagcagcagcaagggcatggatgtgcacaaccaggaggagcggcccaggaagaccctggtgtccaaggccatcagcgcccccctgctgggcagctctgtggacctggaggagagcatccctgagggcatggtggatgctgccagctatgctgccaacctgacagacagcgctgaggcccccaagggcagccctggctcctggtggaagaaggagctgagcggcagcagcagcgcccccaagctggagtacacagtgaggacagacacccagagccccaccaacacaggcagccccagcagcccccagcagaagtctgagggcctgggcagccgccacaggcctgtggcccgggtgagcccccactgcaagaggtctgaggccgaggccaagcccagcggcagccagacagtgaacctgaccggccgggccaatgacccctgtgacctggacagccgggtgcaggccacctctgtgaaggtgacagtggccggcttccagcctggaggagctgtggagaaggagagcctgggcaagctgaccactggagatgcctgtgtgtccaccagctgtgagctggccagcgccctgagccacctggatgccagccacctgacagagaacctgcccaaggccgccagcgagctgggccagcagcccatgacagagctggacagcagcagtgacctgatcagcagccctgggaagaagggggccgcccacccagaccccagcaagacctctgtggacaccggccaggtgtccaggcctgagaaccccagccagcctgccagcccccgggtgaccaagtgcaaggcccggagccctgtgcggctgccccatgagggcagccccagccctggagagaaggctgctgcccccccagactacagcaagaccaggtctgccagcgagaccagcaccccccacaacacccggcgggtggccgccctgcggggggccggccctggagctgagggcatgaccccagctggagctgtgctgcccggggaccccctgaccagccaggagcagaggcagggcgcccctggcaaccacagcaaggccctggagatgacaggcatccacgcccctgagagcagccaggagcccagcctgctggagggcgctgacagcgtgagcagccgggccccccaggccagcctgtccatgctgcccagcacagacaacaccaaggaggcctgtggccacgtgtctggccactgctgccctgggggcagccgggagagccctgtgacagacatcgacagcttcatcaaggagctggatgccagcgctgcccggagccccagcagccagacaggagacagcggcagccaggagggcagcgcccagggccaccccccagctggggccggcggcggcagcagctgcagagctgagcctgtgcctgggggccagaccagcagcccccggcgggcctgggccgccggggccccagcctacccccagtgggccagccagcccagcgtgctggacagcatcaacccagacaagcacttcaccgtgaacaagaacttcctgagcaactacagcaggaacttcagcagcttccacgaggacagcaccagcctgagcggcctgggggacagcacagagcccagcctgagctccatgtatggagatgctgaggacagcagcagtgaccctgagagcctgacagaggccccccgggccagcgccagagatggctggagccccccaagaagccgggtgtccctgcacaaggaggaccccagcgagagcgaggaggagcagatcgagatctgcagcacccggggctgccccaacccccccagcagccctgcccacctgcccacccaggccgccatctgcccagccagcgccaaggtgctgagcctgaagtacagcaccccccgggagagcgtggccagcccccgggagaaggccgcctgcctgcccggcagctacaccagcggccctgacagcagccagcccagcagcctgctggagatgagcagccaggagcacgagacccacgccgacatcagcaccagccagaaccaccggcccagctgtgccgaggagaccacagaggtgaccagcgccagcagcgccatggagaacagccccctgagcaaggtggcccggcacttccacagcccccccatcatcctgagcagccccaacatggtgaatggcctggagcatgacctgctggatgatgagaccctgaaccagtatgagaccagcatcaatgctgctgccagcctgagcagcttctctgtggatgtgcccaagaatggagagagcgtgctggagaacctgcacatcagcgagagccaggacctggatgacctgctgcagaagcccaagatgattgcccggcggcccatcatggcctggttcaaggagatcaacaagcacaaccagggcacccacctgcggagcaagacagagaaggagcagcccctgatgcctgcccggagcccagacagcaagatccagatggtgagcagcagccagaagaagggcgtgacagtgccccacagccccccccagcccaagaccaacctggagaacaaggacctgagcaagaagagccctgctgagatgctgctgaccaacggccagaaggccaagtgtggccccaagctgaagaggctgagcctgaagggcaaggccaaggtgaacagcgaggccccagctgccaatgctgtgaaggccggcggcacagaccacaggaagcccctcatcagcccccagaccagccacaagaccctgagcaaggctgtgtcccagaggctgcacgtggccgaccatgaagatcctgacaggaacaccacagctgcccccaggagcccccagtgtgtgctggagagcaagccacccctggccaccagcggccccctgaagcccagcgtgtctgacaccagcatccgcacctttgtgagccccctgaccagccccaagcctgtgcctgagcagggcatgtggagccgcttccacatggctgtgctgtctgagccagaccggggctgccccaccacccccaagagccccaagtgcagagctgagggccgggcccccagggctgacagcggccctgtgtccccagctgccagcagaaatggcatgtctgtggccggcaaccggcagagcgagccccggctggccagccacgtggccgctgacacagcccagccccggcccactggagagaagggcggcaacatcatggccagtgaccggctggagaggaccaaccagctgaagatcgtggagatctctgctgaggccgtgtctgaaacagtgtgtggcaacaagccagctgagagtgaccggcggggcggctgcctggcccagggcaactgccaggagaagtctgagatccggctgtaccggcaggtggccgagagcagcaccagccaccccagcagcctgcccagccacgccagccaggccgagcaggagatgagccgctccttctccatggccaagctggccagcagcagcagcagcctgcagacagccatcaggaaggccgagtacagccagggcaagagcagcctgatgtctgacagccggggcgtgcccagaaattccatccctgggggccccagcggggaggaccacctgtacttcacccccaggcctgccaccaggacctacagcatgcctgcccagttcagcagccacttcggccgggagggccaccccccccacagcctgggccgcagccgggacagccaggtgcctgtgaccagctctgtggtgcctgaggccaaggccagccggggcggcctgcccagcctggccaacggccagggcatctacagcgtgaagcccctgctggacaccagcaggaacctgcctgccacagatgaaggagacatcatctctgtgcaggagaccagctgcctggtgacagacaagatcaaggtgacccggcggcactactgctatgagcagaactggccccatgagagcaccagcttcttctctgtgaagcagaggatcaagagctttgagaacctggccaatgctgacaggcctgtggccaagagcggggccagccccttcctgtctgtgagcagcaagccacccatcggcagaagaagcagcggcagcatcgtgtctggcagcctgggccaccctggagatgctgctgcccggctgctgcggcgcagcctgagcagctgcagcgagaaccagagcgaggccggcaccctgctgccccagatggccaagagccccagcatcatgaccctgaccatcagccggcagaaccccccagagaccagcagcaagggcagtgacagcgagctgaagaagagcctgggccccctgggcatccccacccccaccatgaccctggccagccctgtgaagaggaacaagagctctgtgcgccacacccagcccagccctgtgagccgcagcaagctgcaggagctgcgggccctgtccatgccagacctggacaagctgtgcagcgaggactacagcgctggccccagcgctgtgctcttcaagacagagctggagatcaccccaagaagaagccctggccccccagctgggggcgtgtcctgcccagagaagggcggcaacagagcctgccctgggggcagcggccccaagaccagcgctgctgagacccccagcagcgccagtgacaccggggaggccgcccaggacctgcccttccgccgctcctggagcgtgaacctggaccagctgctggtgtctgctggggaccagcagaggctgcagagcgtgctgagctctgtgggcagcaagagcaccatcctgaccctcatccaggaggccaaggcccagagtgaaaatgaggaggatgtgtgcttcatcgtgctgaacaggaaggagggcagcggcctgggcttctctgtggccggcggcacagatgtggagcccaagagcatcaccgtgcacagggtcttcagccagggcgccgccagccaggagggcaccatgaacagaggagacttcctgctgtctgtgaatggagccagcctggccggcctggcccacggcaatgtgctgaaggtgctgcaccaggcccagctgcacaaggatgccctggtggtgatcaagaagggcatggaccagccccggcccagcgcccggcaggagcccccaacagccaacgggaagggcctgctgagcaggaagaccatccccctggagcccggcatcggccgctctgtggccgtgcatgatgccctgtgtgtggaggtgctgaagaccagcgctggcctgggcctgagcctggatggcggcaagagctctgtgactggagatggccccctggtgatcaagagggtgtacaagggcggcgctgctgagcaggccggcatcatcgaggccggagatgagatcctggccatcaacgggaagcccctggtgggcctgatgcactttgatgcctggaacatcatgaagtctgtgcctgagggccctgtgcagctgctgatcaggaagcacaggaacagcagctag

SEQ ID NO: 163421 - DNA, 7923 bp, Artificial Sequence
  Description of Artificial Sequence: Synthetic coding sequence
atgcccatcacccaggacaatgctgtgctgcacctgcccctgctgtaccagtggctgcagaacagcctgcaggagggcggagatggccctgagcagaggctgtgccaggccgccatccagaagctgcaggagtacatccagctgaactttgctgtggatgagagcacagtgcccccagaccacagccccccagagatggagatctgcaccgtgtacctgaccaaggagctgggggacacagagaccgtgggcctgagctttggaaacatccctgtgtttggagactatggagagaagaggcggggcggcaagaagaggaagacccaccagggccctgtgctggatgtgggctgcatctgggtgacagagctgaggaagaacagccctgctgggaagagcggcaaggtgcggctgagagatgagatcctgagcctgaatggccagctgatggtgggcgtggatgtgtctggggccagctacctggccgagcagtgctggaatggaggcttcatctacctgatcatgctgcggcgcttcaagcacaaggcccacagcacctacaacggcaacagcagcaacagcagcgagcctggagagacccccaccctggagctgggggacagaacagccaagaagggcaagaggaccaggaagtttggagtcatcagccggcccccagccaacaaggcccctgaggagagcaaaggatctgctggctgtgaggtgtccagtgaccccagcacagagctggagaatggaccagaccctgagctgggcaatggccacgtgttccagctggagaatggaccagacagcctgaaggaggtggccggcccccacctggagaggtctgaggtggaccggggcacagagcaccgcatccccaagacagatgcccccctgaccaccagcaatgacaagaggcgcttcagcaagggcggcaagacagacttccagagcagtgactgcctggcccgggaggaggtgggccgcatctggaagatggagctgctgaaggagagtgatggcctgggcatccaggtgtctgggggccggggcagcaagaggagcccccacgccatcgtggtgacccaggtgaaggagggcggggccgcccaccgggagtaccacatcgtgaagaagagcaccaggagcctgagcaccacccaggtggagagcccctggaggctcatccggcccagcgtcatcagcatcatcggcctgtacaaggagaagggcaagggcctgggcttcagcattgctgggggccgggactgcatccggggccagatgggcatctttgtgaagaccatcttccccaatggatctgctgctgaagatggccgcctgaaggagggagatgagatcctggatgtgaatggcatccccatcaagggcctgaccttccaggaggccatccacaccttcaagcagatccgcagcggcctgtttgtgctgactgtgaggaccaagctggtgagccccagcctgaccccctgcagcacccccacccacatgagccgcagcgccagccccaacttcaacaccagcggcggggccagcgctgggggcagtgatgagggcagcagcagcagcctgggcaggaagaccccaggccccaaggaccgcatcgtgatggaggtgaccctgaacaaggagccccgggtgggcctgggcatcggggcctgctgcctggccctggagaacagccccccaggcatctacatccacagcctggcccctggctctgtggccaagatggagagcaacctgagcagaggagaccagatcctggaggtgaacagcgtgaatgtgagacatgctgccctgagcaaggtgcacgccatcctgagcaaatgtcctgtgtctgagcaggagatggatgaggtgattgcccggagcacctaccaggagagcaaggaggccaacagcagccctggcctgggcacccccctgaagagccccagcctggccaagaaggacagcctcatcagcgagagcgagctgagccagtactttgcccatgatgtgcccggccccctgagtgacttcatggtggccggctctgaagatgaggaccaccctggcagcggctgcagcaccagcgaggagggcagcctgccccccagcaccagcaaggagcccgggaagccccgggccaacagcctggtgaccctgggcagccaccgggccagcggcctcttccacaagcaggtgacagtggcccggcaggccagcctgcccggcagcccccaggccctgaggaaccccctgctgcggcagaggaaggtgggctgctatgatgccaatgatgccagtgatgaggaggagtttgaccgggagggggactgcatcagcctgcccggggccctgcccggccccatccggcccctgtctgaagatgacccccggcgggtgtccatcagcagcagcaagggcatggatgtgcacaaccaggaggagcggcccaggaagaccctggtgtccaaggccatcagcgcccccctgctgggcagctctgtggacctggaggagagcatccctgagggcatggtggatgctgccagctatgctgccaacctgacagacagcgctgaggcccccaagggcagccctggctcctggtggaagaaggagctgagcggcagcagcagcgcccccaagctggagtacacagtgaggacagacacccagagccccaccaacacaggcagccccagcagcccccagcagaagtctgagggcctgggcagccgccacaggcctgtggcccgggtgagcccccactgcaagaggtctgaggccgaggccaagcccagcggcagccagacagtgaacctgaccggccgggccaatgacccctgtgacctggacagccgggtgcaggccacctctgtgaaggtgacagtggccggcttccagcctggaggagctgtggagaagctgtgccaggagagcctgggcaagctgaccactggagatgcctgtgtgtccaccagctgtgagctggccagcgccctgagccacctggatgccagccacctgacagagaacctgcccaaggccgccagcgagctgggccagcagcccatgacagccagtgacctgatcagcagccctgggaagaagggagctgcccacccagaccccagcaagacctctgtggacaccggccaggtgtccaggcctgagaaccccagccagcctgccagcccccgggtgaccaagtgcaaggcccggagccctgtgcggctgccccatgagggcagccccagccctggagagaaggccgccgcccccccagactacagcaagaccaggtctgccagcgagaccagcaccccccacaacaccaggagagtggccgccctgcggggagctggccctggagctgagggcatgaccccagctggagctgtgctgcccggggaccccctgaccagccaggagcagaggcagggcgcccctggcaaccacagcaaggccctggagatgacaggcatccacgcccctgagagcagccaggagcccagcctgctggagggcgctgacagcgtgagcagccgggccccccaggccagcctgtccatgctgcccagcacagacaacaccaaggaggcctgtggccacgtgtctggccactgctgccctgggggcagccgggagagccctgtgacagacatcgacagcttcatcaaggagctggatgccagcgctgcccggagccccagcagccagacaggagacagcggcagccaggagggcagcgcccagggccaccccccagctggagctgggggcggcagcagctgcagagctgagcctgtgcctgggggccagaccagcagcccccggcgggcctgggccgccggggccccagcctacccccagtgggccagccagcccagcgtgctggacagcatcaacccagacaagcacttcaccgtgaacaagaacttcctgagcaactacagcaggaacttcagcagcttccacgaggacagcaccagcctgagcggcctgggggacagcacagagcccagcctgagctccatgtatggagatgctgaggacagcagcagtgaccctgagagcctgacagaggccccccgggccagcgccagagatggctggagcccccccaggagccgggtgtccctgcacaaggaggaccccagcgagagcgaggaggagcagatcgagatctgcagcacccggggctgccccaacccccccagcagccctgcccacctgcccacccaggccgccatctgcccagccagcgccaaggtgctgagcctgaagtacagcaccccccgggagagcgtggccagcccccgggagaaggccgcctgcctgcccggcagctacaccagcggccctgacagcagccagcccagcagcctgctggagatgagcagccaggagcacgagacccatgctgacatcagcaccagccagaaccaccggcccagctgtgccgaggagaccacagaggtgaccagcgccagcagcgccatggagaacagccccctgagcaaggtggcccggcacttccacagcccccccatcatcctgagcagccccaacatggtgaatggcctggagcatgacctgctggatgatgagaccctgaaccagtatgagaccagcatcaatgctgctgccagcctgagcagcttctctgtggatgtgcccaagaatggagagagcgtgctggagaacctgcacatcagcgagagccaggacctggatgacctgctgcagaagcccaagatgattgcccggcggcccatcatggcctggttcaaggagatcaacaagcacaaccagggcacccacctgcggagcaagacagagaaggagcagcccctgatgcctgcccggagcccagacagcaagatccagatggtgagcagcagccagaagaagggcgtgacagtgccccacagccccccccagcccaagaccaacctggagaacaaggacctgagcaagaagagccctgctgagatgctgctgaccaacggccagaaggccaagtgtggccccaagctgaagaggctgagcctgaagggcaaggccaaggtgaacagcgaggccccagctgccaatgctgtgaaggccggcggcacagaccacaggaagcccctcatcagcccccagaccagccacaagaccctgagcaaggctgtgtcccagaggctgcacgtggccgaccacgaggaccctgacaggaacaccacagctgcccccaggagcccccagtgtgtgctggagagcaagccacccctggccaccagcggccccctgaagcccagcgtgtctgacaccagcatccgcacctttgtgagccccctgaccagccccaagcctgtgcctgagcagggcatgtggagccgcttccacatggctgtgctgtctgagccagaccggggctgccccaccacccccaagagccccaagtgcagagctgagggccgggcccccagggctgacagcggccctgtgtccccagctgccagcagaaatggcatgtctgtggccggcaaccggcagagcgagccccggctggccagccacgtggccgctgacacagcccagccccggcccaccggggagaagggcggcaacatcatggccagtgaccggctggagaggaccaaccagctgaagatcgtggagatctctgctgaggccgtgtctgagaccgtgtgtggcaacaagccagctgagagtgacagaagaggaggctgcctggcccagggcaactgccaggagaagtctgagatccggctgtaccggcaggtggccgagagcagcaccagccaccccagcagcctgcccagccacgccagccaggccgagcaggagatgagccgctccttctccatggccaagctggccagcagcagcagcagcctgcagacagccatcaggaaggccgagtacagccagggcaagagcagcctgatgtctgacagcagaggagtgcccaggaacagcatccctgggggccccagcggggaggaccacctgtacttcacccccaggcctgccaccaggacctacagcatgcctgcccagttcagcagccacttcggccgggagggccaccccccccacagcctgggccgcagccgggacagccaggtgcctgtgaccagctctgtggtgcctgaggccaaggccagcagaggaggcctgcccagcctggccaacggccagggcatctacagcgtgaagcccctgctggacaccagcaggaacctgcctgccacagatgaaggagacatcatctctgtgcaggagaccagctgcctggtgacagacaagatcaaggtgaccaggaggcactactgctatgagcagaactggccccatgagagcaccagcttcttctctgtgaagcagaggatcaagagctttgagaacctggccaatgctgacaggcctgtggccaagagcggggccagccccttcctgtctgtgagcagcaagccacccatcggccgccgcagcagcggcagcatcgtgtctggcagcctgggccaccctggagatgctgctgcccggctgctgcggcgcagcctgagcagctgcagcgagaaccagagcgaggccggcaccctgctgccccagatggccaagagccccagcatcatgaccctgaccatcagccggcagaaccccccagagaccagcagcaaaggaagtgacagcgagctgaagaagagcctgggccccctgggcatccccacccccaccatgaccctggccagccctgtgaagaggaacaagagctctgtgcgccacacccagcccagccctgtgagccgcagcaagctgcaggagctgcgggccctgtccatgccagacctggacaagctgtgcagcgaggactacagcgctggccccagcgctgtgctcttcaagacagagctggagatcaccccccggcgcagccctggccccccagctggaggagtgtcctgcccagagaagggcggcaacagagcctgccctgggggcagcggccccaagaccagcgctgctgagacccccagcagcgccagtgacacaggagaggccgcccaggacctgcccttcagaagatcctggagcgtgaacctggaccagctgctggtgtctgctggggaccagcagaggctgcagagcgtgctgagctctgtgggcagcaagagcaccatcctgaccctcatccaggaggccaaggcccagagtgaaaatgaagaagatgtgtgcttcatcgtgctgaacaggaaggagggcagcggcctgggcttctctgtggccggcggcacagatgtggagcccaagagcatcaccgtgcacagggtcttcagccagggcgccgccagccaggagggcaccatgaacagaggagacttcctgctgtctgtgaatggagccagcctggccggcctggcccatggaaatgtgctgaaggtgctgcaccaggcccagctgcacaaggatgccctggtggtgatcaagaagggcatggaccagccccggcccagcgcccggcaggagcccccaacagccaacgggaagggcctgctgagcaggaagaccatccccctggagcccggcatcggccgctctgtggccgtgcatgatgccctgtgtgtggaggtgctgaagaccagcgctggcctgggcctgagcctggatggcggcaagagctctgtgactggagatggccccctggtgatcaagagggtgtacaagggcggcgctgctgagcaggccggcatcattgaagctggagatgagatcctggccatcaatggcaagcccctggtgggcctgatgcactttgatgcctggaacatcatgaagtctgtgcctgagggccctgtgcagctgctgatcaggaagcacaggaacagcagctag

SEQ ID NO: 163422 - DNA, 8520 bp, Artificial Sequence; identical to SEQ ID NO: 163420
  Description of Artificial Sequence: Synthetic coding sequence

SEQ ID NO: 163423 - DNA, 45 bp, Artificial Sequence
  Description of Artificial Sequence: Synthetic coding sequence
atgcccatcacccaggacaatgctgtgctgcacctgcccctgtag

SEQ ID NO: 163424 - DNA, 1476 bp, Artificial Sequence
  Description of Artificial Sequence: Synthetic coding sequence
atggagaaggctgctgacctgcaggacacagccagcctgaccctgaagttcaagttcaaccccaagctgggcatcgacaaccctgtgctgagcctggccgaggaccatgacccctatgacccctggagcctggagcggccccgcttctgcctgctgagcaaggaggagggcaagagctttggcttccacctgcagcaggagctgggccgggccggccacgtggtgtgccgggtggaccccggcaccagcgcccagaggcagggcctgcaggagggggaccgcatcctggccgtgaacaatgatgtggtggagcacgaggactatgctgtggtggtgcggcgcatccgggccagcagcccccgggtgctgctgactgtgctggcccggcatgcccatgatgtggcccgggcccagctgggagaagatgcccacctgtgccccaccctgggccctggggtgcggccccggctgtgccacatcgtgaaggatgaaggaggcttcggcttctctgtgacccacggcaaccagggccccttctggctggtgctgagcactggaggagctgctgagcgggccggcgtgcccccaggggcccggctgctggaggtgaatggcctgtggcagagcggccagcaggtgaccctgctggtggccggccctgaggtggaggagcagtgccggcagctgggcctgcccctggccgcccccctggccgagggctgggccctgcccaccaagccccgctgcctgcacctggagaagggcccccagggcttcggcttcctgctgcgggaggagaagggcctggatggccggcccggccagttcctgtgggaggtggaccccggcctgcctgccaagaaggccggcatgcaggccggggaccggctggtggccgtggccggggagagcgtggagggcctgggccacgaggagaccgtgagccgcatccagggccagggcagctgtgtgtccctgactgtggtggaccctgaggccgaccgcttcttctccatggtgcggctgagccccctgctcttcctggagaacacagaggccccagccagcccccggggcagcagcagcgccagcctggtggagacagaggaccccagcctggaggacacctctgtgcccagcgtgcccctgggcagccggcagtgcttcctgtacccaggccctgggggcagctatggcttccggctgagctgtgtggccagcggccccaggctcttcatcagccaggtgacccctgggggcagcgctgcccgggccggcctgcaggtgggagatgtgatcctggaggtgaatggctaccctgtgggcggccagaatgacctggagcggctgcagcagctgcctgaggccgagccccccctgtgcctgaagctggccgcccggagcctgcggggcctggaggcctggatccccccaggagctgctgaggactgggccctggccagtgacctgctgtag

SEQ ID NO: 163425 - DNA, 1518 bp, Artificial Sequence
  Description of Artificial Sequence: Synthetic coding sequence
atggagaaggctgctgacctgcaggacacagccagcctgaccctgaagttcaagttcaaccccaagctgggcatcgacaaccctgtgctgagcctggccgaggaccatgacccctatgacccctggagcctggagcggccccgcttctgcctgctgagcaaggaggagggcaagagctttggcttccacctgcagcaggagctgggccgggccggccacgtggtgtgccgggtggaccccggcaccagcgcccagaggcagggcctgcaggagggggaccgcatcctggccgtgaacaatgatgtggtggagcacgaggactatgctgtggtggtgcggcgcatccgggccagcagcccccgggtgctgctgactgtgctggcccggcatgcccatgatgtggcccgggcccagctgggagaagatgcccacctgtgccccaccctgggccctggggtgcggccccggctgtgccacatcgtgaaggatgaaggaggcttcggcttctctgtgacccacggcaaccagggccccttctggctggtgctgagcactggaggagctgctgagcgggccggcgtgcccccaggggcccggctgctggaggtgaatggagtgtctgtggagaagttcacccacaaccagctgaccaggaagctgtggcagagcggccagcaggtgaccctgctggtggccggccctgaggtggaggagcagtgccggcagctgggcctgcccctggccgcccccctggccgagggctgggccctgcccaccaagccccgctgcctgcacctggagaagggcccccagggcttcggcttcctgctgcgggaggagaagggcctggatggccggcccggccagttcctgtgggaggtggaccccggcctgcctgccaagaaggccggcatgcaggccggggaccggctggtggccgtggccggggagagcgtggagggcctgggccacgaggagaccgtgagccgcatccagggccagggcagctgtgtgtccctgactgtggtggaccctgaggccgaccgcttcttctccatggtgcggctgagccccctgctcttcctggagaacacagaggccccagccagcccccggggcagcagcagcgccagcctggtggagacagaggaccccagcctggaggacacctctgtgcccagcgtgcccctgggcagccggcagtgcttcctgtacccaggccctgggggcagctatggcttccggctgagctgtgtggccagcggccccaggctcttcatcagccaggtgacccctgggggcagcgctgcccgggccggcctgcaggtgggagatgtgatcctggaggtgaatggctaccctgtgggcggccagaatgacctggagcggctgcagcagctgcctgaggccgagccccccctgtgcctgaagctggccgcccggagcctgcggggcctggaggcctggatccccccaggagctgctgaggactgggccctggccagtgacctgctgtag

SEQ ID NO: 163426 - DNA, 1716 bp, Artificial Sequence
  Description of Artificial Sequence: Synthetic coding sequence
atggtgacccccagccccccaggcaaccacagcctgagcctggaggccccccggctgcacacagccagtgacctgctgggcaaccacagcctgggcctgcccctcatcacagccctggtgggcagccgggacagaagaggccgggtcttcagccctgtgcctgtgcccctgcccaccaaccccaccacccagcaccccacccggcagaagctgcccagcaccctgagcggccaccgggtgtgccaggcccacggggagcctgtgctgggcctgtgccccctgctgcccctcttctgctgccccccccaccccccagacccctggagcctggagcggccccgcttctgcctgctgagcaaggaggagggcaagagctttggcttccacctgcagcaggagctgggccgggccggccacgtggtgtgccgggtggaccccggcaccagcgcccagaggcagggcctgcaggagggggaccgcatcctggccgtgaacaatgatgtggtggagcacgaggactatgctgtggtggtgcggcgcatccgggccagcagcccccgggtgctgctgactgtgctggcccggcatgcccatgatgtggcccgggcccagctgggagaagatgcccacctgtgccccaccctgggccctggggtgcggccccggctgtgccacatcgtgaaggatgaaggaggcttcggcttctctgtgacccacggcaaccagggccccttctggctggtgctgagcactggaggagctgctgagcgggccggcgtgcccccaggggcccggctgctggaggtgaatggagtgtctgtggagaagttcacccacaaccagctgaccaggaagctgtggcagagcggccagcaggtgaccctgctggtggccggccctgaggtggaggagcagtgccggcagctgggcctgcccctggccgcccccctggccgagggctgggccctgcccaccaagccccgctgcctgcacctggagaagggcccccagggcttcggcttcctgctgcgggaggagaagggcctggatggccggcccggccagttcctgtgggaggtggaccccggcctgcctgccaagaaggccggcatgcaggccggggaccggctggtggccgtggccggggagagcgtggagggcctgggccacgaggagaccgtgagccgcatccagggccagggcagctgtgtgtccctgactgtggtggaccctgaggccgaccgcttcttctccatggtgcggctgagccccctgctcttcctggagaacacagaggccccagccagcccccggggcagcagcagcgccagcctggtggagacagaggaccccagcctggaggacacctctgtgcccagcgtgcccctgggcagccggcagtgcttcctgtacccaggccctgggggcagctatggcttccggctgagctgtgtggccagcggccccaggctcttcatcagccaggtgacccctgggggcagcgctgcccgggccggcctgcaggtgggagatgtgatcctggaggtgaatggctaccctgtgggcggccagaatgacctggagcggctgcagcagctgcctgaggccgagccccccctgtgcctgaagctggccgcccggagcctgcggggcctggaggcctggatccccccaggagctgctgaggactgggccctggccagtgacctgctgtag

SEQ ID NO: 163427 - DNA, 1518 bp, Artificial Sequence
  Description of Artificial Sequence: Synthetic coding sequence
atggaggaggccctggacctgcaggacacagccagcctgaccctgaagttcaagttcaaccccaagctgggcatcgacaaccctgtgctgagcctggccgaggaccatgacccctatgacccctggagcctggagcggccccgcttctgcctgctgagcaaggaggagggcaagagctttggcttccacctgcagcaggagctgggccgggccggccacgtggtgtgccgggtggaccccggcaccagcgcccagaggcagggcctgcaggagggggaccgcatcctggccgtgaacaatgatgtggtggagcacgaggactatgctgtggtggtgcggcgcatccgggccagcagcccccgggtgctgctgactgtgctggcccggcatgcccatgatgtggcccgggcccagctgggagaagatgcccacctgtgccccaccctgggccctggggtgcggccccggctgtgccacatcgtgaaggatgaaggaggcttcggcttctctgtgacccacggcaaccagggccccttctggctggtgctgagcactggaggagctgctgagcgggccggcgtgcccccaggggcccggctgctggaggtgaatggagtgtctgtggagaagttcacccacaaccagctgaccaggaagctgtggcagagcggccagcaggtgaccctgctggtggccggccctgaggtggaggagcagtgccggcagctgggcctgcccctggccgcccccctggccgagggctgggccctgcccaccaagccccgctgcctgcacctggagaagggcccccagggcttcggcttcctgctgcgggaggagaagggcctggatggccggcccggccagttcctgtgggaggtggaccccggcctgcctgccaagaaggccggcatgcaggccggggaccggctggtggccgtggccggggagagcgtggagggcctgggccacgaggagaccgtgagccgcatccagggccagggcagctgtgtgtccctgactgtggtggaccctgaggccgaccgcttcttctccatggtgcggctgagccccctgctcttcctggagaacacagaggccccagccagcccccggggcagcagcagcgccagcctggtggagacagaggaccccagcctggaggacacctctgtgcccagcgtgcccctgggcagccggcagtgcttcctgtacccaggccctgggggcagctatggcttccggctgagctgtgtggccagcggccccaggctcttcatcagccaggtgacccctgggggcagcgctgcccgggccggcctgcaggtgggagatgtgatcctggaggtgaatggctaccctgtgggcggccagaatgacctggagcggctgcagcagctgcctgaggccgagccccccctgtgcctgaagctggccgcccggagcctgcggggcctggaggcctggatccccccaggagctgctgaggactgggccctggccagtgacctgctgtag

SEQ ID NO: 163428 - DNA, 1716 bp, Artificial Sequence; identical to SEQ ID NO: 163426
  Description of Artificial Sequence: Synthetic coding sequence

SEQ ID NO: 163429 - DNA, 2310 bp, Artificial Sequence
  Description of Artificial Sequence: Synthetic coding sequence
atgggctgcaacatgtgtgtggtgcagaagccagaggagcagtacaaggtgatgctgcaggtgaatggcaaggagctgagcaagctgagccaggagcagaccctgcaggccctgcggagcagcaaggagcccctggtgatccaggtgctgcggcgcagcccccggctgcggggggacagcagctgccacgacctgcagctggtggacagcggcacccagacagacatcacctttgagcacatcatggccctgggcaagctgcggccccccaccccacccatggtgatcctggagcccccacccatcagccatgagtactatgaccctgctgagttcatggagggcggcccccaggaggccgaccggctggatgagctggagtatgaggaggtggagctgtacaagagcagccaccgggacaagctgggcctgatggtgtgctacagaacagatgatgaggaggacctgggcatctacgtgggggaggtgaaccccaacagcattgctgccaaggatggccgcatccgggagggggaccgcatcatccagatcaatggagtggatgtgcagaaccgggaggaggccgtggccatcctgagccaggaggagaacaccaacatcagcctgctggtggcccggcctgagagccagctggccaagcgctggaaggacagcgacagagatgacttcctggatgactttggaagtgaaaatgaaggagagctgcgggccaggaagctgaagagccccccagcccagcagcctggaaatgaggaggagaagggggccccagatgctggccctggcctgagcaacagccaggagctggacagcggcgtgggccgcacagatgagagcaccagaaatgaggagagcagcgagcatgacctgctgggagatgagccccccagcagcaccaacaccccaggcagcctgaggaagtttggcctgcagggagatgccctgcagagccgggacttccacttctccatggacagcctgctggccgagggcgccggcctgggcggcggagatgtgcccggcctgacagatgaggagtatgaaagataccgggagctgctggagatcaagtgccacctggagaatggaaaccagctgggcctgctcttcccccgggccagcggcggcaacagcgccctggatgtgaacagaaatgaaagcctgggccacgagatggccatgctggaggaggagctgcggcacctggagttcaagtgcaggaacatcctgcgggcccagaagatgcagcagctgcgggagcgctgcatgaaggcctggctgctggaggaggagagcctgtatgacctggccgccagcgagcccaagaagcatgagctgagtgacatcagcgagctgcctgagaagagtgacaaggacagcaccagcgcctacaacacaggagagagctgccgcagcacccccctgctggtggagcccctgcctgagagccccctgcggcgggccatggccggcaacagcaacctgaacagaacacctcctggccctgctgtggccaccccagccaaggccgcccctcctcctggcagccctgccaagttccgcagcctgagccgggaccctgaggccggccggcggcagcacgccgaggagcggggcagaagaaaccccaagacaggcctgaccctggagcgggtgggccctgagagcagcccctacctgagcagaagacaccggggccagggccaggagggggagcactaccacagctgtgtgcagctggcccccacccggggcctggaggagctgggccacggccccctgagcctggccggcggcccccgggtgggcggcgtggccgctgctgccacagaggcccccaggatggagtggaaggtgaaggtgcggagtgatggcaccaggtatgtggccaagaggcctgtgcgggaccggctgctgaaggcccgggccctgaagatccgggaggagaggagcggcatgaccacagatgatgatgctgtgtctgagatgaagatgggccgctactggagcaaggaggagaggaagcagcacctgatccgggcccgggagcagaggaagaggcgggagttcatgatgcagagccggctggagtgcctgcgggagcagcagaatggagacagcaagccagagctgaacatcatcgccctgagccacaggaagaccatgaagaagaggaacaagaagatcctggacaactggatcaccatccaggagatgctggcccatggagcccggtctgcagatggcaagagggtgtacaaccccctgctgtctgtgaccaccgtgtag

SEQ ID NO: 163430 - DNA, 2085 bp, Artificial Sequence
  Description of Artificial Sequence: Synthetic coding sequence
atggccctgggcaagctgcggccccccaccccacccatggtgatcctggagccctacgtgctgtctgagctgccccccatcagccatgagtactatgaccctgctgagttcatggagggcggcccccaggaggccgaccggctggatgagctggagtatgaggaggtggagctgtacaagagcagccaccgggacaagctgggcctgatggtgtgctacagaacagatgatgaggaggacctgggcatctacgtgggggaggtgaaccccaacagcattgctgccaaggatggccgcatccgggagggggaccgcatcatccagatcaacggggtggatgtgcagaaccgggaggaggccgtggccatcctgagccaggaggagaacaccaacatcagcctgctggtggcccggcctgagagccagctggccaagcgctggaaggacagcgacagagatgacttcctggatgactttggaagtgaaaatgaaggagagctgcgggccaggaagctgaagagccccccagcccagcagcctggaaatgaggaggagaagggggccccagatgctggccctggcctgagcaacagccaggagctggacagcggcgtgggccgcacagatgagagcaccagaaatgaggagagcagcgagcatgacctgctgggagatgagccccccagcagcaccaacaccccaggcagcctgaggaagtttggcctgcagggagatgccctgcagagccgggacttccacttctccatggacagcctgctggccgagggcgccggcctgggcggcggagatgtgcccggcctgacagatgaggagtatgagcgctaccgggagctgctggagatcaagtgccacctggagaatggaaaccagctgggcctgctcttcccccgggccagcggcggcaacagcgccctggatgtgaacagaaatgaaagcctgggccacgagatggccatgctggaggaggagctgcggcacctggagttcaagtgcaggaacatcctgcgggcccagaagatgcagcagctgcgggagcgctgcatgaaggcctggctgctggaggaggagagcctgtatgacctggccgccagcgagcccaagaagcatgagctgagtgacatcagcgagctgcctgagaagagtgacaaggacagcaccagcgcctacaacacaggagagagctgccgcagcacccccctgctggtggagcccctgcctgagagccccctgcggcgggccatggccggcaacagcaacctgaacagaacacctcctggccctgctgtggccaccccagccaaggccgcccctcctcctggcagccctgccaagttccgcagcctgagccgggaccctgaggccggccggcggcagcacgccgaggagcggggcagaagaaaccccaagacaggcctgaccctggagcgggtgggccctgagagcagcccctacctgagccgccgccaccggggccagggccaggagggggagcactaccacagctgtgtgcagctggcccccacccggggcctggaggagctgggccacggccccctgagcctggccggcggcccccgggtgggcggcgtggccgccgccgccacagaggcccccaggatggagtggaaggtgaaggtgcggagtgatggcacccgctacgtggccaagaggcctgtgcgggaccggctgctgaaggcccgggccctgaagatccgggaggagaggagcggcatgaccacagatgatgatgctgtgtctgagatgaagatgggccgctactggagcaaggaggagaggaagcagcacctgatccgggcccgggagcagaggaagagaagagagttcatgatgcagagccggctggagtgcctgcgggagcagcagaatggagacagcaagccagagctgaacatcatcgccctgagccacaggaagaccatgaagaagaggaacaagaagatcctggacaactggatcaccatccaggagatgctggcccacggggcccggtctgcagatggcaagagggtgtacaaccccctgctgtctgtgaccaccgtgtag

SEQ ID NO: 163431 - DNA, 2022 bp, Artificial Sequence
  Description of Artificial Sequence: Synthetic coding sequence
atgacagccccacccatcagccatgagtactatgaccctgctgagttcatggagggcggcccccaggaggccgaccggctggatgagctggagtatgaggaggtggagctgtacaagagcagccaccgggacaagctgggcctgatggtgtgctacagaacagatgatgaggaggacctgggcatctacgtgggggaggtgaaccccaacagcattgctgccaaggatggccgcatccgggagggggaccgcatcatccagatcaatggagtggatgtgcagaaccgggaggaggccgtggccatcctgagccaggaggagaacaccaacatcagcctgctggtggcccggcctgagagccagctggccaagcgctggaaggacagcgacagagatgacttcctggatgactttggaagtgaaaatgaaggagagctgcgggccaggaagctgaagagccccccagcccagcagcctggaaatgaggaggagaagggggccccagatgctggccctggcctgagcaacagccaggagctggacagcggcgtgggccgcacagatgagagcaccagaaatgaggagagcagcgagcatgacctgctgggagatgagccccccagcagcaccaacaccccaggcagcctgaggaagtttggcctgcagggagatgccctgcagagccgggacttccacttctccatggacagcctgctggccgagggcgccggcctgggcggcggagatgtgcccggcctgacagatgaggagtatgaaagataccgggagctgctggagatcaagtgccacctggagaatggaaaccagctgggcctgctcttcccccgggccagcggcggcaacagcgccctggatgtgaacagaaatgaaagcctgggccacgagatggccatgctggaggaggagctgcggcacctggagttcaagtgcaggaacatcctgcgggcccagaagatgcagcagctgcgggagcgctgcatgaaggcctggctgctggaggaggagagcctgtatgacctggccgccagcgagcccaagaagcatgagctgagtgacatcagcgagctgcctgagaagagtgacaaggacagcaccagcgcctacaacacaggagagagctgccgcagcacccccctgctggtggagcccctgcctgagagccccctgcggcgggccatggccggcaacagcaacctgaacagaacacctcctggccctgctgtggccaccccagccaaggccgcccctcctcctggcagccctgccaagttccgcagcctgagccgggaccctgaggccggccggcggcagcacgccgaggagcggggcagaagaaaccccaagacaggcctgaccctggagcgggtgggccctgagagcagcccctacctgagcagaagacaccggggccagggccaggagggggagcactaccacagctgtgtgcagctggcccccacccggggcctggaggagctgggccacggccccctgagcctggccggcggcccccgggtgggcggcgtggccgctgctgccacagaggcccccaggatggagtggaaggtgaaggtgcggagtgatggcaccaggtatgtggccaagaggcctgtgcgggaccggctgctgaaggcccgggccctgaagatccgggaggagaggagcggcatgaccacagatgatgatgctgtgtctgagatgaagatgggccgctactggagcaaggaggagaggaagcagcacctgatccgggcccgggagcagaggaagaggcgggagttcatgatgcagagccggctggagtgcctgcgggagcagcagaatggagacagcaagccagagctgaacatcatcgccctgagccacaggaagaccatgaagaagaggaacaagaagatcctggacaactggatcaccatccaggagatgctggcccatggagcccggtctgcagatggcaagagggtgtacaaccccctgctgtctgtgaccaccgtgtag

SEQ ID NO: 163432 - DNA, 1983 bp, Artificial Sequence
  Description of Artificial Sequence: Synthetic coding sequence
atgggctgcaacatgtgtgtggtgcagaagccagaggagcagtacaaggtgatgctgcaggaggtggagctgtacaagagcagccaccgggacaagctgggcctgatggtgtgctacagaacagatgatgaggaggacctgggcatctacgtgggggaggtgaaccccaacagcattgctgccaaggatggccgcatccgggagggggaccgcatcatccagatcaacggggtggatgtgcagaaccgggaggaggccgtggccatcctgagccaggaggagaacaccaacatcagcctgctggtggcccggcctgagagccagctggccaagcgctggaaggacagcgacagagatgacttcctggatgactttggaagtgaaaatgaaggagagctgcgggccaggaagctgaagagccccccagcccagcagcctggaaatgaggaggagaagggggccccagatgctggccctggcctgagcaacagccaggagctggacagcggcgtgggccgcacagatgagagcaccagaaatgaggagagcagcgagcatgacctgctgggagatgagccccccagcagcaccaacaccccaggcagcctgaggaagtttggcctgcagggagatgccctgcagagccgggacttccacttctccatggacagcctgctggccgagggcgccggcctgggcggcggagatgtgcccggcctgacagatgaggagtatgagcgctaccgggagctgctggagatcaagtgccacctggagaatggaaaccagctgggcctgctcttcccccgggccagcggcggcaacagcgccctggatgtgaacagaaatgaaagcctgggccacgagatggccatgctggaggaggagctgcggcacctggagttcaagtgcaggaacatcctgcgggcccagaagatgcagcagctgcgggagcgctgcatgaaggcctggctgctggaggaggagagcctgtatgacctggccgccagcgagcccaagaagcatgagctgagtgacatcagcgagctgcctgagaagagtgacaaggacagcaccagcgcctacaacacaggagagagctgccgcagcacccccctgctggtggagcccctgcctgagagccccctgcggcgggccatggccggcaacagcaacctgaacagaacacctcctggccctgctgtggccaccccagccaaggccgcccctcctcctggcagccctgccaagttccgcagcctgagccgggaccctgaggccggccggcggcagcacgccgaggagcggggcagaagaaaccccaagacaggcctgaccctggagcgggtgggccctgagagcagcccctacctgagccgccgccaccggggccagggccaggagggggagcactaccacagctgtgtgcagctggcccccacccggggcctggaggagctgggccacggccccctgagcctggccggcggcccccgggtgggcggcgtggccgccgccgccacagaggcccccaggatggagtggaaggtgaaggtgcggagtgatggcacccgctacgtggccaagaggcctgtgcgggaccggctgctgaaggcccgggccctgaagatccgggaggagaggagcggcatgaccacagatgatgatgctgtgtctgagatgaagatgggccgctactggagcaaggaggagaggaagcagcacctgatccgggcccgggagcagaggaagagaagagagttcatgatgcagagccggctggagtgcctgcgggagcagcagaatggagacagcaagccagagctgaacatcatcgccctgagccacaggaagaccatgaagaagaggaacaagaagatcctggacaactggatcaccatccaggagatgctggcccacggggcccggtctgcagatggcaagagggtgtacaaccccctgctgtctgtgaccaccgtgtag

SEQ ID NO: 163433 - DNA, 1554 bp, Artificial Sequence
  Description of Artificial Sequence: Synthetic coding sequence
atggcccagggctttgctgtgggctttgaccccctgggcctgggggacctgagcagcggcagcctgagcagcctgagcagccggggccacctgggcagtgacagcggcagcacagccacccgctacctgctgaggaagcagcagaggctgctgaatggccccccccggggcatccgggccagcagccccatgggccgggtcatcctgatcaacagccccatcgaggccaacagtgatgaaagtgacatcatccacagcgtgcgggtggagaagagccctgctggccgcctgggcttctctgtgcggggcggcagcgagcacggcctgggcatctttgtgtccaaggtggaggagggcagcagcgctgagagagctggcctgtgtgtgggggacaagatcacagaggtgaatggcctgagcctggagagcaccaccatgggcagcgctgtgaaggtgctgaccagcagcagccggctgcacatgatggtgcggaggatgggccgggtgcccggcatcaagttcagcaaggagaagaccacctgggtggatgtggtgaacagaaggctggtggtggagaagtgtggcagcacccccagcgacaccagcagtgaagatggagtgcggcgcatcgtgcacctgtacaccaccagtgatgacttctgcctgggcttcaacatccggggcggcaaggagtttggcctgggcatctacgtgtccaaggtggaccatggaggcctggccgaggagaatggcatcaaggtgggggaccaggtgctggccgccaacggggtgcgctttgatgacatcagccacagccaggccgtggaggtgctgaagggccagacccacatcatgctgaccatcaaggagaccggccgctacccagcctacaaggagatggtgtctgagtactgctggctggaccggctgagcaatggagtgctgcagcagctgagccctgccagcgagagcagcagctctgtgagcagctgtgccagcagcgccccctacagcagcggcagcctgcccagcgacaggatggacatctgcctgggccaggaggagcccggcagccggggccctggctggggccgggctgacacagccatgcagacagagccagatgctgggggccgggtggagacctggtgcagcgtgcggcccaccgtcatcctgcgggacacagccatccgcagtgatggcccccaccctggccggcggctggacagcgccctgtctgagagccccaagacagccctgctgctggccctgagccggcccaggcctcccatcaccaggagccagagctacctgaccctgtgggaggagaagcagcagaggaagaaggagaagagcggcagccctggagagaagggggccctgcagaggagcaagaccctgatgaacctcttcttcaagggcggccggcagggccgcctggccagagatggaagaagagaggcctggaccctggacagcggcagcctggccaagacctacccccggctggacatcgagaaggagatgggcgtgagcccctgctgccccggctag

SEQ ID NO: 163434 - DNA, 3102 bp, Artificial Sequence
  Description of Artificial Sequence: Synthetic coding sequence
atggcccagggctttgctgtgggctttgaccccctgggcctgggggacctgagcagcggcagcctgagcagcctgagcagccggggccacctgggcagtgacagcggcagcacagccacccgctacctgctgaggaagcagcagaggctgctgaatggccccccccggggcatccgggccagcagccccatgggccgggtcatcctgatcaacagccccatcgaggccaacagtgatgaaagtgacatcatccacagcgtgcgggtggagaagagccctgctggccgcctgggcttctctgtgcggggcggcagcgagcacggcctgggcatctttgtgtccaaggtggaggagggcagcagcgctgagagagctggcctgtgtgtgggggacaagatcacagaggtgaatggcctgagcctggagagcaccaccatgggcagcgctgtgaaggtgctgaccagcagcagccggctgcacatgatggtgcggaggatgggccgggtgcccggcatcaagttcagcaaggagaagaccacctgggtggatgtggtgaacagaaggctggtggtggagaagtgtggcagcacccccagcgacaccagcagtgaagatggagtgcggcgcatcgtgcacctgtacaccaccagtgatgacttctgcctgggcttcaacatccggggcggcaaggagtttggcctgggcatctacgtgtccaaggtggaccatggaggcctggccgaggagaatggcatcaaggtgggggaccaggtgctggccgccaacggggtgcgctttgatgacatcagccacagccaggccgtggaggtgctgaagggccagacccacatcatgctgaccatcaaggagaccggccgctacccagcctacaaggagatggtgtctgagtactgctggctggaccggctgagcaatggagtgctgcagcagctgagccctgccagcgagagcagcagctctgtgagcagctgtgccagcagcgccccctacagcagcggcagcctgcccagcgacaggatggacatctgcctgggccaggaggagcccggcagccggggccctggctggggccgggctgacacagccatgcagacagagccagatgctgggggccgggtggagacctggtgcagcgtgcggcccaccgtcatcctgcgggacacagccatccgcagtgatggcccccaccctggccggcggctggacagcgccctgtctgagagccccaagacagccctgctgctggccctgagccggcccaggcctcccatcaccaggagccagagctacctgaccctgtgggaggagaagcagcagaggaagaaggagaagagcggcagccctggagagaagggggccctgcagaggagcaagaccctgatgaacctcttcttcaagggcggccggcagggccgcctggccagagatggaagaagagaggcctggaccctggacagcggcagcctggccaagacctacccccggctggacatcgagaaggccggcggcgtgggccctgtgcagaagtttgtgacctggaggctgcggcgggaccaggagcggggccgggccctgctgagcgcccggagcggcagccccagcagccagctgcccaacgtggatgagcaggtgcaggcctgggagagcagaagacccctcatccaggacctggcccagaggctgctgacagatgatgaggtgctggccgtgaccaggcactgcagccgctacgtgcatgagggcggcatcgaggacctggtgcggcccctgctggccatcctggacaggcctgagaagctgctgctgctgcaggacatccgctctgtggtggcccccacagacctgggccgctttgacagcatggtgatgctggtggagctggaggcctttgaggccctgaagagcagagctgtgcggcccccagccctgcggcctgcccggcaggacaccccacccaagaggcacctgatcacccctgtgcctgacagccggggcggcttctacctgctgcctgtgaatggcttccctgaggaggaggacaacggggagctgcgggagcggctgggcgccctgaaggtgagccccagcgccagcgcccccaggcacccccacaagggcatcccccccctgcaggatgtgcctgtggatgccttcacccccctgcgcatcgcctgcaccccaccaccccagctgccccctgtggccccccggcccctgcggcccaactggctgctgacagagcccctgagccgggagcaccccccccagagccagatccggggccgggcccagagccgcagccgcagccgcagccgcagccgcagccgcagcagccggggccagggcaagagccctggccgccgcagccccagccctgtgcccaccccagcccccagcatgaccaacggccgctaccacaagcccaggaaggcccggccccccctgccccggcccctggatggagaggccgccaaggtgggcgccaagcagggccccagcgagagcggcacagagggcacagccaaggaggccgccatgaagaaccccagcggggagctgaagacagtgaccctgagcaagatgaagcagagcctgggcatcagcatcagcggcggcatcgagagcaaggtgcagcccatggtgaagattgagaagatcttccctggaggagctgccttcctgagcggggccctgcaggccggctttgagctggtggccgtggatggagagaacctggagcaggtgacccaccagagagctgtggacaccatccggcgggcctacagaaacaaggcccgggagcccatggagctggtggtgcgggtgcccggccccagcccccggcccagccccagcgacagcagcgccctgacagatggcggcctgcctgctgaccacctgcctgcccaccagcccctggatgctgcccctgtgcctgcccactggctgcctgagccccccaccaacccccagaccccacccacagatgcccggctgctgcagcccacccccagccctgcccccagccctgccctgcagaccccagacagcaagccagcccccagcccccgcatcccctag

SEQ ID NO: 163435 - DNA, 627 bp, Artificial Sequence
  Description of Artificial Sequence: Synthetic coding sequence
tgaccccggccccccatcaccaggagccagagctacctgaccctgtgggaggagaagcagcagaggaagaaggagaagagcggcagccctggagagaagggggccctgcagaggagcaagaccctgatgaacctcttcttcaagggcggccggcagggccgcctggccagagatggccggcgggaggcctggaccctggacagcggcagcctggccaagacctacccccggctggacatcgagaaggccggcggcgtgggccctgtgcagaagtttgtgacctggaggctgcggcgggaccaggagcggggccgggccctgctgagcgcccggagcggcagccccagcagccagctgcccaacgtggatgagcaggtgcaggcctgggagagccggcggcccctcatccaggacctggcccagaggctgctgacagatgatgaggtgctggccgtgaccaggcactgcagccgctacgtgcatgaaggaggcatcgaggacctggtgcggcccctgctggccatcctggacaggcctgagaagctgctgctgctgcaggacatccgctctgtggtggcccccacagacctgggccgctttgacagcatggtgatgctggtggagtag

SEQ ID NO: 163436 - DNA, 3465 bp, Artificial Sequence
  Description of Artificial Sequence: Synthetic coding sequence
atgggcctgctgctgatgatcctggccagcgctgtgctgggcagcttcctgaccctgctggcccagttcttcctgctgtaccgccggcagcctgagcccccagcagatgaggccgcccgggccggggagggcttccgctacatcaagcctgtgcccggcctgctgctgcgggagtacctgtatggaggcggcagagatgaggagcccagcggggccgcccctgagggcggggccacccccacagctgcccctgagaccccagccccacccacccgggagacctgctacttcctgaatgccaccatcctcttcctgttccgggagctgcgggacacagccctgacccggcgctgggtgaccaagaagatcaaggtggagtttgaggagctgctgcagaccaagacagctggccgcctgctggagggcctgagcctgagagatgtgttcctgggggagaccgtgcccttcatcaagaccatccggctggtgcggcctgtggtgcccagcgccactggagagccagatggccctgagggggaggccctgcctgctgcctgcccagaggagctggcctttgaggccgaggtggagtacaatggaggcttccacctggccattgatgtggacctggtgtttgggaagagcgcctacctgtttgtgaagctgagccgggtggtgggccgcctgcggctggtgttcaccagggtgcccttcacccactggttcttctcctttgtggaggaccccctgattgactttgaggtgcgcagccagtttgagggccggcccatgccccagctgaccagcatcatcgtgaaccagctgaagaagatcatcaagaggaagcacaccctgcccaactacaagatccgcttcaagcccttcttcccctaccagaccctgcagggctttgaggaggatgaggagcacatccacatccagcagtgggccctgacagagggccgcctgaaggtgaccctgctggagtgcagccggctgctgatcttcggcagctatgaccgggaggccaacgtgcactgcaccctggagctgagcagctctgtgtgggaggagaagcagaggagcagcatcaagacagtggagctgatcaagggcaacctgcagagcgtgggcctgaccctgcggctggtgcagagcacagatggctacgccggccacgtgatcatcgagaccgtggcccccaacagccctgctgccatcgctgacctgcagagaggagaccggctgattgccatcggcggcgtgaagatcaccagcaccctgcaggtgctgaagctgatcaagcaggccggggacagagtgctggtgtactatgaaagacctgtgggccagagcaaccagggcgctgtgctgcaggacaactttggccagctggaggagaacttcctgagcagcagctgccagagcggctatgaggaggaggccgccggcctgactgtggacacagagagccgggagctggacagcgagtttgaggacctggccagtgatgtgcgggcccagaatgagttcaaggatgaggcccagagcctgagccacagccccaagagggtgcccaccaccctgagcatcaagcccctgggcgccatcagccctgtgctgaacaggaagctggccgtgggcagccaccccctgccccccaagatccagagcaaggatggcaacaagcccccacccctgaagaccagcgagatcacagatcctgcccaggtgtccaagcccacccagggcagcgccttcaagccccctgtgcccccccggccccaggccaaggtgcccctgcccagcgcagatgcccccaaccaggccgagccagatgtgctggtggagaagccagagaaggtggtgcccccacccctggtggacaagtctgctgagaagcaggccaagaatgtggatgccattgatgatgctgctgcccccaagcagttcctggccaagcaggaggtggccaaggatgtgaccagcgagaccagctgccccaccaaggacagcagtgatgaccggcagacctgggagagcagcgagatcctgtacagaaacaagctgggcaagtggaccaggacccgggccagctgcctgtttgacatcgaggcctgccaccgctacctgaacatcgccctgtggtgccgggaccccttcaagctgggcggcctcatctgcctgggccacgtgtccctgaagctggaggatgtggccctgggctgcctggccaccagcaacacagagtacctgagcaagctgcggctggaggcccccagccccaaggccatcgtgaccaggacagccctgaggaacctgtccatgcagaagggcttcaatgacaagttctgctacggggacatcaccatccacttcaagtacctgaaggagggggagagtgaccaccacgtggtgaccaacgtggagaaggagaaggagccccacctggtggaggaggtgtctgtgctgcccaaggaggagcagtttgtgggccagatgggcctgacagagaacaagcacagcttccaggacacccagttccagaaccccacctggtgtgactactgcaagaagaaggtgtggaccaaggccgccagccagtgcatgttctgtgcctacgtgtgccacaagaagtgccaggagaagtgcctggccgagacctctgtgtgtggggccacagacagaagaattgacaggaccctgaagaacctgcggctggagggccaggagaccctgctgggcctgcccccccgggtggatgctgaggccagcaagtctgtgaacaagaccaccggcctgaccaggcacatcatcaacaccagcagccggctgctgaacctgcggcaggtgtccaagacccggctgtctgagcctggaacagacctggtggagcccagccccaagcacacccccaacaccagtgacaatgaaggaagtgacacagaggtgtgtggccccaacagccccagcaagaggggcaacagcacaggcatcaagctggtgaggaaggagggcggcctggatgattctgtgttcatcgctgtgaaggagatcggccgggacctgtaccggggcctgcccacagaggagcgcatccagaagctggagttcatgctggacaagctgcagaatgaaattgaccaggagctggagcacaacaacagcctggtgcgggaggagaaggagaccacagacaccaggaagaagagcctgctgtctgctgccctggccaagagcggggagcggctgcaggccctgaccctgctgatgatccactaccgggccggcattgaagatattgagaccctggagagcctgagcctggaccagcacagcaagaagatcagcaagtacacagatgacacagaggaggacctggacaatgagatcagccagctgattgacagccagcccttcagcagcatcagtgatgacctgtttggccccagcgagagcgtgtag

SEQ ID NO: 163437 - DNA, 3201 bp, Artificial Sequence
  Description of Artificial Sequence: Synthetic coding sequence
atgggctttgagctggacagatttgatggagatgtggaccctgacctgaagtgtgccctgtgccacaaggtgctggaggaccccctgaccaccccctgtggccacgtgttctgtgccggctgtgtgctgccctgggtggtgcaggagggcagctgcccagcccgctgccggggccgcctgagcgccaaggagctgaaccacgtgctgcccctgaagaggctcatcctgaagctggacatcaagtgtgcctatgccacccggggctgcggccgggtggtgaagctgcagcagctgcctgagcacctggagcgctgtgactttgccccagcccgctgcagacatgctggctgcggccaggtgctgctgcggagagatgtggaggcccacatgagagatgcctgtgatgcccggcctgtgggccgctgccaggagggctgcggcctgcccctgacccacggggagcagagagctgggggccactgctgtgcccgggccctgcgggcccacaacggggccctgcaggcccggctgggcgccctgcacaaggccctgaagaaggaggccctgcgggccggcaagcgggagaagagcctggtggcccagctggccgccgcccagctggagctgcagatgacagccctgcgctaccagaagaagttcacagagtacagcgcccggctggacagcctgagccgctgtgtggccgcccctcctgggggcaaaggagaggagaccaagagcctgaccctggtgctgcaccgggacagcggcagcctgggcttcaacatcatcggcggccggcccagcgtggacaaccatgatggcagcagcagcgagggcatctttgtgtccaagatcgtggacagcggccctgctgccaaggagggcggcctgcagatccatgaccgcatcatcgaggtgaatggccgggacctgagccgggccacccatgaccaggccgtggaggccttcaagacagccaaggagcccatcgtggtgcaggtgctgcggaggacccccaggaccaagatgttcaccccaccttctgagagccagctggtggacaccggcacccagacagacatcacctttgagcacatcatggccctgaccaagatgagcagccccagcccccctgtgctggacccctacctgctgcctgaggagcaccccagcgcccacgagtactatgaccccaatgactacatcggggacatccaccaggagatggaccgggaggagctggagctggaggaggtggacctgtacaggatgaacagccaggacaagctgggcctgactgtgtgctacagaacagatgatgaagatgacatcggcatctacatcagcgagattgaccccaacagcattgctgccaaggatggccgcatccgggagggggaccgcatcatccagatcaatggcatcgaggtgcagaaccgggaggaggccgtggccctgctgaccagcgaggagaacaagaacttcagcctgctgattgcccggcctgagctgcagctggatgagggctggatggatgatgacagaaatgacttcctggatgacctgcacatggacatgctggaggagcagcaccaccaggccatgcagttcaccgcctctgtgctgcagcagaagaagcatgatgaagatggcggcaccacagacacagccaccatcctgagcaaccagcacgagaaggacagcggcgtgggccgcacagatgagagcaccagaaatgatgagagcagcgagcaggagaacaatggagatgatgccacagccagcagcaaccccctggccggccagaggaagctgacctgcagccaggacaccctgggcagcggggacctgcccttcagcaatgaaagcttcatctctgctgactgcacagatgctgactacctgggcatccctgtggatgaatgtgagcgcttccgggagctgctggagctgaagtgccaggtgaagagcgccaccccctacggcctgtactaccccagcggccccctggatgctgggaagagtgaccctgagagcgtggacaaggagctggagctgctgaatgaggagctgcggagcattgagctggagtgcctgagcatcgtgcgggcccacaagatgcagcagctgaaggagcagtaccgggagagctggatgctgcacaacagcggcttcaggaactacaacaccagcattgatgtgagaagacatgagctgagtgacatcacagagctgcctgagaagagtgacaaggacagcagcagcgcctacaacacaggagagagctgccgcagcacccccctgaccctggagatcagcccagacaacagcctgcggcgggctgctgagggcatcagctgccccagcagcgagggcgctgtgggcaccacagaggcctacggccctgccagcaagaacctgctgagcatcacagaagatcctgaggtgggcacccccacctacagccccagcctgaaggagctggaccccaaccagcccctggagagcaaggagcggcgggccagtgatggcagccgcagccccacccccagccagaagctgggcagcgcctacctgcccagctaccaccacagcccctacaagcacgcccacatcccagcccacgcccagcactaccagagctacatgcagctgatccagcagaagtctgctgtggagtatgcccagagccagatgagcctggtgtccatgtgcaaggacctgagcagccccaccccatctgagcccaggatggagtggaaggtgaagatccgcagtgatggcacccgctacatcaccaagaggcctgtgcgggaccggctgctgcgggagcgggccctgaagatccgggaggagaggagcggcatgaccacagatgatgatgctgtgtctgagatgaagatgggccgctactggagcaaggaggagaggaagcagcacctggtgaaggccaaggagcagaggagaagaagagagttcatgatgcagagccggctggactgcctgaaggagcagcaggccgcagatgacaggaaggagatgaacatcctggagctgagccacaagaagatgatgaagaagaggaacaagaagatctttgacaactggatgaccatccaggagctgctgacccacggcaccaagagcccagatggcaccagggtgtacaacagcttcctgtctgtgaccaccgtgtag

SEQ ID NO: 163438 - DNA, 2190 bp, Artificial Sequence
  Description of Artificial Sequence: Synthetic coding sequence
atgggctttgagctggacagatttgatggagatgtggaccctgacctgaagtgtgccctgtgccacaaggtgctggaggaccccctgaccaccccctgtggccacgtgttctgtgccggctgtgtgctgccctgggtggtgcaggagggcagctgcccagcccgctgccggggccgcctgagcgccaaggagctgaaccacgtgctgcccctgaagaggctcatcctgaagctggacatcaagtgtgcctatgccacccggggctgcggccgggtggtgaagctgcagcagctgcctgagcacctggagcgctgtgactttgccccagcccgctgcagacatgctggctgcggccaggtgctgctgcggagagatgtggaggcccacatgagagatgcctgtgatgcccggcctgtgggccgctgccaggagggctgcggcctgcccctgacccacggggagcagagagctgggggccactgctgtgcccgggccctgcgggcccacaacggggccctgcaggcccggctgggcgccctgcacaaggccctgaagaaggaggccctgcgggccggcaagcgggagaagagcctggtggcccagctggccgccgcccagctggagctgcagatgacagccctgcgctaccagaagaagttcacagagtacagcgcccggctggacagcctgagccgctgtgtggccgcccctcctgggggcaaaggagaggagaccaagagcctgaccctggtgctgcaccgggacagcggcagcctgggcttcaacatcatcggcggccggcccagcgtggacaaccatgatggcagcagcagcgagggcatctttgtgtccaagatcgtggacagcggccctgctgccaaggagggcggcctgcagatccatgaccgcatcatcgaggtgaatggccgggacctgagccgggccacccatgaccaggccgtggaggccttcaagacagccaaggagcccatcgtggtgcaggtgctgcggaggacccccaggaccaagatgttcaccccaccttctgagagccagctggtggacaccggcacccagacagacatcacctttgagcacatcatggccctgaccaagatgagcagccccagcccccctgtgctggacccctacctgctgcctgaggagcaccccagcgcccacgagtactatgaccccaatgactacatcggggacatccaccaggagatggaccgggaggagctggagctggaggaggtggacctgtacaggatgaacagccaggacaagctgggcctgactgtgtgctacagaacagatgatgaagatgacatcggcatctacatcagcgagattgaccccaacagcattgctgccaaggatggccgcatccgggagggggaccgcatcatccagatcaatggcatcgaggtgcagaaccgggaggaggccgtggccctgctgaccagcgaggagaacaagaacttcagcctgctgattgcccggcctgagctgcagctggatgagggctggatggatgatgacagaaatgacttcctggatgacctgcacatggacatgctggaggagcagcaccaccaggccatgcagttcaccgcctctgtgctgcagcagaagaagcatgatgaagatggcggcaccacagacacagccaccatcctgagcaaccagcacgagaaggacagcggcgtgggccgcacagatgagagcaccagaaatgatgagagcagcgagcaggagaacaatggagatgatgccacagccagcagcaaccccctggccggccagaggaagctgacctgcagccaggacaccctgggcagcggggacctgcccttcagcaatgaaagcttcatctctgctgactgcacagatgctgactacctgggcatccctgtggagggggaggacccccagaggagagatgccctgcaccaccaggaggcccgggccggccccccagctgctggggcccggcctgaggaccccggccgggcccagagacatgaccacagaagaagaagaggagagagagatgaagatggagccctgctggagcagggcggggaggaggccgcccctggagagggccagggcgctgctgctgctgcccgggtgcatgatgctgagcaggtgggcctgagccagggcgccgccagcagcaggtag

SEQ ID NO: 163439 - DNA, 2352 bp, Artificial Sequence
  Description of Artificial Sequence: Synthetic coding sequence
atgggctgcagcctgtgcagcctgcagaagcaggaggagcagtacaagctgctgtatgaggtgtgccaggtgaatggccgggacctgagccgggccacccatgaccaggccgtggaggccttcaagacagccaaggagcccatcgtggtgcaggtgctgcggaggacccccaggaccaagatgttcaccccacccagcgagagccagctggtggacaccggcacccagacagacatcacctttgagcacatcatggccctgaccaagatgagcagccccagcccccctgtgctggacccctacctgctgcctgaggagcaccccagcgcccacgagtactatgaccccaatgactacatcggggacatccaccaggagatggaccgggaggagctggagctggaggaggtggacctgtacaggatgaacagccaggacaagctgggcctgactgtgtgctacagaacagatgatgaagatgacatcggcatctacatcagcgagattgaccccaacagcattgctgccaaggatggccgcatccgggagggggaccgcatcatccagatcaatggaattgaggtgcagaaccgggaggaggccgtggccctgctgaccagcgaggagaacaagaacttcagcctgctgattgcccggcctgagctgcagctggatgagggctggatggatgatgacagaaatgacttcctggatgacctgcacatggacatgctggaggagcagcaccaccaggccatgcagttcaccgcctctgtgctgcagcagaagaagcatgatgaagatggcggcaccacagacacagccaccatcctgagcaaccagcacgagaaggacagcggcgtgggccgcacagatgagagcaccagaaatgatgagagcagcgagcaggagaacaatggagatgatgccacagccagcagcaaccccctggccggccagaggaagctgacctgcagccaggacaccctgggcagcggggacctgcccttcagcaatgaaagcttcatctctgctgactgcacagatgctgactacctgggcatccctgtggatgaatgtgagcgcttccgggagctgctggagctgaagtgccaggtgaagagcgccaccccctacggcctgtactaccccagcggccccctggatgctgggaagagtgaccctgagagcgtggacaaggagctggagctgctgaatgaggagctgcggagcattgagctggagtgcctgagcatcgtgcgggcccacaagatgcagcagctgaaggagcagtaccgggagagctggatgctgcacaacagcggcttcaggaactacaacaccagcattgatgtgagaagacatgagctgagtgacatcacagagctgcctgagaagagtgacaaggacagcagcagcgcctacaacacaggagagagctgccgcagcacccccctgaccctggagatcagcccagacaacagcctgcggcgggctgctgagggcatcagctgccccagcagcgagggcgctgtgggcaccacagaggcctacggccctgccagcaagaacctgctgagcatcacagaggaccctgaggtgggcacccccacctacagccccagcctgaaggagctggaccccaaccagcccctggagagcaaggagcggcgggccagtgatggcagccgcagccccacccccagccagaagctgggcagcgcctacctgcccagctaccaccacagcccctacaagcacgcccacatcccagcccacgcccagcactaccagagctacatgcagctgatccagcagaagtctgctgtggagtatgcccagagccagatgagcctggtgtccatgtgcaaggacctgagcagccccacccccagcgagcccaggatggagtggaaggtgaagatccgcagtgatggcacccgctacatcaccaagaggcctgtgcgggaccggctgctgcgggagcgggccctgaagatccgggaggagaggagcggcatgaccacagatgatgatgctgtgtctgagatgaagatgggccgctactggagcaaggaggagaggaagcagcacctggtgaaggccaaggagcagaggagaagaagagagttcatgatgcagagccggctggactgcctgaaggagcagcaggccgcagatgacaggaaggagatgaacatcctggagctgagccacaagaagatgatgaagaagaggaacaagaagatctttgacaactggatgaccatccaggagctgctgacccacggcaccaagagcccagatggcaccagggtgtacaacagcttcctgtctgtgaccaccgtgtag

SEQ ID NO: 163440 - DNA, 2367 bp, Artificial Sequence
  Description of Artificial Sequence: Synthetic coding sequence
atgaagatggagcacaagaggatgatcctgctcttcagcaagttcaccctcatccacaagccccacggcggccgctggtacctggtgaatggccgggacctgagccgggccacccatgaccaggccgtggaggccttcaagacagccaaggagcccatcgtggtgcaggtgctgcggaggacccccaggaccaagatgttcaccccaccttctgagagccagctggtggacaccggcacccagacagacatcacctttgagcacatcatggccctgaccaagatgagcagccccagcccccctgtgctggacccctacctgctgcctgaggagcaccccagcgcccacgagtactatgaccccaatgactacatcggggacatccaccaggagatggaccgggaggagctggagctggaggaggtggacctgtacaggatgaacagccaggacaagctgggcctgactgtgtgctacagaacagatgatgaagatgacatcggcatctacatcagcgagattgaccccaacagcattgctgccaaggatggccgcatccgggagggggaccgcatcatccagatcaatggcatcgaggtgcagaaccgggaggaggccgtggccctgctgaccagcgaggagaacaagaacttcagcctgctgattgcccggcctgagctgcagctggatgagggctggatggatgatgacagaaatgacttcctggatgacctgcacatggacatgctggaggagcagcaccaccaggccatgcagttcaccgcctctgtgctgcagcagaagaagcatgatgaagatggcggcaccacagacacagccaccatcctgagcaaccagcacgagaaggacagcggcgtgggccgcacagatgagagcaccagaaatgatgagagcagcgagcaggagaacaatggagatgatgccacagccagcagcaaccccctggccggccagaggaagctgacctgcagccaggacaccctgggcagcggggacctgcccttcagcaatgaaagcttcatctctgctgactgcacagatgctgactacctgggcatccctgtggatgaatgtgagcgcttccgggagctgctggagctgaagtgccaggtgaagagcgccaccccctacggcctgtactaccccagcggccccctggatgctgggaagagtgaccctgagagcgtggacaaggagctggagctgctgaatgaggagctgcggagcattgagctggagtgcctgagcatcgtgcgggcccacaagatgcagcagctgaaggagcagtaccgggagagctggatgctgcacaacagcggcttcaggaactacaacaccagcattgatgtgagaagacatgagctgagtgacatcacagagctgcctgagaagagtgacaaggacagcagcagcgcctacaacacaggagagagctgccgcagcacccccctgaccctggagatcagcccagacaacagcctgcggcgggctgctgagggcatcagctgccccagcagcgagggcgctgtgggcaccacagaggcctacggccctgccagcaagaacctgctgagcatcacagaagatcctgaggtgggcacccccacctacagccccagcctgaaggagctggaccccaaccagcccctggagagcaaggagcggcgggccagtgatggcagccgcagccccacccccagccagaagctgggcagcgcctacctgcccagctaccaccacagcccctacaagcacgcccacatcccagcccacgcccagcactaccagagctacatgcagctgatccagcagaagtctgctgtggagtatgcccagagccagatgagcctggtgtccatgtgcaaggacctgagcagccccaccccatctgagcccaggatggagtggaaggtgaagatccgcagtgatggcacccgctacatcaccaagaggcctgtgcgggaccggctgctgcgggagcgggccctgaagatccgggaggagaggagcggcatgaccacagatgatgatgctgtgtctgagatgaagatgggccgctactggagcaaggaggagaggaagcagcacctggtgaaggccaaggagcagaggagaagaagagagttcatgatgcagagccggctggactgcctgaaggagcagcaggccgcagatgacaggaaggagatgaacatcctggagctgagccacaagaagatgatgaagaagaggaacaagaagatctttgacaactggatgaccatccaggagctgctgacccacggcaccaagagcccagatggcaccagggtgtacaacagcttcctgtctgtgaccaccgtgtag

SEQ ID NO: 163441 - DNA, 2331 bp, Artificial Sequence
  Description of Artificial Sequence: Synthetic coding sequence
atgtctgggaagaggcagttcttcctgaagcccctggccctgctgacctgctggcccagcacagtgaatggcaaggacctgagcaaggccacccatgaggaggccgtggaggccttcagaaatgccaaggagcccatcgtggtgcaggtgctgcggaggacccccctgagcaggcctgcctacggcatggccagcgaggtgcagctgatgaatgccagcacccagacagacatcacctttgagcacatcatggccctggccaagctgcggccccccaccccacctgtgcctgacatctgccccttcctgctgagtgacagctgccacagcctgcaccccatggagcacgagttctatgaggacaatgagtacatcagcagcctgcctgcagatgctgacagaacagaggactttgaatatgaggaggtggagctgtgccgggtgagcagccaggagaagctgggcctgactgtgtgctacagaacagatgatgaggaggacaccggcatctacgtgtctgaggtggaccccaacagcattgctgccaaggatggccgcatccgggagggggaccgcatcctgcagatcaatggagaagatgtgcagaaccgggaggaggccgtggccctgctgagcaatgatgagtgcaagagaattgtgctgctggtggcccggcctgagatccagctggatgagggctggctggaggatgaaagaaatgagttcctggaggagctgaacctggagatgctggaggaggagcacaatgaggccatgcagcccacagccaatgaggtggagcagcccaagaagcaggaggaggaggagggcaccacagacacagccaccagcagcagcaacaaccacgagaaggacagcggcgtgggccgcacagatgagagcctgagaaatgatgagagcagcgagcaggagaatgctgctgaggaccccaacagcaccagcctgaagagcaagagggacctgggccagagccaggacaccctgggctctgtggagctgcagtacaatgaaagcctggtgtctggagagtacatcgacagcgactgcatcggcaacccagatgaggactgtgagcgcttccggcagctgctggagctgaagtgcaagatccggaaccacggggagtatgacctgtactacagcagcagcaccatcgagtgcaaccagggcgagcaggagggcgtggagcacgagctgcagctgctgaatgaggagctgaggaacatcgagctggagtgccagaacatcatgcaggcccaccggctgcagaaggtgacagaccagtacggggacatctggaccctgcatgatggcggcttcaggaactacaacaccagcattgacatgcagaggggcaagctggatgacatcatggagcaccctgagaagagtgacaaggacagcagcagcgcctacaacacagctgagagctgccgcagcacccccctgactgtggacaggagcccagacagcagcctgcccagggtcatcaacctgaccaacaagaagaacctgcggagcaccatggccgccacccagagcagcagcggccagagcagcaaggagagcaccagcaccaaggccaagaccacagagcagggctgcagcgctgagagcaaggagaaggtgctggagggcagcaagctgcctgaccaggagaaggctgtgtctgagcacatcccctacctgagcccctaccacagcagcagctaccgctatgccaacatcccagcccacgcccggcactaccagagctacatgcagctgatccagcagaagtctgctgtggagtatgcccagagccagctgagcctggtgtccatgtgcaaggagagccagaagtgcagcgagcccaagatggagtggaaggtgaagatccgcagtgatggcacccgctacatcaccaagaggcctgtgcgggaccgcatcctgaaggagcgggccctgaagatcaaggaggagaggagcggcatgaccacagatgatgacaccatgtctgagatgaagatgggccgctactggagcaaggaggagaggaagcagcacctggtgcgggccaaggagcagaggagaagaagagagttcatgatgaggagccggctggagtgcctgaaggagagcccccagagcggcagcgagggcaagaaggagatcaacatcatcgagctgagccacaagaagatgatgaagaagaggaacaagaagatcctggacaactggatgaccatccaggagctgatgacccacggggccaagagcccagatggcaccagggtgcacaatgccttcctgtctgtgaccaccgtgtag

SEQ ID NO: 163442 - DNA, 3111 bp, Artificial Sequence
  Description of Artificial Sequence: Synthetic coding sequence
atgggctttgccctggagagatttgctgaggccgtggaccctgccctggagtgcaagctgtgtggccaggtgctggaggagcccctgtgcaccccctgtggccacgtgttctgtgccagctgcctgctgccctgggccgtgagaagaagacgctgccccctgcagtgccagcccctggcccctggagagctgtacagagtgctgcccctgcggagcctcatccagaagctgcgggtgcagtgtgactaccgggcccggggctgcggccacagcgtgcggctgcacgagctggaggcccacgtggagcactgtgactttggacctgcccggcggctgcggagccggggcggctgtgccagcggcctgggcggcggggaggtgcctgcccggggcggctgcggccccacccccagggctggccggggcggcggggcccggggcggccccccaggcggccgctggggccggggccggggccctggcccccgggtgctggcctggaggagaagagagaaggccctgctggcccagctgtgggccctgcagggcgaggtgcagctgacagcccggcgctaccaggagaagttcacccagtacatggcccacgtgaggaactttgtgggggacctgggcggcggccacagaagagatggagagcacaagcccttcaccatcgtgctggagcgggagaatgacaccctgggcttcaacatcattggaggccggcccaaccagaacaaccaggagggcaccagcacagagggcatctacgtgtccaagatcctggagaatggacctgctgacagagcagatggcctggagatccatgacaagatcatggaggtgaatggcaaggacctgagcaaggccacccatgaggaggccgtggaggccttcagaaatgccaaggagcccatcgtggtgcaggtgctgcggaggacccccctgagcaggcctgcctacggcatggccagcgaggtgcagctgatgaatgccagcacccagacagacatcacctttgagcacatcatggccctggccaagctgcggccccccaccccacctgtgcctgacatctgccccttcctgctgagtgacagctgccacagcctgcaccccatggagcacgagttctatgaggacaatgagtacatcagcagcctgcctgcagatgctgacagaacagaggactttgaatatgaggaggtggagctgtgccgggtgagcagccaggagaagctgggcctgactgtgtgctacagaacagatgatgaggaggacaccggcatctacgtgtctgaggtggaccccaacagcattgctgccaaggatggccgcatccgggagggggaccgcatcctgcagatcaatggagaagatgtgcagaaccgggaggaggccgtggccctgctgagcaatgatgagtgcaagagaattgtgctgctggtggcccggcctgagatccagctggatgagggctggctggaggatgaaagaaatgagttcctggaggagctgaacctggagatgctggaggaggagcacaatgaggccatgcagcccacagccaatgaggtggagcagcccaagaagcaggaggaggaggagggcaccacagacacagccaccagcagcagcaacaaccacgagaaggacagcggcgtgggccgcacagatgagagcctgagaaatgatgagagcagcgagcaggagaatgctgctgaggaccccaacagcaccagcctgaagagcaagagggacctgggccagagccaggacaccctgggctctgtggagctgcagtacaatgaaagcctggtgtctggagagtacatcgacagcgactgcatcggcaacccagatgaggactgtgagcgcttccggcagctgctggagctgaagtgcaagatccggaaccacggggagtatgacctgtactacagcagcagcaccatcgagtgcaaccagggcgagcaggagggcgtggagcacgagctgcagctgctgaatgaggagctgaggaacatcgagctggagtgccagaacatcatgcaggcccaccggctgcagaaggtgacagaccagtacggggacatctggaccctgcatgatggcggcttcaggaactacaacaccagcattgacatgcagaggggcaagctggatgacatcatggagcaccctgagaagagtgacaaggacagcagcagcgcctacaacacagctgagagctgccgcagcacccccctgactgtggacaggagcccagacagcagcctgcccagggtcatcaacctgaccaacaagaagaacctgcggagcaccatggccgccacccagagcagcagcggccagagcagcaaggagagcaccagcaccaaggccaagaccacagagcagggctgcagcgctgagagcaaggagaaggtgctggagggcagcaagctgcctgaccaggagaaggctgtgtctgagcacatcccctacctgagcccctaccacagcagcagctaccgctatgccaacatcccagcccacgcccggcactaccagagctacatgcagctgatccagcagaagtctgctgtggagtatgcccagagccagctgagcctggtgtccatgtgcaaggagagccagaagtgcagcgagcccaagatggagtggaaggtgaagatccgcagtgatggcacccgctacatcaccaagaggcctgtgcgggaccgcatcctgaaggagcgggccctgaagatcaaggaggagaggagcggcatgaccacagatgatgacaccatgtctgagatgaagatgggccgctactggagcaaggaggagaggaagcagcacctggtgcgggccaaggagcagaggagaagaagagagttcatgatgaggagccggctggagtgcctgaaggagagcccccagagcggcagcgagggcaagaaggagatcaacatcatcgagctgagccacaagaagatgatgaagaagaggaacaagaagatcctggacaactggatgaccatccaggagctgatgacccacggggccaagagcccagatggcaccagggtgcacaatgccttcctgtctgtgaccaccgtgtag

SEQ ID NO: 163443 - DNA, 2337 bp, Artificial Sequence
  Description of Artificial Sequence: Synthetic coding sequence
atgggctgcaacctgtgcaccttccagaagcgggaggagcactacaagctgctgtatgaggtgtcccaggtgaatggcaaggacctgagcaaggccacccatgaggaggccgtggaggccttcagaaatgccaaggagcccatcgtggtgcaggtgctgcggaggacccccctgagcaggcctgcctacggcatggccagcgaggtgcagctgatgaatgccagcacccagacagacatcacctttgagcacatcatggccctggccaagctgcggccccccaccccacctgtgcctgacatctgccccttcctgctgagtgacagctgccacagcctgcaccccatggagcacgagttctatgaggacaatgagtacatcagcagcctgcctgcagatgctgacagaacagaggactttgaatatgaggaggtggagctgtgccgggtgagcagccaggagaagctgggcctgactgtgtgctacagaacagatgatgaggaggacaccggcatctacgtgtctgaggtggaccccaacagcattgctgccaaggatggccgcatccgggagggggaccgcatcctgcagatcaatggagaagatgtgcagaaccgggaggaggccgtggccctgctgagcaatgatgagtgcaagagaattgtgctgctggtggcccggcctgagatccagctggatgagggctggctggaggatgaaagaaatgagttcctggaggagctgaacctggagatgctggaggaggagcacaatgaggccatgcagcccacagccaatgaggtggagcagcccaagaagcaggaggaggaggagggcaccacagacacagccaccagcagcagcaacaaccacgagaaggacagcggcgtgggccgcacagatgagagcctgagaaatgatgagagcagcgagcaggagaatgctgctgaggaccccaacagcaccagcctgaagagcaagagggacctgggccagagccaggacaccctgggctctgtggagctgcagtacaatgaaagcctggtgtctggagagtacatcgacagcgactgcatcggcaacccagatgaggactgtgagcgcttccggcagctgctggagctgaagtgcaagatccggaaccacggggagtatgacctgtactacagcagcagcaccatcgagtgcaaccagggcgagcaggagggcgtggagcacgagctgcagctgctgaatgaggagctgaggaacatcgagctggagtgccagaacatcatgcaggcccaccggctgcagaaggtgacagaccagtacggggacatctggaccctgcatgatggcggcttcaggaactacaacaccagcattgacatgcagaggggcaagctggatgacatcatggagcaccctgagaagagtgacaaggacagcagcagcgcctacaacacagctgagagctgccgcagcacccccctgactgtggacaggagcccagacagcagcctgcccagggtcatcaacctgaccaacaagaagaacctgcggagcaccatggccgccacccagagcagcagcggccagagcagcaaggagagcaccagcaccaaggccaagaccacagagcagggctgcagcgctgagagcaaggagaaggtgctggagggcagcaagctgcctgaccaggagaaggctgtgtctgagcacatcccctacctgagcccctaccacagcagcagctaccgctatgccaacatcccagcccacgcccggcactaccagagctacatgcagctgatccagcagaagtctgctgtggagtatgcccagagccagctgagcctggtgtccatgtgcaaggagagccagaagtgcagcgagcccaagatggagtggaaggtgaagatccgcagtgatggcacccgctacatcaccaagaggcctgtgcgggaccgcatcctgaaggagcgggccctgaagatcaaggaggagaggagcggcatgaccacagatgatgacaccatgtctgagatgaagatgggccgctactggagcaaggaggagaggaagcagcacctggtgcgggccaaggagcagaggagaagaagagagttcatgatgaggagccggctggagtgcctgaaggagagcccccagagcggcagcgagggcaagaaggagatcaacatcatcgagctgagccacaagaagatgatgaagaagaggaacaagaagatcctggacaactggatgaccatccaggagctgatgacccacggggccaagagcccagatggcaccagggtgcacaatgccttcctgtctgtgaccaccgtgtag

SEQ ID NO: 163444 - DNA, 1158 bp, Artificial Sequence
  Description of Artificial Sequence: Synthetic coding sequence
atgaagctggtgaggaagaacatcgagaaggacaatgccggccaggtgaccctggtgcctgaggagcctgaggacatgtggcacacctacaacctggtgcaggtgggggacagcctgcgggccagcaccatcaggaaggtgcagacagagagcagcactggatctgtgggcagcaacagagtgaggaccaccctgaccctgtgtgtggaggccatcgactttgacagccaggcctgccagctgcgggtgaagggcaccaacatccaggagaatgaatatgtgaagatgggcgcctaccacaccatcgagctggagcccaaccggcagttcaccctggccaagaagcagtgggacagcgtggtgctggagagaattgagcaggcctgtgaccctgcctggagcgcagatgtggccgctgtggtgatgcaggagggcctggcccacatctgcctggtgacccccagcatgaccctgacccgggccaaggtggaggtgaacatccccaggaagaggaagggcaactgcagccagcacgaccgggccctggagcgcttctatgagcaggtggtgcaggccatccagaggcacatccactttgatgtggtgaagtgcatcctggtggccagccctggctttgtgcgggagcagttctgtgactacctgttccagcaggccgtgaagacagacaacaagctgctgctggagaacagaagcaagttcctgcaggtgcacgccagcagcggccacaagtacagcctgaaggaggccctgtgtgaccccaccgtggccagccggctgagtgacaccaaggccgccggggaggtgaaggccctggatgacttctacaagatgctgcagcacgagccagaccgggccttctacggcctgaagcaggtggagaaggccaatgaggccatggccatcgacaccctgctgatcagtgatgagctgttccgccaccaggatgtggccaccaggagccgctacgtgcggctggtggacagcgtgaaggaaaatgccggcaccgtgcgcatcttcagcagcctgcacgtgtctggagagcagctgagccagctgactggagtggccgccatcctgcgcttccctgtgcctgagctgagtgaccaggagggggacagcagcagcgaggaggactag

SEQ ID NO: 163445 - DNA, 855 bp, Artificial Sequence
  Description of Artificial Sequence: Synthetic coding sequence
atggccagctacccctaccggcagggctgccctggagctgctggccaggcccctggggcccctcctggcagctactacccaggcccccccaacagcggcggccagtatggcagcggcctgcccccaggcggcggctacggcggccctgcccctgggggcccctacggccccccagctgggggcggcccctacggccaccccaaccctggcatgttccccagcggcaccccaggcggcccctatggaggagctgcccctgggggcccctacggccagcccccacccagcagctatggagcccagcagcccggcctgtatggccagggcggggccccacccaacgtggaccctgaggcctacagctggttccagagcgtggacagcgaccacagcggctacatctccatgaaggagctgaagcaggccctggtgaactgcaactggagcagcttcaatgatgagacctgcctgatgatgatcaacatgtttgacaagaccaagagcggcagaattgatgtgtatggcttcagcgccctgtggaagttcatccagcagtggaagaacctcttccagcagtatgaccgggacaggagcggcagcatctcctacacagagctgcagcaggccctgagccagatgggctacaacctgagcccccagttcacccagctgctggtgagccgctactgccccaggtctgccaacccagccatgcagctggaccgcttcatccaggtgtgcacccagctgcaggtgctgacagaggccttccgggagaaggacacagctgtgcagggcaacatccggctgagctttgaagattttgtgaccatgacagccagcaggatgctgtag

SEQ ID NO: 163446 - DNA, 423 bp, Artificial Sequence
  Description of Artificial Sequence: Synthetic coding sequence
atggccagctacccctaccggcagggctgccctggagctgctggccaggcccctggggcccctcctggcagctactacccaggcccccccaacagcggcggccagtatggcagcggcctgcccccaggcggcggctacggcggccctgcccctgggggcccctacggccccccagctgggggcggcccctacggccaccccaaccctggcatgttccccagcggcaccccaggcggcccctatggaggagctgcccctgggggcccctacggccagcccccacccagcagctatggagcccagcagcccggcctgtatggccagggcatccacgccgagggcgccgcccctgtgtgggacatgctgagcctgtggcagcgggagggcgctggggagctggccaggatgcacaatgccagctag

SEQ ID NO: 163447 - DNA, 1146 bp, Artificial Sequence
  Description of Artificial Sequence: Synthetic coding sequence
atgcacctgctggccatcctcttctgtgccctgtggagcgctgtgctggccgagaacagtgatgattatgacctgatgtatgtgaacctggacaatgaaattgacaatggcctgcaccccacagaggaccccaccccctgtgcctgtggccaggagcacagcgagtgggacaagctgttcatcatgctggagaacagccagatgagggagaggatgctgctgcaggccacagatgatgtgctgcggggggagctgcagaggctgcgggaggagctgggccgcctggccgagagcctggcccggccctgtgcccctggggccccagctgaggcccggctgaccagcgccctggatgagctgctgcaggccaccagagatgctggaagaaggctggccaggatggagggcgctgaggcccagaggcctgaggaggccggccgggccctggccgctgtgctggaggagctgcggcagaccagggctgacctgcatgctgtgcagggctgggccgcccgctcctggctgcctgctggctgtgaaacagccatcctcttccccatgaggagcaagaagatctttggatctgtgcaccctgtgcggcccatgaggctggagagcttcagcgcctgcatctgggtgaaggccacagatgtgctgaacaagaccatcctcttctcctatggcaccaagaggaacccctatgagatccagctgtacctgagctaccagagcatcgtgtttgtggtgggcggggaggagaacaagctggtggccgaggccatggtgtccctgggccgctggacccacctgtgtggcacctggaacagcgaggagggcctgaccagcctgtgggtgaatggagagctggccgccaccaccgtggagatggccaccggccacatcgtgcctgagggcggcatcctgcagatcggccaggagaagaatggctgctgcgtgggcggcggctttgatgagaccctggccttcagcggccgcctgaccggcttcaacatctgggacagcgtgctgagcaatgaggagatccgggagactggaggagctgagagctgccacatccggggcaacatcgtgggctggggcgtgacagagatccagccccacggcggggcccagtatgtgtcctag

SEQ ID NO: 163448 - DNA, 1422 bp, Artificial Sequence
  Description of Artificial Sequence: Synthetic coding sequence
atgggcagcggcaactgggaggtgactggaccaccctgtggcagccgctgtgagcggcccccaggcctgccccggggcgtgcacggccagttccgctctgctgtgggcctgagcggcctgcgctggttccgccgcttccaggaggtgacctggacccacctgcagaacatcgccagcaactacaacgtgtcctacaacgtggatgtgcgcttccgcagcctggccgaggagagccaggccgtggcccaggccgtgaacagaagccaggcctctgtgcagggcgagctggcccagctgaaggcctgggtgaggaagctgcagaggcggggcaggaaggtggacacccggctgcgggccctggacctgaccctgggggagaggagccagcagagggcccgggagaggaaggcccacaaggcccagagagatgccctgcaggacagcctggcccggctggagggcctggtgcacagccagggcgcccggctggccgccctggagggccgcctgcctgtggcccaccctggaacagctgccctgggccctgccctggtgcccacccccacccagcctgaggagctgggccccaccagcctgaagctgcagagggaccggcaggagctgcgggccgccagcgagcaccggggccccccccaggacagcagcgcccccctgcagggccggcgggagcccccagccagcggcagccaccgggtgctgtctggaacagcccccaaggacccccggcagcaggcctggagcccccaggtgcctggagagatctgtggggtgggccccaccctggtgttccccaatgccagcaccagaaatgtggtgttcctgagccctggctttgtgacagccctgcgggccctgtccttctgctcctgggtgaggacagccagcggccgcctgggcaccctgctgtcctatgccacagaggacaatgacaacaagctggtgctgcacggccgggacagcctgctgcccggcagcatccactttgtgattggagaccctgccttccgggagctgcccctgcagctgctgctggatggccagtggcaccacatctgtgtgatctggaccagcacccagggccgctactggctgcacgtggaccggcggctggtggccaccggcagccgcttccgggagggctatgagatccccccaggcggcagcctggtgctgggccaggagcaggacagcgtgggcggcggctttgacagcagcgaggcctttgtgggctccatgagcggcctggccatctgggaccgggccctggtgcctggagaggtggccaacctggccatcggcaaggagttccccactggagccatcctgaccctggccaatgctgccctggccggcggctttgtgcagggcgccaactgcacctgcctggagcgctgcccctag

SEQ ID NO: 163449 - DNA, 1437 bp, Artificial Sequence
  Description of Artificial Sequence: Synthetic coding sequence
atgggctgctcctggaggaagaccctgtccttcttcctggtgtttgtgcccatctacctgcatggagccagcagccaggaggccgcccctgtgggccccaggaagcccttctttgagcggctgcggcggctggaggagcagttccgccgcttccaggaggtgacctggacccacctgcagaacatcgccagcaactacaacgtgtcctacaacgtggatgtgcgcttccgcagcctggccgaggagagccaggccgtggcccaggccgtgaacagaagccaggcctctgtgcagggcgagctggcccagctgaaggcctgggtgaggaagctgcagaggcggggcaggaaggtggacacccggctgcgggccctggacctgaccctgggggagaggagccagcagagggcccgggagaggaaggcccacaaggcccagagagatgccctgcaggacagcctggcccggctggagggcctggtgcacagccagggcgcccggctggccgccctggagggccgcctgcctgtggcccaccctggaacagctgccctgggccctgccctggtgcccacccccacccagcctgaggagctgggccccaccagcctgaagctgcagagggaccggcaggagctgcgggccgccagcgagcaccggggccccccccaggacagcagcgcccccctgcagggcagaagagagcccccagccagcggcagccaccgggtgctgagcggcacagcccccaaggacccccggcagcaggcctggagcccccaggtgcctggagagatctgtggggtgggccccaccctggtgttccccaatgccagcaccagaaatgtggtgttcctgagccctggctttgtgacagccctgcgggccctgtccttctgctcctgggtgaggacagccagcggccgcctgggcaccctgctgtcctatgccacagaagataatgacaacaagctggtgctgcacggccgggacagcctgctgcccggcagcatccacttcgtcatcggggaccctgccttccgggagctgcccctgcagctgctgctggatggccagtggcaccacatctgtgtgatctggaccagcacccagggccgctactggctgcacgtggaccggcggctggtggccaccggcagccgcttccgggagggctatgagatccccccaggcggcagcctggtgctgggccaggagcaggacagcgtgggcggcggctttgacagcagcgaggcctttgtgggctccatgagcggcctggccatctgggaccgggccctggtgcctggagaggtggccaacctggccatcggcaaggagttccccaccggggccatcctgaccctggccaatgctgccctggccggcggctttgtgcagggcgccaactgcacctgcctggagcgctgcccctag

SEQ ID NO: 163450 - DNA, 1167 bp, Artificial Sequence
  Description of Artificial Sequence: Synthetic coding sequence
atgaagtggctgctgctgctgggcctggtggccctgtctgagtgcatcatgtacaaggtgcccctcatcaggaagaagagcctgcggaggaccctgtctgagcggggcctgctgaaggacttcctgaagaagcacaacctgaacccagccaggaagtacttcccccagtggaaggcccccaccctggtggatgagcagcccctggagaactacctggacatggagtacttcggcaccatcggcatcggcaccccagcccaggacttcaccgtggtgtttgacaccggcagcagcaacctgtgggtgcccagcgtgtactgcagcagcctggcctgcaccaaccacaaccgcttcaaccctgaggacagcagcacctaccagagcaccagcgagaccgtgtccatcacctatggaacaggctccatgacaggcatcctgggctatgacacagtgcaggtgggcggcatcagtgacaccaaccagatcttcggcctgtctgaaacagagcccggcagcttcctgtactatgccccctttgatggcatcctgggcctggcctaccccagcatcagcagcagcggggccacccctgtgtttgacaacatctggaaccagggcctggtgtcccaggacctcttctctgtgtacctgtctgcagatgaccagagcggctctgtggtgatctttggaggcatcgacagcagctactacacaggcagcctgaactgggtgcctgtgacagtggagggctactggcagatcaccgtggacagcatcaccatgaatggagaggccatcgcctgtgccgagggctgccaggccatcgtggacaccggcaccagcctgctgaccggccccaccagccccatcgccaacatccagagcgacattggagcctctgaaaattctgatggagacatggtggtgtcctgcagcgccatcagcagcctgcctgacatcgtgttcaccatcaatggagtgcagtaccctgtgccccccagcgcctacatcctgcagagcgagggcagctgcatcagcggcttccagggcatgaacctgcccacagaaagtggagagctgtggatcctgggagatgtgttcatccggcagtacttcaccgtgtttgaccgggccaacaaccaggtgggcctggcccctgtggcctag

SEQ ID NO: 163451 - DNA, 849 bp, Artificial Sequence
  Description of Artificial Sequence: Synthetic coding sequence
atgaagtggctgctgctgctgggcctggtggccctgtctgagtgcatcatgtacaaggtgcccctcatcaggaagaagagcctgcggaggaccctgtctgagcggggcctgctgaaggacttcctgaagaagcacaacctgaacccagccaggaagtacttcccccagtggaaggcccccaccctggtggatgagcagcccctggagaactacctggacatggagtacttcggcaccatcggcatcggcaccccagcccaggacttcaccgtggtgtttgacaccggcagcagcaacctgtgggtgcccagcgtgtactgcagcagcctggcctgcaccaaccacaaccgcttcaaccctgaggacagcagcacctaccagagcaccagcgagaccgtgtccatcacctatggaacaggctccatgacaggcatcctgggctatgacacagtgcagacagtggccatctggaggtctgctgccatgggcctggtgtcccaggacctcttctctgtgtacctgtctgcagatgaccagagcggctctgtggtgatctttggaggcatcgacagcagctactacacaggcagcctgaactgggtgcctgtgacagtggagggctactggcagatcaccgtggacagcatcaccatgaatggagaggccatcgcctgtgccgagggctgccaggccatcgtggacaccggcaccagcctgctgaccggccccaccagccccatcgccaacatccagagcgacatcggggccagcgagaacagtgatggagacatggtggtgtcctgcagcgccatcagcagcctgcctgacatcgtgttcaccatcaactag

SEQ ID NO: 163452 - DNA, 750 bp, Artificial Sequence
  Description of Artificial Sequence: Synthetic coding sequence
atgacaggcatcctgggctatgacacagtgcaggtgggcggcatcagtgacaccaaccagatcttcggcctgtctgaaacagagcccggcagcttcctgtactatgccccctttgatggcatcctgggcctggcctaccccagcatcagcagcagcggggccacccctgtgtttgacaacatctggaaccagggcctggtgtcccaggacctcttctctgtgtacctgtctgcagatgaccagagcggctctgtggtgatctttggaggcatcgacagcagctactacacaggcagcctgaactgggtgcctgtgacagtggagggctactggcagatcaccgtggacagcatcaccatgaatggagaggccatcgcctgtgccgagggctgccaggccatcgtggacaccggcaccagcctgctgaccggccccaccagccccatcgccaacatccagagcgacatcggggccagcgagaacagtgatggagacatggtggtgtcctgcagcgccatcagcagcctgcctgacatcgtgttcaccatcaacggggtgcagtaccctgtgcccccatctgcctacatcctgcagctgcccagcgagggcagctgcatcagcggcttccagggcatgaacctgcccacagagagcggggagctgtggatcctgggagatgtgttcatccggcagtacttcaccgtgtttgaccgggccaacaaccaggtgggcctggcccctgtggcctag

SEQ ID NO: 163453 - DNA, 1167 bp, Artificial Sequence
  Description of Artificial Sequence: Synthetic coding sequence
atgaagtggctgctgctgctgggcctggtggccctgtctgagtgcatcatgtacaaggtgcccctcatcaggaagaagagcctgcggaggaccctgtctgagcggggcctgctgaaggacttcctgaagaagcacaacctgaacccagccaggaagtacttcccccagtgggaggcccccaccctggtggatgagcagcccctggagaactacctggacatggagtacttcggcaccatcggcatcggcaccccagcccaggacttcaccgtggtgtttgacaccggcagcagcaacctgtgggtgcccagcgtgtactgcagcagcctggcctgcaccaaccacaaccgcttcaaccctgaggacagcagcacctaccagagcaccagcgagaccgtgtccatcacctatggaacaggctccatgacaggcatcctgggctatgacacagtgcaggtgggcggcatcagtgacaccaaccagatcttcggcctgtctgaaacagagcccggcagcttcctgtactatgccccctttgatggcatcctgggcctggcctaccccagcatcagcagcagcggggccacccctgtgtttgacaacatctggaaccagggcctggtgtcccaggacctcttctctgtgtacctgtctgcagatgaccagagcggctctgtggtgatctttggaggcatcgacagcagctactacacaggcagcctgaactgggtgcctgtgacagtggagggctactggcagatcaccgtggacagcatcaccatgaatggagaggccatcgcctgtgccgagggctgccaggccatcgtggacaccggcaccagcctgctgaccggccccaccagccccatcgccaacatccagagcgacattggagcctctgaaaattctgatggagacatggtggtgtcctgcagcgccatcagcagcctgcctgacatcgtgttcaccatcaatggagtgcagtaccctgtgccccccagcgcctacatcctgcagagcgagggcagctgcatcagcggcttccagggcatgaacctgcccacagaaagtggagagctgtggatcctgggagatgtgttcatccggcagtacttcaccgtgtttgaccgggccaacaaccaggtgggcctggcccctgtggcctag

SEQ ID NO: 163454 - DNA, 1167 bp, Artificial Sequence
  Description of Artificial Sequence: Synthetic coding sequence
atgaagtggctgctgctgctgggcctggtggccctgtctgagtgcatcatgtacaaggtgcccctcatcaggaagaagagcctgcggaggaccctgtctgagcggggcctgctgaaggacttcctgaagaagcacaacctgaacccagccaggaagtacttcccccagtgggaggcccccaccctggtggatgagcagcccctggagaactacctggacatggagtacttcggcaccatcggcatcggcaccccagcccaggacttcaccgtggtgtttgacaccggcagcagcaacctgtgggtgcccagcgtgtactgcagcagcctggcctgcaccaaccacaaccgcttcaaccctgaggacagcagcacctaccagagcaccagcgagaccgtgtccatcacctatggaacaggctccatgacaggcatcctgggctatgacacagtgcaggtgggcggcatcagtgacaccaaccagatcttcggcctgtctgaaacagagcccggcagcttcctgtactatgccccctttgatggcatcctgggcctggcctaccccagcatcagcagcagcggggccacccctgtgtttgacaacatctggaaccagggcctggtgtcccaggacctcttctctgtgtacctgtctgcagatgacaagagcggctctgtggtgatctttggaggcatcgacagcagctactacacaggcagcctgaactgggtgcctgtgacagtggagggctactggcagatcaccgtggacagcatcaccatgaatggagagaccatcgcctgtgccgagggctgccaggccatcgtggacaccggcaccagcctgctgaccggccccaccagccccatcgccaacatccagagcgacattggagcctctgaaaattctgatggagacatggtggtgtcctgcagcgccatcagcagcctgcctgacatcgtgttcaccatcaatggagtgcagtaccctgtgccccccagcgcctacatcctgcagagcgagggcagctgcatcagcggcttccagggcatgaatgtgcccacagaaagtggagagctgtggatcctgggagatgtgttcatccggcagtacttcaccgtgtttgaccgggccaacaaccaggtgggcctggcccctgtggcctag

SEQ ID NO: 163455 - DNA, 849 bp, Artificial Sequence
  Description of Artificial Sequence: Synthetic coding sequence
atgaagtggctgctgctgctgggcctggtggccctgtctgagtgcatcatgtacaaggtgcccctcatcaggaagaagagcctgcggaggaccctgtctgagcggggcctgctgaaggacttcctgaagaagcacaacctgaacccagccaggaagtacttcccccagtgggaggcccccaccctggtggatgagcagcccctggagaactacctggacatggagtacttcggcaccatcggcatcggcaccccagcccaggacttcaccgtggtgtttgacaccggcagcagcaacctgtgggtgcccagcgtgtactgcagcagcctggcctgcaccaaccacaaccgcttcaaccctgaggacagcagcacctaccagagcaccagcgagaccgtgtccatcacctatggaacaggctccatgacaggcatcctgggctatgacacagtgcagacagtggccatctggaggtctgctgccatgggcctggtgtcccaggacctcttctctgtgtacctgtctgcagatgaccagagcggctctgtggtgatctttggaggcatcgacagcagctactacacaggcagcctgaactgggtgcctgtgacagtggagggctactggcagatcaccgtggacagcatcaccatgaatggagaggccatcgcctgtgccgagggctgccaggccatcgtggacaccggcaccagcctgctgaccggccccaccagccccatcgccaacatccagagcgacatcggggccagcgagaacagtgatggagacatggtggtgtcctgcagcgccatcagcagcctgcctgacatcgtgttcaccatcaactag

SEQ ID NO: 163456 - DNA, 750 bp, Artificial Sequence; identical to SEQ ID NO: 163452
  Description of Artificial Sequence: Synthetic coding sequence

SEQ ID NO: 163457 - DNA, 1167 bp, Artificial Sequence; identical to SEQ ID NO: 163454
  Description of Artificial Sequence: Synthetic coding sequence

SEQ ID NO: 163458 - DNA, 849 bp, Artificial Sequence
  Description of Artificial Sequence: Synthetic coding sequence
atgaagtggctgctgctgctgggcctggtggccctgtctgagtgcatcatgtacaaggtgcccctcatcaggaagaagagcctgcggaggaccctgtctgagcggggcctgctgaaggacttcctgaagaagcacaacctgaacccagccaggaagtacttcccccagtgggaggcccccaccctggtggatgagcagcccctggagaactacctggacatggagtacttcggcaccatcggcatcggcaccccagcccaggacttcaccgtggtgtttgacaccggcagcagcaacctgtgggtgcccagcgtgtactgcagcagcctggcctgcaccaaccacaaccgcttcaaccctgaggacagcagcacctaccagagcaccagcgagaccgtgtccatcacctatggaacaggctccatgacaggcatcctgggctatgacacagtgcagacagtggccatctggaggtctgctgccatgggcctggtgtcccaggacctcttctctgtgtacctgtctgcagatgacaagagcggctctgtggtgatctttggaggcatcgacagcagctactacacaggcagcctgaactgggtgcctgtgacagtggagggctactggcagatcaccgtggacagcatcaccatgaatggagagaccatcgcctgtgccgagggctgccaggccatcgtggacaccggcaccagcctgctgaccggccccaccagccccatcgccaacatccagagcgacatcggggccagcgagaacagtgatggagacatggtggtgtcctgcagcgccatcagcagcctgcctgacatcgtgttcaccatcaactag

SEQ ID NO: 163459 - DNA, 750 bp, Artificial Sequence
  Description of Artificial Sequence: Synthetic coding sequence
atgacaggcatcctgggctatgacacagtgcaggtgggcggcatcagtgacaccaaccagatcttcggcctgtctgaaacagagcccggcagcttcctgtactatgccccctttgatggcatcctgggcctggcctaccccagcatcagcagcagcggggccacccctgtgtttgacaacatctggaaccagggcctggtgtcccaggacctcttctctgtgtacctgtctgcagatgacaagagcggctctgtggtgatctttggaggcatcgacagcagctactacacaggcagcctgaactgggtgcctgtgacagtggagggctactggcagatcaccgtggacagcatcaccatgaatggagagaccatcgcctgtgccgagggctgccaggccatcgtggacaccggcaccagcctgctgaccggccccaccagccccatcgccaacatccagagcgacatcggggccagcgagaacagtgatggagacatggtggtgtcctgcagcgccatcagcagcctgcctgacatcgtgttcaccatcaacggggtgcagtaccctgtgcccccatctgcctacatcctgcagctgcccagcgagggcagctgcatcagcggcttccagggcatgaatgtgcccacagagagcggggagctgtggatcctgggagatgtgttcatccggcagtacttcaccgtgtttgaccgggccaacaaccaggtgggcctggcccctgtggcctag

SEQ ID NO: 163460 - DNA, 1578 bp, Artificial Sequence
  Description of Artificial Sequence: Synthetic coding sequence
atggctgctgtggtgctggccgccacccggctgctgcggggcagcggctcctggggctgcagccggctgcgctttggacctccagcctaccgccgcttcagcagtggaggagcctaccccaacatccccctgagcagccccctgcccggggtgcccaagcctgtgtttgccaccgtggatggccaggagaagtttgagaccaaggtgaccaccctggacaatggcctgcgggtggccagccagaacaagtttggccagttctgcaccgtgggcatcctgatcaacagcggcagccgctatgaggccaagtacctgagcggcatcgcccacttcctggagaagctggccttcagcagcacagccaggtttgacagcaaggatgagatcctgctgaccctggagaagcacggcggcatctgtgactgccagaccagccgggacaccaccatgtatgctgtgtctgctgacagcaagggcctggacacagtggtggccctgctggctgatgtggtgctgcagccccggctgacagatgaggaggtggagatgaccaggatggctgtgcagtttgagctggaggacctgaacctgcggccagaccctgagcccctgctgacagagatgatccacgaggccgcctaccgggagaacacagtgggcctgcaccgcttctgccccacagaaaatgtggccaagatcaaccgggaggtgctgcacagctacctgaggaactactacaccccagacaggatggtgctggccggcgtgggcgtggagcacgagcacctggtggactgtgccaggaagtacctgctgggcgtgcagcctgcctggggcagcgctgaggccgtggacatcgacagatctgtggcccagtacacaggaggcatcgccaagctggagcgggacatgagcaatgtgtccctgggccccacccccatccctgagctgacccacatcatggtgggcctggagagctgcagcttcctggaggaggacttcatcccctttgctgtgctgaacatgatgatgggcggcggcggcagcttctctgctgggggccctgggaagggcatgttcagccggctgtacctgaatgtgctgaacagacaccactggatgtacaatgccaccagctaccaccacagctatgaggacaccggcctgctgtgcatccacgccagcgctgacccccggcaggtgcgggagatggtggagatcatcaccaaggagttcatcctgatgggcggcaccgtggacacagtggagctggagcgggccaagacccagctgacctccatgctgatgatgaacctggagagcaggcctgtgatctttgaagatgtgggccggcaggtgctggccaccaggagcaggaagctgccccatgagctgtgcaccctcatcagaaatgtgaagccagaagatgtgaagagggtggccagcaagatgctgcggggcaagccagctgtggccgccctgggggacctgacagacctgcccacctatgagcacatccagacagccctgagcagcaaggatggccgcctgcccaggacctaccgcctcttcagatag

SEQ ID NO: 163461 - DNA, 441 bp, Artificial Sequence
  Description of Artificial Sequence: Synthetic coding sequence
atggctgctgtggtgctggccgccacccggctgctgcggggcagcggctcctggggctgcagccggctgcgctttggacctccagcctaccgccgcttcagcagtggaggagcctaccccaacatccccctgagcagccccctgcccggggtgcccaagcctgtgtttgccaccgtggatggccaggagaagtttgagaccaaggtgaccaccctggacaatggcctgcgggtggccagccagaacaagtttggccagttctgcaccgtgggcatcctgatcaacagcggcagccgctatgaggccaagtacctgagcggcatcgcccacttcctggagaagctggccttcagcagcacagccaggtttgacagcaaggatgagatcctgctgaccctggagaagcacggcggcatctgtgactgccagaccagcaggtag

SEQ ID NO: 163462 - DNA, 1185 bp, Artificial Sequence
  Description of Artificial Sequence: Synthetic coding sequence
atgaagaggaacaccctggtggagctgctgaccttctggaagaactggcacttccggctgctgctggacctgacagccaagatgaagttctgcctgcgctggaagtccatgggcgtgtctgtgacagcccggcaccaggatgaggaggtggagatgaccaggatggctgtgcagtttgagctggaggacctgaacctgcggccagaccctgagcccctgctgacagagatgattcatgaagctgcctacagagaaaatacagtgggcctgcaccgcttctgccccacagaaaatgtggccaagatcaaccgggaggtgctgcacagctacctgaggaactactacaccccagacaggatggtgctggccggcgtgggcgtggagcacgagcacctggtggactgtgccaggaagtacctgctgggcgtgcagcctgcctggggcagcgctgaggccgtggacatcgacagatctgtggcccagtacacaggaggcatcgccaagctggagcgggacatgagcaatgtgtccctgggccccacccccatccctgagctgacccacatcatggtgggcctggagagctgcagcttcctggaggaggacttcatcccctttgctgtgctgaacatgatgatgggcggcggcggcagcttctctgctgggggccctgggaagggcatgttcagccggctgtacctgaatgtgctgaacagacaccactggatgtacaatgccaccagctaccaccacagctatgaggacaccggcctgctgtgcatccacgccagcgctgacccccggcaggtgcgggagatggtggagatcatcaccaaggagttcatcctgatgggcggcaccgtggacacagtggagctggagcgggccaagacccagctgacctccatgctgatgatgaacctggagagcaggcctgtgatctttgaagatgtgggccggcaggtgctggccaccaggagcaggaagctgccccatgagctgtgcaccctcatcagaaatgtgaagccagaagatgtgaagagggtggccagcaagatgctgcggggcaagccagctgtggccgccctgggggacctgacagacctgcccacctatgagcacatccagacagccctgagcagcaaggatggccgcctgcccaggacctaccgcctcttcagatag

SEQ ID NO: 163463 - DNA, 816 bp, Artificial Sequence
  Description of Artificial Sequence: Synthetic coding sequence
tacacaggaggcatcgccaagctggagcgggacatgagcaatgtgtccctgggccccacccccatccctgagctgacccacatcatggtgggcctggagagctgcagcttcctggaggaggacttcatcccctttgctgtgctgaacatgatgatgggcggcggcggcagcttctctgctgggggccctgggaagggcatgttcagccggctgtacctgaatgtgctgaacagacaccactggatgtacaatgccaccagctaccaccacagctatgaggacaccggcctgctgtgcatccacgccagcgctgacccccggcaggtgcgggagatggtggagatcatcaccaaggagttcatcctgatgggcggcaccgtggacacagtggagctggagcgggccaagacccagctgacctccatgctgatgatgaacctggagagcaggcctgtgatctttgaagatgtgggccggcaggtgctggccaccaggagcaggaagctgccccatgagctgtgcaccctcatccgggagtacagaagaggcagcgagggcctgccccaggccagcgcccggctgcggggcggccgcctggccctgccccaggccgtggtgggcctgtggtacgtgcaccacacccagaacctgggccccagccctgtggtgctgagcagaggaggccagggccagggccggggcgtggccgacctggtgtccctgcccggccccaccatgcacctgctgcccccctggcaggtgaccccacccagcgcccccctgggcggcgctgtgaccacagcccagagctgctag

SEQ ID NO: 163464 - DNA, 1482 bp, Artificial Sequence
  Description of Artificial Sequence: Synthetic coding sequence
atggctgctgccaccggccccagcttctggctgggcaatgagaccctgaaggtgcccctggccctgtttgccctgaaccggcagaggctgtgtgagcggctgaggaagaacccagctgtgcaggccggcagcatcgtggtgctgcagggcggggaggagacccagcgctactgcacagacacaggagtgctcttccggcaggagagcttcttccactgggcctttggagtgacagagcccggctgctatggagtgattgatgtggacaccgggaagagcaccctgtttgtgccccggctgcctgccagccacgccacctggatgggcaagatccacagcaaggagcacttcaaggagaagtatgctgtggatgatgtgcagtatgtggatgagatcgcctctgtgctgaccagccagaagcccagcgtgctgctgaccctgcggggcgtgaacacagacagcggctctgtgtgccgggaggccagctttgatggcatcagcaagtttgaggtgaacaacaccatcctgcaccctgagatcgtggagtgcagggtcttcaagacagacatggagctggaggtgctgcgctacaccaacaagatcagcagcgaggcccaccgggaggtgatgaaggctgtgaaggtgggcatgaaggagtatgagctggagagcctgtttgagcactactgctacagccggggcggcatgaggcacagcagctacacctgcatctgtggcagcggagaaaattctgctgtgctgcactacggccatgctggggccccaaatgacaggaccatccagaatggagacatgtgcctgtttgacatgggcggggagtactactgctttgccagtgacatcacctgcagcttccctgccaacgggaagttcaccgctgaccagaaggctgtgtatgaggccgtgctgcggagcagcagagctgtgatgggcgccatgaagccaggagtgtggtggccagacatgcaccggctggccgaccgcatccacctggaggagctggcccacatgggcatcctgagcggctctgtggatgccatggtgcaggcccacctgggcgctgtgttcatgccccacggcctgggccacttcctgggcattgatgtgcatgatgtgggcggctacccagagggcgtggagagaattgatgagcccggcctgcggagcctgaggacagcccggcacctgcagcccggcatggtgctgactgtggagcccggcatctacttcatcgaccacctgctggatgaggccctggccgaccctgcccgggccagcttcctgaaccgggaggtgctgcagcgcttccggggctttggaggagtgagaattgaagaagatgtggtggtgacagacagcggcatcgagctgctgacctgtgtgcccaggacagtggaggagattgaggcctgcatggccggctgtgacaaggccttcacccccttcagcggccccaagtag

SEQ ID NO: 163465 - DNA, 1359 bp, Artificial Sequence
  Description of Artificial Sequence: Synthetic coding sequence
atggctgctgccaccggccccagcttctggctgggcaatgagaccctgaaggtgcccctggccctgtttgccctgaaccggcagaggctgtgtgagcggctgaggaagaacccagctgtgcaggccggcagcatcgtggtgctgcagggcggggaggagacccagcgctactgcacagacacaggagtgctcttccggcaggagagcttcttccactgggcctttggagtgacagagcccggctgctatggagtgattgatgtggacaccgggaagagcaccctgtttgtgccccggctgcctgccagccacgccacctggatgggcaagatccacagcaaggagcacttcaaggagaagtatgctgtggatgatgtgcagtatgtggatgagatcgcctctgtgctgaccagccagaagcccagcgtgctgctgaccctgcggggcgtgaacacagacagcggctctgtgtgccgggaggccagctttgatggcatcagcaagtttgaggtgaacaacaccatcctgcaccctgagatcgtggagtgcctgtttgagcactactgctacagcagaggaggcatgaggcacagcagctacacctgcatctgtggcagcggggagaacagcgctgtgctgcactacggccacgccggggccccaaatgacaggaccatccagaatggagacatgtgcctgtttgacatgggcggggagtactactgctttgccagtgacatcacctgcagcttccctgccaacgggaagttcaccgctgaccagaaggctgtgtatgaagctgtgctgcggagcagcagagctgtgatgggcgccatgaagccaggagtgtggtggccagacatgcaccggctggccgaccgcatccacctggaggagctggcccacatgggcatcctgagcggctctgtggatgccatggtgcaggcccacctgggcgctgtgttcatgcctcatggcctgggccacttcctgggcattgatgtgcatgatgtgggcggctacccagagggcgtggagagaattgatgagcccggcctgcggagcctgaggacagcccggcacctgcagcccggcatggtgctgactgtggagcccggcatctacttcatcgaccacctgctggatgaggccctggccgaccctgcccgggccagcttcctgaaccgggaggtgctgcagcgcttccggggctttggaggagtgcgcatcgaggaggatgtggtggtgacagattctggaattgagctgctgacctgtgtgcccaggacagtggaggagattgaggcctgcatggccggctgtgacaaggccttcacccccttcagcggccccaagtag

SEQ ID NO: 163466 - DNA, 1290 bp, Artificial Sequence
  Description of Artificial Sequence: Synthetic coding sequence
atggctgctgccaccggccccagcttctggctgggcaatgagaccctgaaggtgcccctggccctgtttgccctgaaccggcagaggctgtgtgagcggctgaggaagaacccagctgtgcaggccggcagcatcgtggtgctgcagggcggggaggagacccagcgctactgcacagacacaggagtgctcttccggcagatcgcctctgtgctgaccagccagaagcccagcgtgctgctgaccctgcggggcgtgaacacagacagcggctctgtgtgccgggaggccagctttgatggcatcagcaagtttgaggtgaacaacaccatcctgcaccctgagatcgtggagtgcagggtcttcaagacagacatggagctggaggtgctgcgctacaccaacaagatcagcagcgaggcccaccgggaggtgatgaaggctgtgaaggtgggcatgaaggagtatgagctggagagcctgtttgagcactactgctacagccggggcggcatgaggcacagcagctacacctgcatctgtggcagcggagaaaattctgctgtgctgcactacggccatgctggggccccaaatgacaggaccatccagaatggagacatgtgcctgtttgacatgggcggggagtactactgctttgccagtgacatcacctgcagcttccctgccaacgggaagttcaccgctgaccagaaggctgtgtatgaggccgtgctgcggagcagcagagctgtgatgggcgccatgaagccaggagtgtggtggccagacatgcaccggctggccgaccgcatccacctggaggagctggcccacatgggcatcctgagcggctctgtggatgccatggtgcaggcccacctgggcgctgtgttcatgccccacggcctgggccacttcctgggcattgatgtgcatgatgtgggcggctacccagagggcgtggagagaattgatgagcccggcctgcggagcctgaggacagcccggcacctgcagcccggcatggtgctgactgtggagcccggcatctacttcatcgaccacctgctggatgaggccctggccgaccctgcccgggccagcttcctgaaccgggaggtgctgcagcgcttccggggctttggaggagtgagaattgaagaagatgtggtggtgacagacagcggcatcgagctgctgacctgtgtgcccaggacagtggaggagattgaggcctgcatggccggctgtgacaaggccttcacccccttcagcggccccaagtag

SEQ ID NO: 163467 - DNA, 354 bp, Artificial Sequence
  Description of Artificial Sequence: Synthetic coding sequence
atgagggccagcagcttcctgattgtggtggtgttcctgattgctggcaccctggtgctggaggccgctgtgactggagtgcctgtgaagggccaggacacagtgaagggccgggtgcccttcaacggccaggaccctgtgaagggccaggtgtctgtgaagggccaggacaaggtgaaggcccaggagcctgtgaagggccctgtgtccaccaagccaggcagctgccccatcatcctgatccgctgtgccatgctgaacccccccaaccgctgcctgaaggacacagactgccccggcatcaagaagtgctgtgagggcagctgtggcatggcctgctttgtgccccagtag

SEQ ID NO: 163468 - DNA, 732 bp, Artificial Sequence
  Description of Artificial Sequence: Synthetic coding sequence
atggcccggctgtggggcgccctgagcctgtggcccctgtgggccgctgtgccctggggcggcgctgctgctgtgggcgtgcgggcctgcagcagcacagctgccccagatggagtggagggccctgccctgcggcgcagctactggaggcacctgcggcggctggtgctgggccccccagagccccccttcagccacgtgtgccaggtgggggaccctgtgctgcggggcgtggccgcccctgtggagcgggcccagctgggcggccctgagctgcagaggctgacccagaggctggtgcaggtgatgagaagaagaagatgtgtgggcctgagcgccccccagctgggcgtgccccggcaggtgctggccctggagctgcctgaggccctgtgccgggagtgccccccccggcagagggccctgcggcagatggagcccttccccctgcgggtgtttgtgaaccccagcctgcgggtgctggacagccggctggtgaccttccctgagggctgtgagagcgtggccggcttcctggcctgtgtgccccgcttccaggccgtgcagatcagcggcctggaccccaacggggagcaggtggtgtggcaggccagcggctgggccgcccgcatcatccagcacgagatggaccacctgcagggctgcctcttcatcgacaagatggacagcaggaccttcaccaacgtgtactggatgaaggtgaatgactag

SEQ ID NO: 163469 - DNA, 294 bp, Artificial Sequence
  Description of Artificial Sequence: Synthetic coding sequence
atggtgtttgtgagaagaccctggccagccctgaccaccgtgctgctggccctgctggtgtgcctgggcgccctggtggatgcctaccccatcaagccagaggccccccgggaggatgccagccctgaggagctgaaccgctactatgccagcctgcggcactacctgaacctggtgacccggcagagatatggcaagagagatggccctgacaccctgctgagcaagaccttcttcccagatggagaagatagacctgtgcgcagccgctctgagggccctgacctgtggtag

SEQ ID NO: 163470 - DNA, 1992 bp, Artificial Sequence
  Description of Artificial Sequence: Synthetic coding sequence
atggcccccaagagggtggtgcagctgagcctgaagatgcccacccatgctgtgtgtgtggtgggcgtggaggcccacgtggacatccacagtgatgtgcccaagggggccaacagcttccgggtgtctggcagcagcggcgtggaggtgttcatggtgtacaacagaaccagggtgaaggagcccatcggcaaggcccgctggcccctggacacagatgctgacatggtggtgtctgtgggcacagccagcaaggagctgaaggacttcaaggtgcgggtgtcctactttggagagcaggaggaccaggccctgggccgctctgtgctgtacctgactggagtggacatcagcctggaggtggacaccggccgcacaggcaaggtgaagaggagccagggcgacaagaagacctggcgctggggccctgagggctacggggccatcctgctggtgaactgtgaccgggacaaccacaggtctgctgagccagacctgacccacagctggctgatgagcctggccgacctgcaggacatgagccccatgctgctgagctgcaatggaccagacaagctgtttgacagccacaagctggtgctgaatgtgcccttcagtgacagcaagagggtgcgggtcttctgtgcccggggcggcaacagcctgagtgactacaagcaggtgctgggcccccagtgcctgtcctatgaggtggagcggcagcccggggagcaggagatcaagttctacgtggagggcctgaccttcccagatgctgacttcctgggcctggtgtccctgtctgtgtccctggtggaccccggcaccctgcctgaggtgaccctcttcacagacacagtgggcttcaggatggccccctggatcatgacccccaacacccagcccccagaggagctgtatgtgtgccgggtgatggacacccacggcagcaatgagaagttcctggaggacatgagctacctgaccctgaaggccaactgcaagctgaccatctgcccccaggtggagaacagaaatgaccgctggatccaggatgagatggagtttggctacatcgaggccccccacaagagcttccctgtggtgtttgacagccccaggaacagaggcctgaaggacttcccctacaagaggatcctgggccctgactttggctacgtgacccgggagatccccctgcccggccccagcagcctggacagctttggaaacctggatgtgagcccccctgtgacagtgggcggcacagagtaccccctgggccgcatcctgattggcagcagcttccccaagagcggcggccggcagatggcccgggctgtgaggaacttcctgaaggcccagcaggtgcaggcccctgtggagctgtacagcgactggctgtctgtgggccacgtggatgagttcctgacctttgtgcccaccagtgaccagaagggcttccggctgctgctggccagccccagcgcctgcctgaagctgttccaggagaagaaggaggagggctacggggaggccgcccagtttgatggcctgaagcaccaggccaagaggagcatcaatgagatgctggccgacagacacctgcagagggacaacctgcacgcccagaagtgcatcgactggaacagaaatgtgctgaagcgggagctgggcctggccgagagtgacatcgtggacatcccccagctgttcttcctgaagaacttctatgcagaggccttcttcccagacatggtgaacatggtggtgctgggcaagtacctgggcatccccaagccctacggccccatcatcaatggccgctgctgcctggaggagaaggtgcagagcctgctggagcccctgggcctgcactgcatcttcattgatgactacctgagctaccacgagctgcagggcgagatccactgcggcaccaacgtgcggaggaagcccttccccttcaagtggtggaacatggtgccctag

SEQ ID NO: 163471 - DNA, 537 bp, Artificial Sequence
  Description of Artificial Sequence: Synthetic coding sequence
atggcccgggctgtgaggaacttcctgaaggcccagcaggtgcaggcccctgtggagctgtacagcgactggctgtctgtgggccacgtggatgagttcctgacctttgtgcccaccagtgaccagaagggcttccggctgctgctggccagccccagcgcctgcctgaagctgttccaggagaagaaggaggagggctatggagaggccgcccagtttgatggcctgaagcaccaggccaagaggagcatcaatgagatgctggccgacagacacctgcagagggacaacctgcacgcccaggtgaacatggtggtgctgggcaagtacctgggcatccccaagccctacggccccatcatcaatggccgctgctgcctggaggagaaggtgcagagcctgctggagcccctgggcctgcactgcatcttcattgatgactacctgagctaccacgagctgcagggcgagatccactgcggcaccaacgtgcggaggaagcccttccccttcaagtggtggaacatggtgccctag

SEQ ID NO: 163472 - DNA, 405 bp, Artificial Sequence
  Description of Artificial Sequence: Synthetic coding sequence
atgctggccgacagacacctgcagagggacaacctgcacgcccagaagtgcatcgactggaacagaaatgtgctgaagcgggagctgggcctggccgagagtgacatcgtggacatcccccagctgttcttcctgaagaacttctacgccgaggccttcttcccagacatggtgaacatggtggtgctgggcaagtacctgggcatccccaagccctacggccccatcatcaatggccgctgctgcctggaggagaaggtgcagagcctgctggagcccctgggcctgcactgcatcttcattgatgactacctgagctaccacgagctgcagggcgagatccactgcggcaccaacgtgcggaggaagcccttccccttcaagtggtggaacatggtgccctag

SEQ ID NO: 163473 - DNA, 663 bp, Artificial Sequence
  Description of Artificial Sequence: Synthetic coding sequence
atggcccgggctgtgaggaacttcctgaaggcccagcaggtgcaggcccctgtggagctgtacagcgactggctgtctgtgggccacgtggatgagttcctgacctttgtgcccaccagtgaccagaagggcttccggctgctgctggccagccccagcgcctgcctgaagctgttccaggagaagaaggaggagggctatggagaggccgcccagtttgatggcctgaagcaccaggccaagaggagcatcaatgagatgctggccgacagacacctgcagagggacaacctgcacgcccagaagtgcatcgactggaacagaaatgtgctgaagcgggagctgggcctggccgagagtgacatcgtggacatcccccagctgttcttcctgaagaacttctacgccgaggccttcttcccagacatggtgaacatggtggtgctgggcaagtacctgggcatccccaagccctacggccccatcatcaatggccgctgctgcctggaggagaaggtgcagagcctgctggagcccctgggcctgcactgcatcttcattgatgactacctgagctaccacgagctgcagggcgagatccactgcggcaccaacgtgcggaggaagcccttccccttcaagtggtggaacatggtgccctag

SEQ ID NO: 163474 - DNA, 1314 bp, Artificial Sequence
  Description of Artificial Sequence: Synthetic coding sequence
atgctgcgggagaggacagtgcggctgcagtatggcagccgggtggaggccgtgtatgtgctgggcacctacctgtggacagatgtgtacagcgctgccccagctggggcccagaccttcagcctgaagcacagcgagcacgtgtgggtggaggtggtgagagatggagaggccgaggaggtggccaccaacgggaagcagcgctggctgctgagccccagcaccaccctgcgggtgaccatgagccaggccagcacagaggccagcagtgacaaggtgacagtgaactactatgatgaggagggcagcatccccatcgaccaggccggcctcttcctgacagccatcgagatcagcctggatgtggatgctgacagagatggagtggtggagaagaacaaccccaagaaggcctcctggacctggggccctgagggccagggcgccatcctgctggtgaactgtgaccgggagaccccctggctgcccaaggaggactgcagagatgagaaggtgtacagcaaggaggacctgaaggacatgagccagatgatcctgcggaccaagggccctgaccggctgcctgctggctatgagatcgtgctgtacatctccatgtctgacagcgacaaggtgggcgtcttctacgtggagaaccccttcttcggccagcgctacatccacatcctgggccgcaggaagctgtaccacgtggtgaagtacacaggaggcagcgctgagctgctcttctttgtggagggcctgtgcttcccagatgagggcttcagcggcctggtgtccatccacgtgtccctgctggagtacatggcccaggacatccccctgacccccatcttcacagacaccgtcatcttccgcatcgccccctggatcatgacccccaacatcctgccccctgtgtctgtgtttgtgtgctgcatgaaggacaactacctgttcctgaaggaggtgaagaacctggtggagaagaccaactgtgagctgaaggtgtgcttccagtacctgaacagaggagaccgctggatccaggatgaaattgaatttggctacatcgaggccccccacaagggcttccctgtggtgctggacagccccagagatggcaacctgaaggacttccctgtgaaggagctgctgggccctgactttggctacgtgacccgggagcccctgtttgaatctgtgaccagcctggacagctttggaaacctggaggtgtccccacctgtgacagtgaatggcaagacctaccccctgggccgcatcctgattggcagcagcttccccctgtag

SEQ ID NO: 163475 - DNA, 1998 bp, Artificial Sequence
  Description of Artificial Sequence: Synthetic coding sequence
atgctgcgggagaggacagtgcggctgcagtatggcagccgggtggaggccgtgtatgtgctgggcacctacctgtggacagatgtgtacagcgctgccccagctggggcccagaccttcagcctgaagcacagcgagcacgtgtgggtggaggtggtgagagatggagaggccgaggaggtggccaccaacgggaagcagcgctggctgctgagccccagcaccaccctgcgggtgaccatgagccaggccagcacagaggccagcagtgacaaggtgacagtgaactactatgatgaggagggcagcatccccatcgaccaggccggcctcttcctgacagccatcgagatcagcctggatgtggatgctgacagagatggagtggtggagaagaacaaccccaagaaggcctcctggacctggggccctgagggccagggcgccatcctgctggtgaactgtgaccgggagaccccctggctgcccaaggaggactgcagagatgagaaggtgtacagcaaggaggacctgaaggacatgagccagatgatcctgcggaccaagggccctgaccggctgcctgctggctatgagatcgtgctgtacatctccatgtctgacagcgacaaggtgggcgtcttctacgtggagaaccccttcttcggccagcgctacatccacatcctgggccgcaggaagctgtaccacgtggtgaagtacacaggaggcagcgctgagctgctcttctttgtggagggcctgtgcttcccagatgagggcttcagcggcctggtgtccatccacgtgtccctgctggagtacatggcccaggacatccccctgacccccatcttcacagacaccgtcatcttccgcatcgccccctggatcatgacccccaacatcctgccccctgtgtctgtgtttgtgtgctgcatgaaggacaactacctgttcctgaaggaggtgaagaacctggtggagaagaccaactgtgagctgaaggtgtgcttccagtacctgaacagaggagaccgctggatccaggatgaaattgaatttggctacatcgaggccccccacaagggcttccctgtggtgctggacagccccagagatggcaacctgaaggacttccctgtgaaggagctgctgggccctgactttggctacgtgacccgggagcccctgtttgaatctgtgaccagcctggacagctttggaaacctggaggtgtccccacctgtgacagtgaatggcaagacctaccccctgggccgcatcctgattggcagcagcttccccctgagcggcggccgcaggatgaccaaggtggtgcgggacttcctgaaggcccagcaggtgcaggcccctgtggagctgtacagcgactggctgactgtgggccacgtggatgagttcatgagctttgtgcccatccctggcaccaagaagttcctgctgctgatggccagcaccagcgcctgctacaagctgttccgggagaagcagaaggatggccatggagaggccatcatgttcaagggcctgggcggcatgagcagcaagaggatcaccatcaacaagatcctgagcaatgaaagcctggtgcaggagaacctgtacttccagcgctgcctggactggaacagagacatcctgaagaaggagctgggcctgacagagcaggacatcatcgacctgcctgccctcttcaagatggatgaggaccaccgggcccgggccttcttccccaacatggtgaacatgattgtgctggacaaggacctgggcatccccaagcccttcggcccccaggtggaggaggagtgctgcctggagatgcacgtgcggggcctgctggagcccctgggcctggagtgcaccttcattgatgacatcagcgcctaccacaagttcctgggggaggtgcactgcggcaccaacgtgcggaggaagcccttcaccttcaagtggtggcacatggtgccctag

SEQ ID NO: 163476 - DNA, 1650 bp, Artificial Sequence
  Description of Artificial Sequence: Synthetic coding sequence
atgctgcgggagaggacagtgcggctgcagtatggcagccgggtggaggccgtgtatgtgctgggcacctacctgtggacagatgtgtacagcgctgccccagctggggcccagaccttcagcctgaagcacagcgagcacgtgtgggtggaggtggtgagagatggagaggccgaggaggtggccaccaacgggaagcagcgctggctgctgagccccagcaccaccctgcgggtgaccatgagccaggccagcacagaggccagcagtgacaaggtgacagtgaactactatgatgaggagggcagcatccccatcgaccaggccggcctcttcctgacagccatcgagatcagcctggatgtggatgctgacagagatggagtggtggagaagaacaaccccaagaagaccaggagcagcgccaatgccatcagcacctcctgggccggcggcagcagcaccatgtggagcagcaccagggtggcccccaggagctgctgcagctcctggaaggcctctgtgagccccacccgggccagccaggcctggagccccagcatgtctgcctgctggagcacctggcccagcatgaaggacaactacctgttcctgaaggaggtgaagaacctggtggagaagaccaactgtgagctgaaggtgtgcttccagtacctgaacagaggagaccgctggatccaggatgaaattgaatttggctacatcgaggccccccacaagggcttccctgtggtgctggacagccccagagatggcaacctgaaggacttccctgtgaaggagctgctgggccctgactttggctacgtgacccgggagcccctgtttgaatctgtgaccagcctggacagctttggaaacctggaggtgtccccacctgtgacagtgaatggcaagacctaccccctgggccgcatcctgattggcagcagcttccccctgagcggcggccgcaggatgaccaaggtggtgcgggacttcctgaaggcccagcaggtgcaggcccctgtggagctgtacagcgactggctgactgtgggccacgtggatgagttcatgagctttgtgcccatccctggcaccaagaagttcctgctgctgatggccagcaccagcgcctgctacaagctgttccgggagaagcagaaggatggccatggagaggccatcatgttcaagggcctgggcggcatgagcagcaagaggatcaccatcaacaagatcctgagcaatgaaagcctggtgcaggagaacctgtacttccagcgctgcctggactggaacagagacatcctgaagaaggagctgggcctgacagagcaggacatcatcgacctgcctgccctcttcaagatggatgaggaccaccgggcccgggccttcttccccaacatggtgaacatgattgtgctggacaaggacctgggcatccccaagcccttcggcccccaggtggaggaggagtgctgcctggagatgcacgtgcggggcctgctggagcccctgggcctggagtgcaccttcattgatgacatcagcgcctaccacaagttcctgggggaggtgcactgcggcaccaacgtgcggaggaagcccttcaccttcaagtggtggcacatggtgccctag

SEQ ID NO: 163477 - DNA, 1995 bp, Artificial Sequence
  Description of Artificial Sequence: Synthetic coding sequence
atgagcctgcagagaattgtgcgggtgtccctggagcaccccaccagcgctgtgtgtgtggccggcgtggagaccctggtggacatctacggctctgtgcctgagggcacagagatgtttgaggtgtatggcaccccaggagtggacatctacatcagccccaacatggagcggggccgggagagagctgacacccggcgctggaggtttgatgccaccctggagatcatcgtggtgatgaacagccccagcaatgacctgaatgacagccacgtgcagatctcctaccacagcagccatgagcccctgcccctggcctatgctgtgctgtacctgacctgtgtggacatcagcctggactgtgacctgaactgtgagggccggcaggacaggaactttgtggacaagaggcagtgggtgtggggccccagcggctacggcggcatcctgctggtgaactgtgacagagatgaccccagctgtgatgtgcaggacaactgtgaccagcacgtgcactgcctgcaggacctggaggacatgtctgtgatggtgctgcggacccagggccctgctgccctgtttgatgaccacaagctggtgctgcacaccagcagctatgatgccaagagggcccaggtgttccacatctgtggcccagaagatgtgtgtgaggcctaccgccacgtgctgggccaggacaaggtgtcctatgaggtgccccggctgcatggagatgaggagcgcttctttgtggagggcctgtccttcccagatgctggcttcaccggcctcatctccttccacgtgaccctgctggatgacagcaatgaagacttcagcgccagccccatcttcacagacacagtggtgttccgggtggccccctggatcatgacccccagcaccctgccccccctggaggtgtatgtgtgccgggtgaggaacaacacctgctttgtggatgctgtggccgagctggccaggaaggccggctgcaagctgaccatctgcccccaggctgaaaatagaaatgaccgctggatccaggatgagatggagctgggctacgtgcaggccccccacaagaccctgcctgtggtgtttgacagccccagaaatggagagctgcaggacttcccctacaagaggatcctgggccctgactttggctacgtgacccgggagccccgggacagatctgtgtctggcctggacagctttggaaacctggaggtgagcccccctgtggtggccaacgggaaggagtaccccctgggccgcatcctgattggaggcaacctgcccggcagcagcggccggcgggtgacccaggtggtgcgggacttcctgcacgcccagaaggtgcagccccctgtggagctgtttgtggactggctggccgtgggccacgtggatgagttcctgagctttgtgcctgccccagatggcaagggcttcaggatgctgctggccagccctggggcctgcttcaagctgttccaggagaagcagaagtgtggccacggccgggccctgctcttccagggcgtggtggatgatgagcaggtgaagaccatcagcatcaaccaggtgctgagcaacaaggacctgatcaactacaacaagtttgtgcagagctgcatcgactggaaccgggaggtgctgaagcgggagctgggcctggctgaatgtgacatcatcgacatcccccagctgttcaagacagagaggaagaaggccacagccttcttcccagacctggtgaacatgctggtgctgggcaagcacctgggcatccccaagcccttcggccccatcatcaatggctgctgctgcctggaggagaaggtgcgcagcctgctggagcccctgggcctgcactgcaccttcattgatgacttcaccccctaccacatgctgcatggagaggtgcactgcggcaccaacgtgtgcaggaagcccttctccttcaagtggtggaacatggtgccctag

SEQ ID NO: 163478 - DNA, 645 bp, Artificial Sequence
  Description of Artificial Sequence: Synthetic coding sequence
atggcccagggcaccctcatccgggtgaccccagagcagcccacccatgctgtgtgtgtgctgggcaccctgacccagctggacatctgcagcagcgcccctgaggactgcaccagcttcagcatcaatgccagccctggggtggtggtggacatcgcccacggccccccagccaagaagaagagcacaggcagcagcacctggcccctggaccccggggtggaggtgaccctgaccatgaaggtggccagcggcagcactggagaccagaaggtgcagatctcctactacggccccaagaccccacctgtgaaggccctgctgtacctgactggagtggatggagtgagcccctgccaccctggctggagcgccatgcatgacctggcccactgcaacctgcggctgcaggtgcaggccatcctgtgcttctctgtgcccagctcctggaccaccggggcctgccaccacgcctggctgatctttgtgttcctggtggagatggagttccaccacgtgggccaggccggcctggagctgctgaccagcggggacctgcctgccagcggcagccagagcgcccgcatcaccggcatgaaccactgtgcccggcccagcatcttcctgatcctgaagtacctgtag

SEQ ID NO: 163479 - DNA, 1992 bp, Artificial Sequence
  Description of Artificial Sequence: Synthetic coding sequence
atggcccagggcaccctcatccgggtgaccccagagcagcccacccatgctgtgtgtgtgctgggcaccctgacccagctggacatctgcagcagcgcccctgaggactgcaccagcttcagcatcaatgccagccctggggtggtggtggacatcgcccacggccccccagccaagaagaagagcacaggcagcagcacctggcccctggaccccggggtggaggtgaccctgaccatgaaggtggccagcggcagcactggagaccagaaggtgcagatctcctactacggccccaagaccccacctgtgaaggccctgctgtacctgactggagtggagatcagcctgtgtgccgacatcaccaggacaggcaaggtgaagcccaccagggctgtgaaggaccagaggacctggacctggggcccctgtggccagggcgccatcctgctggtgaactgtgaccgggacaacctggagagcagcgccatggactgtgaagatgatgaggtgctggacagcgaggacctgcaggacatgagcctgatgaccctgagcaccaagacccccaaggacttcttcaccaaccacaccctggtgctgcacgtggcccggtctgagatggacaaggtgcgggtcttccaggccacccggggcaagctgagcagcaagtgcagcgtggtgctgggccccaagtggcccagccactacctgatggtgcctgggggcaagcacaacatggacttctacgtggaggccctggccttcccagacacagacttccctggcctcatcaccctgaccatcagcctgctggacaccagcaacctggagctgcctgaggccgtggtgttccaggacagcgtggtgttccgggtggccccctggatcatgacccccaacacccagcccccccaggaggtgtatgcctgcagcatctttgaaaatgaagacttcctgaagtctgtgaccaccctggccatgaaggccaagtgcaagctgaccatctgcccagaggaggagaacatggatgaccagtggatgcaggatgagatggagatcggctacatccaggccccccacaagaccctgcctgtggtgtttgacagccccaggaacagaggcctgaaggagttccccatcaagagggtgatgggccctgactttggctacgtgacccggggcccccagacaggaggcatcagcggcctggacagctttggaaacctggaggtgagcccccctgtgacagtgcggggcaaggagtaccccctgggccgcatcctgtttggagacagctgctaccccagcaatgacagccggcagatgcaccaggccctgcaggacttcctgagcgcccagcaggtgcaggcccctgtgaagctgtacagcgactggctgtctgtgggccacgtggatgagttcctgagctttgtgcctgccccagacaggaagggcttccggctgctgctggccagccccaggagctgctacaagctgttccaggagcagcagaatgaaggacatggagaggccctgctgtttgagggcatcaagaagaagaagcagcagaagatcaagaacatcctgagcaacaagaccctgcgggagcacaacagctttgtggagcgctgcatcgactggaaccgggagctgctgaagcgggagctgggcctggccgagagtgacatcatcgacatcccccagctgttcaagctgaaggagttcagcaaggccgaggccttcttccccaacatggtgaacatgctggtgctgggcaagcacctgggcatccccaagcccttcggccctgtgatcaatggccgctgctgcctggaggagaaggtgtgcagcctgctggagcccctgggcctgcagtgcaccttcatcaatgacttcttcacctaccacatccgccacggggaggtgcactgcggcaccaacgtgcggaggaagcccttctccttcaagtggtggaacatggtgccctag

SEQ ID NO: 163480 - DNA, 384 bp, Artificial Sequence
  Description of Artificial Sequence: Synthetic coding sequence
atggcccagggcaccctcatccgggtgaccccagagcagcccacccatgctgtgtgtgtgctgggcaccctgacccagctggacatctgcagcagcgcccctgaggactgcaccagcttcagcatcaatgccagccctggggtggtggtggacatcgcccacggccccccagccaagaagaagagcacaggcagcagcacctggcccctggaccccggggtggaggtgaccctgaccatgaaggtggccagcggcagcactggagaccagaaggtgcagatctcctactacggccccaagaccccacctgtgaaggccctgctgtacctgactggagtggatggagtgagcccctgccaccctggctggagcgccatggcctag

SEQ ID NO: 163481 - DNA, 2628 bp, Artificial Sequence
  Description of Artificial Sequence: Synthetic coding sequence
atggacacagtgcaccacatgctgctgtttggctgcaacatgcccagcagcacaggcagctactggttctgtgatgagggcacctgcacagacaaggccaacatcctgtatgcctgggccagaaatgccccacccacccggctgcccaagggcgtgggcttccgggtgggcggggagaccggcagcaagtactttgtgctgcaggtgcactatggagacatcagcgccttccgggacaacaacaaggactgcagcggcgtgtccctgcacctgacccggctgccccagcccctgattgctggcatgtacctgatgatgtctgtggacaccgtcatcccagctggggagaaggtggtgaacagcgacatcagctgccactacaagaactaccccatgcacgtgtttgcctacagagtgcacacccaccacctgggcaaggtggtgtctggctacagagtgagaaatggccagtggaccctgattggccggcagagcccccagctgccccaggccttctaccctgtgggccaccctgtggatgtgtcctttggagacctgctggccgcccgctgtgtgttcaccggggagggccgcacagaggccacccacatcggcggcaccagcagtgatgagatgtgcaacctgtacatcatgtactacatggaggccaagcatgctgtgtccttcatgacctgcacccagaatgtggccccagacatgttccgcaccatccccccagaggccaacatccccatccctgtgaagagtgacatggtgatgatgcatgagcaccacaaggagacagagtacaaggacaagatccccctgctgcagcagcccaagcgggaggaggaggaggtgctggaccagggcgacttctacagcctgctgagcaagctgctgggggagagagaagatgtggtgcacgtgcacaagtacaaccccacagagaaggccgagagcgagagtgacctggtggccgagatcgccaacgtggtgcagaagaaggacctgggccgcagtgatgcccgggagggcgctgagcacgagagaggaaatgccatcctggtgcgggaccgcatccacaagttccaccggctggtgtccaccctgcggcccccagagagcagggtcttcagcctgcagcagcccccacctggagagggcacctgggagcctgagcacactggagacttccacatggaggaggccctggactggccaggagtgtacctgctgcccggccaggtgtctggagtggccctggaccccaagaacaacctggtgatcttccacagaggagaccacgtgtgggatggcaacagctttgacagcaagtttgtgtaccagcagatcggcctgggccccatcgaggaggacaccatcctggtgattgaccccaacaatgctgctgtgctgcagagcagcggcaagaacctcttctacctgccccacggcctgagcattgacaaggatggcaactactgggtgacagatgtggccctgcaccaggtgttcaagctggaccccaacaacaaggagggccctgtgctgatcctgggccgctccatgcagcccggcagtgaccagaaccacttctgccagcccacagatgtggccgtggaccccggcactggagccatctacgtgtctgatggctactgcaacagcagaattgtgcagttcagccccagcggcaagttcatcacccagtggggcgaggagagcagcggcagcagccccctgcccggccagttcaccgtgccccacagcctggccctggtgcccctgctgggccagctgtgtgtggccgacagagaaaatggccgcatccagtgcttcaagacagacaccaaggagtttgtgcgggagatcaagcacagcagctttggaagaaatgtgtttgccatctcctacatccctggcctgctgtttgctgtgaatggcaagccccactttggagaccaggagcctgtgcagggctttgtgatgaacttcagcaatggagagatcatcgacatcttcaagcctgtgaggaagcactttgacatgcctcatgacatcgtggcctctgaagatggcaccgtgtacatcggagatgcccacaccaacacagtgtggaagttcaccctgacagagaagctggagcacaggtctgtgaagaaggccggcatcgaggtgcaggagatcaaggccgaggccgtggtggagaccaagatggagaacaagcccaccagcagcgagctgcagaagatgcaggagaagcagaagctgatcaaggagcccggcagcggcgtgcctgtggtgctgatcaccaccctgctggtgattcctgtggtggtgctgctggccatcgccatcttcatccgctggaagaagagccgggcctttggagacagcgagcacaagctggagaccagcagcggccgggtgctgggccgcttccggggcaagggcagcggcggcctgaacctgggcaacttctttgccagcaggaagggctacagcaggaagggctttgaccggctgagcacagagggcagtgaccaggagaaggaggatgatggcagcgagagcgaggaggagtacagcgcccccctgcctgccctggcccccagcagcagctag

SEQ ID NO: 163482 - DNA, 2925 bp, Artificial Sequence
  Description of Artificial Sequence: Synthetic coding sequence
atggccggccgggtgcccagcctgctggtgctgctggtgttccccagcagctgcctggccttccgcagccccctgagcgtcttcaagcgcttcaaggagaccacccggcccttcagcaatgaatgtctgggcaccaccaggcctgtggtgcccatcgacagcagtgactttgccctggacatccgcatgcctggggtgacccccaagcagagcgacacctacttctgcatgtccatgagaattcctgtggatgaggaggccttcgtcatcgacttcaagccccgggcctccatggacacagtgcaccacatgctgctgtttggctgcaacatgcccagcagcacaggcagctactggttctgtgatgagggcacctgcacagacaaggccaacatcctgtatgcctgggccagaaatgccccacccacccggctgcccaagggcgtgggcttccgggtgggcggggagaccggcagcaagtactttgtgctgcaggtgcactacggggacatcagcgccttccgggacaacaacaaggactgcagcggcgtgtccctgcacctgacccggctgccccagcccctgattgctggcatgtacctgatgatgtctgtggacaccgtcatcccagctggggagaaggtggtgaacagcgacatcagctgccactacaagaactaccccatgcacgtgtttgcctacagagtgcacacccaccacctgggcaaggtggtgtctggctacagagtgagaaatggccagtggaccctcatcggccggcagagcccccagctgccccaggccttctaccctgtgggccaccctgtggatgtgtcctttggagacctgctggccgcccgctgtgtgttcaccggggagggccgcacagaggccacccacatcggcggcaccagcagtgatgagatgtgcaacctgtacatcatgtactacatggaggccaagcatgctgtgtccttcatgacctgcacccagaatgtggccccagacatgttccgcaccatccccccagaggccaacatccccatccctgtgaagagtgacatggtgatgatgcatgagcaccacaaggagacagagtacaaggacaagatccccctgctgcagcagcccaagcgggaggaggaggaggtgctggaccagggcgacttctacagcctgctgagcaagctgctgggggagcgggaggatgtggtgcacgtgcacaagtacaaccccacagagaaggccgagagcgagagtgacctggtggccgagatcgccaacgtggtgcagaagaaggacctgggccgcagtgatgcccgggagggcgctgagcacgagagaggaaatgccatcctggtgcgggaccgcatccacaagttccaccggctggtgtccaccctgcggcccccagagagcagggtcttcagcctgcagcagcccccacctggagagggcacctgggagcctgagcacactggagacttccacatggaggaggccctggactggccaggagtgtacctgctgcccggccaggtgtctggagtggccctggaccccaagaacaacctggtgatcttccacagaggagaccacgtgtgggatggcaacagctttgacagcaagtttgtgtaccagcagatcggcctgggccccatcgaggaggacaccatcctggtgattgaccccaacaatgctgctgtgctgcagagcagcggcaagaacctcttctacctgccccacggcctgagcattgacaaggatggcaactactgggtgacagatgtggccctgcaccaggtgttcaagctggaccccaacaacaaggagggccctgtgctgatcctgggccgctccatgcagcccggcagtgaccagaaccacttctgccagcccacagatgtggccgtggaccccggcaccggggccatctacgtgtctgatggctactgcaacagccgcatcgtgcagttcagccccagcggcaagttcatcacccagtggggcgaggagagcagcggcagcagccccctgcccggccagttcaccgtgccccacagcctggccctggtgcccctgctgggccagctgtgtgtggccgaccgggagaatggccgcatccagtgcttcaagacagacaccaaggagtttgtgcgggagatcaagcacagcagctttggaagaaatgtgtttgccatctcctacatccctggcctgctgtttgctgtgaatggcaagccccactttggagaccaggagcctgtgcagggctttgtgatgaacttcagcaatggagagatcatcgacatcttcaagcctgtgaggaagcactttgacatgcctcatgacatcgtggcctctgaagatggcaccgtgtacatcggagatgcccacaccaacacagtgtggaagttcaccctgacagagaagctggagcacaggtctgtgaagaaggccggcatcgaggtgcaggagatcaaggaggccgaggccgtggtggagaccaagatggagaacaagcccaccagcagcgagctgcagaagatgcaggagaagcagaagctgatcaaggagcccggcagcggcgtgcctgtggtgctgatcaccaccctgctggtgattcctgtggtggtgctgctggccatcgccatcttcatccgctggaagaagagccgggcctttggagctgacagcgagcacaagctggagaccagcagcggccgggtgctgggccgcttccggggcaaaggaagtggcggcctgaacctgggcaacttctttgccagcaggaagggctacagcaggaaaggatttgaccggctgagcacagagggcagtgaccaggagaaggaggatgatggcagcgagagcgaggaggagtacagcgcccccctgcctgccctggcccccagcagcagctag

SEQ ID NO: 163483 - DNA, 2664 bp, Artificial Sequence
  Description of Artificial Sequence: Synthetic coding sequence
atggccggccgggtgcccagcctgctggtgctgctggtgttccccagcagctgcctggccttccgcagccccctgagcgtcttcaagcgcttcaaggagaccacccggcccttcagcaatgaatgtctgggcaccaccaggcctgtggtgcccatcgacagcagtgactttgccctggacatccgcatgcctggggtgacccccaagcagagcgacacctacttctgcatgtccatgagaattcctgtggatgaggaggccttcgtcatcgacttcaagccccgggcctccatggacacagtgcaccacatgctgctgtttggctgcaacatgcccagcagcacaggcagctactggttctgtgatgagggcacctgcacagacaaggccaacatcctgtatgcctgggccagaaatgccccacccacccggctgcccaagggcgtgggcttccgggtgggcggggagaccggcagcaagtactttgtgctgcaggtgcactacggggacatcagcgccttccgggacaacaacaaggactgcagcggcgtgtccctgcacctgacccggctgccccagcccctgattgctggcatgtacctgatgatgtctgtggacaccgtcatcccagctggggagaaggtggtgaacagcgacatcagctgccactacaagaactaccccatgcacgtgtttgcctacagagtgcacacccaccacctgggcaaggtggtgtctggctacagagtgagaaatggccagtggaccctcatcggccggcagagcccccagctgccccaggccttctaccctgtgggccaccctgtggatgtgtcctttggagacctgctggccgcccgctgtgtgttcaccggggagggccgcacagaggccacccacatcggcggcaccagcagtgatgagatgtgcaacctgtacatcatgtactacatggaggccaagcatgctgtgtccttcatgacctgcacccagaatgtggccccagacatgttccgcaccatccccccagaggccaacatccccatccctgtgaagagtgacatggtgatgatgcatgagcaccacaaggagacagagtacaaggacaagatccccctgctgcagcagcccaagcgggaggaggaggaggtgctggaccagggcgacttctacagcctgctgagcaagctgctgggggagcgggaggatgtggtgcacgtgcacaagtacaaccccacagagaaggccgagagcgagagtgacctggtggccgagatcgccaacgtggtgcagaagaaggacctgggccgcagtgatgcccgggagggcgctgagcacgagagaggaaatgccatcctggtgcgggaccgcatccacaagttccaccggctggtgtccaccctgcggcccccagagagcagggtcttcagcctgcagcagcccccacctggagagggcacctgggagcctgagcacactggagacttccacatggaggaggccctggactggccaggagtgtacctgctgcccggccaggtgtctggagtggccctggaccccaagaacaacctggtgatcttccacagaggagaccacgtgtgggatggcaacagctttgacagcaagtttgtgtaccagcagatcggcctgggccccatcgaggaggacaccatcctggtgattgaccccaacaatgctgctgtgctgcagagcagcggcaagaacctcttctacctgccccacggcctgagcattgacaaggatggcaactactgggtgacagatgtggccctgcaccaggtgttcaagctggaccccaacaacaaggagggccctgtgctgatcctgggccgctccatgcagcccggcagtgaccagaaccacttctgccagcccacagatgtggccgtggaccccggcaccggggccatctacgtgtctgatggctactgcaacagccgcatcgtgcagttcagccccagcggcaagttcatcacccagtggggcgaggagagcagcggcagcagccccctgcccggccagttcaccgtgccccacagcctggccctggtgcccctgctgggccagctgtgtgtggccgaccgggagaatggccgcatccagtgcttcaagacagacaccaaggagtttgtgcgggagatcaagcacagcagctttggaagaaatgtgtttgccatctcctacatccctggcctgctgtttgctgtgaatggcaagccccactttggagaccaggagcctgtgcagggctttgtgatgaacttcagcaatggagagatcatcgacatcttcaagcctgtgaggaagcactttgacatgcctcatgacatcgtggcctctgaagatggcaccgtgtacatcggagatgcccacaccaacacagtgtggaagttcaccctgacagagaagctggagcacaggtctgtgaagaaggccggcatcgaggtgcaggagatcaagggcaagggcagcggcggcctgaacctgggcaacttctttgccagcaggaagggctacagcaggaagggctttgaccggctgagcacagagggcagtgaccaggagaaggaggatgatggcagcgagagcgaggaggagtacagcgcccccctgcctgccctggcccccagcagcagctag

SEQ ID NO: 163484 - DNA, 2601 bp, Artificial Sequence
  Description of Artificial Sequence: Synthetic coding sequence
atggccggccgggtgcccagcctgctggtgctgctggtgttccccagcagctgcctggccttccgcagccccctgagcgtcttcaagcgcttcaaggagaccacccggcccttcagcaatgaatgtctgggcaccaccaggcctgtggtgcccatcgacagcagtgactttgccctggacatccgcatgcctggggtgacccccaagcagagcgacacctacttctgcatgtccatgagaattcctgtggatgaggaggccttcgtcatcgacttcaagccccgggcctccatggacacagtgcaccacatgctgctgtttggctgcaacatgcccagcagcacaggcagctactggttctgtgatgagggcacctgcacagacaaggccaacatcctgtatgcctgggccagaaatgccccacccacccggctgcccaagggcgtgggcttccgggtgggcggggagaccggcagcaagtactttgtgctgcaggtgcactacggggacatcagcgccttccgggacaacaacaaggactgcagcggcgtgtccctgcacctgacccggctgccccagcccctgattgctggcatgtacctgatgatgtctgtggacaccgtcatcccagctggggagaaggtggtgaacagcgacatcagctgccactacaagaactaccccatgcacgtgtttgcctacagagtgcacacccaccacctgggcaaggtggtgtctggctacagagtgagaaatggccagtggaccctcatcggccggcagagcccccagctgccccaggccttctaccctgtgggccaccctgtggatgtgtcctttggagacctgctggccgcccgctgtgtgttcaccggggagggccgcacagaggccacccacatcggcggcaccagcagtgatgagatgtgcaacctgtacatcatgtactacatggaggccaagcatgctgtgtccttcatgacctgcacccagaatgtggccccagacatgttccgcaccatccccccagaggccaacatccccatccctgtgaagagtgacatggtgatgatgcatgagcaccacaaggagacagagtacaaggacaagatccccctgctgcagcagcccaagcgggaggaggaggaggtgctggaccaggacttccacatggaggaggccctggactggccaggagtgtacctgctgcccggccaggtgtctggagtggccctggaccccaagaacaacctggtgatcttccacagaggagaccacgtgtgggatggcaacagctttgacagcaagtttgtgtaccagcagatcggcctgggccccatcgaggaggacaccatcctggtgattgaccccaacaatgctgctgtgctgcagagcagcggcaagaacctcttctacctgccccacggcctgagcattgacaaggatggcaactactgggtgacagatgtggccctgcaccaggtgttcaagctggaccccaacaacaaggagggccctgtgctgatcctgggccgctccatgcagcccggcagtgaccagaaccacttctgccagcccacagatgtggccgtggaccccggcactggagccatctacgtgtctgatggctactgcaacagcagaattgtgcagttcagccccagcggcaagttcatcacccagtggggcgaggagagcagcggcagcagccccctgcccggccagttcaccgtgccccacagcctggccctggtgcccctgctgggccagctgtgtgtggccgacagagaaaatggccgcatccagtgcttcaagacagacaccaaggagtttgtgcgggagatcaagcacagcagctttggaagaaatgtgtttgccatctcctacatccctggcctgctgtttgctgtgaatggcaagccccactttggagaccaggagcctgtgcagggctttgtgatgaacttcagcaatggagagatcatcgacatcttcaagcctgtgaggaagcactttgacatgcctcatgacatcgtggcctctgaagatggcaccgtgtacatcggagatgcccacaccaacacagtgtggaagttcaccctgacagagaagctggagcacaggtctgtgaagaaggccggcatcgaggtgcaggagatcaaggaggccgaggccgtggtggagaccaagatggagaacaagcccaccagcagcgagctgcagaagatgcaggagaagcagaagctgatcaaggagcccggcagcggcgtgcctgtggtgctgatcaccaccctgctggtgattcctgtggtggtgctgctggccatcgccatcttcatccgctggaagaagagccgggccttcggggacagcgagcacaagctggagaccagcagcggccgggtgctgggccgcttccggggcaaaggaagtggcggcctgaacctgggcaacttctttgccagcaggaagggctacagcaggaaaggatttgaccggctgagcacagagggcagtgaccaggagaaggaggatgatggcagcgagagcgaggaggagtacagcgcccccctgcctgccctggcccccagcagcagctag

SEQ ID NO: 163485 - DNA, 1008 bp, Artificial Sequence
  Description of Artificial Sequence: Synthetic coding sequence
atgcagcccggcagtgaccagaaccacttctgccagcccacagatgtggccgtggaccccggcaccggggccatctacgtgtctgatggctactgcaacagccgcatcgtgcagttcagccccagcggcaagttcatcacccagtggggcgaggagagcagcggcagcagccccctgcccggccagttcaccgtgccccacagcctggccctggtgcccctgctgggccagctgtgtgtggccgaccgggagaatggccgcatccagtgcttcaagacagacaccaaggagtttgtgcgggagatcaagcacagcagctttggaagaaatgtgtttgccatctcctacatccctggcctgctgtttgctgtgaatggcaagccccactttggagaccaggagcctgtgcagggctttgtgatgaacttcagcaatggagagatcatcgacatcttcaagcctgtgaggaagcactttgacatgcctcatgacatcgtggcctctgaagatggcaccgtgtacatcggagatgcccacaccaacacagtgtggaagttcaccctgacagagaagctggagcacaggtctgtgaagaaggccggcatcgaggtgcaggagatcaaggaggccgaggccgtggtggagaccaagatggagaacaagcccaccagcagcgagctgcagaagatgcaggagaagcagaagctgatcaaggagcccggcagcggcgtgcctgtggtgctgatcaccaccctgctggtgattcctgtggtggtgctgctggccatcgccatcttcatccgctggaagaagagccgggcctttggaggcaagggcagcggcggcctgaacctgggcaacttctttgccagcaggaagggctacagcaggaagggctttgaccggctgagcacagagggcagtgaccaggagaaggaggatgatggcagcgagagcgaggaggagtacagcgcccccctgcctgccctggcccccagcagcagctag

SEQ ID NO: 163486 - DNA, 468 bp, Artificial Sequence
  Description of Artificial Sequence: Synthetic coding sequence
atgcatgagcaccacaaggagacagagtacaaggacaagatccccctgctgcagcagcccaagcgggaggaggaggaggtgctggaccagggcgacttctacagcctgctgagcaagctgctgggggagagagaagatgtggtgcacgtgcacaagtacaaccccacagagaaggccgagagcgagagtgacctggtggccgagatcgccaacgtggtgcagaagaaggacctgggccgcagtgatgcccgggagggcgctgagcacgagagaggaaatgccatcctggtgcgggaccgcatccacaagttccaccggctggtgtccaccctgcggcccccagagagcagggtcttcagcctgcagcagcccccacctggagagggcacctgggagcctgagcacactggagcccggcgggaggacatgaagtgcttccagtgcaaggagatgatctctgtgcagtag

SEQ ID NO: 163487 - DNA, 2922 bp, Artificial Sequence
  Description of Artificial Sequence: Synthetic coding sequence
atggccggccgggtgcccagcctgctggtgctgctggtgttccccagcagctgcctggccttccgcagccccctgagcgtcttcaagcgcttcaaggagaccacccggcccttcagcaatgaatgtctgggcaccaccaggcctgtggtgcccatcgacagcagtgactttgccctggacatccgcatgcctggggtgacccccaagcagagcgacacctacttctgcatgtccatgagaattcctgtggatgaggaggccttcgtcatcgacttcaagccccgggcctccatggacacagtgcaccacatgctgctgtttggctgcaacatgcccagcagcacaggcagctactggttctgtgatgagggcacctgcacagacaaggccaacatcctgtatgcctgggccagaaatgccccacccacccggctgcccaagggcgtgggcttccgggtgggcggggagaccggcagcaagtactttgtgctgcaggtgcactacggggacatcagcgccttccgggacaacaacaaggactgcagcggcgtgtccctgcacctgacccggctgccccagcccctgattgctggcatgtacctgatgatgtctgtggacaccgtcatcccagctggggagaaggtggtgaacagcgacatcagctgccactacaagaactaccccatgcacgtgtttgcctacagagtgcacacccaccacctgggcaaggtggtgtctggctacagagtgagaaatggccagtggaccctcatcggccggcagagcccccagctgccccaggccttctaccctgtgggccaccctgtggatgtgtcctttggagacctgctggccgcccgctgtgtgttcaccggggagggccgcacagaggccacccacatcggcggcaccagcagtgatgagatgtgcaacctgtacatcatgtactacatggaggccaagcatgctgtgtccttcatgacctgcacccagaatgtggccccagacatgttccgcaccatccccccagaggccaacatccccatccctgtgaagagtgacatggtgatgatgcatgagcaccacaaggagacagagtacaaggacaagatccccctgctgcagcagcccaagcgggaggaggaggaggtgctggaccagggcgacttctacagcctgctgagcaagctgctgggggagcgggaggatgtggtgcacgtgcacaagtacaaccccacagagaaggccgagagcgagagtgacctggtggccgagatcgccaacgtggtgcagaagaaggacctgggccgcagtgatgcccgggagggcgctgagcacgagagaggaaatgccatcctggtgcgggaccgcatccacaagttccaccggctggtgtccaccctgcggcccccagagagcagggtcttcagcctgcagcagcccccacctggagagggcacctgggagcctgagcacactggagacttccacatggaggaggccctggactggccaggagtgtacctgctgcccggccaggtgtctggagtggccctggaccccaagaacaacctggtgatcttccacagaggagaccacgtgtgggatggcaacagctttgacagcaagtttgtgtaccagcagatcggcctgggccccatcgaggaggacaccatcctggtgattgaccccaacaatgctgctgtgctgcagagcagcggcaagaacctcttctacctgccccacggcctgagcattgacaaggatggcaactactgggtgacagatgtggccctgcaccaggtgttcaagctggaccccaacaacaaggagggccctgtgctgatcctgggccgctccatgcagcccggcagtgaccagaaccacttctgccagcccacagatgtggccgtggaccccggcaccggggccatctacgtgtctgatggctactgcaacagccgcatcgtgcagttcagccccagcggcaagttcatcacccagtggggcgaggagagcagcggcagcagccccctgcccggccagttcaccgtgccccacagcctggccctggtgcccctgctgggccagctgtgtgtggccgaccgggagaatggccgcatccagtgcttcaagacagacaccaaggagtttgtgcgggagatcaagcacagcagctttggaagaaatgtgtttgccatctcctacatccctggcctgctgtttgctgtgaatggcaagccccactttggagaccaggagcctgtgcagggctttgtgatgaacttcagcaatggagagatcatcgacatcttcaagcctgtgaggaagcactttgacatgcctcatgacatcgtggcctctgaagatggcaccgtgtacatcggagatgcccacaccaacacagtgtggaagttcaccctgacagagaagctggagcacaggtctgtgaagaaggccggcatcgaggtgcaggagatcaaggaggccgaggccgtggtggagaccaagatggagaacaagcccaccagcagcgagctgcagaagatgcaggagaagcagaagctgatcaaggagcccggcagcggcgtgcctgtggtgctgatcaccaccctgctggtgattcctgtggtggtgctgctggccatcgccatcttcatccgctggaagaagagccgggcctttggagacagcgagcacaagctggagaccagcagcggccgggtgctgggccgcttccggggcaagggcagcggcggcctgaacctgggcaacttctttgccagcaggaagggctacagcaggaagggctttgaccggctgagcacagagggcagtgaccaggagaaggaggatgatggcagcgagagcgaggaggagtacagcgcccccctgcctgccctggcccccagcagcagctag

SEQ ID NO: 163488 - DNA, 2718 bp, Artificial Sequence
  Description of Artificial Sequence: Synthetic coding sequence
atggccggccgggtgcccagcctgctggtgctgctggtgttccccagcagctgcctggccttccgcagccccctgagcgtcttcaagcgcttcaaggagaccacccggcccttcagcaatgaatgtctgggcaccaccaggcctgtggtgcccatcgacagcagtgactttgccctggacatccgcatgcctggggtgacccccaagcagagcgacacctacttctgcatgtccatgagaattcctgtggatgaggaggccttcgtcatcgacttcaagccccgggcctccatggacacagtgcaccacatgctgctgtttggctgcaacatgcccagcagcacaggcagctactggttctgtgatgagggcacctgcacagacaaggccaacatcctgtatgcctgggccagaaatgccccacccacccggctgcccaagggcgtgggcttccgggtgggcggggagaccggcagcaagtactttgtgctgcaggtgcactacggggacatcagcgccttccgggacaacaacaaggactgcagcggcgtgtccctgcacctgacccggctgccccagcccctgattgctggcatgtacctgatgatgtctgtggacaccgtcatcccagctggggagaaggtggtgaacagcgacatcagctgccactacaagaactaccccatgcacgtgtttgcctacagagtgcacacccaccacctgggcaaggtggtgtctggctacagagtgagaaatggccagtggaccctcatcggccggcagagcccccagctgccccaggccttctaccctgtgggccaccctgtggatgtgtcctttggagacctgctggccgcccgctgtgtgttcaccggggagggccgcacagaggccacccacatcggcggcaccagcagtgatgagatgtgcaacctgtacatcatgtactacatggaggccaagcatgctgtgtccttcatgacctgcacccagaatgtggccccagacatgttccgcaccatccccccagaggccaacatccccatccctgtgaagagtgacatggtgatgatgcatgagcaccacaaggagacagagtacaaggacaagatccccctgctgcagcagcccaagcgggaggaggaggaggtgctggaccagggcgacttctacagcctgctgagcaagctgctgggggagcgggaggatgtggtgcacgtgcacaagtacaaccccacagagaaggccgagagcgagagtgacctggtggccgagatcgccaacgtggtgcagaagaaggacctgggccgcagtgatgcccgggagggcgctgagcacgagagaggaaatgccatcctggtgcgggaccgcatccacaagttccaccggctggtgtccaccctgcggcccccagagagcagggtcttcagcctgcagcagcccccacctggagagggcacctgggagcctgagcacactggagacttccacatggaggaggccctggactggccaggagtgtacctgctgcccggccaggtgtctggagtggccctggaccccaagaacaacctggtgatcttccacagaggagaccacgtgtgggatggcaacagctttgacagcaagtttgtgtaccagcagatcggcctgggccccatcgaggaggacaccatcctggtgattgaccccaacaatgctgctgtgctgcagagcagcggcaagaacctcttctacctgccccacggcctgagcattgacaaggatggcaactactgggtgacagatgtggccctgcaccaggtgttcaagctggaccccaacaacaaggagggccctgtgctgatcctgggccgctccatgcagcccggcagtgaccagaaccacttctgccagcccacagatgtggccgtggaccccggcaccggggccatctacgtgtctgatggctactgcaacagccgcatcgtgcagttcagccccagcggcaagttcatcacccagtggggcgaggagagcagcggcagcagccccctgcccggccagttcaccgtgccccacagcctggccctggtgcccctgctgggccagctgtgtgtggccgaccgggagaatggccgcatccagtgcttcaagacagacaccaaggagtttgtgcgggagatcaagcacagcagctttggaagaaatgtgtttgccatctcctacatccctggcctgctgtttgctgtgaatggcaagccccactttggagaccaggagcctgtgcagggctttgtgatgaacttcagcaatggagagatcatcgacatcttcaagcctgtgaggaagcactttgacatgcctcatgacatcgtggcctctgaagatggcaccgtgtacatcggagatgcccacaccaacacagtgtggaagttcaccctgacagagaagctggagcacaggtctgtgaagaaggccggcatcgaggtgcaggagatcaaggacagcgagcacaagctggagaccagcagcggccgggtgctgggccgcttccggggcaagggcagcggcggcctgaacctgggcaacttctttgccagcaggaagggctacagcaggaagggctttgaccggctgagcacagagggcagtgaccaggagaaggaggatgatggcagcgagagcgaggaggagtacagcgcccccctgcctgccctggcccccagcagcagctag

SEQ ID NO: 163489 - DNA, 90 bp, Artificial Sequence
  Description of Artificial Sequence: Synthetic coding sequence
atggccggccgggtgcccagcctgctggtgctgctggtgttccccagcagctgcctggccttccgcagccccctgagcgtcttcaagtag

SEQ ID NO: 163490 - DNA, 87 bp, Artificial Sequence
  Description of Artificial Sequence: Synthetic coding sequence
atggccggccgggtgcccagcctgctggtgctgctggtgttccccagcagctgcctggccttccgcagccccctgagcgtcttctag

SEQ ID NO: 163491 - DNA, 162 bp, Artificial Sequence
  Description of Artificial Sequence: Synthetic coding sequence
atggccggccgggtgcccagcctgctggtgctgctggtgttccccagcagctgcctggccttccgcagccccctgagcgtcttcaagcgcttcaaggagaccacccggcccttcagcaatgaatgtctgggcaccaccaggcctgtggtgcccatcgactag

SEQ ID NO: 163492 - DNA, 129 bp, Artificial Sequence
  Description of Artificial Sequence: Synthetic coding sequence
atggccggccgggtgcccagcctgctggtgctgctggtgttccccagcagctgcctggccttccgcagccccctgagcgtcttcaagcgcttcaaggagaccacccggcccttcagcaatgaatgttag

SEQ ID NO: 163493 - DNA, 207 bp, Artificial Sequence
  Description of Artificial Sequence: Synthetic coding sequence
atggccggccgggtgcccagcctgctggtgctgctggtgttccccagcagctgcctggccttccgcagccccctgagcgtcttcaagcgcttcaaggagaccacccggcccttcagcaatgaatgtctgggcaccaccaggcctgtggtgcccatcgacagcagtgactttgccctggacatccgcatgcctggggtgaccccctag

SEQ ID NO: 163494 - DNA, 78 bp, Artificial Sequence
  Description of Artificial Sequence: Synthetic coding sequence
atggccggccgggtgcccagcctgctggtgctgctggtgttccccagcagctgcctggccttccgcagccccctgtag

SEQ ID NO: 163495 - DNA, 501 bp, Artificial Sequence
  Description of Artificial Sequence: Synthetic coding sequence
atggccgccatccccccagacagctggcagcccccaaatgtgtacctggagacctccatgggcatcatcgtgctggagctgtactggaagcacgcccccaagacctgcaagaactttgctgagctggcccggcggggctactacaacggcaccaagttccaccgcatcatcaaggacttcatgatccagggcggggaccccaccggcaccggccggggcggggccagcatctacggcaagcagtttgaagatgagctgcacccagacctgaagttcaccggggccggcatcctggccatggccaatgccggccctgacaccaacggcagccagttctttgtgaccctggcccccacccagtggctggatggcaagcacaccatcttcggccgggtgtgccagggcatcggcatggtgaacagagtgggcatggtggagaccaacagccaggacaggcctgtggatgatgtgaagatcatcaaggcctaccccagcggctag

SEQ ID NO: 163496 - DNA, 1563 bp, Artificial Sequence
  Description of Artificial Sequence: Synthetic coding sequence
atgggcaagaggcagcaccagaaggacaagatgtacatcacctgtgccgagtacacccacttctacggcggcaagaagccagacctgccccagaccaacttccggcggctgccctttgaccactgcagcctgagcctgcagccctttgtgtaccctgtgtgcaccccagatggcatcgtgtttgacctgctgaacatcgtgccctggctgaagaagtatggcaccaaccccagcaatggagagaagctggatggccgcagcctcatcaagctgaacttcagcaagaacagcgagggcaagtaccactgccctgtgctcttcaccgtcttcaccaacaacacccacatcgtggccgtgaggaccactggaaatgtgtatgcctatgaggccgtggagcagctgaacatcaaggccaagaacttccgggacctgctgacagatgagcccttcagccggcaggacatcatcaccctgcaggaccccaccaacctggacaagttcaacgtgagcaacttctaccacgtgaagaacaacatgaagatcatcgaccctgatgaggagaaggccaagcaggaccccagctactacctgaagaacaccaatgctgagacccgggagaccctgcaggagctgtacaaggagttcaagggagatgagatcctggccgccaccatgaaggcccctgagaagaagaaggtggacaagctgaatgctgcccactacagcacaggcaaggtgtctgccagcttcaccagcacagccatggtgcctgagaccacccatgaagctgctgccattgatgaagatgtgctgcgctaccagtttgtgaagaagaagggctacgtgcggctgcacaccaacaagggggacctgaacctggagctgcactgtgacctgacccccaagacctgtgagaacttcatccggctgtgcaagaagcactactatgatggcaccatcttccacaggagcatccggaacttcgtcatccagggcggggaccccaccggcaccggcaccggcggggagagctactggggcaagcccttcaaggatgagttccggcccaacctgagccacacaggccggggcatcctgtccatggccaacagcggccccaacagcaacagaagccagttcttcatcaccttccgcagctgtgcctacctggacaagaagcacaccatcttcggccgggtggtgggcggctttgatgtgctgacagccatggagaatgtggagagtgaccccaagacagaccggcccaaggaggagatcagaattgatgccaccaccgtgtttgtggacccctatgaggaggctgatgcccagatcgcccaggagaggaagacccagctgaaggtggcccctgagaccaaggtgaagagcagccagccccaggccggcagccagggcccccagaccttccggcagggcgtgggcaagtacatcaacccagctgccaccaagagagctgctgaggaggagcccagcaccagcgccaccgtgcccatgagcaagaagaagcccagccggggctttggagacttcagctcctggtag

SEQ ID NO: 163497 - DNA, 1563 bp, Artificial Sequence; identical to SEQ ID NO: 163496
  Description of Artificial Sequence: Synthetic coding sequence

SEQ ID NO: 163498 - DNA, 1563 bp, Artificial Sequence; identical to SEQ ID NO: 163496
  Description of Artificial Sequence: Synthetic coding sequence

SEQ ID NO: 163499 - DNA, 1584 bp, Artificial Sequence
  Description of Artificial Sequence: Synthetic coding sequence
atgggcaagaggcagcaccagaaggacaagatgtacatcacctgtgccgagtacacccacttctacggcggcaagaagccagacctgccccagaccaacttccggcggctgccctttgaccactgcagcctgagcctgcagccctttgtgtaccctgtgtgcaccccagatggcatcgtgtttgacctgctgaacatcgtgccctggctgaagaagtatggcaccaaccccagcaatggagagaagctggatggccgcagcctcatcaagctgaacttcagcaagaacagcgagggcaagtaccactgccctgtgctcttcaccgtcttcaccaacaacacccacatcgtggccgtgaggaccactggaaatgtgtatgcctatgaggccgtggagcagctgaacatcaaggccaagaacttccgggacctgctgacagatgagcccttcagccggcaggacatcatcaccctgcaggaccccaccaacctggacaagttcaacgtgagcaacttctaccacgtgaagaacaacatgaagatcatcgaccctgatgaggagaaggccaagcaggaccccagctactacctgaagaacaccaatgctgagacccgggagaccctgcaggagctgtacaaggagttcaagggagatgagatcctggccgccaccatgaaggcccctgagaagaagaaggtggacaagctgaatgctgcccactacagcacaggcaaggtgtctgccagcttcaccagcacagccatggtgcctgagaccacccatgaagctgctgccattgatgaagatgtgctgcgctaccagtttgtgaagaagaagggctacgtgcggctgcacaccaacaagggggacctgaacctggagctgcactgtgacctgacccccaagacctgtgagaacttcatccggctgtgcaagaagcactactatgatggcaccatcttccacaggagcatccggaacttcgtcatccagggcggggaccccaccggcaccggcaccggcggggagagctactggggcaagcccttcaaggatgagttccggcccaacctgagccacacaggccggggcatcctgtccatggccaacagcggccccaacagcaacagaagccagttcttcatcaccttccgcagctgtgcctacctggacaagaagcacaccatcttcggccgggtggtgggcggctttgatgtgctgacagccatggagaatgtggagagtgaccccaagacagaccggcccaaggaggagatcagaattgatgccaccaccgtgtttgtggacccctatgaggaggctgatgcccagatcgcccaggagaggaagacccagctgaaggtggcccctgagaccaaggtgaagagcagccagccccaggccggcagccagggcccccagaccttccggcagggcgtgggcaagtacatcaacccagctgccacagagcagcagaggaagagcccccagcctgtgcccctgagcccctgcccccggcgcagccctgtgggcgtgctgggcaccagcgcccctggcagcagccggctgcctgatgaccactag

SEQ ID NO: 163500 - DNA, 1470 bp, Artificial Sequence
  Description of Artificial Sequence: Synthetic coding sequence
atgggcaagaggcagcaccagaaggacaagatgtacatcacctgtgccgagtacacccacttctacggcggcaagaagccagacctgccccagaccaacttccggcggctgccctttgaccactgcagaaatattgtgccctggctgaagaagtatggcaccaaccccagcaatggagagaagctggatggccgcagcctcatcaagctgaacttcagcaagaacagcgagggcaagtaccactgccctgtgctcttcaccgtcttcaccaacaacacccacatcgtggccgtgaggaccactggaaatgtgtatgcctatgaagctgtggagcagctgaacatcaaggccaagaacttccgggacctgctgacagatgagcccttcagccggcaggacatcatcaccctgcaggaccccaccaacctggacaagttcaacgtgagcaacttctaccacgtgaagaacaacatgaagatcattgatcctgatgaggagaaggccaagcaggaccccagctactacctgaagaacaccaatgctgagacccgggagaccctgcaggagctgtacaaggagttcaagggagatgagatcctggccgccaccatgaaggcccctgagaagaagaaggtggacaagctgaatgctgcccactacagcacaggcaaggtgtctgccagcttcaccagcacagccatggtgcctgagaccacccatgaggccgccgccattgatgaagatgtgctgcgctaccagtttgtgaagaagaagggctacgtgcggctgcacaccaacaagggggacctgaacctggagctgcactgtgacctgacccccaagacctgtgagaacttcatccggctgtgcaagaagcactactatgatggcaccatcttccacaggagcatccggaactttgtgatccagggcggggaccccactggaactggaactggaggagagagctactggggcaagcccttcaaggatgagttccggcccaacctgagccacacaggccggggcatcctgtccatggccaacagcggccccaacagcaacagaagccagttcttcatcaccttccgcagctgtgcctacctggacaagaagcacaccatcttcggccgggtggtgggcggctttgatgtgctgacagccatggagaatgtggagagtgaccccaagacagaccggcccaaggaggagatcagaattgatgccaccaccgtgtttgtggacccctatgaggaggctgatgcccagatcgcccaggagaggaagacccagctgaaggaggccagcagccggggccgggccctgaaccagtgccactgcccccacgtgcaggaggaggcccagagcggcttctggggcctgcagctgctggtggccgccgccacctgccgcctgtacctgtgccccagcttcagccaccagagcctgatgctgaagctgcaggcctag

SEQ ID NO: 163501 - DNA, 1563 bp, Artificial Sequence; identical to SEQ ID NO: 163496
  Description of Artificial Sequence: Synthetic coding sequence

SEQ ID NO: 163502 - DNA, 1479 bp, Artificial Sequence
  Description of Artificial Sequence: Synthetic coding sequence
atggctgtgctgctggagaccaccctgggagatgtggtgattgacctgtacacagaggagcggccccgggcctgcctgaacttcctgaagctgtgcaagatcaagtactacaactactgcctgatccacaacgtgcagagggacttcatcatccagacaggagaccccactggaacaggccggggcggggagagcatcttcggccagctgtatggagaccaggccagcttctttgaggccgagaaggtgccccgcatcaagcacaagaagaagggcaccgtgtccatggtgaacaatggaagtgaccagcacggcagccagttcctgatcaccaccggggagaacctggactacctggatggagtgcacacagtgtttggagaggtgacagagggcatggacatcatcaagaagatcaatgagacctttgtggacaaggactttgtgccctaccaggacatccgcatcaaccacacagtcatcctggatgacccctttgatgatcctccagacctgctgatcccagacaggagccctgagcccacccgggagcagctggacagcggcagaattggagcagatgaggagattgatgacttcaagggccgctctgctgaggaggtggaggagatcaaggccgagaaggaggccaagacccaggccatcctgctggagatggtgggggacctgcctgatgctgacatcaagcccccagaaaatgtgctgtttgtgtgcaagctgaaccctgtgaccacagatgaggacctggagatcatcttcagcagatttggccccatccgcagctgtgaggtgatccgggactggaagacaggagagagcctgtgctacgccttcatcgagtttgagaaggaggaggactgtgagaaggccttcttcaagatggacaacgtgctgattgatgaccggcgcatccacgtggacttcagccagagcgtggccaaggtgaagtggaagggcaaaggaggcaagtacaccaagagtgacttcaaggagtatgagaaggagcaggacaagccacccaacctggtgctgaaggacaaggtgaagcccaagcaggacaccaagtatgacctgatcctggatgagcaggccgaggacagcaagagcagccacagccacaccagcaagaagcacaagaagaagacccaccactgcagcgaggagaaggaggatgaggactacatgcccatcaagaacaccaaccaggacatctaccgggagatgggcttcggccactatgaggaggaggagagctgctgggagaagcagaagtctgagaagagggacaggacccagaacagaagccgcagccgcagccgggagagagatggccactacagcaacagccacaagagcaagtaccagacagacctgtatgaaagagagaggagcaagaagagggacaggagccgcagccccaagaagagcaaggacaaggagaagagcaagtacagatag

SEQ ID NO: 163503 - DNA, 384 bp, Artificial Sequence
  Description of Artificial Sequence: Synthetic coding sequence
atgagccggcccaagacccagaaccaggtgacccacacccaggtgaagaacaccaggaggaagcccatcaccgtgctgaagaggaagaagatgaggaccacctgccagagcaagatcctgatccgcatcagcattgagaagtggggcctggtgaccatgaagaagaagaaggctgtgggcaggaacaagagggtgaagcgggagacagagctgaggacagaggtggtggccgacctggagcggggcatggccatcatcgtcatcgtcatcaaccagaacaccaagcagatcttcatgaaggagaagggcgtgaagcgggagacagaggccgaggtgcagaggagccccaagatcaagaagaacctgagcattgatgaaagatag

SEQ ID NO: 163504 - DNA, 318 bp, Artificial Sequence
  Description of Artificial Sequence: Synthetic coding sequence
atgtgccagggcggggacttcaccaggcacaatggaactggaggcaagagcatctatggagagaagtttgaagatgagaacttcatcctgaagcacactggacctggcatcctgtccatggccaatgccggccccaacaccaacggcagccagttcttcatctgcacagccaagacagagtggctggatggcaagcacgtggtgtttgggaaggtgaaggagggcatgaacatcgtggaggccatggagagatttggcagcagaaatggcaagaccagcaagaagatcaccatcgctgactgtggccagctggagtag

SEQ ID NO: 163505 - DNA, 390 bp, Artificial Sequence
  Description of Artificial Sequence: Synthetic coding sequence
atggtgaaccccaccgtcttctttgatattgctgtggatggagagcccctgggccgggtgtcctttgagctgtttgctgacaaggtgcccaagacagctgagaacttccgggccctgagcactggagagaagggcttcggctacaagggcagctgcttccaccgcatcatccctggcttcatgtgccagggcggggacttcaccaggcacaatggaactggaggcaagagcatctgcacagccaagacagagtggctggatggcaagcacgtggtgtttgggaaggtgaaggagggcatgaacatcgtggaggccatggagagatttggcagcagaaatggcaagaccagcaagaagatcaccatcgctgactgtggccagctggagtag

SEQ ID NO: 163506 - DNA, 498 bp, Artificial Sequence
  Description of Artificial Sequence: Synthetic coding sequence
atggtgaaccccaccgtcttctttgatattgctgtggatggagagcccctgggccgggtgtcctttgagctgtttgctgacaaggtgcccaagacagctgagaacttccgggccctgagcactggagagaagggcttcggctacaagggcagctgcttccaccgcatcatccctggcttcatgtgccagggcggggacttcaccaggcacaatggaactggaggcaagagcatctatggagagaagtttgaagatgagaacttcatcctgaagcacactggacctggcatcctgtccatggccaatgccggccccaacaccaacggcagccagttcttcatctgcacagccaagacagagtggctggatggcaagcacgtggtgtttgggaaggtgaaggagggcatgaacatcgtggaggccatggagagatttggcagcagaaatggcaagaccagcaagaagatcaccatcgctgactgtggccagctggagtag

SEQ ID NO: 163507 - DNA, 495 bp, Artificial Sequence
  Description of Artificial Sequence: Synthetic coding sequence
atggtgaacagcgtggtgttctttgacatcaccgtggatggcaagcccctgggccgcatcagcatcaagctgtttgctgacaagatcctgaagacagctgagaacttccgggccctgagcactggagagaagggcttccgctacaagggcagctgcttccaccgcatcatccctggcttcatgtgccagggcggggacttcaccaggcacaatggaactggagacaagagcatctatggagagaagtttgatgatgagaacctgatcaggaagcacactggaagtggcatcctgtccatggccaatgccggccccaacaccaacggcagccagttcttcatctgtgccgccaagacagagtggctggatggcaagcacgtggccttcggcaaggtgaaggagcgggtgaacatcgtggaggccatggagcacttcggctacagaaacagcaagaccagcaagaagatcaccatcgctgactgtggccagttctag

SEQ ID NO: 163508 - DNA, 651 bp, Artificial Sequence
  Description of Artificial Sequence: Synthetic coding sequence
atgctgcggctgtctgaaagaaacatgaaggtgctgctggccgccgccctgattgctggctctgtgttcttcctgctgctgcccggccccagcgctgctgatgagaagaagaagggccccaaggtgacagtgaaggtgtactttgacctgagaattggagatgaagatgtgggccgggtcatcttcggcctgtttgggaagacagtgcccaagacagtggacaactttgtggccctggccactggagagaagggcttcggctacaagaacagcaagttccacagggtcatcaaggacttcatgatccagggcggggacttcaccagaggagatggcactggaggcaagagcatctatggagagcgcttcccagatgagaacttcaagctgaagcactacggccctggctgggtgtccatggccaatgccggcaaggacaccaacggcagccagttcttcatcaccaccgtgaagacagcctggctggatggcaagcacgtggtgtttgggaaggtgctggagggcatggaggtggtgaggaaggtggagagcaccaagacagacagccgggacaagcccctgaaggatgtgatcatcgctgactgtgggaagattgaggtggagaagccctttgccatcgccaaggagtag

SEQ ID NO: 163509 - DNA, 639 bp, Artificial Sequence
  Description of Artificial Sequence: Synthetic coding sequence
atgggccctggcccccggctgctgctgcccctggtgctgtgtgtgggcctgggcgccctggtgttcagcagcggggctgagggcttcaggaagaggggccccagcgtgacagccaaggtgttctttgatgtgcgcatcggggacaaggatgtgggccgcatcgtcatcggcctgtttgggaaggtggtgcccaagacagtggagaactttgtggccctggccactggagagaagggctacggctacaagggcagcaagttccacagggtcatcaaggacttcatgatccagggcggggacatcaccactggagatggcactggaggagtgtccatctatggagagaccttcccagatgagaacttcaagctgaagcactatggaattggctgggtgtccatggccaatgccggccctgacaccaacggcagccagttcttcatcaccctgaccaagcccacctggctggatggcaagcacgtggtgtttgggaaggtgattgatggcatgacagtggtgcacagcattgagctgcaggccacagatggccatgaccggcccctgaccaactgcagcatcatcaacagcggcaagattgatgtgaagaccccatttgtggtggagattgctgactggtag

SEQ ID NO: 163510 - DNA, 1113 bp, Artificial Sequence
  Description of Artificial Sequence: Synthetic coding sequence
atgagccaccccagcccccaggccaagcccagcaaccccagcaaccccagggtcttctttgatgtggacatcggcggggagcgggtgggccgcatcgtgctggagctgtttgctgacatcgtgcccaagacagctgagaacttccgggccctgtgcacaggagagaagggcatcggccacaccaccgggaagcccctgcacttcaagggctgccccttccaccgcatcatcaagaagttcatgatccagggcggggacttcagcaaccagaatggaactggaggagagagcatctatggagagaagtttgaagatgagaacttccactacaagcatgaccgggagggcctgctgtccatggccaatgccggcaggaacaccaacggcagccagttcttcatcaccaccgtgcccaccccccacctggatggcaagcacgtggtgtttggccaggtgatcaagggcatcggcgtggcccgcatcctggagaatgtggaggtgaagggggagaagccagccaagctgtgtgtgattgctgaatgtggggagctgaaggagggagatgatggcggcatcttccccaaggatggcagcggggacagccacccagacttcccagaagatgctgacatcgacctgaaggatgtggacaagatcctgctgatcacagaggacctgaagaacatcggcaacaccttcttcaagagccagaactgggagatggccatcaagaagtatgcagaggtgctgcgctacgtggacagcagcaaggccgtcatcgagacagctgaccgggccaagctgcagcccatcgccctgagctgtgtgctgaacattggagcctgcaagctgaagatgagcaactggcagggcgccatcgacagctgcctggaggccctggagctggaccccagcaacaccaaggccctgtaccgccgggcccagggctggcagggcctgaaggagtatgaccaggccctggccgacctgaagaaggcccagggcatcgcccctgaggacaaggccatccaggccgagctgctgaaggtgaagcagaagatcaaggcccagaaggacaaggagaaggctgtgtatgccaagatgtttgcctag

SEQ ID NO: 163511 - DNA, 597 bp, Artificial Sequence
  Description of Artificial Sequence: Synthetic coding sequence
atggatgccatcctgaactacagaagtgaggacacagaggactactacaccctgctgggctgtgatgagctgagctctgtggagcagatcctggccgagttcaaggtgcgggccctggagtgccacccagacaagcaccctgagaaccccaaggctgtggagaccttccagaagctgcagaaggccaaggagatcctgaccaatgaggagagccgggcccgctatgaccactggaggaggagccagatgtccatgcccttccagcagtgggaggccctgaatgacagcgtgaagacctccatgcactgggtggtgcggggcaagaaggacctgatgctggaggagagtgacaagacccacaccaccaagatggagaatgaggagtgcaatgagcagcgggagaggaagaaggaggagctggccagcacagctgagaagacagagcagaaggagcccaagcccctggagaagtctgtgagcccccagaacagcgacagcagcggctttgctgatgtgaatggctggcacctgcgcttccgctggagcaaggatgcccccagcgagctgctgaggaagttcaggaactatgagatctag

SEQ ID NO: 163512 - DNA, 468 bp, Artificial Sequence
  Description of Artificial Sequence: Synthetic coding sequence
atgctggccctgcgctgtggcagccgctggctgggcctgctgtctgtgcccaggtctgtgcccctgcggctgcctgctgcccgggcctgcagcaagggcagcggggaccccagcagcagcagcagcagcggcaaccccctggtgtacctggatgtggatgccaacgggaagcccctgggccgggtggtgctggagctgaaggcagatgtggtgcccaagacagctgagaacttccgggccctgtgcacaggagagaagggcttcggctacaagggcagcaccttccacagggtcatccccagcttcatgtgccaggccggggacttcaccaaccacaatggaactggaggcaagagcatctacggcagccgcttcccagatgagaacttcaccctgaagcacgtgggccctggctggatggcctccatgctgtgcagcgtgaccagcaagagggcctggaccagctag

SEQ ID NO: 163513 - DNA, 498 bp, Artificial Sequence
  Description of Artificial Sequence: Synthetic coding sequence
tgaagcagcagcagcagcagcggcaaccccctggtgtacctggatgtggatgccaacgggaagcccctgggccgggtggtgctggagctgaaggcagatgtggtgcccaagacagctgagaacttccgggccctgtgcacaggagagaagggcttcggctacaagggcagcaccttccacagggtcatccccagcttcatgtgccaggccggggacttcaccaaccacaatggaactggaggcaagagcatctacggcagccgcttcccagatgagaacttcaccctgaagcacgtgggccctggggtgctgtccatggccaatgccggccccaacaccaacggcagccagttcttcatctgcaccatcaagacagactggagcatggccctggatgacatcgccctgcactgctgcagccctggcagccctgtgctgaccggctggatggcctccatgctgtgcagcgtgaccagcaagagggcctggaccagctag

SEQ ID NO: 163514 - DNA, 2265 bp, Artificial Sequence
  Description of Artificial Sequence: Synthetic coding sequence
atgggcatcaaggtgcagaggccccgctgcttctttgacatcgccatcaacaaccagcctgctggccgggtggtgtttgagctgttcagtgatgtgtgccccaagacctgtgagaacttccgctgcctgtgcacaggagagaagggcaccgggaagagcacccagaagcccctgcactacaagagctgcctcttccaccgggtggtgaaggacttcatggtgcagggcggggacttcagcgagggcaatggccggggcggggagagcatctatggaggcttctttgaagatgagagctttgctgtgaagcacaacaaggagttcctgctgtccatggccaacagaggcaaggacaccaacggcagccagttcttcatcaccaccaagcccaccccccacctggatggccaccacgtggtgtttggccaggtgatcagcggccaggaggtggtgcgggagattgagaaccagaagacagatgctgccagcaagccctttgctgaggtgcgcatcctgagctgtggggagctgatccccaagagcaaggtgaagaaggaggagaagaagaggcacaagagcagcagcagcagcagcagcagcagcagtgacagcgacagcagcagtgacagccagagcagcagtgacagcagtgacagcgagagcgccacagaggagaagagcaagaagaggaagaagaagcacaggaagaacagcaggaagcacaagaaggagaagaagaagaggaagaagagcaagaagagcgccagcagcgagagcgaggccgagaacctggaggcccagccccagagcacagtgcggcctgaggagatcccccccatccctgagaaccgcttcctgatgaggaagagcccccccaaggcagatgagaaggagaggaagaaccgggagcgggagcgggagcgggagtgcaacccccccaacagccagcctgccagctaccagaggcggctgctggtgaccaggagcggcaggaagatcaagggccggggcccccggcgctaccgcacccccagccgcagccgcagccgggaccgcttccgccgctctgagaccccaccccactggaggcaggagatgcagagggcccagaggatgagggtgagcagcggggagcgctggatcaagggggacaagtctgagctgaatgagatcaaggagaaccagaggagccctgtgcgggtgaaggagaggaagatcacagaccacagaaatgtgtctgagagccccaacaggaagaatgagaaggagaagaaggtgaaggaccacaagagcaacagcaaggagcgggacatcagaagaaacagcgagaaggatgacaagtacaagaacaaggtgaagaagagggccaagagcaagagccgcagcaagagcaaggagaagagcaagagcaaggagcgggacagcaagcacaacagaaatgaggagaagaggatgaggagccgcagcaagggccgggaccatgaaaatgtgaaggagaaggagaagcagagcgacagcaagggcaaggaccaggagaggagccgcagcaaggagaagagcaagcagctggagagcaagagcaatgaacatgaccacagcaagagcaaggagaaggaccggcgggcccagagccgcagccgggagtgtgacatcaccaagggcaagcacagctacaacagcaggacccgggagaggagccgcagccgggacaggagcagaagagtgcgcagcaggacccatgaccgggacaggagccgcagcaaggagtaccaccgctaccgggagcaggagtacagaagaagaggccgcagccgcagccgggagaggaggaccccacctggccgcagccgcagcaaggacagaagaagaagaagaagagacagccgcagcagcgagcgggaggagagccagagcaggaacaaggacaagtacagaaaccaggagagcaagagcagccacaggaaggagaacagcgagagcgagaagaggatgtacagcaagagccgggaccacaacagcagcaacaacagccgggagaagaaggctgaccgggaccagagccccttcagcaagatcaagcagagcagccaggacaatgagctgaagagctccatgctgaagaacaaggaggatgagaagatccgcagctctgtggagaaggagaaccagaagagcaagggccaggagaatgaccacgtgcatgagaagaacaagaagtttgaccacgagagcagccctggaacagatgaggacaagtctggatag

SEQ ID NO: 163515 - DNA, 741 bp, Artificial Sequence
  Description of Artificial Sequence: Synthetic coding sequence
atgggcatcaaggtgcagaggccccgctgcttctttgacatcgccatcaacaaccagcctgctggccgggtggtgtttgagctgttcagtgatgtgtgccccaagacctgtgagaacttccgctgcctgtgcacaggagagaagggcaccgggaagagcacccagaagcccctgcactacaagagctgcctcttccaccgggtggtgaaggacttcatggtgcagggcggggacttcagcgagggcaatggccggggcggggagagcatctatggaggcttctttgaagatgagagctttgctgtgaagcacaacaaggagttcctgctgtccatggccaacagaggcaaggacaccaacggcagccagttcttcatcaccaccaagcccaccccccacctggatggccaccacgtggtgtttggccaggtgatcagcggccaggaggtggtgcgggagattgagaaccagaagacagatgctgccagcaagccctttgctgaggtgcgcatcctgagctgtggggagctgatccccaagagcaaggtgaagaaggaggagaagaagaggcacaagagcagcagcagcagcagcagcagcagcagtgacagcgacagcagcagtgacagccagagcagcagtgacagcagtgacagcgagagcgccacagaggagaagagcaagaagaggaagaagaagcacaggaagaacagcaggaagcacaagaaggagaagaagtag

SEQ ID NO: 163516 - DNA, 180 bp, Artificial Sequence
  Description of Artificial Sequence: Synthetic coding sequence
atgggcatcaaggtgcagaggccccgctgcttctttgacatcgccatcaacaaccagcctgctggccgggtggtgtttgagctgttcagtgatgtgtgccccaagacctgtgagaacttccgctgcctgtgcacaggagagaagggcaccgggaagagcacccagaagcccctgcactag

SEQ ID NO: 163517 - DNA, 2265 bp, Artificial Sequence; identical to SEQ ID NO: 163514
  Description of Artificial Sequence: Synthetic coding sequence

SEQ ID NO: 163518 - DNA, 1347 bp, Artificial Sequence
  Description of Artificial Sequence: Synthetic coding sequence
atgggcatcaaggtgcagaggccccgctgcttctttgacatcgccatcaacaaccagcctgctggccgggtggtgtttgagctgttcagtgatgtgtgccccaagacctgtgagaacttccgctgcctgtgcacaggagagaagggcaccgggaagagcacccagaagcccctgcactacaagagctgcctcttccaccgggtggtgaaggacttcatggtgcagggcggggacttcagcgagggcaatggccggggcggggagagcatctatggaggcttctttgaagatgagagctttgctgtgaagcacaacaaggagttcctgctgtccatggccaacagaggcaaggacaccaacggcagccagttcttcatcaccaccaagcccaccccccacctggatggccaccacgtggtgtttggccaggtgatcagcggccaggaggtggtgcgggagattgagaaccagaagacagatgctgccagcaagccctttgctgaggtgcgcatcctgagctgtggggagctgatccccaagagcaaggtgaagaaggaggagaagaagaggcacaagagcagcagcagcagcagcagcagcagcagtgacagcgacagcagcagtgacagccagagcagcagtgacagcagtgacagcgagagcgccacagaggagaagagcaagaagaggaagaagaagcacaggaagaacagcaggaagcacaagaaggagaagaagaagaggaagaagagcaagaagagcgccagcagcgagagcgaggccgagaacctggaggcccagccccagagcacagtgcggcctgaggagatcccccccatccctgagaaccgcttcctgatgaggaagagcccccccaaggcagatgagaaggagaggaagaaccgggagcgggagcgggagcgggagtgcaacccccccaacagccagcctgccagctaccagaggcggctgctggtgaccaggagcggcaggaagatcaagggccggggcccccggcgctaccgcacccccagccgcagccgcagccgggaccgcttccgccgctctgagaccccaccccactggaggcaggagatgcagagggcccagaggatgagggtgagcagcggggagcgctggatcaagggggacaagtctgagctgaatgagatcaaggagaaccagaggagccctgtgcgggtgaaggagaggaagatcacagaccacagaaatgtgtctgagagccccaacaggaagaatgagaaggagaagaaggtgaaggaccacaagagcaacagcaaggagcgggacatccggaggaagaagaagaagaagaagaagaagtag

SEQ ID NO: 163519 - DNA, 534 bp, Artificial Sequence
  Description of Artificial Sequence: Synthetic coding sequence
atggctgtggccaacagcagccctgtgaaccctgtggtgttctttgatgtgtccattggaggccaggaggtgggccgcatgaagattgagctgtttgctgatgtggtgcccaagacagctgagaacttccggcagttctgcaccggggagttcaggaaggatggagtgcccatcggctacaagggcagcaccttccacagggtcatcaaggacttcatgatccagggcggggactttgtgaatggagatggcactggagtggccagcatctaccggggcccctttgctgatgagaacttcaagctgcggcacagcgcccctggcctgctgtccatggccaacagcggccccagcaccaacggctgccagttcttcatcacctgcagcaaatgtgactggctggatggcaagcacgtggtgtttgggaagatcattgatggcctgctggtgatgaggaagattgaaaatgtgcccaccggccccaacaacaagcccaagctgcctgtggtgatcagccagtgtggggagatgtag

SEQ ID NO: 163520 - DNA, 174 bp, Artificial Sequence
  Description of Artificial Sequence: Synthetic coding sequence
atgaagattgagctgtttgctgatgtggtgcccaagacagctgagaacttccggcagttctgcaccggggagttccgctctgtgtctgatgtgtttgacttctttgcctgcagccggggcgtcttctggggctgcagcgagggcattggagagcccccagctggcctggagtag

SEQ ID NO: 163521 - DNA, 405 bp, Artificial Sequence
  Description of Artificial Sequence: Synthetic coding sequence
atgattgctggggacagcgacaggaggaaggatggagtgcccatcggctacaagggcagcaccttccacagggtcatcaaggacttcatgatccagggcggggactttgtgaatggagatggcaccggggtggccagcatctaccggggcccctttgctgatgagaacttcaagctgcggcacagcgcccctggcctgctgtccatggccaacagcggccccagcaccaacggctgccagttcttcatcacctgcagcaaatgtgactggctggatggcaagcacgtggtgtttgggaagatcattgatggcctgctggtgatgaggaagattgaaaatgtgcccaccggccccaacaacaagcccaagctgcctgtggtgatcagccagtgtggggagatgtag

SEQ ID NO: 163522 - DNA, 207 bp, Artificial Sequence
  Description of Artificial Sequence: Synthetic coding sequence
atggtgaactggaagggcctggtgctgcctgctgtgacccccagcctcttcctgtttggctacaggaaggatggagtgcccatcggctacaagggcagcaccttccacagggtcatcaaggacttcatgatccagggcggggactttgtgaatgtgtccaccatccccttcctgagcaagaccaggagcttctccttctgctgctag

SEQ ID NO: 163523 - DNA, 435 bp, Artificial Sequence
  Description of Artificial Sequence: Synthetic coding sequence
atgaagattgagctgtttgctgatgtggtgcccaagacagctgagaacttccggcagttctgcaccggggagttcaggaaggatggagtgcccatcggctacaagggcagcaccttccacagggtcatcaaggacttcatgatccagggcggggactttgtgaatggagatggcactggagtggccagcatctaccggggcccctttgctgatgagaacttcaagctgcggcacagcgcccctggcctgctgtccatggccaacagcggccccagcaccaacggctgccagttcttcatcacctgcagcaaatgtgactggctggatggcaagcacgtggtgtttgggaagatcattgatggcctgctggtgatgaggaagattgaaaatgtgcccaccggccccaacaacaagcccaagctgcctgtggtgtag

SEQ ID NO: 163524 - DNA, 405 bp, Artificial Sequence; identical to SEQ ID NO: 163521
  Description of Artificial Sequence: Synthetic coding sequence

SEQ ID NO: 163525 - DNA, 540 bp, Artificial Sequence
  Description of Artificial Sequence: Synthetic coding sequence
atgcccagcaagagcctggtgatggagtacctggcccaccccagcaccctgggcctggccgtgggcgtggcctgtggcatgtgcctgggctggagcctgcgggtgtgcttcggcatgctgcccaagagcaagaccagcaagacccacacagacacagagagcgaggccagcatcctgggggacagcggggagtacaagatgatcctggtggtgagaaatgacctgaagatgggcaagggcaaggtggccgcccagtgcagccatgctgctgtgtctgcctacaagcagatccagaggaggaaccctgagatgctgaagcagtgggagtactgcggccagcccaaggtggtggtgaaggccccagatgaggagaccctgattgccctgctggcccacgccaagatgctgggcctgactgtgtccctcatccaggatgctggccgcacccagatcgcccctggcagccagacagtgctgggcatcggccctggccctgctgacctgattgacaaggtgacaggccacctgaagctgtactag

SEQ ID NO: 163526 - DNA, 543 bp, Artificial Sequence
  Description of Artificial Sequence: Synthetic coding sequence
atgatgcccagcaagagcctggtgatggagtacctggcccaccccagcaccctgggcctggccgtgggcgtggcctgtggcatgtgcctgggctggagcctgcgggtgtgcttcggcatgctgcccaagagcaagaccagcaagacccacacagacacagaaagtgaggccagcatcctgggggacagcggggagtacaagatgatcctggtggtgagaaatgacctgaagatgggcaagggcaaggtggccgcccagtgcagccacgccgctgtgtctgcctacaagcagatccagaggagaaatcctgagatgctgaagcagtgggagtactgcggccagcccaaggtggtggtgaaggccccagatgaggagaccctcatcgccctgctggcccacgccaagatgctgggcctgactgtgtccctcatccaggatgctggccgcacccagatcgcccctggcagccagacagtgctgggcatcggccctggccctgctgacctgattgacaaggtgacaggccacctgaagctgtactag

SEQ ID NO: 163527 - DNA, 540 bp, Artificial Sequence; identical to SEQ ID NO: 163525
  Description of Artificial Sequence: Synthetic coding sequence

SEQ ID NO: 163528 - DNA, 1668 bp, Artificial Sequence
  Description of Artificial Sequence: Synthetic coding sequence
atggccgcccggctgctgctgctgggcatcctgctgctgctgctgcccctgcctgtgcctgccccctgccacacagctgcccggtctgagtgcaagaggagccacaagtttgtgcctggggcctggctggccggggagggcgtggatgtgaccagcctgcggcgcagcggcagcttccctgtggacacccagcgcttcctgcggccagatggcacctgcaccctgtgtgaaaatgccctgcaggagggcaccctgcagaggctgcccctggccctgaccaactggagggcccagggcagcggctgccagagacatgtgacccgggccaaggtgagcagcacagaggccgtggccagagatgctgcccggagcatcagaaatgactggaaggtgggcctggatgtgacccccaagcccaccagcaatgtgcacgtgtctgtggccggcagccacagccaggccgccaactttgctgcccagaagacccaccaggaccagtacagcttcagcacagacacagtggagtgccgcttctacagcttccacgtggtgcacaccccacccctgcacccagacttcaagagggccctgggggacctgccccaccacttcaatgccagcacccagcctgcctacctgcggctcatcagcaactacggcacccacttcatccgggctgtggagctgggcggccgcatcagcgccctgacagccctgcggacctgtgagctggccctggagggcctgacagacaatgaggtggaggactgcctgactgtggaggcccaggtgaacatcggcatccacggcagcatctctgctgaggccaaggcctgtgaggagaagaagaagaagcacaagatgacagccagcttccaccagacctaccgggagcggcacagcgaggtggtgggcggccaccacaccagcatcaatgacctgctgtttggcatccaggccggccctgagcagtacagcgcctgggtgaacagcctgcccggcagccctggcctggtggactacaccctggagcccctgcacgtgctgctggacagccaggacccccggcgggaggccctgcggcgggccctgagccagtacctgacagaccgggcccgctggagggactgcagccggccctgccccccaggccggcagaagagcccccgggacccctgccagtgtgtgtgccacggcagcgctgtgaccacccaggactgctgcccccggcagaggggcctggcccagctggaggtgaccttcatccaggcctggggcctgtggggagactggttcaccgccacagatgcctacgtgaagctgttctttggaggccaggagctgcggaccagcacagtgtgggacaacaacaaccccatctggagcgtgcggctggactttggagatgtgctgctggccaccggcggccccctgcggctgcaggtgtgggaccaggacagcggcagagatgatgacctgctgggcacctgtgaccaggcccccaagagcggcagccatgaggtgcgctgcaacctgaaccacggccacctgaagttccgctaccacgcccgctgcctgccccacctgggcggcggcacctgcctggactatgtgccccagatgctgctgggggagcccccaggcaacagaagtggagctgtgtggtag

SEQ ID NO: 163529 - DNA, 1668 bp, Artificial Sequence; identical to SEQ ID NO: 163528
  Description of Artificial Sequence: Synthetic coding sequence

SEQ ID NO: 163530 - DNA, 1668 bp, Artificial Sequence; identical to SEQ ID NO: 163528
  Description of Artificial Sequence: Synthetic coding sequence

SEQ ID NO: 163531 - DNA, 444 bp, Artificial Sequence
  Description of Artificial Sequence: Synthetic coding sequence
atggaggcccggagccgctctgctgaggagctgcggcgggcagagctggtggagatcatcgtggagacagaggcccagacaggagtgtctggcatcaacgtggccggcggcggcaaggagggcatctttgtgcgggagctgcgggaggacagccctgctgcccggagcctgagcctgcaggagggggaccagctgctgagcgcccgggtcttctttgagaacttcaagtatgaagatgccctgcggctgctgcagtgtgccgagccctacaaggtgtccttctgcctgaagaggacagtgcccaccggggacctggccctgcggcccggcaccgtgtctggctatgagatcaagggcccccgggccaaggtggccaagctggtgcgggtgctgagccctgccccagccctggactgccccagcgaccctgtgtctgccccctag

SEQ ID NO: 163532 - DNA, 4386 bp, Artificial Sequence
  Description of Artificial Sequence: Synthetic coding sequence
atggaggcccggagccgctctgctgaggagctgcggcgggcagagctggtggagatcatcgtggagacagaggcccagacaggagtgtctggcatcaacgtggccggcggcggcaaggagggcatctttgtgcgggagctgcgggaggacagccctgctgcccggagcctgagcctgcaggagggggaccagctgctgagcgcccgggtcttctttgagaacttcaagtatgaagatgccctgcggctgctgcagtgtgccgagccctacaaggtgtccttctgcctgaagaggacagtgcccaccggggacctggccctgcggcccggcaccgtgtctggctatgagatcaagggcccccgggccaaggtggccaagctgaacatccagagcctgagccctgtgaagaagaagaagatggtgcctggggccctgggcgtgcctgctgacctggcccctgtggatgtggagttctccttccccaagttcagccggctgcggcggggcctgaaggccgaggccgtgaagggccctgtgcctgctgccccagcccggcggcggctgcagctgccccggctgcgggtgcgggaggtggccgaggaggcccaggccgcccggctggccgccgccgcccccccacccaggaaggccaaggtggaggccgaggtggccgccggggcccgcttcaccgccccccaggtggagctggtgggcccccggctgcccggggctgaggtgggcgtgccccaggtgtctgcccccaaggccgcccccagcgctgaggccgccggcggctttgccctgcacctgcccaccctgggcctgggcgccccagcccccccagctgtggaggccccagctgtgggcatccaggtgccccaggtggagctgcctgccctgcccagcctgcccaccctgcccaccctgccctgcctggagacccgggagggcgctgtgtctgtggtggtgcccaccctggatgtggccgcccccaccgtgggcgtggacctggccctgcccggggctgaggtggaggcccggggggaggcccctgaggtggccctgaagatgccccggctgtccttccccaggtttggagcccgggccaaggaggtggccgaggccaaggtggccaaggtgtccccagaggcccgggtgaagggcccccggctgaggatgcccaccttcggcctgagcctgctggagcccaggcctgctgcccctgaggtggtggagagcaagctgaagctgcccaccatcaagatgcccagcctgggcattggagtgtctggccctgaggtgaaggtgcccaagggccctgaggtgaagctgcccaaggcccctgaggtgaagctgcccaaggtgcctgaggccgccctgcctgaggtgcggctgcctgaggtggagctgcccaaggtgtctgagatgaagctgcccaaggtgcctgagatggctgtgcctgaggtgcggctgcctgaggtggagctgcccaaggtgtctgagatgaagctgcccaaggtgcctgagatggctgtgcctgaggtgcggctgcctgaggtgcagctgctgaaggtgtctgagatgaagctgcccaaggtgcctgagatggctgtgcctgaggtgcggctgcctgaggtgcagctgcccaaggtgtctgagatgaagctgcctgaggtgtctgaggtggccgtgcctgaggtgcggctgcctgaggtgcagctgcccaaggtgcctgagatgaaggtgcctgagatgaagctgcccaaggtgcctgagatgaagctgcctgagatgaagctgcctgaggtgcagctgcccaaggtgcctgagatggctgtgcctgatgtgcacctgcctgaggtgcagctgcccaaggtgcctgagatgaagctgcctgagatgaagctgcctgaggtgaagctgcccaaggtgcctgagatggctgtgcctgatgtgcacctgcctgaggtgcagctgcccaaggtgcctgagatgaagctgcccaagatgcctgagatggctgtgcctgaggtgcggctgcctgaggtgcagctgcccaaggtgtctgagatgaagctgcccaaggtgcctgagatggctgtgcctgatgtgcacctgcctgaggtgcagctgcccaaggtgtgtgagatgaaggtgcctgacatgaagctgcctgagatcaagctgcccaaggtgcctgagatggctgtgcctgatgtgcacctgcctgaggtgcagctgcccaaggtgtctgagatccggctgcctgagatgcaggtgcccaaggtgcctgatgtgcacctgcccaaggcccctgaggtgaagctgccccgggcccctgaggtgcagctgaaggccaccaaggccgagcaggccgagggcatggagtttggcttcaagatgcccaagatgaccatgcccaagctgggccgggcagagagccccagccggggcaagccaggagaggccggggctgaggtgtctgggaagctggtgaccctgccctgcctgcagcctgaggtggatggagaggcccacgtgggcgtgcccagcctgaccctgcccagcgtggagctggacctgcccggggccctgggcctgcagggccaggtgcctgctgccaagatgggcaagggggagcgggtggagggccctgaggtggccgccggcgtgcgggaggtgggcttccgggtgcccagcgtggagatcgtgaccccccagctgcctgctgtggagattgaggagggccgcctggagatgattgagaccaaggtgaagcccagcagcaagttcagcctgcccaagtttggcctgagcggccccaaggtggccaaggccgaggccgagggcgccggccgggccaccaagctgaaggtgtccaagtttgccatcagcctgcccaaggcccgggtgggcgctgaggccgaggccaagggggccggggaggccggcctgctgcctgccctggacctgagcatcccccagctgagcctggatgcccacctgcccagcggcaaggtggaggtggccggggctgacctgaagttcaagggccccaggtttgccctgcccaagtttggagtgcggggccgggacacagaagctgctgagctggtgcctggggtggccgagctggagggcaagggctggggctgggatggccgggtgaagatgcccaagctgaagatgcccagctttggcctggcccggggcaaggaggccgaggtgcagggcgaccgggccagccctggagagaaggccgagagcacagctgtgcagctgaagatccctgaggtggagctggtgaccctgggcgcccaggaggagggccgggcagagggcgctgtggccgtgtctggcatgcagctgagcggcctgaaggtgtccacagctggccaggtggtgacagagggccatgatgctggcctgaggatgccacccctgggcatcagcctgccccaggtggagctgaccggctttggagaggccggcaccccaggccagcaggcccagagcacagtgcccagcgctgagggcacagctggctacagagtgcaggtgccccaggtgaccctgagcctgcccggggcccaggtggccggcggggagctgctggtgggggagggcgtcttcaagatgcccaccgtgacagtgccccagctggagctggatgtgggcctgagccgggaggcccaggccggggaggccgccaccggggagggcggcctgcggctgaagctgcccaccctgggcgcccgggcccgggtgggcggggagggcgctgaggagcagcccccaggagctgagaggaccttctgcctgagcctgcctgatgtggagctgagccccagcggcggcaaccacgccgagtaccaggtggccgagggggagggggaggccggccacaagctgaaggtgcggctgcccaggtttggcctggtgcgggccaaggagggcgctgaggagggggagaaggccaagagccccaagctgcggctgccccgggtgggcttcagccagagcgagatggtgactggagagggcagccccagccctgaggaggaggaggaggaggaggaggagggcagcggggagggcgccagcggccggcggggccgggtgcgggtgcggctgccccgggtgggcctggccgcccccagcaaggccagccggggccaggagggagatgctgcccccaagagccctgtgcgggagaagagccccaagttccgcttcccccgggtgtccctgagccccaaggcccggagcggcagcggggaccaggaggagggcggcctgcgggtgcggctgcccagcgtgggcttcagcgagactggagcccctggccctgccaggatggagggcgcccaggccgctgctgtgtag

SEQ ID NO: 163533 - DNA, 4191 bp, Artificial Sequence
  Description of Artificial Sequence: Synthetic coding sequence
atggaggcccggagccgctctgctgaggagctgcggcgggcagagctggtggagatcatcgtggagacagaggcccagacaggagtgtctggcatcaacgtggccggcggcggcaaggagggcatctttgtgcgggagctgcgggaggacagccctgctgcccggagcctgagcctgcaggagggggaccagctgctgagcgcccgggtcttctttgagaacttcaagtatgaagatgccctgcggctgctgcagtgtgccgagccctacaaggtgtccttctgcctgaagaggacagtgcccaccggggacctggccctgcggcccggcaccgtgtctggctatgagatcaagggcccccgggccaaggtggccaagctgaacatccagagcctgagccctgtgaagaagaagaagatggtgcctggggccctgggcgtgcctgctgacctggcccctgtggatgtggagttctccttccccaagttcagccggctgcggcggggcctgaaggccgaggccgtgaagggccctgtgcctgctgccccagcccggcggcggctgcagctgccccggctgcgggtgcgggaggtggccgaggaggcccaggccgcccggctggccgccgccgcccccccacccaggaaggccaaggtggaggccgaggtggccgccggggcccgcttcaccgccccccaggtggagctggtgggcccccggctgcccggggctgaggtgggcgtgccccaggtgtctgcccccaaggccgcccccagcgctgaggccgccggcggctttgccctgcacctgcccaccctgggcctgggcgccccagcccccccagctgtggaggccccagctgtgggcatccaggtgccccaggtggagctgcctgccctgcccagcctgcccaccctgcccaccctgccctgcctggagacccgggagggcgctgtgtctgtggtggtgcccaccctggatgtggccgcccccaccgtgggcgtggacctggccctgcccggggctgaggtggaggcccggggggaggcccctgaggtggccctgaagatgccccggctgtccttccccaggtttggagcccgggccaaggaggtggccgaggccaaggtggccaaggtgtccccagaggcccgggtgaagggcccccggctgaggatgcccaccttcggcctgagcctgctggagcccaggcctgctgcccctgaggtggtggagagcaagctgaagctgcccaccatcaagatgcccagcctgggcattggagtgtctggccctgaggtgaaggtgcccaagggccctgaggtgaagctgcccaaggcccctgaggtgaagctgcccaaggtgcctgaggccgccctgcctgaggtgcggctgcctgaggtggagctgcccaaggtgtctgagatgaagctgcccaaggtgcctgagatggctgtgcctgaggtgcggctgcctgaggtggagctgcccaaggtgtctgagatgaagctgcccaaggtgcctgagatggctgtgcctgaggtgcggctgcctgaggtgcagctgctgaaggtgtctgagatgaagctgcccaaggtgcctgagatggctgtgcctgaggtgcggctgcctgaggtgcagctgcccaaggtgtctgagatgaagctgcctgaggtgtctgaggtggccgtgcctgaggtgcggctgcctgaggtgcagctgcccaaggtgcctgagatgaaggtgcctgagatgaagctgcccaaggtgcctgagatgaagctgcctgagatgaagctgcctgaggtgcagctgcccaaggtgcctgagatggctgtgcctgatgtgcacctgcctgaggtgcagctgcccaaggtgcctgagatgaagctgcctgagatgaagctgcctgaggtgaagctgcccaaggtgcctgagatggctgtgcctgatgtgcacctgcctgaggtgcagctgcccaaggtgcctgagatgaagctgcccaagatgcctgagatggctgtgcctgaggtgcggctgcctgaggtgcagctgcccaaggtgtctgagatgaagctgcccaaggtgcctgagatggctgtgcctgatgtgcacctgcctgaggtgcagctgcccaaggtgtgtgagatgaaggtgcctgacatgaagctgcctgagatcaagctgcccaaggtgcctgagatggctgtgcctgatgtgcacctgcctgaggtgcagctgcccaaggtgtctgagatccggctgcctgagatgcaggtgcccaaggtgcctgatgtgcacctgcccaaggcccctgaggtgaagctgccccgggcccctgaggtgcagctgaaggccaccaaggccgagcaggccgagggcatggagtttggcttcaagatgcccaagatgaccatgcccaagctgggccgggcagagagccccagccggggcaagccaggagaggccggggctgaggtgtctgggaagctggtgaccctgccctgcctgcagcctgaggtggatggagaggcccacgtgggcgtgcccagcctgaccctgcccagcgtggagctggacctgcccggggccctgggcctgcagggccaggtgcctgctgccaagatgggcaagggggagcgggtggagggccctgaggtggccgccggcgtgcgggaggtgggcttccgggtgcccagcgtggagatcgtgaccccccagctgcctgctgtggagattgaggagggccgcctggagatgattgagaccaaggtgaagcccagcagcaagttcagcctgcccaagtttggcctgagcggccccaaggtggccaaggccgaggccgagggcgccggccgggccaccaagctgaaggtgtccaagtttgccatcagcctgcccaaggcccgggtgggcgctgaggccgaggccaagggggccggggaggccggcctgctgcctgccctggacctgagcatcccccagctgagcctggatgcccacctgcccagcggcaaggtggaggtggccggggctgacctgaagttcaagggccccaggtttgccctgcccaagtttggagtgcggggccgggacacagaagctgctgagctggtgcctggggtggccgagctggagggcaagggctggggctgggatggccgggtgaagatgcccaagctgaaggtgtccacagctggccaggtggtgacagagggccatgatgctggcctgaggatgccacccctgggcatcagcctgccccaggtggagctgactggatttggagaggccggcaccccaggccagcaggcccagagcacagtgcccagcgctgagggcacagctggctacagagtgcaggtgccccaggtgaccctgagcctgcccggggcccaggtggccggcggggagctgctggtgggggagggcgtcttcaagatgcccaccgtgacagtgccccagctggagctggatgtgggcctgagccgggaggcccaggccggggaggccgccactggagagggcggcctgcggctgaagctgcccaccctgggcgcccgggcccgggtgggcggggagggcgctgaggagcagcccccaggagctgagaggaccttctgcctgagcctgcctgatgtggagctgagccccagcggcggcaaccacgccgagtaccaggtggccgagggggagggggaggccggccacaagctgaaggtgcggctgccccgcttcggcctggtgcgggccaaggagggcgctgaggagggggagaaggccaagagccccaagctgcggctgccccgggtgggcttcagccagagcgagatggtgactggagagggcagccccagccctgaggaggaggaggaggaggaggaggagggcagcggggagggcgccagcggcagaagaggccgggtgcgggtgcggctgccccgggtgggcctggccgcccccagcaaggccagccggggccaggagggagatgctgcccccaagagccctgtgcgggagaagagccccaagttccgcttcccccgggtgtccctgagccccaaggcccggagcggcagcggggaccaggaggagggcggcctgcgggtgcggctgcccagcgtgggcttcagcgagaccggggcccctggccctgccaggatggagggcgcccaggccgctgctgtgtag

SEQ ID NO: 163534 - DNA, 2214 bp, Artificial Sequence
  Description of Artificial Sequence: Synthetic coding sequence
atggaggtggagcaggagcagaggaggaggaaggtggaggccggccgcaccaagctggcccacttccggcagaggaagaccaagggggacagcagccacagcgagaagaagacagccaagaggaagggcagcgctgtggatgcctctgtgcaggaggagagccctgtgaccaaggaggacagcgccctgtgtggcggcggggacatctgcaagagcaccagctgtgatgacaccccagatggagctgggggcgcctttgctgcccagcctgaggactgtgatggagagaagcgggaggacctggagcagctgcagcagaagcaggtgaatgaccaccccccagagcagtgtggcatgttcaccgtgtctgaccaccccccagagcagcacggcatgttcaccgtgggggaccaccccccagagcagaggggcatgttcaccgtgtctgaccaccccccagagcagaggggcatgttcaccatcagtgaccaccagcctgagcagaggggcatgttcaccgtgtctgaccacaccccagagcagaggggcatcttcaccatcagtgaccaccctgctgagcagaggggcatgttcaccaaggaatgtgagcaggagtgtgagctggccatcacagacctggagagcggccgggaggatgaagctggcctgcaccagagccaggccgtgcacggcctggagctggaggccctgcggctgagcctgagcaacatgcacacagcccagctggagctgacccaggccaacctgcagaaggagaaggagacagccctgacagagctgcgggagatgctgaacagccggcgggcccaggagctggccctgctgcagagccggcagcagcacgagctggagctgctgcgggagcagcacgcccgggagaaggaggaggtggtgctgcgctgtggccaggaggccgctgagctgaaggagaagctgcagagcgagatggagaagaatgcccagatcgtgaagaccctgaaggaggactgggagagcgagaaggacctgtgcctggagaacctgaggaaggagctgagcgccaagcaccagagcgagatggaggacctgcagaaccagttccagaaggagctggccgagcagagagctgagctggagaagatcttccaggacaagaaccaggccgagcgggccctgaggaacctggagagccaccaccaggccgccatcgagaagctgcgggaggacctgcagagcgagcacggccgctgcctggaggacctggagttcaagttcaaggagagcgagaaggagaagcagctggagctggagaacctgcaggccagctatgaggacctgaaggcccagagccaggaggagatccggcggctgtggagccagctggacagcgcccggaccagccggcaggagctgtctgagctgcacgagcagctgctggcccggaccagccgggtggaggacctggagcagctgaagcagcgggagaagacccagcatgaaagtgagctggagcagctgcgcatctactttgagaagaagctgagagatgctgagaagacctaccaggaggacctgaccctgctgcagcagaggctgcagggcgccagagaagatgccctgctggacagcgtggaggtgggcctgagctgtgtgggcctggaggagaagccagagaagggcaggaaggaccacgtggatgagctggagcctgagcggcacaaggagagcctgccccgcttccaggccgagctggaggagagccaccgccaccagctggaggccctggagagccccctgtgcatccagcacgagggccacgtgtctgaccgctgctgcgtggagaccagcgccctgggccacgagtggaggctggagcccagcgagggccacagccaggagctgccctgggtgcacctgcagggcgtgcaggatggagacctggaggccgacacagagcgggccgcccgggtgctgggcctggagacagagcacaaggtgcagctgagcctgctgcagacagagctgaaggaggagattgagctgctgaagattgaaaatagaaacctgtatggcaagctgcagcacgagacccggctgaaggatgacctggagaaggtgaagcacaacctgattgaggaccaccagaaggagctgaacaatgccaagcagaagacagagctgatgaagcaggagttccagaggaaggagacctag

SEQ ID NO: 163535 - DNA, 10011 bp, Artificial Sequence
  Description of Artificial Sequence: Synthetic coding sequence
atggaggtggagcaggagcagaggaggaggaaggtggaggccggccgcaccaagctggcccacttccggcagaggaagaccaagggggacagcagccacagcgagaagaagacagccaagaggaagggcagcgctgtggatgcctctgtgcaggaggagagccctgtgaccaaggaggacagcgccctgtgtggcggcggggacatctgcaagagcaccagctgtgatgacaccccagatggagctgggggcgcctttgctgcccagcctgaggactgtgatggagagaagcgggaggacctggagcagctgcagcagaagcaggtgaatgaccaccccccagagcagtgtggcatgttcaccgtgtctgaccaccccccagagcagcacggcatgttcaccgtgggggaccaccccccagagcagaggggcatgttcaccgtgtctgaccaccccccagagcagcacggcatgttcaccgtgtctgaccaccccccagagcagaggggcatgttcaccatcagtgaccaccagcctgagcagaggggcatgttcaccgtgtctgaccacaccccagagcagaggggcatcttcaccatcagtgaccaccctgctgagcagaggggcatgttcaccaaggaatgtgagcaggagtgtgagctggccatcacagacctggagagcggcagagaagatgaggccggcctgcaccagagccaggccgtgcacggcctggagctggaggccctgcggctgagcctgagcaacatgcacacagcccagctggagctgacccaggccaacctgcagaaggagaaggagacagccctgacagagctgcgggagatgctgaacagcagaagagcccaggagctggccctgctgcagagccggcagcagcacgagctggagctgctgcgggagcagcacgcccgggagaaggaggaggtggtgctgcgctgtggccaggaggccgctgagctgaaggagaagctgcagagcgagatggagaagaatgcccagatcgtgaagaccctgaaggaggactgggagagcgagaaggacctgtgcctggagaacctgaggaaggagctgagcgccaagcaccagagcgagatggaggacctgcagaaccagttccagaaggagctggccgagcagagagctgagctggagaagatcttccaggacaagaaccaggccgagcgggccctgaggaacctggagagccaccaccaggccgccatcgagaagctgcgggaggacctgcagagcgagcacggccgctgcctggaggacctggagttcaagttcaaggagagcgagaaggagaagcagctggagctggagaacctgcaggccagctatgaggacctgaaggcccagagccaggaggagatccggcggctgtggagccagctggacagcgcccggaccagccggcaggagctgtctgagctgcacgagcagctgctggcccggaccagccgggtggaggacctggagcagctgaagcagcgggagaagacccagcacgagagcgagctggagcagctgcgcatctactttgagaagaagctgagagatgctgagaagacctaccaggaggacctgaccctgctgcagcagaggctgcagggcgcccgggaggatgccctgctggacagcgtggaggtgggcctgagctgtgtgggcctggaggagaagccagagaagggcaggaaggaccacgtggatgagctggagcctgagcggcacaaggagagcctgccccgcttccaggccgagctggaggagagccaccgccaccagctggaggccctggagagccccctgtgcatccagcacgagggccacgtgtctgaccgctgctgcgtggagaccagcgccctgggccacgagtggaggctggagcccagcgagggccacagccaggagctgccctgggtgcacctgcagggcgtgcaggatggagacctggaggccgacacagaaagagctgcccgggtgctgggcctggagacagagcacaaggtgcagctgagcctgctgcagacagagctgaaggaggagattgagctgctgaagattgagaacagaaacctgtatggcaagctgcagcacgagacccggctgaaggatgacctggagaaggtgaagcacaacctgattgaggaccaccagaaggagctgaacaatgccaagcagaagacagagctgatgaagcaggagttccagaggaaggagacagactggaaggtgatgaaggaggagctgcagcgggaggccgaggagaagctgaccctgatgctgctggagctgcgggagaaggccgagagcgagaagcagaccatcatcaacaagtttgagctgcgggaggccgagatgaggcagctgcaggaccagcaggccgcccagatcctggacctggagaggagcctgacagagcagcagggccgcctgcagcagctggagcaggacctgaccagtgatgatgccctgcactgcagccagtgtggccgggagcccccaacagcccaggatggagagctggccgccctgcacgtgaaggaggactgtgccctgcagctgatgctggcccggagccgcttcctggaggagaggaaggagatcacagagaagttctctgctgagcaggatgccttcctgcaggaggcccaggagcagcacgcccgggagctgcagctgctgcaggagcggcaccagcagcagctgctgtctgtgacagctgagctggaggcccggcaccaggccgccctgggggagctgacagccagcctggagagcaagcagggcgccctgctggccgcccgggtggccgagctgcagaccaagcacgccgctgacctgggcgccctggagaccaggcacctgagcagcctggacagcctggagagctgctacctgtctgagttccagaccatccgggaggagcaccggcaggccctggagctgctgcgggctgactttgaggagcagctgtggaagaaggacagcctgcaccagaccatcctgacccaggagctggagaagctgaagaggaagcatgaaggagagctgcagagcgtgcgggaccacctgaggacagaggtgtccacagagctggccggcaccgtggcccacgagctgcagggcgtgcaccagggcgagtttggcagcgagaagaagacagccctgcacgagaaggaggagaccctgcggctgcagagcgcccaggcccagcccttccaccaggaggagaaggagagcctgagcctgcagctgcagaagaagaaccaccaggtgcagcagctgaaggaccaggtgctgagcctgagccatgaaattgaggagtgccgctctgagctggaggtgctgcagcagaggcgggagagagaaaatcgggagggcgccaacctgctgtccatgctgaaggcagatgtgaacctgagccacagcgagcggggggccctgcaggatgccctgcggcggctgctgggcctgtttggagagaccctgcgggctgctgtgaccctgcggagcagaattggagagcgggtgggcctgtgcctggatgatgctggggccggcctggccctgagcacagccccagccctggaggagacctggagcgatgtggccctgcctgagctggacaggaccctgtctgaatgtgccgagatgagctctgtggccgagatcagcagccacatgagggagagcttcctgatgagccctgagagcgtgagagaatgtgagcagcccatcagaagagtcttccagagcctgagcctggccgtggatggcctgatggagatggccctggacagcagccggcagctggaggaggcccggcagatccacagcagatttgagaaggagttctccttcaagaatgaggagacagcccaggtggtgaggaagcaccaggagctgctggagtgcctgaaggaggagagcgctgccaaggccgagctggccctggagctgcacaagacccagggcaccctggagggcttcaaggtggagacagctgacctgaaggaggtgctggccggcaaggaggacagcgagcaccggctggtgctggagctggagagcctgcggcggcagctgcagcaggccgcccaggagcaggccgccctgcgggaggagtgcacccggctgtggagcagaggagaggccacagccacagatgctgaggcccgggaggccgccctgaggaaggaggtggaggacctgaccaaggagcagagcgagaccaggaagcaggccgagaaggacagaagtgccctgctgagccagatgaagatcctggagagcgagctggaggagcagctgagccagcaccggggctgtgccaagcaggccgaggccgtgacagccctggagcagcaggtggccagcctggacaagcacctgaggaaccagaggcagttcatggatgagcaggccgctgagcgggagcacgagcgggaggagttccagcaggagatccagaggctggagggccagctgcggcaggccgccaagccccagccctggggcccccgggacagccagcaggcccccctggatggagaggtggagctgctgcagcagaagctgcgggagaagctggatgagttcaatgagctggccatccagaaggagagcgctgaccggcaggtgctgatgcaggaggaggagatcaagaggctggaggagatgaacatcaacatcaggaagaaggtggcccagctgcaggaggaggtggagaagcagaagaacatcgtgaagggcctggagcaggacaaggaggtgctgaagaagcagcagatgagcagcctgctgctggccagcaccctgcagagcaccctggatgctggccgctgcccagagccccccagcggcagccccccagagggccctgagatccagctggaggtgacccagagggccctgctgcggcgggagagcgaggtgctggacctgaaggagcagctggagaagatgaagggggacctggagagcaagaatgaggagatcctgcacctgaacctgaagctggacatgcagaacagccagacagctgtgtccctgcgggagctggaggaggagaacaccagcctgaaggtgatctacaccaggagcagcgagattgaggagctgaaggccaccatcgagaacctgcaggagaaccagaagaggctgcagaaggagaaggccgaggagattgagcagctgcatgaagtcatcgagaagctgcagcacgagctgagcctgatgggccctgtggtgcatgaggtgtctgacagccaggccggcagcctgcagagcgagctgctgtgcagccaggccggcggcccccggggccaggccctgcagggcgagctggaggccgccctggaggccaaggaggccctgagccggctgctggccgaccaggagaggaggcacagccaggccctggaggccctgcagcagaggctgcagggcgctgaggaggccgctgagctgcagctggccgagctggagagaaatgtggccctgcgggaggccgaggtggaggacatggccagccgcatccaggagtttgaagctgccctgaaggccaaggaggccaccatcgccgagaggaacctggagattgatgccctgaaccagaggaaggccgcccacagcgctgagctggaggccgtgctgctggccctggcccgcatccggcgggccctggagcagcagcccctggccgccggggccgcccctcctgagctgcagtggctgcgggcccagtgtgcccggctgagccggcagctgcaggtgctgcaccagcgcttcctgcgctgccaggtggagctggaccggcggcaggcccggcgggccacagcccacaccagggtgcctggggcccacccccagcccaggatggatggaggagccaaggcccaggtgactggagatgtggaggccagccatgatgctgccctggagcctgtggtgcctgacccccagggcgacctgcagcctgtgctggtgaccctgaaggatgcccccctgtgcaagcaggagggcgtgatgtctgtgctgactgtgtgccagaggcagctgcagagcgagctgctgctggtgaagaatgagatgaggctgagcctggaggatggcggcaagggcaaggagaaggtgctggaggactgccagctgcccaaggtggacctggtggcccaggtgaagcagctgcaggagaagctgaaccggctgctgtacagcatgaccttccagaatgtggatgctgctgacaccaagagcctgtggcccatggccagcgcccacctgctggagagctcctggagcgatgacagctgtgatggagaggagccagacatcagcccccacatcgacacctgtgatgccaacacagccactggaggagtgacagatgtgatcaagaaccaggccattgatgcctgtgatgccaacaccacccctgggggcgtgacagatgtgatcaagaactgggacagcctcatcccagatgagatgccagacagccccatccaggagaagtctgagtgccaggacatgagcctgagcagccccacctctgtgctgggcggcagccgccaccagagccacacagctgaggccggccccaggaagagccctgtgggcatgctggacctgagctcctggagcagccctgaggtgctgaggaaggactggaccctggagccctggcccagcctgcctgtgaccccccacagcggggccctgagcctgtgcagcgctgacaccagcctgggggacagagctgacaccagcctgccccagacccagggccctggcctgctgtgcagccctggggtgtctgctgctgccctggccctgcagtgggccgagagccccccagcagatgaccaccacgtgcagaggacagctgtggagaaggatgtggaggacttcatcaccaccagctttgacagccaggagaccctgagcagccccccacctggcctggagggcaaggctgacagaagtgagaagagtgatggcagcggctttggagcccggctgagccctggcagcggcggccctgaggcccagacagctggccctgtgaccccagccagcatcagcggccgcttccagcccctgcctgaggccatgaaggagaaggaggtgcggcccaagcacgtgaaggccctgctgcagatggtgagagatgagagccaccagatcctggccctgtctgagggcctggcccctccttctggagagccccacccccccaggaaggaggatgagatccaggacatcagcctgcatggaggcaagacccaggaggtgcccacagcctgcccagactggaggggggacctgctgcaggtggtgcaggaggcctttgagaaggagcaggagatgcagggcgtggagctgcagccccggctgagcggcagtgacctgggcggccacagcagcctgctggagcggctggagaagatcatccgggagcagggcgacctgcaggagaagagcctggagcacctgcggctgcctgacaggagcagcctgctgtctgagatccaggccctgcgggcccagctgaggatgacccacctgcagaaccaggagaagctgcagcacctgaggacagccctgaccagcgctgaggcccggggcagccagcaggagcaccagctgcggcggcaggtggagctgctggcctacaaggtggagcaggagaagtgcatcgccggggacctgcagaagaccctgtctgaggagcaggagaaggccaacagcgtgcagaagctgctggccgctgagcagacagtggtgcgggacctgaagagtgacctgtgtgagagccggcagaagtctgagcagctgagccgcagcctgtgtgaggtgcagcaggaggtgctgcagctgcgctccatgctgagcagcaaagaaaatgagctgaaggccgccctgcaggagctggagagcgagcagggcaagggccgggccctgcagagccagctggaggaggagcagctgcggcacctgcagcgggagagccagagcgccaaggccctggaggagctgcgggccagcctggagacccagagggcccagagcagccggctgtgtgtggccctgaagcatgagcagacagccaaggacaacctgcagaaggagctgcgcatcgagcacagccgctgtgaggccctgctggcccaggagaggagccagctgtctgagctgcagaaggacctggccgctgagaagagcaggaccctggagctgtctgaggccctgcggcatgagcggctgctgacagagcagctgagccagaggacccaggaggcctgtgtgcaccaggacacccaggcccaccacgccctgctgcagaagctgaaggaggagaagagccgggtggtggacctgcaggccatgctggagaaggtgcagcagcaggccctgcacagccagcagcagctggaggccgaggcccagaagcactgtgaggccctgcggcgggagaaggaggtgtctgccaccctgaagagcacagtggaggccctgcacacccagaagcgggagctgcgctgcagcctggagcgggagcgggagaagccagcctggctgcaggccgagctggagcagagccacccccggctgaaggagcaggagggcaggaaggccgcccggcgctctgctgaggcccggcagagccctgctgctgctgagcagtggaggaagtggcagagggacaaggagaagctgcgggagctggagctgcagaggcagagggacctgcacaagatcaagcagctgcagcagacagtgcgggacctggagagcaaggatgaggtgcccggcagccggctgcacctgggcagcgcccggcgggctgctggcagtgatgctgaccacctgcgggagcagcagcgggagctggaggccatgaggcagaggctgctgtctgctgcccggctgctgaccagcttcaccagccaggccgtggacagaacagtgaatgactggaccagcagcaatgagaaggctgtgatgagcctgctgcacaccctggaggagctgaagagtgacctgagccggcccaccagcagccagaagaagatggctgctgagctgcagttccagtttgtggatgtgctgctgaaggacaacgtgtccctgaccaaggccctgagcacagtgacccaggagaagctggagctgagcagagctgtgtccaagctggagaagctgctgaagcaccacctgcagaagggctgcagccccagccgctctgagaggtctgcctggaagccagatgaaacagccccccagagcagcctgcggcggccagaccccggccgcctgcccccagctgccagcgaggaggcccacaccagcaatgtgaagatggagaagctgtacctgcactacctgcgggcagagagcttcaggaaggccctgatctaccagaagaagtacctgctgctgctgattggaggcttccaggacagcgagcaggagaccctgtccatgattgcccacctgggcgtcttccccagcaaggccgagaggaagatcaccagccggcccttcacccgcttcagaacagctgtgcgggtggtgattgccatcctgcggctgcgcttcctggtgaagaagtggcaggaggtggacaggaagggggccctggcccagggcaaggcccccaggcctggcccccgggcccggcagccccagagcccccccaggacccgggagagcccccccaccagagatgtgcccagcggccacacccgggaccctgcccggggccgccgcctggccgccgccgccagcccccacagcggcggccgggccacccccagccccaacagccggctggagaggagcctgacagccagccaggaccctgagcacagcctgacagagtacatccaccacctggaggtgatccagcagaggctgggcggcgtgctgcctgacagcaccagcaagaagagctgccaccccatgatcaagcagtag

SEQ ID NO: 163536 - DNA, 6075 bp, Artificial Sequence
  Description of Artificial Sequence: Synthetic coding sequence
atggccactggaggcggcccctttgaagatggcatgaatgaccaggacctgcccaactggagcaatgaaaatgtggatgaccggctgaacaacatggactggggcgcccagcagaagaaggccaacagaagcagcgagaagaacaagaagaagtttggagtggagagtgacaagagggtgaccaatgacatcagccctgagagcagccctggggtgggcagaagaaggaccaagaccccccacaccttcccccacagccgctacatgagccagatgtctgtgcctgagcaggccgagctggagaagctgaagcagaggatcaacttcagtgacctggaccagaggagcattggaagtgacagccagggccgggccacagctgccaacaacaagaggcagctgtctgagaacaggaagcccttcaacttcctgcccatgcagatcaacaccaacaagagcaaggatgccagcaccaacccccccaaccgggagaccatcggcagcgcccagtgcaaggagctgtttgccagcgccctgagcaatgacctgctgcagaactgccaggtgtctgaggaggatggccgcggggagcccgccatggagagcagccagatcgtgtcccggctggtgcagatccgggactacatcaccaaggccagctccatgagggaggacctggtggagaagaatgaaagaagtgccaacgtggagcggctgacccacctgattgaccacctgaaggagcaggagaagagctacatgaagttcctgaagaagatcctggcccgggacccccagcaggagcccatggaggagattgagaacctgaagaagcagcacgacctgctgaagaggatgctgcagcagcaggagcagctgcgggccctgcagggccggcaggccgccctgctggccctgcagcacaaggccgagcaggccatcgctgtgatggatgacagcgtggtggccgagacagctggcagcctgagcggcgtgtccatcaccagcgagctgaatgaggagctgaatgacctgatccagcgcttccacaaccagctgcgggacagccagcccccagctgtgcctgacaacagacggcaggccgagagcctgagcctgacccgggaggtgtcccagagcaggaagcccagcgccagcgagcggctgcctgatgagaaggtggagctgttcagcaagatgagggtgctgcaggagaagaagcagaagatggacaagctgctgggggagctgcacaccctgcgggaccagcacctgaacaacagcagcagcagcccccagaggtctgtggaccagaggagcaccagcgcccccagcgcctctgtgggcctggcccctgtggtgaatggagagagcaacagcctgaccagctctgtgccctaccccacagccagcctggtgtcccagaatgaaagtgaaaatgaaggccacctgaaccccagcgagaagctgcagaagctgaatgaggtgaggaagaggctgaatgagctgcgggagctggtgcactactatgagcagaccagtgacatgatgacagatgctgtgaatgaaaataggaaggatgaggagacagaggagagtgaatatgattctgaacatgagaacagcgagcctgtgaccaacatccggaacccccaggtggccagcacctggaatgaggtgaacagccacagcaatgcccagtgtgtgagcaacaacagagatggccgcacagtgaacagcaactgtgagatcaacaacagatctgctgccaacatccgggccctgaacatgccacccagcctggactgccgctacaaccgggagggggagcaggagatccacgtggcccagggagaagatgatgaggaggaggaggaggaggccgaggaggagggcgtgtctggggccagcctgagcagccacaggagcagcctggtggatgagcacccagaagatgctgagtttgagcagaagatcaaccggctgatggccgccaagcagaagctgcggcagctgcaggacctggtggccatggtgcaggatgatgatgctgcccagggcgtcatcagcgccagcgccagcaacctggatgacttctacccagctgaggaggacaccaagcagaacagcaacaacaccagaggaaatgccaacaagacccagaaggacaccggggtgaatgagaaggcccgggagaagttctatgaggccaagctgcagcagcagcagcgggagctgaagcagctgcaggaggagaggaagaagctgattgacatccaggagaagatccaggccctgcagacagcctgcccagacctgcagctgtctgctgcctctgtgggcaactgccccaccaagaagtacatgcctgctgtgaccagcacccccaccgtgaaccagcacgagaccagcaccagcaagtctgtgtttgagcctgaggacagcagcatcgtggacaatgagctgtggagcgagatgagaagacatgagatgctgcgggaggagctgcggcagaggaggaagcagctggaggccctgatggccgagcaccagaggcggcagggcctggccgagacagccagccctgtggccgtgtccctgcggagtgatggcagcgagaacctgtgcaccccccagcagagcaggacagagaagaccatggccacctggggcggcagcacccagtgtgccctggatgaggagggagatgaagatggctacctgtctgagggcatcgtgaggacagatgaggaggaggaggaggagcaggatgccagcagcaatgacaacttctctgtgtgccccagcaacagcgtgaaccacaacagctacaacgggaaggagaccaagaaccgctggaagaacaactgccccttcagcgcagatgagaactaccggcccctggccaagacccggcagcagaacatctccatgcagaggcaggagaacctgcgctgggtgtctgagctgtcctatgtggaggagaaggagcagtggcaggagcagatcaaccagctgaagaagcagctggacttctctgtgtccatctgccagaccctgatgcaggaccagcagaccctgagctgcctgctgcagaccctgctgaccggcccctacagcgtgatgcccagcaatgtggccagcccccaggtgcacttcatcatgcaccagctgaaccagtgctacacccagctgacctggcagcagaacaacgtgcagaggctgaagcagatgctgaatgagctgatgaggcagcagaaccagcaccctgagaagccaggcggcaaggagcggggcagcagcgccagccacccccccagccccagcctcttctgccccttctccttccccacccagcctgtgaacctcttcaacatccctggcttcaccaacttcagcagctttgcccctggcatgaacttcagccccctcttccccagcaactttggagacttcagccagaacatcagcacccccagcgagcagcagcagcccctggcccagaacagcagcggcaagacagagtacatggccttccccaagccctttgagagcagcagcagcattggagctgagaagcccaggaacaagaagctgcctgaggaggaggtggagagcagcaggaccccctggctgtatgagcaggagggggaggtggagaagcccttcatcaagacaggcttctctgtgtctgtggagaagagcaccagcagcaacaggaagaaccagctggacaccaatggaagaagacggcagtttgatgaggagagcctggagagcttcagctccatgccagaccctgtggaccccaccaccgtgaccaagaccttcaagaccaggaaggccagcgcccaggccagcctggccagcaaggacaagacccccaagagcaagagcaagaagaggaacagcacccagctgaagagccgggtgaagaacatccgctatgagagcgcctccatgagcagcacctgtgagccctgcaagagcaggaacagacattctgcccagacagaggagcctgtgcaggccaaggtgttcagcaggaagaaccacgagcagctggagaagatcatcaagtgcaacagaagcacagagatcagcagcgagactggaagtgacttctccatgtttgaggccctgcgggacaccatctacagcgaggtggccaccctcatcagccagaatgaaagccggccccacttcctgattgagctgttccacgagctgcagctgctgaacacagactacctgcggcagagggccctgtatgccctgcaggacatcgtgagccgccacatcagcgagagccatgagaagggggagaatgtgaagtctgtgaacagcggcacctggatcgccagcaacagcgagctgacccccagcgagagcctggccaccacagatgatgagacctttgagaagaactttgagcgggagacccacaagatcagcgagcagaatgatgctgacaatgcctctgtgctgtctgtgagcagcaactttgagccctttgccacagatgacctgggcaacacagtcatccacctggaccaggccctggccaggatgagagaatatgaaagaatgaagacagaggccgagagcaacagcaacatgcgctgcacctgccgcatcattgaagatggagatggagctggagctggcaccaccgtgaacaacctggaggagacccctgtgattgaaaatagaagcagccagcagcctgtgtctgaggtgtccaccatcccctgccccagaattgacacccagcagctggaccggcagatcaaggccatcatgaaggaggtgatccccttcctgaaggagcacatggatgaggtgtgcagcagccagctgctgacctctgtgcggaggatggtgctgaccctgacccagcagaatgatgagagcaaggagtttgtgaagttcttccacaagcagctgggcagcatcctgcaggacagcctggccaagtttgctggcaggaagctgaaggactgtggggaggacctgctggtggagatcagcgaggtgctcttcaatgagctggccttcttcaagctgatgcaggacctggacaacaacagcatcaccgtgaagcagcgctgcaagaggaagattgaggccactggagtcatccagagctgtgccaaggaggccaagaggatcctggaggaccacggcagccctgctggggagattgatgatgaggacaaggacaaggatgaaacagaaacagtgaagcagacccagaccagcgaggtgtatgatggccccaagaatgtgcggagtgacatcagtgaccaggaggaggatgaggagagcgagggctgccctgtgtccatcaacctgagcaaggccgagacccaggccctgaccaactacggcagcggggaggatgaaaatgaagatgaggagatggaggagtttgaggagggccctgtggatgtgcagaccagcctgcaggccaacacagaggccacagaagaaaatgaacatgatgagcaggtgctgcagagggacttcaagaagacagctgagagcaagaatgtgcccctggagcgggaggccaccagcaagaatgaccagaacaactgccctgtgaagccctgctacctgaacatcctggaggatgagcagcccctgaacagcgctgcccacaaggagagcccccccaccgtggacagcacccagcagcccaaccccctgcccctgcggctgcctgagatggagcccctggtgccccgggtgaaggaggtgaagagcgcccaggagaccccagagagcagcctggccggcagcccagacacagagagccctgtgctggtgaatgactatgaagctgagagcggcaacatcagccagaagagtgatgaagaagattttgtgaaggtggaggacctgcccctgaagctgaccatctacagcgaggccgacctgaggaagaagatggtggaggaggagcagaagaaccacctgtctggagagatctgtgagatgcagacagaggagctggccggcaacagcgagaccctgaaggagcctgagaccgtgggcgcccagagcatctag

SEQ ID NO: 163537 - DNA, 1590 bp, Artificial Sequence
  Description of Artificial Sequence: Synthetic coding sequence
atggccactggaggcggcccctttgaagatggcatgaatgaccaggacctgcccaactggagcaatgaaaatgtggatgaccggctgaacaacatggactggggcgcccagcagaagaaggccaacagaagcagcgagaagaacaagaagaagtttggagtggagagtgacaagagggtgaccaatgacatcagccctgagagcagccctggggtgggcagaagaaggaccaagaccccccacaccttcccccacagccgctacatgagccagatgtctgtgcctgagcaggccgagctggagaagctgaagcagaggatcaacttcagtgacctggaccagaggagcattggaagtgacagccagggccgggccacagctgccaacaacaagaggcagctgtctgagaacaggaagcccttcaacttcctgcccatgcagatcaacaccaacaagagcaaggatgccagcaccaacccccccaaccgggagaccatcggcagcgcccagtgcaaggagctgtttgccagcgccctgagcaatgacctgctgcagaactgccaggtgtctgaggaggatggccgcggggagcccgccatggagagcagccagatcgtgtcccggctggtgcagatccgggactacatcaccaaggccagctccatgagggaggacctggtggagaagaatgaaagaagtgccaacgtggagcggctgacccacctgattgaccacctgaaggagcaggagaagagctacatgaagttcctgaagaagatcctggcccgggagaatgaggaggaggatgtgaggaccattgattctgctgtgggcagcggctctgtggccgagagcaccagcctgaacattgatgtgcagagcgaggccagtgacaccacagcccgggacccccagcaggagcccatggaggagattgagaacctgaagaagcagcacgacctgctgaagaggatgctgcagcagcaggagcagctgcgggccctgcagggccggcaggccgccctgctggccctgcagcacaaggccgagcaggccatcgctgtgatggatgattctgtggtggccgagacagctggcagcctgtctggagtgtccatcaccagcgagctgaatgaggagctgaatgacctgatccagcgcttccacaaccagctgcgggacagccagcccccagctgtgcctgacaacagacggcaggccgagagcctgagcctgacccgggaggtgtcccagagcaggaagcccagcgccagcgagcggctgcctgatgagaaggtggagctgttcagcaagatgagggtgctgcaggagaagaagcagaagatggacaagctgctgggggagctgcacaccctgcgggaccagcacctgaacaacagcagcagcagcccccagaggtctgtggaccagaggagcaccagcgcccccagcgcctctgtgggcctggcccctgtggtgaatggagagagcaacagcctgaccagctctgtgccctaccccacagccagcctggtgtcccagaatgaaagtgaaaatgaaggccacctgaaccccagcgagaagctgtag

SEQ ID NO: 163538 - DNA, 2172 bp, Artificial Sequence
  Description of Artificial Sequence: Synthetic coding sequence
atgagcagcacctgtgagccctgcaagagcaggaacagacattctgcccagacagaggagcctgtgcaggccaaggtgttcagcaggaagaaccacgagcagctggagaagatcatcaagtgcaacagaagcacagagatcagcagcgcccacgcccggcgcatcctgcagcagagcaacagaaatgcctgcaatgaggcccctgagaccggcagtgacttctccatgtttgaggccctgcgggacaccatctacagcgaggtggccaccctcatcagccagaatgaaagccggccccacttcctgattgagctgttccacgagctgcagctgctgaacacagactacctgcggcagagggccctgtatgccctgcaggacatcgtgagccgccacatcagcgagagccatgagaagggagaaaatgtgaagtctgtgaacagcggcacctggatcgccagcaacagcgagctgaccccatctgagagcctggccaccacagatgatgagacctttgagaagaactttgagcgggagacccacaagatcagcgagcagaatgatgctgacaatgcctctgtgctgtctgtgagcagcaactttgagccctttgccacagatgacctgggcaacacagtcatccacctggaccaggccctggccaggatgagagaatatgaaagaatgaagacagaagctgagagcaacagcaacatgcgctgcacctgccgcatcattgaagatggagatggagctggggccggcaccaccgtgaacaacctggaggagacccctgtgattgagaacagaagcagccagcagcctgtgtctgaggtgtccaccatcccctgccccagaattgacacccagcagctggaccggcagatcaaggccatcatgaaggaggtgatccccttcctgaaggagcacatggatgaggtgtgcagcagccagctgctgacctctgtgcggaggatggtgctgaccctgacccagcagaatgatgagagcaaggagtttgtgaagttcttccacaagcagctgggcagcatcctgcaggacagcctggccaagtttgctggcaggaagctgaaggactgtggggaggacctgctggtggagatcagcgaggtgctcttcaatgagctggccttcttcaagctgatgcaggacctggacaacaacagcatcaccgtgaagcagcgctgcaagaggaagattgaggccaccggggtcatccagagctgtgccaaggaggccaagaggatcctggaggaccacggcagccctgctggggagattgatgatgaggacaaggacaaggatgaaacagagaccgtgaagcagacccagaccagcgaggtgtatgatggccccaagaatgtgcggagtgacatcagtgaccaggaggaggatgaggagagcgagggctgccctgtgtccatcaacctgagcaaggccgagacccaggccctgaccaactacggcagcggagaagatgaaaatgaagatgaggagatggaggagtttgaggagggccctgtggatgtgcagaccagcctgcaggccaacacagaggccacagaggagaatgaacatgatgagcaggtgctgcagagggacttcaagaagacagctgagagcaagaatgtgcccctggagcgggaggccaccagcaagaatgaccagaacaactgccctgtgaagccctgctacctgaacatcctggaggatgagcagcccctgaacagcgctgcccacaaggagagccccccaacagtggacagcacccagcagcccaaccccctgcccctgcggctgcctgagatggagcccctggtgccccgggtgaaggaggtgaagagcgcccaggagaccccagagagcagcctggccggcagcccagacacagagagccctgtgctggtgaatgactatgaggccgagagcggcaacatcagccagaagagtgatgaggaggactttgtgaaggtggaggacctgcccctgaagctgaccatctacagcgaggccgacctgaggaagaagatggtggaggaggagcagaagaaccacctgagcggggagatctgtgagatgcagacagaggagctggccggcaacagcgagaccctgaaggagcctgagaccgtgggcgcccagagcatctag

SEQ ID NO: 163539 - DNA, 2295 bp, Artificial Sequence
  Description of Artificial Sequence: Synthetic coding sequence
tgaaaagccagcgcccaggccagcctggccagcaaggacaagacccccaagagcaagagcaagaagaggaacagcacccagctgaagagccgggtgaagaacatccgctatgaaagtgcctccatgagcagcacctgtgagccctgcaagagcaggaacagacacagcgcccagacagaggagcctgtgcaggccaaggtgttcagcaggaagaaccacgagcagctggagaagatcatcaagtgcaacagaagcacagagatcagcagcgcccacgcccggcgcatcctgcagcagagcaacagaaatgcctgcaatgaggcccctgagactggaagtgacttctccatgtttgaggccctgcgggacaccatctacagcgaggtggccaccctcatcagccagaatgaaagccggccccacttcctgattgagctgttccacgagctgcagctgctgaacacagactacctgcggcagagggccctgtatgccctgcaggacatcgtgagccgccacatcagcgagagccatgagaagggggagaatgtgaagtctgtgaacagcggcacctggatcgccagcaacagcgagctgacccccagcgagagcctggccaccacagatgatgagacctttgagaagaactttgagcgggagacccacaagatcagcgagcagaatgatgctgacaatgcctctgtgctgtctgtgagcagcaactttgagccctttgccacagatgacctgggcaacacagtcatccacctggaccaggccctggccaggatgagagaatatgaaagaatgaagacagaggccgagagcaacagcaacatgcgctgcacctgccgcatcattgaagatggagatggagctggagctggcaccaccgtgaacaacctggaggagacccctgtgattgaaaatagaagcagccagcagcctgtgtctgaggtgtccaccatcccctgccccagaattgacacccagcagctggaccggcagatcaaggccatcatgaaggaggtgatccccttcctgaaggagcacatggatgaggtgtgcagcagccagctgctgacctctgtgcggaggatggtgctgaccctgacccagcagaatgatgagagcaaggagtttgtgaagttcttccacaagcagctgggcagcatcctgcaggacagcctggccaagtttgctggcaggaagctgaaggactgtggggaggacctgctggtggagatcagcgaggtgctcttcaatgagctggccttcttcaagctgatgcaggacctggacaacaacagcatcaccgtgaagcagcgctgcaagaggaagattgaggccactggagtcatccagagctgtgccaaggaggccaagaggatcctggaggaccacggcagccctgctggggagattgatgatgaggacaaggacaaggatgaaacagaaacagtgaagcagacccagaccagcgaggtgtatgatggccccaagaatgtgcggagtgacatcagtgaccaggaggaggatgaggagagcgagggctgccctgtgtccatcaacctgagcaaggccgagacccaggccctgaccaactacggcagcggggaggatgaaaatgaagatgaggagatggaggagtttgaggagggccctgtggatgtgcagaccagcctgcaggccaacacagaggccacagaagaaaatgaacatgatgagcaggtgctgcagagggacttcaagaagacagctgagagcaagaatgtgcccctggagcgggaggccaccagcaagaatgaccagaacaactgccctgtgaagccctgctacctgaacatcctggaggatgagcagcccctgaacagcgctgcccacaaggagagcccccccaccgtggacagcacccagcagcccaaccccctgcccctgcggctgcctgagatggagcccctggtgccccgggtgaaggaggtgaagagcgcccaggagaccccagagagcagcctggccggcagcccagacacagagagccctgtgctggtgaatgactatgaagctgagagcggcaacatcagccagaagagtgatgaagaagattttgtgaaggtggaggacctgcccctgaagctgaccatctacagcgaggccgacctgaggaagaagatggtggaggaggagcagaagaaccacctgtctggagagatctgtgagatgcagacagaggagctggccggcaacagcgagaccctgaaggagcctgagaccgtgggcgcccagagcatctag

SEQ ID NO: 163540 - DNA, 1227 bp, Artificial Sequence
  Description of Artificial Sequence: Synthetic coding sequence
atggccactggaggcggcccctttgaagatggcatgaatgaccaggacctgcccaactggagcaatgaaaatgtggatgaccggctgaacaacatggactggggcgcccagcagaagaaggccaacagaagcagcgagaagaacaagaagaagtttggagtggagagtgacaagagggtgaccaatgacatcagccctgagagcagccctggggtgggcagaagaaggaccaagaccccccacaccttcccccacagccgctacatgagccagatgtctgtgcctgagcaggccgagctggagaagctgaagcagaggatcaacttcagtgacctggaccagaggagcattggaagtgacagccagggccgggccacagctgccaacaacaagaggcagctgtctgagaacaggaagcccttcaacttcctgcccatgcagatcaacaccaacaagagcaaggatgccagcaccaacccccccaaccgggagaccatcggcagcgcccagtgcaaggagctgtttgccagcgccctgagcaatgacctgctgcagaactgccaggtgtctgaggaggatggccgcggggagcccgccatggagagcagccagatcgtgtcccggctggtgcagatccgggactacatcaccaaggccagctccatgagggaggacctggtggagaagaatgaaagaagtgccaacgtggagcggctgacccacctgattgaccacctgaaggagcaggagaagagctacatgaagttcctgaagaagatcctggcccgggacccccagcaggagcccatggaggagattgagaacctgaagaagcagcacgacctgctgaagaggatgctgcagcagcaggagcagctgcgggccctgcagggccggcaggccgccctgctggccctgcagcacaaggccgagcaggccatcgctgtgatggatgacagcgtggtggccgagacagctggcagcctgagcggcgtgtccatcaccagcgagctgaatgaggagctgaatgacctgatccagcgcttccacaaccagctgcgggacagccagcccccagctgtgcctgacaacagacggcaggccgagagcctgagcctgacccgggaggtgtcccagagcaggaagcccagcgccagcgagcggctgcctgatgagaaggtggagctgttcagcaagatgagggtgctgcaggagaagaagcagtag

SEQ ID NO: 163541 - DNA, 1569 bp, Artificial Sequence
  Description of Artificial Sequence: Synthetic coding sequence
atggctgtgaacaagggcctgaccctgctggatggagacctgcctgagcaggagaatgtgctgcagagggtgctgcagctgcctgtggtgtctggcacctgtgagtgcttccagaagacctacaccagcaccaaggaggcccaccccctggtggcctctgtgtgcaatgcctatgagaagggcgtgcagagcgccagcagcctggccgcctggagcatggagcctgtggtgcggcggctgagcacccagttcaccgctgccaatgagctggcctgccggggcctggaccacctggaggagaagatcccagccctgcagtacccacctgagaagatcgccagcgagctgaaggacaccatcagcacccggctgcggagcgccaggaacagcatctctgtgcccatcgccagcaccagtgacaaggtgctgggcgccgccctggccggctgtgagctggcctggggcgtggcccgggacacagctgagtttgctgccaacaccagggctggccgcctggccagcggcggcgctgacctggccctgggcagcattgagaaggtggtggagtacctgctgcccccagacaaggaggagagcgccccagcccctggccaccagcaggcccagaagagccccaaggccaagcccagcctgctgagccgggtgggcgccctgaccaacaccctgagccgctacacagtgcagaccatggcccgggccctggagcagggccacacagtggccatgtggatccctggggtggtgcccctgagcagcctggcccagtggggcgcctctgtggccatgcaggccgtgtccagaagaagaagtgaggtgcgggtgccctggctgcacagcctggccgccgcccaggaggaggaccacgaggaccagacagacacagaaggagaggacacagaggaggaggaggagctggagacagaggagaacaagttcagcgaggtggccgccctgcccggcccccggggcctgctgggcggcgtggcccacaccctgcagaagaccctgcagaccaccatctctgctgtgacctgggccccagctgctgtgctgggcatggccggccgggtgctgcacctgaccccagccccagctgtgagcagcaccaagggccgggccatgagcctgagtgatgccctgaagggcgtgacagacaacgtggtggacacagtggtgcactacgtgcccctgccccggctgagcctgatggagcctgagagcgagttccgggacatcgacaaccccccagctgaggtggagcggcgggaggccgagcggcgggccagcggggcccccagcgctggccctgagcccgccccccggctggcccagcccaggaggagcctgcggagcgcccagagccctggggcccctcctggccctggcctggaggatgaggtggccaccccagctgccccccggcccggcttccctgctgtgccccgggagaagcccaagagaagagtgtctgacagcttcttccggcccagcgtgatggagcccatcctgggccgcacccactacagccagctgaggaagaagagctag

SEQ ID NO: 163542 - DNA, 1569 bp, Artificial Sequence; identical to SEQ ID NO: 163541
  Description of Artificial Sequence: Synthetic coding sequence

SEQ ID NO: 163543 - DNA, 1314 bp, Artificial Sequence
  Description of Artificial Sequence: Synthetic coding sequence
atggcctctgtggccgtggacccccagcccagcgtggtgaccagggtggtgaacctgcccctggtgagcagcacctatgacctgatgagcagcgcctacctgagcaccaaggaccagtacccctacctgaagtctgtgtgtgagatggctgaaaatggagtgaagaccatcacctctgtggccatgaccagcgccctgcccatcatccagaagctggagccccagattgctgtggccaacacctacgcctgcaagggcctggaccgcatcgaggagcggctgcccatcctgaaccagcccagcacccagatcgtggccaatgccaagggagctgtgactggagccaaggatgctgtgaccaccaccgtgactggagccaaggacagcgtggccagcaccatcactggagtgatggacaagaccaagggagctgtgacaggctctgtggagaagaccaagtctgtggtgtctggcagcatcaacacagtgctgggcagcaggatgatgcagctggtgagcagcggcgtggagaatgccctgaccaagtctgagctgctggtggagcagtacctgcccctgacagaggaggagctggagaaggaggccaagaaggtggagggctttgacctggtgcagaagcccagctactacgtgcggctgggcagcctgagcaccaagctgcacagccgggcctaccagcaggccctgagccgggtgaaggaggccaagcagaagagccagcagaccatcagccagctgcacagcacagtgcacctgattgaatttgccaggaagaatgtgtacagcgccaaccagaagatccaggatgcccaggacaagctgtacctgtcctgggtggagtggaagaggagcatcggctatgatgacacagatgagagccactgtgccgagcacatcgagagcaggaccctggccatcgccaggaacctgacccagcagctgcagaccacctgccacaccctgctgagcaacatccagggcgtgccccagaacatccaggaccaggccaagcacatgggcgtgatggccggggacatctacagcgtcttcagaaatgctgccagcttcaaggaggtgtctgacagcctgctgaccagcagcaagggccagctgcagaagatgaaggagagcctggatgatgtgatggactacctggtgaacaacacccccctgaactggctggtgggccccttctacccccagctgacagagagccagaatgcccaggaccagggcgctgagatggacaagagcagccaggagacccagaggtctgagcacaagacccactag

SEQ ID NO: 163544 - DNA, 333 bp, Artificial Sequence
  Description of Artificial Sequence: Synthetic coding sequence
atggcctctgtggccgtggacccccagcccagcgtggtgaccagggtggtgaacctgcccctggtgagcagcacctatgacctgatgagcagcgcctacctgagcaccaaggaccagtacccctacctgaagtctgtgtgtgagatggctgaaaatggagtgaagaccatcacctctgtggccatgaccagcgccctgcccatcatccagaagctggagccccagattgctgtggccaacacctacgcctgcaagggcctggaccgcatcgaggagcggctgcccatcctgaaccagcccagcacccaggtgtccctgggccagaagtgctag

SEQ ID NO: 163545 - DNA, 381 bp, Artificial Sequence
  Description of Artificial Sequence: Synthetic coding sequence
atggcctctgtggccgtggacccccagcccagcgtggtgaccagggtggtgaacctgcccctggtgagcagcacctatgacctgatgagcagcgcctacctgagcaccaaggaccagtacccctacctgaagtctgtgtgtgagatggctgaaaatggagtgaagaccatcacctctgtggccatgaccagcgccctgcccatcatccagaagctggagccccagattgctgtggccaacacctacgcctgcaagggcctggaccgcatcgaggagcggctgcccatcctgaaccagcccagcacccaggccaacacctgcttccccaacctggacctggatgtgtgcctgaagaacaacggccacttcctgaccagctag

SEQ ID NO: 163546 - DNA, 1071 bp, Artificial Sequence
  Description of Artificial Sequence: Synthetic coding sequence
atggcctctgtggccgtggacccccagcccagcgtggtgaccagggtggtgaacctgcccctggtgagcagcacctatgacctgatgagcagcgcctacctgagcaccaaggaccagtacccctacctgaagtctgtgtgtgagatggctgaaaatggagtgaagaccatcacctctgtggccatgaccagcgccctgcccatcatccagaagctggagccccagattgctgtggccaacacctacgcctgcaagggcctggaccgcatcgaggagcggctgcccatcctgaaccagcccagcacccagatcgtggccaatgccaagggagctgtgactggagccaaggatgctgtgaccaccaccgtgactggagccaaggacagcgtggccagcaccatcactggagtgatggacaagaccaagggagctgtgacaggctctgtggagaagaccaagtctgtgaagaagaagcagaagaagctgaaggacctgatctggttccgcagccagctgcacagcacagtgcacctgattgaatttgccaggaagaatgtgtacagcgccaaccagaagatccaggatgcccaggacaagctgtacctgtcctgggtggagtggaagaggagcatcggctatgatgacacagatgagagccactgtgccgagcacatcgagagcaggaccctggccatcgccaggaacctgacccagcagctgcagaccacctgccacaccctgctgagcaacatccagggcgtgccccagaacatccaggaccaggccaagcacatgggcgtgatggccggggacatctacagcgtcttcagaaatgctgccagcttcaaggaggtgtctgacagcctgctgaccagcagcaagggccagctgcagaagatgaaggagagcctggatgatgtgatggactacctggtgaacaacacccccctgaactggctggtgggccccttctacccccagctgacagagagccagaatgcccaggaccagggcgctgagatggacaagagcagccaggagacccagaggtctgagcacaagacccactag

SEQ ID NO: 163547 - DNA, 378 bp, Artificial Sequence
  Description of Artificial Sequence: Synthetic coding sequence
atggcctctgtggccgtggacccccagcccagcgtggtgaccagggtggtgaacctgcccctggtgagcagcacctatgacctgatgagcagcgcctacctgagcaccaaggaccagtacccctacctgaagtctgtgtgtgagatggctgaaaatggagtgaagaccatcacctctgtggccatgaccagcgccctgcccatcatccagaagctggagccccagattgctgtggccaacacctacgcctgcaagggcctggaccgcatcgaggagcggctgcccatcctgaaccagcccagcacccagatcgtggccaatgccaagggagctgtgactggagccaaggatgctgtgaccaccaccgtgactggatag

SEQ ID NO: 163548 - DNA, 735 bp, Artificial Sequence
  Description of Artificial Sequence: Synthetic coding sequence
atgggccccccatctgctgccccccggggcggccaccggccctggcagggcctgctgatcacagccagcctgctgaccttctggcacccccccaccaccgtgcagttcaccatcgaggccctgcccagcagcgctgctgagggcaaggatgtgctgctgctggcctgcaacatcagcgagaccatccaggcctactactggcacaagggcaagacagctgagggcagccccctgattgctggctacatcacagacatccaggccaacatccctggagctgcctacagcggccgggagaccgtgtaccccaacggcagcctgctcttccagaacatcaccctggaggatgctggcagctacaccctgcggaccatcaatgccagctatgacagcgaccaggccaccggccagctgcacgtgcaccagaacaacgtgcccggcctgcctgtgggcgctgtggccggcatcgtgactggagtgctggtgggcgtggccctggtggccgccctggtgtgcttcctgctgctgagcaggacaggccgggccagcatccagagggacctgcgggagcagcccccaccagccagcaccccaggccacggccccagccacaggagcaccttcagcgcccccctgcccagccccaggacagccacccccatctatgaggagctgctgtacagtgatgccaacatctactgccagattgaccacaaggcagatgtggtgtcctag

SEQ ID NO: 163549 - DNA, 1269 bp, Artificial Sequence
  Description of Artificial Sequence: Synthetic coding sequence
atgtctgcagatggagctgaggctgatggcagcacccaggtgacagtggaggagcctgtgcagcagcccagcgtggtggacagagtggcctccatgcccctcatcagcagcacctgtgacatggtgtctgctgcctatgccagcaccaaggagagctacccccacatcaagacagtgtgtgatgctgctgagaagggcgtgaggaccctgacagctgctgctgtgtctggggcccagcccatcctgagcaagctggagccccagatcgccagcgcctctgaatatgcccaccggggcctggacaagctggaggagaacctgcccatcctgcagcagcccacagagaaggtgtctggggcccaggagatggtgagcagcgccaaggacacagtggccacccagctgtctgaggccgtggatgccaccagaggagctgtgcagagcggcgtggacaagaccaagtctgtggtgactggaggagtgcagagcgtgatgggcagccggctgggccagatggtgctgtctggagtggacacagtgctgggcaagtctgaggagtgggccgacaaccacctgcccctgacagatgctgagctggcccgcatcgccaccagcctggatggctttgatgtggcctctgtgcagcagcagaggcaggagcagagctactttgtgcggctgggcagcctgtctgagcggctgcggcagcacgcctatgagcacagcctgggcaagctgcgggccaccaagcagagggcccaggaggccctgctgcagctgagccaggtgctgagcctgatggagaccgtgaagcagggcgtggaccagaagctggtggagggccaggagaagctgcaccagatgtggctgtcctggaaccagaagcagctgcagggccctgagaaggagccccccaagccagagcaggtggagagccgggccctgaccatgttccgggacatcgcccagcagctgcaggccacctgcaccagcctgggcagcagcatccagggcctgcccaccaacgtgaaggaccaggtgcagcaggcccggcggcaggtggaggacctgcaggccaccttcagcagcatccacagcttccaggacctgagcagcagcatcctggcccagagccgggagcgggtggccagcgcccgggaggccctggaccacatggtggagtatgtggcccagaacacccctgtgacctggctggtgggcccctttgcccctggcatcacagagaaggcccctgaggagaagaagtag

SEQ ID NO: 163550 - DNA, 1392 bp, Artificial Sequence
  Description of Artificial Sequence: Synthetic coding sequence
atgtctgaggaggaggccgcccagatccccaggagctctgtgtgggagcaggaccagcagaatgtggtgcagagggtggtggccctgcccctggtgcgggccacctgcacagctgtgtgtgatgtgtacagcgctgccaaggacagacaccccctgctgggcagcgcctgccgcctggccgagaactgtgtgtgtggcctgaccacccgggccctggaccacgcccagcccctgctggagcacctgcagccccagctggccaccatgaacagcctggcctgccggggcctggacaagctggaggagaagctgcccttcctgcagcagcccagcgagaccgtggtgaccagcgccaaggatgtggtggccagctctgtgactggagtggtggacctggcccggcggggccgccgctggagcgtggagctgaagaggtctgtgtcccatgctgtggatgtggtgctggagaagtctgaggagctggtggaccacttcctgcccatgacagaggaggagctggccgccctggccgctgaggccgagggccctgaggtgggctctgtggaggaccagaggcggcagcagggctactttgtgcggctgggcagcctgagcgcccgcatccgccacctggcctatgagcacagcgtgggcaagctgcggcagagcaagcaccgggcccaggacaccctggcccagctgcaggagaccctggagctgattgaccacatgcagtgtggggtgacccccacagccccagcctgccctgggaaggtgcatgagctgtggggcgagtggggccagaggcctcctgagagcagaagaagaagccaggccgagctggagaccctggtgctgagccgcagcctgacccaggagctgcagggcaccgtggaggccctggagagctctgtgcggggcctgcctgctggggcccaggagaaggtggccgaggtgcggcgctctgtggatgccctgcagacagcctttgctgatgcccgctgcttcagagatgtgcctgctgctgccctggccgagggccggggccgggtggcccacgcccacgcctgtgtggatgagctgctggagctggtggtgcaggccgtgcccctgccctggctggtgggcccctttgcccccatcctggtggagaggcctgagcccctgcctgacctggccgacctggtggatgaagtcatcggcggccctgacccccgctgggcccacctggactggccagcccagcagagggcctgggaggccgagcacagagatggcagcggaaatggagatggagacaggatgggcgtggccggggacatctgtgagcaggagcctgagacccccagctgccctgtgaagcacaccctgatgcctgagctggacttctag

SEQ ID NO: 163551 - DNA, 3768 bp, Artificial Sequence
  Description of Artificial Sequence: Synthetic coding sequence
atgaatggctatgcagagttcccccccagccccagcaaccccaccaaggagcctgtggagccccagcccagccaggtgcccctgcaggaggatgtggacatgagcagcggcagcagcggccacgagaccaatgaaaactgcagcacaggccgggacagccagggcagtgactgtgatgattctgggaaggagctgggcatgctggtggagcccccagatgcccggcagagcccagacaccttcagcctgatgatggccaagtctgagcacaaccccagcaccagcggctgcagcagtgaccagagcagcaaggtggacacccacaaggagctgatcaagaccctgaaggagctgaaggtgcacctgcctgctgacaagaaggccaagggcaaggccagcaccctggccaccctgaagtatgccctgcggtctgtgaagcaggtgaaggccaatgaggagtactaccagctgctgatgagcagcgagggccacccctgtggggctgatgtgcccagctacacagtggaggagatggagagcgtgaccagcgagcacatcgtgaagaatgctgacatgtttgctgtggccgtgtccctggtgtctgggaagatcctgtacatcagtgaccaggtggccagcatcttccactgcaagagagatgccttcagtgatgccaagtttgtggagttcctggcccctcatgatgtgggcgtcttccacagcttcaccagcccctacaagctgcccctgtggagcatgtgcagcggggctgacagcttcacccaggagtgcatggaggagaagagcttcttctgccgggtgtctgtgaggaagagccatgaaaatgagatccgctaccaccccttcaggatgaccccctacctggtgaaggtgcgggaccagcagggcgctgagagccagctgtgctgcctgctgctggccgagcgggtgcacagcggctatgaggccccccgcatccccccagagaagaggatcttcaccaccacccacacccccaactgcctcttccaggatgtggatgaaagagctgtgcccctgctgggctacctgccccaggacctgattgagacccctgtgctggtgcagctgcaccccagcgaccggcccctgatgctggccatccacaagaagatcctgcagagcggcggccagccctttgactacagccccatccgcttccgggccagaaatggagagtacatcaccctggacacctcctggagcagcttcatcaacccctggagcaggaagatctccttcatcatcggccgccacaaggtgcgggtgggccccctgaatgaagatgtgtttgctgcccacccctgcacagaggagaaggccctgcaccccagcatccaggagctgacagagcagatccaccggctgctgctgcagcctgtgccccacagcggcagcagcggctacggcagcctgggcagcaatggcagccatgagcacctgatgagccagaccagcagcagtgacagcaatggacatgaggacagcagaagaagaagagctgagatctgcaagaatggaaacaagaccaagaacagaagccactacagccatgaaagtggagagcagaagaagaagtctgtgacagagatgcagaccaaccccccagctgagaagaaggctgtgcctgccatggagaaggacagcctgggcgtgtccttccctgaggagctggcctgcaagaaccagcccacctgcagctaccagcagatcagctgcctggacagcgtcatccgctacctggagagctgcaatgaggccgccaccctgaagaggaaatgtgagttccctgccaacgtgcctgccctgcggagcagtgacaagaggaaggccaccgtgtccccaggcccccacgccggggaggccgagccccccagccgggtgaacagcaggactggagtgggcacccacctgaccagcctggccctgcccgggaaggccgagagcgtggccagcctgaccagccagtgcagctacagcagcaccatcgtgcacgtgggggacaagaagccccagcctgagctggagatggtggaggatgctgccagcggccctgagagcctggactgcctggccggccctgccctggcctgtggcctgagccaggagaaggagcccttcaagaagctgggcctgaccaaggaggtgctggccgcccacacccagaaggaggagcagagcttcctgcagaagttcaaggagatcaggaagctgagcatcttccagagccactgccactactacctgcaggagaggagcaagggccagcccagcgagaggacagcccctggcctgaggaacaccagcggcatcgacagcccctggaagaagacaggcaagaacaggaagctgaagagcaagagggtgaagccccgggacagcagcgagagcactggaagtggcggccctgtgtctgcccggccccccctggtgggcctgaatgccacagcctggagccccagcgacaccagccagagcagctgcccagctgtgcccttccctgcccctgtgcctgctgcctacagcctgcctgtgtttcctgcccctggcaccgtggccgcccccccagcccctcctcatgccagcttcaccgtgcctgctgtgcctgtggacctgcagcaccagtttgctgtgcagcccccacccttccctgcccccctggcccctgtgatggccttcatgctgcccagctacagcttccccagcggcacccccaacctgccccaggccttcttccccagccagccccagttccccagccaccccaccctgaccagcgagatggccagcgccagccagcctgagttccccagcaggaccagcatcccccggcagccctgtgcctgcccagccacccgggccaccccaccttctgccatgggccgggccagccccccactcttccagagccgcagcagcagccccctgcagctgaacctgctgcagctggaggaggcccctgagggcggcaccggggccatgggcaccaccggggccacagaaacagctgctgtgggcgctgactgcaagccaggcaccagccgggaccagcagcccaaggcccccctgaccagagatgagcccagcgacacccagaacagtgatgccctgagcaccagcagcggcctgctgaacctgctgctgaatgaagacctgtgcagcgccagcggcagcgctgccagcgagagcctgggcagcggcagcctgggctgtgatgccagccccagcggggccggcagcagtgacaccagccacaccagcaagtacttcggcagcattgacagcagcgagaacaaccacaaggccaagatgaacacaggcatggaggagagcgagcacttcatcaagtgtgtgctgcaggaccccatctggctgctgatggctgatgctgacagctctgtgatgatgacctaccagctgcccagcaggaacctggaggccgtgctgaaggaggaccgggagaagctgaagctgctgcagaagctgcagccccgcttcacagagagccagaagcaggagctgcgggaggtgcaccagtggatgcagacaggaggcctgcctgctgccattgatgtggctgaatgtgtgtactgtgagaacaaggagaagggcaacatctgcatcccctatgaggaggacatccccagcctgggcctgtctgaggtgtctgacaccaaggaggatgaaaatggcagccccctgaaccacagaattgaggagcagacctag

SEQ ID NO: 163552 - DNA, 1215 bp, Artificial Sequence
  Description of Artificial Sequence: Synthetic coding sequence
atgaatggctatgcagagttcccccccagccccagcaaccccaccaaggagcctgtggagccccagcccagccaggtgcccctgcaggaggatgtggacatgagcagcggcagcagcggccacgagaccaatgaaaactgcagcacaggccgggacagccagggcagtgactgtgatgattctgggaaggagctgggcatgctggtggagcccccagatgcccggcagagcccagacaccttcagcctgatgatggccaagtctgagcacaaccccagcaccagcggctgcagcagtgaccagagcagcaaggtggacacccacaaggagctgatcaagaccctgaaggagctgaaggtgcacctgcctgctgacaagaaggccaagggcaaggccagcaccctggccaccctgaagtatgccctgcggtctgtgaagcaggtgaaggccaatgaggagtactaccagctgctgatgagcagcgagggccacccctgtggggctgatgtgcccagctacacagtggaggagatggagagcgtgaccagcgagcacatcgtgaagaatgctgacatgtttgctgtggccgtgtccctggtgtctgggaagatcctgtacatcagtgaccaggtggccagcatcttccactgcaagagagatgccttcagtgatgccaagtttgtggagttcctggcccctcatgatgtgggcgtcttccacagcttcaccagcccctacaagctgcccctgtggagcatgtgcagcggggctgacagcttcacccaggagtgcatggaggagaagagcttcttctgccgggtgtctgtgaggaagagccatgaaaatgagatccgctaccaccccttcaggatgaccccctacctggtgaaggtgcgggaccagcagggcgctgagagccagctgtgctgcctgctgctggccgagcgggtgcacagcggctatgaggccccccgcatccccccagagaagaggatcttcaccaccacccacacccccaactgcctcttccaggatgtggatgagagccctgctgtgagaagagctgccttccgcctcttcagccacagcgtgtccaggcctgagaggagagtgcaccacgtgggccaccagctggtgcagctgcaccagcccatggagcaggagaacctgctgcaccactgggaggcccagagccagggcggcccctttgaatag

SEQ ID NO: 163553 - DNA, 1215 bp, Artificial Sequence; identical to SEQ ID NO: 163552
  Description of Artificial Sequence: Synthetic coding sequence

SEQ ID NO: 163554 - DNA, 330 bp, Artificial Sequence
  Description of Artificial Sequence: Synthetic coding sequence
atgaatggctatgcagagttcccccccagccccagcaaccccaccaaggagcctgtggagccccagcccagccaggtgcccctgcaggaggatgtggacatgagcagcggcagcagcggccacgagaccaatgaaaactgcagcacaggccgggacagccagggcagtgactgtgatgattctgggaaggagctgggcatgctggtggagcccccagatgcccggcagagcccagacaccttcagcctgatgatggccaagtctgagcacaaccccagcaccagcggctgcagcagtgaccagagcagcaaggtggacacccacaagtag

SEQ ID NO: 163555 - DNA, 1452 bp, Artificial Sequence
  Description of Artificial Sequence: Synthetic coding sequence
atgaatggctatgcagagttcccccccagccccagcaaccccaccaaggagcctgtggagccccagcccagccaggtgcccctgcaggaggatgtggacatgagcagcggcagcagcggccacgagaccaatgaaaactgcagcacaggccgggacagccagggcagtgactgtgatgattctgggaaggagctgggcatgctggtggagcccccagatgcccggcagagcccagacaccttcagcctgatgatggccaagtctgagcacaaccccagcaccagcggctgcagcagtgaccagagcagcaaggtggacacccacaaggagctgatcaagaccctgaaggagctgaaggtgcacctgcctgctgacaagaaggccaagggcaaggccagcaccctggccaccctgaagtatgccctgcggtctgtgaagcaggtgaaggccaatgaggagtactaccagctgctgatgagcagcgagggccacccctgtggggctgatgtgcccagctacacagtggaggagatggagagcgtgaccagcgagcacatcgtgaagaatgctgacatgtttgctgtggccgtgtccctggtgtctgggaagatcctgtacatcagtgaccaggtggccagcatcttccactgcaagagagatgccttcagtgatgccaagtttgtggagttcctggcccctcatgatgtgggcgtcttccacagcttcaccagcccctacaagctgcccctgtggagcatgtgcagcggggctgacagcttcacccaggagtgcatggaggagaagagcttcttctgccgggtgtctgtgaggaagagccatgaaaatgagatccgctaccaccccttcaggatgaccccctacctggtgaaggtgcgggaccagcagggcgctgagagccagctgtgctgcctgctgctggccgagcgggtgcacagcggctatgaggccccccgcatccccccagagaagaggatcttcaccaccacccacacccccaactgcctcttccaggatgtggatgaaagagctgtgcccctgctgggctacctgccccaggacctgattgagacccctgtgctggtgcagctgcaccccagcgaccggcccctgatgctggccatccacaagaagatcctgcagagcggcggccagccctttgactacagccccatccgcttccgggccagaaatggagagtacatcaccctggacacctcctggagcagcttcatcaacccctggagcaggaagatctccttcatcatcggccgccacaaggtgcgggtgggccccctgaatgaagatgtgtttgctgcccacccctgcacagaggagaaggccctgcaccccagcatccaggagctgacagagcagatccaccggctgctgctgcaggtgggcgtggtgcctgcctgccccccaccaagatag

SEQ ID NO: 163556 - DNA, 2340 bp, Artificial Sequence
  Description of Artificial Sequence: Synthetic coding sequence
atgatccccttcctgcccatgttcagcctgctgctgctgctgattgtgaaccccatcaatgccaacaaccactatgacaagatcctggcccacagccgcatccggggccgggaccagggccccaacgtgtgtgccctgcagcagatcctgggcaccaagaagaagtacttcagcacctgcaagaactggtacaagaagagcatctgtggccagaagaccaccgtgctgtatgagtgctgccccggctacatgaggatggagggcatgaagggctgcccagctgtgctgcccatcgaccacgtgtatggcaccctgggcatcgtgggcgccaccaccacccagcgctacagtgatgccagcaagctgcgggaggagattgagggcaagggcagcttcacctactttgcccccagcaatgaggcctgggacaacctggacagcgacatccggcggggcctggagagcaatgtgaatgtggagctgctgaatgccctgcacagccacatgatcaacaagaggatgctgaccaaggacctgaagaatggcatgatcatccccagcatgtacaacaacctgggcctcttcatcaaccactacccaaatggagtggtgacagtgaactgtgcccgcatcatccacggcaaccagatcgccaccaacggggtggtgcacgtgattgacagagtgctgacccagatcggcaccagcatccaggacttcattgaagcagaagatgacctgagcagcttccgggctgctgccatcaccagtgacatcctggaggccctgggcagagatggccacttcaccctgtttgcccccaccaatgaggcctttgagaagctgccccggggcgtgctggagcgcatcatgggagacaaggtggccagcgaggccctgatgaagtaccacatcctgaacaccctgcagtgcagcgagagcatcatgggcggcgctgtgtttgagaccctggagggcaacaccattgaaattggctgtgatggagacagcatcaccgtgaatggcatcaagatggtgaacaagaaggacatcgtgaccaacaatggagtcatccacctgattgaccaggtgctgatcccagattctgccaagcaggtgattgagctggccggcaagcagcagaccaccttcacagacctggtggcccagctgggcctggccagcgccctgcggccagatggagagtacaccctgctggcccctgtgaacaatgccttcagtgatgacaccctgtccatggaccagaggctgctgaagctgatcctgcagaaccacatcctgaaggtgaaggtgggcctgaatgagctgtacaacggccagatcctggagaccatcggcggcaagcagctgcgggtgtttgtgtacagaacagctgtgtgcatcgagaacagctgcatggagaagggcagcaagcagggcagaaatggagccatccacatcttccgggagatcatcaagccagctgagaagagcctgcacgagaagctgaagcaggacaagcgcttcagcaccttcctgagcctgctggaggccgctgacctgaaggagctgctgacccagcccggggactggaccctgtttgtgcccaccaatgatgccttcaagggcatgaccagcgaggagaaggagatcctgatccgggacaagaatgccctgcagaacatcatcctgtaccacctgaccccaggagtcttcatcggcaaaggatttgagcccggggtgaccaacatcctgaagaccacccagggcagcaagatcttcctgaaggaggtgaatgacaccctgctggtgaatgagctgaagagcaaggagagtgacatcatgaccaccaacggggtcatccacgtggtggacaagctgctgtacccagctgacacccctgtgggcaatgaccagctgctggagatcctgaacaagctgatcaagtacatccagatcaagtttgtgcggggcagcaccttcaaggagatccctgtgacagtgtacaagcccatcatcaagaagtacaccaagatcattgatggagtgcctgtggagatcacagagaaggagacccgggaggagcgcatcatcactggacctgagatcaagtacacccgcatcagcactggaggaggagaaacagaggagaccctgaagaagctgctgcaggaggaggtgaccaaggtgaccaagttcatcgagggcggagatggccacctgtttgaagatgaggagatcaagaggctgctgcagggcgacacccctgtgaggaagctgcaggccaacaagaaggtgcagggcagcagaagaaggctgcgggagggccgcagccagtag

SEQ ID NO: 163557 - DNA, 2430 bp, Artificial Sequence
  Description of Artificial Sequence: Synthetic coding sequence
atgatccccttcctgcccatgttcagcctgctgctgctgctgattgtgaaccccatcaatgccaacaaccactatgacaagatcctggcccacagccgcatccggggccgggaccagggccccaacgtgtgtgccctgcagcagatcctgggcaccaagaagaagtacttcagcacctgcaagaactggtacaagaagagcatctgtggccagaagaccaccgtgctgtatgagtgctgccccggctacatgaggatggagggcatgaagggctgcccagctgtgctgcccatcgaccacgtgtatggcaccctgggcatcgtgggcgccaccaccacccagcgctacagtgatgccagcaagctgcgggaggagattgagggcaagggcagcttcacctactttgcccccagcaatgaggcctgggacaacctggacagcgacatccggcggggcctggagagcaatgtgaatgtggagctgctgaatgccctgcacagccacatgatcaacaagaggatgctgaccaaggacctgaagaatggcatgatcatccccagcatgtacaacaacctgggcctcttcatcaaccactacccaaatggagtggtgacagtgaactgtgcccgcatcatccacggcaaccagatcgccaccaacggggtggtgcacgtgattgacagagtgctgacccagatcggcaccagcatccaggacttcattgaagcagaagatgacctgagcagcttccgggctgctgccatcaccagtgacatcctggaggccctgggcagagatggccacttcaccctgtttgcccccaccaatgaggcctttgagaagctgccccggggcgtgctggagcgcatcatgggagacaaggtggccagcgaggccctgatgaagtaccacatcctgaacaccctgcagtgcagcgagagcatcatgggcggcgctgtgtttgagaccctggagggcaacaccattgaaattggctgtgatggagacagcatcaccgtgaatggcatcaagatggtgaacaagaaggacatcgtgaccaacaatggagtcatccacctgattgaccaggtgctgatcccagattctgccaagcaggtgattgagctggccggcaagcagcagaccaccttcacagacctggtggcccagctgggcctggccagcgccctgcggccagatggagagtacaccctgctggcccctgtgaacaatgccttcagtgatgacaccctgtccatggaccagaggctgctgaagctgatcctgcagaaccacatcctgaaggtgaaggtgggcctgaatgagctgtacaacggccagatcctggagaccatcggcggcaagcagctgcgggtgtttgtgtacagaacagctgtgtgcatcgagaacagctgcatggagaagggcagcaagcagggcagaaatggagccatccacatcttccgggagatcatcaagccagctgagaagagcctgcacgagaagctgaagcaggacaagcgcttcagcaccttcctgagcctgctggaggccgctgacctgaaggagctgctgacccagcccggggactggaccctgtttgtgcccaccaatgatgccttcaagggcatgaccagcgaggagaaggagatcctgatccgggacaagaatgccctgcagaacatcatcctgtaccacctgaccccaggagtcttcatcggcaaaggatttgagcccggggtgaccaacatcctgaagaccacccagggcagcaagatcttcctgaaggaggtgaatgacaccctgctggtgaatgagctgaagagcaaggagagtgacatcatgaccaccaacggggtcatccacgtggtggacaagctgctgtacccagctgacacccctgtgggcaatgaccagctgctggagatcctgaacaagctgatcaagtacatccagatcaagtttgtgcggggcagcaccttcaaggagatccctgtgacagtgtaccggcccaccctgaccaaggtgaagattgaaggagagcctgagttccgcctcatcaaggagggggagaccatcacagaggtgatccacggggagcccatcatcaagaagtacaccaagatcattgatggagtgcctgtggagatcacagagaaggagacccgggaggagcgcatcatcactggacctgagatcaagtacacccgcatcagcactggaggaggagaaacagaggagaccctgaagaagctgctgcaggaggaggtgaccaaggtgaccaagttcatcgagggcggagatggccacctgtttgaagatgaggagatcaagaggctgctgcagggcgacacccctgtgaggaagctgcaggccaacaagaaggtgcagggcagcagaagaaggctgcgggagggccgcagccagtag

SEQ ID NO: 163558 - DNA, 2511 bp, Artificial Sequence
  Description of Artificial Sequence: Synthetic coding sequence
atgatccccttcctgcccatgttcagcctgctgctgctgctgattgtgaaccccatcaatgccaacaaccactatgacaagatcctggcccacagccgcatccggggccgggaccagggccccaacgtgtgtgccctgcagcagatcctgggcaccaagaagaagtacttcagcacctgcaagaactggtacaagaagagcatctgtggccagaagaccaccgtgctgtatgagtgctgccccggctacatgaggatggagggcatgaagggctgcccagctgtgctgcccatcgaccacgtgtatggcaccctgggcatcgtgggcgccaccaccacccagcgctacagtgatgccagcaagctgcgggaggagattgagggcaagggcagcttcacctactttgcccccagcaatgaggcctgggacaacctggacagcgacatccggcggggcctggagagcaatgtgaatgtggagctgctgaatgccctgcacagccacatgatcaacaagaggatgctgaccaaggacctgaagaatggcatgatcatccccagcatgtacaacaacctgggcctcttcatcaaccactacccaaatggagtggtgacagtgaactgtgcccgcatcatccacggcaaccagatcgccaccaacggggtggtgcacgtgattgacagagtgctgacccagatcggcaccagcatccaggacttcattgaagcagaagatgacctgagcagcttccgggctgctgccatcaccagtgacatcctggaggccctgggcagagatggccacttcaccctgtttgcccccaccaatgaggcctttgagaagctgccccggggcgtgctggagcgcatcatgggagacaaggtggccagcgaggccctgatgaagtaccacatcctgaacaccctgcagtgcagcgagagcatcatgggcggcgctgtgtttgagaccctggagggcaacaccattgaaattggctgtgatggagacagcatcaccgtgaatggcatcaagatggtgaacaagaaggacatcgtgaccaacaatggagtcatccacctgattgaccaggtgctgatcccagattctgccaagcaggtgattgagctggccggcaagcagcagaccaccttcacagacctggtggcccagctgggcctggccagcgccctgcggccagatggagagtacaccctgctggcccctgtgaacaatgccttcagtgatgacaccctgtccatggaccagaggctgctgaagctgatcctgcagaaccacatcctgaaggtgaaggtgggcctgaatgagctgtacaacggccagatcctggagaccatcggcggcaagcagctgcgggtgtttgtgtacagaacagctgtgtgcatcgagaacagctgcatggagaagggcagcaagcagggcagaaatggagccatccacatcttccgggagatcatcaagccagctgagaagagcctgcacgagaagctgaagcaggacaagcgcttcagcaccttcctgagcctgctggaggccgctgacctgaaggagctgctgacccagcccggggactggaccctgtttgtgcccaccaatgatgccttcaagggcatgaccagcgaggagaaggagatcctgatccgggacaagaatgccctgcagaacatcatcctgtaccacctgaccccaggagtcttcatcggcaaaggatttgagcccggggtgaccaacatcctgaagaccacccagggcagcaagatcttcctgaaggaggtgaatgacaccctgctggtgaatgagctgaagagcaaggagagtgacatcatgaccaccaacggggtcatccacgtggtggacaagctgctgtacccagctgacacccctgtgggcaatgaccagctgctggagatcctgaacaagctgatcaagtacatccagatcaagtttgtgcggggcagcaccttcaaggagatccctgtgacagtgtacaccaccaagatcatcaccaaggtggtggagcccaagatcaaggtgattgagggcagcctgcagcccatcatcaagacagagggccccaccctgaccaaggtgaagattgaaggagagcctgagttccgcctcatcaaggagggggagaccatcacagaggtgattcatggagagcccatcatcaagaagtacaccaagatcattgatggagtgcctgtggagatcacagagaaggagacccgggaggagcgcatcatcaccggccctgagatcaagtacacccgcatcagcactggaggaggagaaacagaggagaccctgaagaagctgctgcaggaggaggtgaccaaggtgaccaagttcattgaaggaggagatggccacctgtttgaagatgaggagatcaagaggctgctgcagggcgacacccctgtgaggaagctgcaggccaacaagaaggtgcagggcagcagaagaaggctgcgggagggccgcagccagtag

SEQ ID NO: 163559 - DNA, 2427 bp, Artificial Sequence
  Description of Artificial Sequence: Synthetic coding sequence
atgatccccttcctgcccatgttcagcctgctgctgctgctgattgtgaaccccatcaatgccaacaaccactatgacaagatcctggcccacagccgcatccggggccgggaccagggccccaacgtgtgtgccctgcagcagatcctgggcaccaagaagaagtacttcagcacctgcaagaactggtacaagaagagcatctgtggccagaagaccaccgtgctgtatgagtgctgccccggctacatgaggatggagggcatgaagggctgcccagctgtgctgcccatcgaccacgtgtatggcaccctgggcatcgtgggcgccaccaccacccagcgctacagtgatgccagcaagctgcgggaggagattgagggcaagggcagcttcacctactttgcccccagcaatgaggcctgggacaacctggacagcgacatccggcggggcctggagagcaatgtgaatgtggagctgctgaatgccctgcacagccacatgatcaacaagaggatgctgaccaaggacctgaagaatggcatgatcatccccagcatgtacaacaacctgggcctcttcatcaaccactacccaaatggagtggtgacagtgaactgtgcccgcatcatccacggcaaccagatcgccaccaacggggtggtgcacgtgattgacagagtgctgacccagatcggcaccagcatccaggacttcattgaagcagaagatgacctgagcagcttccgggctgctgccatcaccagtgacatcctggaggccctgggcagagatggccacttcaccctgtttgcccccaccaatgaggcctttgagaagctgccccggggcgtgctggagcgcatcatgggagacaaggtggccagcgaggccctgatgaagtaccacatcctgaacaccctgcagtgcagcgagagcatcatgggcggcgctgtgtttgagaccctggagggcaacaccattgaaattggctgtgatggagacagcatcaccgtgaatggcatcaagatggtgaacaagaaggacatcgtgaccaacaatggagtcatccacctgattgaccaggtgctgatcccagattctgccaagcaggtgattgagctggccggcaagcagcagaccaccttcacagacctggtggcccagctgggcctggccagcgccctgcggccagatggagagtacaccctgctggcccctgtgaacaatgccttcagtgatgacaccctgtccatggaccagaggctgctgaagctgatcctgcagaaccacatcctgaaggtgaaggtgggcctgaatgagctgtacaacggccagatcctggagaccatcggcggcaagcagctgcgggtgtttgtgtacagaacagctgtgtgcatcgagaacagctgcatggagaagggcagcaagcagggcagaaatggagccatccacatcttccgggagatcatcaagccagctgagaagagcctgcacgagaagctgaagcaggacaagcgcttcagcaccttcctgagcctgctggaggccgctgacctgaaggagctgctgacccagcccggggactggaccctgtttgtgcccaccaatgatgccttcaagggcatgaccagcgaggagaaggagatcctgatccgggacaagaatgccctgcagaacatcatcctgtaccacctgaccccaggagtcttcatcggcaaaggatttgagcccggggtgaccaacatcctgaagaccacccagggcagcaagatcttcctgaaggaggtgaatgacaccctgctggtgaatgagctgaagagcaaggagagtgacatcatgaccaccaacggggtcatccacgtggtggacaagctgctgtacccagctgacacccctgtgggcaatgaccagctgctggagatcctgaacaagctgatcaagtacatccagatcaagtttgtgcggggcagcaccttcaaggagatccctgtgacagtgtacaccaccaagatcatcaccaaggtggtggagcccaagatcaaggtgattgagggcagcctgcagcccatcatcaagacagagggccccaccctgaccaaggtgaagattgaaggagagcctgagttccgcctcatcaaggagggggagaccatcacagaggtgattcatggagagcccatcatcaagaagtacaccaagatcattgatggagtgcctgtggagatcacagagaaggagacccgggaggagcgcatcatcaccggccctgagatcaagtacacccgcatcagcactggaggaggagaaacagaggagaccctgaagaagctgctgcaggaggacacccctgtgaggaagctgcaggccaacaagaaggtgcagggcagcagaagaaggctgcgggagggccgcagccagtag

SEQ ID NO: 163560 - DNA, 834 bp, Artificial Sequence
  Description of Artificial Sequence: Synthetic coding sequence
atgaggatggagggcatgaagggctgcccagctgtgctgcccatcgaccacgtgtatggcaccctgggcatcgtgggcgccaccaccacccagcgctacagtgatgccagcaagctgcgggaggagattgagggcaagggcagcttcacctactttgcccccagcaatgaggcctgggacaacctggacagcgacatcagaagaggcctggagagcaatgtgaatgtggagctgctgaatgccctgcacagccacatgatcaacaagaggatgctgaccaaggacctgaagaatggcatgatcatccccagcatgtacaacaacctgggcctcttcatcaaccactaccccaacggggtggtgacagtgaactgtgcccgcatcatccacggcaaccagatcgccaccaatggagtggtgcacgtgattgacagagtgctgacccagatcggcaccagcatccaggacttcatcgaggctgaagatgacctgagcagcttccgggccgccgccatcaccagtgacatcctggaggccctgggcagagatggccacttcaccctgtttgcccccaccaatgaggcctttgagaagctgccccggggcgtgctggagcgcatcatgggagacaaggtggccagcgaggccctgatgaagtaccacatcctgaacaccctgcagtgcagcgagagcatcatgggcggcgctgtgtttgagaccctggagggcaacaccatcgagatcggctgtgatggagacagcatcaccgtgaatggcatcaagatggtgaacaagaaggacatcgtgaccaactggtgtgacccctttgattag

SEQ ID NO: 163561 - DNA, 2346 bp, Artificial Sequence
  Description of Artificial Sequence: Synthetic coding sequence
atgatccccttcctgcccatgttcagcctgctgctgctgctgattgtgaaccccatcaatgccaacaaccactatgacaagatcctggcccacagccgcatccggggccgggaccagggccccaacgtgtgtgccctgcagcagatcctgggcaccaagaagaagtacttcagcacctgcaagaactggtacaagaagagcatctgtggccagaagaccaccgtgctgtatgagtgctgccccggctacatgaggatggagggcatgaagggctgcccagctgtgctgcccatcgaccacgtgtatggcaccctgggcatcgtgggcgccaccaccacccagcgctacagtgatgccagcaagctgcgggaggagattgagggcaagggcagcttcacctactttgcccccagcaatgaggcctgggacaacctggacagcgacatccggcggggcctggagagcaatgtgaatgtggagctgctgaatgccctgcacagccacatgatcaacaagaggatgctgaccaaggacctgaagaatggcatgatcatccccagcatgtacaacaacctgggcctcttcatcaaccactacccaaatggagtggtgacagtgaactgtgcccgcatcatccacggcaaccagatcgccaccaacggggtggtgcacgtgattgacagagtgctgacccagatcggcaccagcatccaggacttcattgaagcagaagatgacctgagcagcttccgggctgctgccatcaccagtgacatcctggaggccctgggcagagatggccacttcaccctgtttgcccccaccaatgaggcctttgagaagctgccccggggcgtgctggagcgcatcatgggagacaaggtggccagcgaggccctgatgaagtaccacatcctgaacaccctgcagtgcagcgagagcatcatgggcggcgctgtgtttgagaccctggagggcaacaccattgaaattggctgtgatggagacagcatcaccgtgaatggcatcaagatggtgaacaagaaggacatcgtgaccaacaatggagtcatccacctgattgaccaggtgctgatcccagattctgccaagcaggtgattgagctggccggcaagcagcagaccaccttcacagacctggtggcccagctgggcctggccagcgccctgcggccagatggagagtacaccctgctggcccctgtgaacaatgccttcagtgatgacaccctgtccatggaccagaggctgctgaagctgatcctgcagaaccacatcctgaaggtgaaggtgggcctgaatgagctgtacaacggccagatcctggagaccatcggcggcaagcagctgcgggtgtttgtgtacagaacagctgtgtgcatcgagaacagctgcatggagaagggcagcaagcagggcagaaatggagccatccacatcttccgggagatcatcaagccagctgagaagagcctgcacgagaagctgaagcaggacaagcgcttcagcaccttcctgagcctgctggaggccgctgacctgaaggagctgctgacccagcccggggactggaccctgtttgtgcccaccaatgatgccttcaagggcatgaccagcgaggagaaggagatcctgatccgggacaagaatgccctgcagaacatcatcctgtaccacctgaccccaggagtcttcatcggcaaaggatttgagcccggggtgaccaacatcctgaagaccacccagggcagcaagatcttcctgaaggaggtgaatgacaccctgctggtgaatgagctgaagagcaaggagagtgacatcatgaccaccaacggggtcatccacgtggtggacaagctgctgtacccagctgacacccctgtgggcaatgaccagctgctggagatcctgaacaagctgatcaagtacatccagatcaagtttgtgcggggcagcaccttcaaggagatccctgtgacagtgtaccggcccaccctgaccaaggtgaagattgaaggagagcctgagttccgcctcatcaaggagggggagaccatcacagaggtgatccacggggagcccatcatcaagaagtacaccaagatcattgatggagtgcctgtggagatcacagagaaggagacccgggaggagcgcatcatcactggacctgagatcaagtacacccgcatcagcactggaggaggagaaacagaggagaccctgaagaagctgctgcaggaggacacccctgtgaggaagctgcaggccaacaagaaggtgcagggcagcagaagaaggctgcgggagggccgcagccagtag

SEQ ID NO: 163562 - DNA, 2250 bp, Artificial Sequence
  Description of Artificial Sequence: Synthetic coding sequence
atgatccccttcctgcccatgttcagcctgctgctgctgctgattgtgaaccccatcaatgccaacaaccactatgacaagatcctggcccacagccgcatccggggccgggaccagggccccaacgtgtgtgccctgcagcagatcctgggcaccaagaagaagtacttcagcacctgcaagaactggtacaagaagagcatctgtggccagaagaccaccgtgctgtatgagtgctgccccggctacatgaggatggagggcatgaagggctgcccagctgtgctgcccatcgaccacgtgtatggcaccctgggcatcgtgggcgccaccaccacccagcgctacagtgatgccagcaagctgcgggaggagattgagggcaagggcagcttcacctactttgcccccagcaatgaggcctgggacaacctggacagcgacatccggcggggcctggagagcaatgtgaatgtggagctgctgaatgccctgcacagccacatgatcaacaagaggatgctgaccaaggacctgaagaatggcatgatcatccccagcatgtacaacaacctgggcctcttcatcaaccactacccaaatggagtggtgacagtgaactgtgcccgcatcatccacggcaaccagatcgccaccaacggggtggtgcacgtgattgacagagtgctgacccagatcggcaccagcatccaggacttcattgaagcagaagatgacctgagcagcttccgggctgctgccatcaccagtgacatcctggaggccctgggcagagatggccacttcaccctgtttgcccccaccaatgaggcctttgagaagctgccccggggcgtgctggagcgcatcatgggagacaaggtggccagcgaggccctgatgaagtaccacatcctgaacaccctgcagtgcagcgagagcatcatgggcggcgctgtgtttgagaccctggagggcaacaccattgaaattggctgtgatggagacagcatcaccgtgaatggcatcaagatggtgaacaagaaggacatcgtgaccaacaatggagtcatccacctgattgaccaggtgctgatcccagattctgccaagcaggtgattgagctggccggcaagcagcagaccaccttcacagacctggtggcccagctgggcctggccagcgccctgcggccagatggagagtacaccctgctggcccctgtgaacaatgccttcagtgatgacaccctgtccatggaccagaggctgctgaagctgatcctgcagaaccacatcctgaaggtgaaggtgggcctgaatgagctgtacaacggccagatcctggagaccatcggcggcaagcagctgcgggtgtttgtgtacagaacagctgtgtgcatcgagaacagctgcatggagaagggcagcaagcagggcagaaatggagccatccacatcttccgggagatcatcaagccagctgagaagagcctgcacgagaagctgaagcaggacaagcgcttcagcaccttcctgagcctgctggaggccgctgacctgaaggagctgctgacccagcccggggactggaccctgtttgtgcccaccaatgatgccttcaagggcatgaccagcgaggagaaggagatcctgatccgggacaagaatgccctgcagaacatcatcctgtaccacctgaccccaggagtcttcatcggcaaaggatttgagcccggggtgaccaacatcctgaagaccacccagggcagcaagatcttcctgaaggaggtgaatgacaccctgctggtgaatgagctgaagagcaaggagagtgacatcatgaccaccaacggggtcatccacgtggtggacaagctgctgtacccagctgacacccctgtgggcaatgaccagctgctggagatcctgaacaagctgatcaagtacatccagatcaagtttgtgcggggcagcaccttcaaggagatccctgtgacagtgtacagccctgagatcaagtacacccgcatcagcactggaggaggagaaacagaggagaccctgaagaagctgctgcaggaggaggtgaccaaggtgaccaagttcatcgagggcggagatggccacctgtttgaagatgaggagatcaagaggctgctgcagggcgacacccctgtgaggaagctgcaggccaacaagaaggtgcagggcagcagaagaaggctgcgggagggccgcagccagtag

SEQ ID NO: 163563 - DNA, 399 bp, Artificial Sequence
  Description of Artificial Sequence: Synthetic coding sequence
atgagcaacaagttcctgggcacctggaagctggtgtccagtgaaaattttgatgactacatgaaggccctgggcgtgggcctggccaccaggaagctgggcaacctggccaagcccaccgtcatcatcagcaagaagggggacatcatcaccatcagaacagagagcaccttcaagaacacagagatctccttcaagctgggccaggagtttgaggagaccacagctgacaacaggaagaccaagagcatcgtgaccctgcagaggggcagcctgaaccaggtgcagcgctgggatggcaaggagaccaccatcaagaggaagctggtgaatggcaagatggtggccgagtgcaagatgaagggcgtggtgtgcacccgcatctatgagaaggtgtag

SEQ ID NO: 163564 - DNA, 483 bp, Artificial Sequence
  Description of Artificial Sequence: Synthetic coding sequence
atgctgctgctgctgctgagcatcatcgtgctgcacgtggccgtgctggtgctgctgtttgtgtccaccatcgtgtcccagtggatcgtgggcaatggccacgccacagacctgtggcagaactgcagcaccagcagcagtggaaatgtgcaccactgcttcagcagcagccccaatgagtggctgcagagcgtgcaggccaccatgatcctgagcatcatcttcagcatcctgagcctcttcctgttcttctgccagctgttcaccctgaccaagggcggccgcttctacatcaccggcatcttccagatcctggccggcctgtgtgtgatgtctgctgctgccatctacacagtgcgccaccctgagtggcacctgaacagcgactacagctatggctttgcctacatcctggcctgggtggccttccccctggccctgctgtctggagtcatctacgtgatcctgaggaagcgggagtag

SEQ ID NO: 163565 - DNA, 357 bp, Artificial Sequence
  Description of Artificial Sequence: Synthetic coding sequence
atgctgctgctgctgctgagcatcatcgtgctgcacgtggccgtgctggtgctgctgtttgtgtccaccatcgtgtcccagtggatcgtgggcaatggccacgccacagacctgtggcagaactgcagcaccagcagcagtggaaatgtgcaccactgcttcagcagcagccccaatgagtggctgcagagcgtgcaggccaccatgatcctgagcatcatcttcagcatcctgagcctcttcctgttcttctgccagctgttcaccctgaccaagggcggccgcttctacatcaccggcatcttccagatcctggccgagagcaacagcagccagatgtgtggctacagagactag

SEQ ID NO: 163566 - DNA, 483 bp, Artificial Sequence; identical to SEQ ID NO: 163564
  Description of Artificial Sequence: Synthetic coding sequence

SEQ ID NO: 163567 - DNA, 450 bp, Artificial Sequence
  Description of Artificial Sequence: Synthetic coding sequence
atgctgctgctgctgctgagcatcatcgtgctgcacgtggccgtgctggtgctgctgtttgtgtccaccatcgtgtcccagtggatcgtgggcaatggccacgccacagacctgtggcagaactgcagcaccagcagcagtggaaatgtgcaccactgcttcagcagcagccccaatgagtggctgcagagcgtgcaggccaccatgatcctgagcatcatcttcagcatcctgagcctcttcctgttcttctgccagctgttcaccctgaccaagggcggccgcttctacatcaccggcatcttccagatcctggccggcctgtgtgtgatgtctgctgctgccatctacacagtgcgccaccctgagtggcacctgaacagcgactacagcttccccctggccctgctgagcggggtcatctacgtgatcctgaggaagcgggagtag

SEQ ID NO: 163568 - DNA, 1413 bp, Artificial Sequence
  Description of Artificial Sequence: Synthetic coding sequence
atgagccaccaccccagcggcctgcgggccggcttcagcagcaccagctacagaaggacctttggacctccacccagcctgagccctggggccttctcctacagcagcagcagccgcttcagcagcagccggctgctgggcagcgccagccccagcagctctgtgcggctgggcagcttccgcagccccagggctggagctggggccctgctgcggctgcccagcgagcggctggacttctccatggccgaggccctgaaccaggagttcctggccaccaggagcaatgagaagcaggagctgcaggagctgaatgacagatttgccaacttcatcgagaaggtgcgcttcctggagcagcagaatgctgccctgcggggggagctgagccaggcccggggccaggagcccgcccgggctgaccagctgtgccagcaggagctgcgggagctgcggcgggagctggagctgctgggccgggagcgggacagagtgcaggtggagagagatggcctggccgaggacctggccgccctgaagcagaggctggaggaggagaccaggaagagagaagatgctgagcacaacctggtgctcttcaggaaggatgtggatgatgccaccctgagccggctggagctggagaggaagattgagagcctgatggatgaaattgagttcctgaagaagctgcacgaggaggagctgcgggacctgcaggtgtctgtggagagccagcaggtgcagcaggtggaggtggaggccaccgtgaagccagagctgacagctgccctgcgggacatccgggcccagtatgagagcattgctgccaagaacctgcaggaggccgaggagtggtacaagagcaaatatgctgacctgagtgatgctgccaacagaaaccacgaggccctgcggcaggccaagcaggagatgaatgaaagccggcggcagatccagagcctgacctgtgaggtggatggcctgcggggcaccaatgaggccctgctgcggcagctgcgggagctggaggagcagtttgccctggaggccggcggctaccaggccggggccgcccggctggaggaggagctgcggcagctgaaggaggagatggcccggcacctgcgggagtaccaggagctgctgaatgtgaagatggccctggacattgaaattgccacctacaggaagctgctggagggggaggagagccgcatctctgtgcctgtgcacagctttgccagcctgaacatcaagaccaccgtgcctgaggtggagcccccccaggacagccacagcaggaagacagtgctgatcaagaccatcgagaccagaaatggagaggtggtgacagagagccagaaggagcagaggtctgagctggacaagagcagcgcccacagctactag

SEQ ID NO: 163569 - DNA, 603 bp, Artificial Sequence
  Description of Artificial Sequence: Synthetic coding sequence
atgggccaggagttctcctgggaggaggccgaggccgccggggagattgatgtggccgagctgcaggagtggtacaagaagtttgtgatggagtgccccagcggcaccctcttcatgcatgagttcaagcgcttcttcaaggtgacagatgatgaggaggccagccagtatgtggagggcatgttccgggcctttgacaagaatggagacaacaccatcgacttcctggagtatgtggccgccctgaacctggtgctgcggggcaccctggagcacaagctgaagtggaccttcaagatctatgacaaggatggaaatggctgcatcgaccggctggagctgctgaacatcgtggagggcatctaccagctgaagaaggcctgcagaagagagctgcagacagagcagggccagctgctgaccccagaggaggtggtggaccgcatcttcctgctggtggatgaaaatggagatggccagctgagcctgaatgaatttgtggagggcgcccggcgggacaagtgggtgatgaagatgctgcagatggacatgaaccccagctcctggctggcccagcagaggaggaagagcgccatgttttag

SEQ ID NO: 163570 - DNA, 1104 bp, Artificial Sequence
  Description of Artificial Sequence: Synthetic coding sequence
atgtggagcgagggccgctatgaatatgagcgcatcccccgggagcgggccccacccaggagccaccccagtgatggctacaaccggctggtgaacatcgtgcccaagaagccacccctgctggacaggcctggagagggcagctacaaccgctactacagccacgtggactacagagattatgatgagggccgctccttcagccatgacagaagaagtggccccccccacagaggagatgagagcggctaccgctggaccagagatgaccacagcgccagccggcagcctgagtacagagacatgagagatggcttccggaggaagagcttctacagcagccactacgcccgggagaggagcccctacaagagggacaacaccttcttccgggagagccctgtgggcaggaaggacagcccccacagccgcagcggcagctctgtgagcagccgcagctacagccctgagaggagcaagagctacagcttccaccagagccagcacaggaagtctgtgcggcctggggccagctacaagaggcagaatgaaggcaaccctgagcgggacaaggagaggcctgtgcagagcctgaagaccagccgggacaccagccccagcagcggcagcgctgtgagcagcagcaaggtgctggacaagcccagccggctgacagagaaggagctggccgaggccgccagcaagtgggccgctgagaagctggagaagagtgatgagagcaacctgcctgagatcagtgaatatgaagctggcagcacagcccccctcttcacagaccagcctgaggagcctgagagcaacaccacccatggaattgagctgtttgaggacagccagctgaccaccaggagcaaggccatcgccagcaagaccaaggagattgagcaggtgtaccggcaggactgtgagaccttcggcatggtggtgaagatgctgattgagaaggaccccagcctggagaagagcatccagtttgccctgcggcagaacctgcatgaaattggagagcgctgtgtggaggagctgaagcacttcatcgccgagtatgacaccagcacccaggactttggagagcccttctag

SEQ ID NO: 163571 - DNA, 1377 bp, Artificial Sequence
  Description of Artificial Sequence: Synthetic coding sequence
atgtggagcgagggccgctatgaatatgagcgcatcccccgggagcgggccccacccaggagccaccccagtgatggctacaaccggctggtgaacatcgtgcccaagaagccacccctgctggacaggcctggagagggcagctacaaccgctactacagccacgtggactacagagattatgatgagggccgctccttcagccatgacagaagaagtggccccccccacagaggagatgagagcggctaccgctggaccagagatgaccacagcgccagccggcagcctgagtacagagacatgagagatggcttccggaggaagagcttctacagcagccactacgcccgggagaggagcccctacaagagggacaacaccttcttccgggagagccctgtgggcaggaaggacagcccccacagccgcagcggcagctctgtgagcagccgcagctacagccctgagaggagcaagagctacagcttccaccagagccagcacaggaagtctgtgcggcctggggccagctacaagaggcagaatgaaggcaaccctgagcgggacaaggagaggcctgtgcagagcctgaagaccagccgggacaccagccccagcagcggcagcgctgtgagcagcagcaaggtgctggacaagcccagccggctgacagagaaggagctggccgaggccgccagcaagtgggccgctgagaagctggagaagagtgatgagagcaacctgcctgagatcagtgaatatgaagctggcagcacagcccccctcttcacagaccagcctgaggagcctgagagcaacaccacccatggaattgagctgtttgaggacagccagctgaccaccaggagcaaggccatcgccagcaagaccaaggagattgagcaggtgtaccggcaggactgtgagaccttcggcatggtggtgaagatgctgattgagaaggaccccagcctggagaagagcatccagtttgccctgcggcagaacctgcatgaaattgaatctgctggccagacctggcagcaggtgccccctgtgaggaacacagagatggaccatgatggcaccccagaaaatgaaggagaggagacagcccagagcgccccccagcccccccaggccccccagcccctgcagcccaggaagaagagggtgcggaggaccacccagctgcggaggaccactggagccccagacatcacctggggcatgctgaagaagaccacccaggaggccgagcgcatcctgctgcggacccagacccccttcaccccagagaacctcttcctggccatgctgtctgtggtgcactgcaacagcaggaaggatgtgaagccagagaacaagcagtag

SEQ ID NO: 163572 - DNA, 1125 bp, Artificial Sequence
  Description of Artificial Sequence: Synthetic coding sequence
atggcctacagaagagatgagatgtggagcgagggccgctatgaatatgaaagaatcccccgggagcgggccccacccaggagccaccccagtgatggctacaaccggctggtgaacatcgtgcccaagaagccacccctgctggacaggcctggagagggcagctacaaccgctactacagccacgtggactacagagattatgatgagggccgctccttcagccatgaccggcgcagcggccccccccacagaggagatgaaagtggctaccgctggaccagagatgaccacagcgccagccggcagcctgagtacagagacatgagagatggcttccggaggaagagcttctacagcagccactacgcccgggagaggagcccctacaagagggacaacaccttcttccgggagagccctgtgggcaggaaggacagcccccacagccgcagcggcagctctgtgagcagccgcagctacagccctgagaggagcaagagctacagcttccaccagagccagcacaggaagtctgtgcggcctggggccagctacaagaggcagaatgaaggcaaccctgagcgggacaaggagaggcctgtgcagagcctgaagaccagccgggacaccagccccagcagcggcagcgctgtgagcagcagcaaggtgctggacaagcccagccggctgacagagaaggagctggccgaggccgccagcaagtgggccgctgagaagctggagaagagtgatgagagcaacctgcctgagatcagtgaatatgaggccggcagcacagcccccctcttcacagaccagcctgaggagcctgagagcaacaccacccacggcatcgagctgtttgaggacagccagctgaccaccaggagcaaggccatcgccagcaagaccaaggagattgagcaggtgtaccggcaggactgtgagaccttcggcatggtggtgaagatgctgattgagaaggaccccagcctggagaagagcatccagtttgccctgcggcagaacctgcacgagatcggggagcgctgtgtggaggagctgaagcacttcatcgccgagtatgacaccagcacccaggactttggagagcccttctag

SEQ ID NO: 163573 - DNA, 1305 bp, Artificial Sequence
  Description of Artificial Sequence: Synthetic coding sequence
atgtggagcgagggccgctatgaatatgagcgcatcccccgggagcgggccccacccaggagccaccccagtgatgaaagtggctaccgctggaccagagatgaccacagcgccagccggcagcctgagtacagagacatgagagatggcttccggaggaagagcttctacagcagccactacgcccgggagaggagcccctacaagagggacaacaccttcttccgggagagccctgtgggcaggaaggacagcccccacagccgcagcggcagctctgtgagcagccgcagctacagccctgagaggagcaagagctacagcttccaccagagccagcacaggaagtctgtgcggcctggggccagctacaagaggcagaatgaaggcaaccctgagcgggacaaggagaggcctgtgcagagcctgaagaccagccgggacaccagccccagcagcggcagcgctgtgagcagcagcaaggtgctggacaagcccagccggctgacagagaaggagctggccgaggccgccagcaagtgggccgctgagaagctggagaagagtgatgagagcaacctgcctgagatcagtgaatatgaggccggcagcacagcccccctcttcacagaccagcctgaggagcctgagagcaacaccacccacggcatcgagctgtttgaggacagccagctgaccaccaggagcaaggccatcgccagcaagaccaaggagattgagcaggtgtaccggcaggactgtgagaccttcggcatggtggtgaagatgctgattgagaaggaccccagcctggagaagagcatccagtttgccctgcggcagaacctgcacgagattgagagcgctggccagacctggcagcaggtgccccctgtgaggaacacagagatggaccatgatggcaccccagaaaatgaaggagaggagacagcccagagcgccctgtttggcttccagcatgatgccagcaaccacaccatcgtgggcctgggccccaaccaggtgcctgagatgaaggagaccaccctgcaggccccccagcccccccaggccccccagcccctgcagcccaggaagaagagggtgcggaggaccacccagctgcggaggaccactggagccccagacatcacctggggcatgctgaagaagaccacccaggaggccgagcgcatcctgctgcggacccagacccccttcaccccagagaacctcttcctggccatgctgtctgtggtgcactgcaacagcaggaaggatgtgaagccagagaacaagcagtag

SEQ ID NO: 163574 - DNA, 1047 bp, Artificial Sequence
  Description of Artificial Sequence: Synthetic coding sequence
atgtggagcgagggccgctatgaatatgagcgcatcccccgggagcgggccccacccaggagccaccccagtgatggctacaaccggctggtgaacatcgtgcccaagaagccacccctgctggacaggcctggagagggcagctacaaccgctactacagccacgtggactacagagattatgatgagggccgctccttcagccatgacagaagaagtggccccccccacagaggagatgagagcggctaccgctggaccagagatgaccacagcgccagccggcagcctgagtacagagacatgagagatggcttccggaggaagagcttctacagcagccactacgcccgggagaggagcccctacaagagggacaacaccttcttccgggagagccctgtgggcaggaaggacagcccccacagccgcagcggcagctctgtgagcagccgcagctacagccctgagaggagcaagagctacagcttccaccagagccagcacaggaacaaggagaggcctgtgcagagcctgaagaccagccgggacaccagccccagcagcggcagcgctgtgagcagcagcaaggtgctggacaagcccagccggctgacagagaaggagctggccgaggccgccagcaagtgggccgctgagaagctggagaagagtgatgagagcaacctgcctgagatcagtgaatatgaggccggcagcacagcccccctcttcacagaccagcctgaggagcctgagagcaacaccacccacggcatcgagctgtttgaggacagccagctgaccaccaggagcaaggccatcgccagcaagaccaaggagattgagcaggtgtaccggcaggactgtgagaccttcggcatggtggtgaagatgctgattgagaaggaccccagcctggagaagagcatccagtttgccctgcggcagaacctgcacgagatcggggagcgctgtgtggaggagctgaagcacttcatcgccgagtatgacaccagcacccaggactttggagagcccttctag

SEQ ID NO: 163575 - DNA, 486 bp, Artificial Sequence
  Description of Artificial Sequence: Synthetic coding sequence
atggcctacagaagagatgagatgtggagcgagggccgctatgaatatgaaagaatcccccgggagcgggccccacccaggagccaccccagtgatggctacaaccggctggtgaacatcgtgcccaagaagccacccctgctggacaggcctggagagggcagctacaaccgctactacagccacgtggactacagagattatgatgagggccgctccttcagccatgaccggcgcagcggccccccccacagaggagatgaaagtggctaccgctggaccagagatgaccacagcgccagccggcagcctgagtacagagacatgagagatggcttccggaggaagagcttctacagcagccactacgcccgggagaggagcccctacaagagggacaacaccttcttccgggagagccctgtgggcaggaaggacagcccccacagccgcagcggcagctctgtgagcagccgcagctactag

SEQ ID NO: 163576 - DNA, 507 bp, Artificial Sequence
  Description of Artificial Sequence: Synthetic coding sequence
atgtggagcgagggccgctatgaatatgagcgcatcccccgggagcgggccccacccaggagccaccccagtgatggctacaaccggctggtgaacatcgtgcccaagaagccacccctgctggacaggcctggagagggcagctacaaccgctactacagccacgtggactacagagattatgatgagggccgctccttcagccatgacagaagaagtggccccccccacagaggagatgagagcggctaccgctggaccagagatgaccacagcgccagccggcagcctgagtacagagacatgagagatggcttccggaggaagagcttctacagcagccactacgcccgggagaggagcccctacaagagggacaacaccttcttccgggagagccctgtgggcaggaaggacagcccccacagccgcagcggcagctctgtgagcagccgcagctacagccctgagaggagcaagagctacagcttccaccagagccagtag

SEQ ID NO: 163577 - DNA, 960 bp, Artificial Sequence
  Description of Artificial Sequence: Synthetic coding sequence
atggcctacagaagagatgagatgtggagcgagggccgctatgaatatgaaagaatcccccgggagcgggccccacccaggagccaccccagtgatgagagcggctaccgctggaccagagatgaccacagcgccagccggcagcctgagtacagagacatgagagatggcttccggaggaagagcttctacagcagccactacgcccgggagaggagcccctacaagagggacaacaccttcttccgggagagccctgtgggcaggaaggacagcccccacagccgcagcggcagctctgtgagcagccgcagctacagccctgagaggagcaagagctacagcttccaccagagccagcacaggaagtctgtgcggcctggggccagctacaagaggcagaatgaaggcaaccctgagcgggacaaggagaggcctgtgcagagcctgaagaccagccgggacaccagccccagcagcggcagcgctgtgagcagcagcaaggtgctggacaagcccagccggctgacagagaaggagctggccgaggccgccagcaagtgggccgctgagaagctggagaagagtgatgagagcaacctgcctgagatcagtgaatatgaagctggcagcacagcccccctcttcacagaccagcctgaggagcctgagagcaacaccacccatggaattgagctgtttgaggacagccagctgaccaccaggagcaaggccatcgccagcaagaccaaggagattgagcaggtgtaccggcaggactgtgagaccttcggcatggtggtgaagatgctgattgagaaggaccccagcctggagaagagcatccagtttgccctgcggcagaacctgcatgaaattggagagcgctgtgtggaggagctgaagcacttcatcgccgagtatgacaccagcacccaggactttggagagcccttctag

SEQ ID NO: 163578 - DNA, 5271 bp, Artificial Sequence
  Description of Artificial Sequence: Synthetic coding sequence
atgaacagcctcttcaggaagaggaacaagggcaagtacagccccaccgtgcagaccaggagcatcagcaacaaggagctgtctgagctgattgagcagctgcagaagaatgctgaccaggtggagaagaacatcgtggacacagaggccaagatgcagagcgacctggcccggctgcaggagggccggcagcctgagcacagagatgtgaccctgcagaaggtgctggacagcgagaagctgctgtatgtgctggaggctgatgctgccatcgccaagcacatgaagcacccccagggcgacatgattgctgaggacatccggcagctgaaggagcgggtgaccaacctgcggggcaagcacaagcagatctaccgcctggccgtgaaggaggtggacccccaggtgaactgggccgccctggtggaggagaagctggacaagctgaacaaccagagctttggaacagacctgcccctggtggaccaccaggtggaggagcacaacatcttccacaatgaggtgaaggccatcggcccccacctggccaaggatggagacaaggagcagaacagcgagctgcgggccaagtaccagaagctgctggccgccagccaggcccggcagcagcacctgagcagcctgcaggactacatgcagcgctgcaccaatgagctgtactggctggaccagcaggccaagggccgcatgcagtatgactggagcgacaggaacctggactaccccagcagaagacggcagtatgagaacttcatcaacagaaacctggaggccaaggaggagcgcatcaacaagctgcacagcgagggggaccagctgctggccgctgagcaccctggcaggaacagcattgaggcccacatggaggccgtgcacgccgactggaaggagtacctgaacctgctgatctgtgaggagagccacctgaagtacatggaggactaccaccagttccatgaagatgtgaaggatgcccaggagctgctgaggaaggtggacagcgacctgaaccagaagtatggccctgacttcaaggaccgctaccagatcgagctgctgctgcgggagctggatgaccaggagaaggtgctggacaagtatgaagatgtggtgcagggcctgcagaagaggggccagcaggtggtgcccctgaagtaccgccgggagacccccctgaagcccatccctgtggaggccctgtgtgactttgaaggagagcagggcctcatcagccggggctacagctacaccctgcagaagaacaatggagagagctgggagctgatggacagcgctggcaacaagctgattgccccagctgtgtgcttcgtcatccccccaacagatcctgaggccctggccctggccgacagcctgggcagccagtacagatctgtgcggcagaaggccgccggcagcaagaggaccctgcagcagagatatgaggtgctgaagacagagaaccctggagatgccagtgacctgcagggccggcagctgctggccggcctggacaaggtggccagtgacctggaccggcaggagaaggccatcaccggcatcctgcggccccccctggagcagggccgggctgtgcaggacagcgctgagcgggccaaggacctgaagaacatcaccaatgagctgctgagaattgagcctgagaagaccaggagcacagctgagggggaggccttcatccaggccctgcccggcagcggcaccacccccctgctgcggaccagggtggaggacaccaacagaaaatatgagcacctgctgcagctgctggacctggcccaggagaaggtggatgtggccaaccggctggagaagagcctgcagcagagctgggagctgctggccacccatgagaaccacctgaaccaggatgacacagtgcctgagagcagccgggtgctggacagcaagggccaggagctggccgccatggcctgtgagctgcaggcccagaagagcctgctgggggaggtggagcagaacctgcaggccgccaagcagtgcagcagcaccctggccagccgcttccaggagcactgcccagacctggagcggcaggaggccgaggtgcacaagctgggccagcgcttcaacaacctgcggcagcaggtggagcggcgggcccagagcctgcagagcgccaaggccgcctatgagcacttccaccggggccatgaccacgtgctgcagttcctggtgtccatccccagctatgagccccaggagacagacagcctgagccagatggagaccaagctgaagaaccagaagaacctgctggatgaaattgccagccgggagcaggaggtgcagaagatctgtgccaacagccagcagtaccagcaggccgtgaaggactatgagctggaggccgagaagctgcggagcctgctggacctggagaatggccgccgcagccacgtgtccaagagggcccggctgcagagccctgccaccaaggtgaaggaggaggaggccgccctggccgccaagttcacagaggtgtatgccatcaaccggcagaggctgcagaacctggagtttgccctgaacctgctgcggcagcagcctgaggtggaggtgacccatgagaccctgcagaggaacagaccagattctggagtggaggaggcctggaagatcaggaaggagctggatgaggagacagaaagaagacggcagctggagaatgaggtgaagagcacccaggaggagatctggaccctgaggaaccagggcccccaggagagcgtggtgaggaaggaggtgctgaagaaggtgcctgaccctgtgctggaggagagcttccagcagctgcagaggaccctggccgaggagcagcacaagaaccagctgctgcaggaggagctggaggccctgcagctgcagctgcgggccctggagcaggagaccagagatggcggccaggagtatgtggtgaaggaggtgctgcgcatcgagccagaccgggcccaggctgatgaggtgctgcagctgcgggaggagctggaggccctgcggcggcagaagggggcccgggaggccgaggtgctgctgctgcagcagagggtggccgccctggccgaggagaagagccgggcccaggagaaggtgacagagaaggaggtggtgaagctgcagaatgacccccagctggaggccgagtaccagcagctgcaggaggaccaccagaggcaggaccagctgcgggagaagcaggaggaggagctgtccttcctgcaggacaagctgaagaggctggagaaggagcgggccatggccgagggcaagatcaccgtgaaggaggtgctgaaggtggagaaggatgctgccacagagcgggaggtgtctgacctgacccggcagtatgaagatgaagctgccaaggcccgggccagccagcgggagaagacagagctgctgaggaagatctgggccctggaggaggagaatgccaaggtggtggtgcaggagaaggtgcgggagatcgtgcggccagaccccaaggccgagagcgaggtggccaacctgcggctggagctggtggagcaggagaggaagtacagaggagctgaggagcagctgcggagctaccagagcgagctggaggccctgcggcggcggggcccccaggtggaggtgaaggaggtgaccaaggaggtgatcaagtacaagacagatcctgagatggagaaggagctgcagaggctgcgggaggagatcgtggacaagaccaggctcatcgagcgctgtgacctggagatctaccagctgaagaaggagatccaggccctgaaggacaccaagccccaggtgcagaccaaggaggtggtgcaggagatcctgcagttccaggaggacccccagaccaaggaggaggtggccagcctgcgggccaagctgtctgaggagcagaagaagcaggtggacctggagcgggagcgggccagccaggaggagcagatcgccaggaaggaggaggagctgagccgggtgaaggagcgggtggtgcagcaggaggtggtgcgctatgaggaggagcccggcctgcgggcagaggccagcgcctttgctgagagcattgatgtggagctgcggcagattgacaagctgcgggcagagctgcggcggctgcagaggagaagaacagagctggagcggcagctggaggagctggagcgggagcggcaggcccggcgggaggccgagcgggaggtgcagaggctgcagcagaggctggccgccctggagcaggaggaggccgaggcccgggagaaggtgacccacacccagaaggtggtgctgcagcaggacccccagcaggcccgggagcacgccctgctgcggctgcagctggaggaggagcagcaccggcggcagctgctggagggggagctggagaccctgcggaggaagctggccgccctggagaaggccgaggtgaaggagaaggtggtgctgtctgagagcgtgcaggtggagaagggggacacagagcaggagatccagaggctgaagagcagcctggaggaggagagccgcagcaagcgggagctggatgtggaggtgtcccggctggaggcccggctgtctgagctggagttccacaacagcaagagcagcaaggagctggacttcctgcgggaggagaaccacaagctgcagctggagcggcagaacctgcagctggagacccggcggctgcagagcgagatcaacatggccgccacagagacccgggacctgaggaacatgacagtggccgacagcggcaccaaccacgacagccggctgtggagcctggagcgggagctggatgacctgaagaggctgagcaaggacaaggacctggagattgatgagctgcagaagaggctgggctctgtggccgtgaagcgggagcagcgggagaaccacctgcggcgcagcatcgtggtgatccacccagacaccggccgggagctgagccctgaggaggcccacagagctggcctgattgactggaacatgtttgtgaagctgcggagccaggagtgtgactgggaggagatctctgtgaagggccccaacggggagagcagcgtcatccatgacaggaagagcggcaagaagttcagcattgaggaggccctgcagagcggccgcctgaccccagcccagtatgaccgctacgtgaacaaggacatgagcatccaggagctggccgtgctggtgtctggccagaagtag

SEQ ID NO: 163579 - DNA, 4440 bp, Artificial Sequence
  Description of Artificial Sequence: Synthetic coding sequence
atggccaagaggagccggggccctggccgccgctgcctgctggccctggtgctcttctgtgcctggggcaccctggccgtggtggcccagaagccaggggccggctgccccagccgctgcctgtgcttccgcaccaccgtgcgctgcatgcacctgctgctggaggccgtgcctgctgtggccccccagaccagcatcctggacctgcgcttcaaccgcatccgggagatccagcccggggccttccggcggctgaggaacctgaacaccctgctgctgaacaacaaccagatcaagaggatccccagcggggcctttgaggacctggagaacctgaagtacctgtacctgtacaagaatgagatccagagcattgaccggcaggccttcaagggcctggccagcctggagcagctgtacctgcacttcaaccagatcgagaccctggaccctgacagcttccagcacctgcccaagctggagcggctcttcctgcacaacaaccgcatcacccacctggtgcccggcaccttcaaccacctggagagcatgaagaggctgcggctggacagcaacaccctgcactgtgactgtgagatcctgtggctggccgacctgctgaagacctatgcagagagcggaaatgcccaggccgccgccatctgtgagtacccccggcgcatccagggccgctctgtggccaccatcaccccagaggagctgaactgtgagcggccccgcatcaccagcgagccccaggatgctgatgtgaccagcggcaacacagtgtacttcacctgcagagctgagggcaaccccaagccagagatcatctggctgaggaacaacaatgagctgtccatgaagacagacagccggctgaacctgctggatgatggcaccctgatgatccagaacacccaggagacagaccagggcatctaccagtgcatggccaagaatgtggccggggaggtgaagacccaggaggtgaccctgcgctacttcggcagccctgcccggcccaccttcgtcatccagccccagaacacagaggtgctggtgggggagagcgtgaccctggagtgcagcgccaccggccaccccccaccccgcatctcctggaccaggggggacaggacccccctgcctgtggacccccgggtgaacatcacccccagcggcggcctgtacatccagaatgtggtgcagggcgacagcggggagtatgcctgcagcgccaccaacaacatcgacagcgtgcacgccacagccttcatcatcgtgcaggccctgccccagttcaccgtgaccccccaggacagagtggtgattgagggccagacagtggacttccagtgtgaggccaagggcaaccccccacctgtgattgcctggaccaagggcggcagccagctgtctgtggacagaagacacctggtgctgagcagcggcaccctgcgcatcagcggcgtggccctgcatgaccagggccagtatgagtgccaggccgtgaacatcatcggcagccagaaggtggtggcccacctgactgtgcagccccgggtgacccctgtgtttgccagcatccccagcgacaccaccgtggaggtgggcgccaacgtgcagctgccctgcagcagccagggcgagcctgagcccgccatcacctggaacaaggatggagtgcaggtgacagagagcggcaagttccacatcagccctgagggcttcctgaccatcaatgatgtgggccctgcagatgctggccgctatgaatgtgtggccaggaacaccatcggcagcgcctctgtgtccatggtgctgtctgtgaatgtgcctgatgtgtccagaaatggagacccctttgtggccaccagcatcgtggaggccatcgccaccgtggaccgggccatcaacagcaccaggacccacctgtttgacagccggcccaggagccccaatgacctgctggccctcttccgctacccccgggacccctacacagtggagcaggcccgggccggggagatctttgagaggaccctgcagctgatccaggagcacgtgcagcacggcctgatggtggacctgaatggcaccagctaccactacaatgacctggtgagcccccagtacctgaacctgattgccaacctgagcggctgcacagcccacagaagagtgaacaactgcagcgacatgtgcttccaccagaagtaccgcacccatgatggcacctgcaacaacctgcagcaccccatgtggggcgccagcctgacagcctttgagcggctgctgaagtctgtgtatgaaaatggcttcaacaccccccggggcatcaacccccaccggctgtacaacggccacgccctgcccatgccccggctggtgtccaccaccctgattggaacagaaacagtgaccccagatgagcagttcacccacatgctgatgcagtggggccagttcctggaccatgacctggacagcacagtggtggccctgagccaggcccgcttcagtgatggccagcactgcagcaatgtgtgcagcaatgaccccccctgcttctctgtgatgatccccccaaatgacagccgggcccggagcggggcccgctgcatgttctttgtgcgcagcagccctgtgtgtggcagcggcatgaccagcctgctgatgaacagcgtgtacccccgggagcagatcaaccagctgaccagctacattgatgccagcaatgtgtatggcagcacagaacatgaggcccggagcatccgggacctggccagccaccggggcctgctgcggcagggcatcgtgcagaggtctgggaagcccctgctgccctttgccactggaccacccacagagtgcatgagagatgaaaatgaaagccccatcccctgcttcctggccggggaccaccgggccaatgagcagctgggcctgacctccatgcacaccctgtggttccgggagcacaaccgcatcgccacagagctgctgaagctgaacccccactgggatggagacaccatctactatgagaccaggaagatcgtgggcgctgagatccagcacatcacctaccagcactggctgcccaagatcctgggggaggtgggcatgaggaccctgggggagtaccacggctatgaccccggcatcaatgccggcatcttcaatgcctttgccacagctgccttccgcttcggccacaccctggtgaaccccctgctgtaccgcctggatgagaacttccagcccatcgcccaggaccacctgcccctgcacaaggccttcttcagccccttccgcatcgtgaatgaaggaggcatcgaccccctgctgcggggcctgtttggagtggccggcaagatgagggtgcccagccagctgctgaacacagagctgacagagcggctcttctccatggcccacacagtggccctggacctggccgccatcaacatccagaggggccgggaccacggcatccccccctaccatgactacagagtgtactgcaacctgtctgctgcccacacctttgaggacctgaagaatgagatcaagaaccctgagatccgggagaagctgaagaggctgtatggcagcaccctgaacatcgacctcttccctgccctggtggtggaggacctggtgcccggcagccggctgggccccaccctgatgtgcctgctgagcacccagttcaagaggctgagagatggagaccggctgtggtatgagaaccctggggtcttctccccagcccagctgacccagatcaagcagaccagcctggcccgcatcctgtgtgacaatgctgacaacatcaccagggtgcagagtgatgtgttccgggtggccgagttcccccacggctacggcagctgtgatgagatcccccgggtggacctgcgggtgtggcaggactgctgtgaggactgcaggacccggggccagttcaatgccttctcctaccacttccggggcagaagaagcctggagttctcctaccaggaggacaagcccaccaagaagacccggcccaggaagatccccagcgtgggccggcagggcgagcacctgagcaacagcaccagcgccttcagcaccaggagtgatgccagcggcaccaatgacttccgggagtttgtgctggagatgcagaagaccatcacagacctgcggacccagatcaagaagctggagagccggctgagcaccacagaatgtgtggatgctggaggagagagccacgccaacaacaccaagtggaagaaggatgcctgcaccatctgtgagtgcaaggatggccaggtgacctgctttgtggaggcctgccccccagccacctgtgctgtgcctgtgaacatccctggggcctgctgccctgtgtgcctgcagaagagagctgaggagaagccctag

SEQ ID NO: 163580 - DNA, 2172 bp, Artificial Sequence
  Description of Artificial Sequence: Synthetic coding sequence
tgaagaggccctggccgccgctgcctgctggccctggtgctcttctgtgcctggggcaccctggccgtggtggcccagaagccaggggccggctgccccagccgctgcctgtgcttccgcaccaccgtgcgctgcatgcacctgctgctggaggccgtgcctgctgtggccccccagaccagcatcctggacctgcgcttcaaccgcatccgggagatccagcccggggccttccggcggctgaggaacctgaacaccctgctgctgaacaacaaccagatcaagaggatccccagcggggcctttgaggacctggagaacctgaagtacctgtacctgtacaagaatgagatccagagcattgaccggcaggccttcaagggcctggccagcctggagcagctgtacctgcacttcaaccagatcgagaccctggaccctgacagcttccagcacctgcccaagctggagcggctcttcctgcacaacaaccgcatcacccacctggtgcccggcaccttcaaccacctggagagcatgaagaggctgcggctggacagcaacaccctgcactgtgactgtgagatcctgtggctggccgacctgctgaagacctatgcagagagcggaaatgcccaggccgccgccatctgtgagtacccccggcgcatccagggccgctctgtggccaccatcaccccagaggagctgaactgtgagcggccccgcatcaccagcgagccccaggatgctgatgtgaccagcggcaacacagtgtacttcacctgcagagctgagggcaaccccaagccagagatcatctggctgaggaacaacaatgagctgtccatgaagacagacagccggctgaacctgctggatgatggcaccctgatgatccagaacacccaggagacagaccagggcatctaccagtgcatggccaagaatgtggccggggaggtgaagacccaggaggtgaccctgcgctacttcggcagccctgcccggcccaccttcgtcatccagccccagaacacagaggtgctggtgggggagagcgtgaccctggagtgcagcgccaccggccaccccccaccccgcatctcctggaccaggggggacaggacccccctgcctgtggacccccgggtgaacatcacccccagcggcggcctgtacatccagaatgtggtgcagggcgacagcggggagtatgcctgcagcgccaccaacaacatcgacagcgtgcacgccacagccttcatcatcgtgcaggccctgccccagttcaccgtgaccccccaggacagagtggtgattgagggccagacagtggacttccagtgtgaggccaagggcaaccccccacctgtgattgcctggaccaagggcggcagccagctgtctgtggacagaagacacctggtgctgagcagcggcaccctgcgcatcagcggcgtggccctgcatgaccagggccagtatgagtgccaggccgtgaacatcatcggcagccagaaggtggtggcccacctgactgtgcagccccgggtgacccctgtgtttgccagcatccccagcgacaccaccgtggaggtgggcgccaacgtgcagctgccctgcagcagccagggcgagcctgagcccgccatcacctggaacaaggatggagtgcaggtgacagagagcggcaagttccacatcagccctgagggcttcctgaccatcaatgatgtgggccctgcagatgctggccgctatgaatgtgtggccaggaacaccatcggcagcgcctctgtgtccatggtgctgtctgtgaatgtgcctgatgtgtccagaaatggagacccctttgtggccaccagcatcgtggaggccatcgccaccgtggaccgggccatcaacagcaccaggacccacctgtttgacagccggcccaggagccccaatgacctgctggccctcttccgctacccccgggacccctacacagtggagcaggcccgggccggggagatctttgagaggaccctgcagctgatccaggagcacgtgcagcacggcctgatggtggacctgaatggcaccagccagtgccagagcctcttcttcctgctgcacggcctgagcaatggagtggagcacgcctctgtgaagagccacagctag

SEQ ID NO: 163581 - DNA, 771 bp, Artificial Sequence
  Description of Artificial Sequence: Synthetic coding sequence
atggctgctgctgtgggccgcctgctgcgggcctctgtggcccggcacgtgtctgccatcccctggggcatcagcgccacagctgccctgcggcctgctgcctgtggccgcaccagcctgaccaacctgctgtgcagcggcagcagccaggccaagctgttcagcaccagcagcagctgccacgccccagctgtgacccagcacgccccctacttcaagggcacagctgtggtgaatggagagttcaaggacctgagcctggatgacttcaagggcaagtacctggtgctcttcttctaccccctggacttcacctttgtgtgccccacagagatcgtggccttcagtgacaaggccaatgagttccatgatgtgaactgtgaggtggtggccgtgtctgtggacagccacttcagccacctggcctggatcaacacccccaggaagaatggaggcctgggccacatgaacatcgccctgctgagtgacctgaccaagcagatcagccgggactatggagtgctgctggagggcagcggcctggccctgcggggcctcttcatcatcgaccccaacggggtcatcaagcacctgtctgtgaatgacctgcctgtgggccgctctgtggaggagaccctgcggctggtgaaggccttccagtatgtggagacccatggagaggtgtgcccagccaactggaccccagacagccccaccatcaagcccagccctgctgccagcaaggagtacttccagaaggtgaaccagtag

SEQ ID NO: 163582 - DNA, 717 bp, Artificial Sequence
  Description of Artificial Sequence: Synthetic coding sequence
atggctgctgctgtgggccgcctgctgcgggcctctgtggcccggcacgtgtctgccatcccctggggcatcagcgccacagctgccctgcggcctgctgcctgtggccgcaccagcctgaccaacctgctgtgcagcggcagcagccaggccccctacttcaagggcacagctgtggtgaatggagagttcaaggacctgagcctggatgacttcaagggcaagtacctggtgctcttcttctaccccctggacttcacctttgtgtgccccacagagatcgtggccttcagtgacaaggccaatgagttccatgatgtgaactgtgaggtggtggccgtgtctgtggacagccacttcagccacctggcctggatcaacacccccaggaagaatggaggcctgggccacatgaacatcgccctgctgagtgacctgaccaagcagatcagccgggactatggagtgctgctggagggcagcggcctggccctgcggggcctcttcatcatcgaccccaacggggtcatcaagcacctgtctgtgaatgacctgcctgtgggccgctctgtggaggagaccctgcggctggtgaaggccttccagtatgtggagacccatggagaggtgtgcccagccaactggaccccagacagccccaccatcaagcccagccctgctgccagcaaggagtacttccagaaggtgaaccagtag

SEQ ID NO: 163583 - DNA, 645 bp, Artificial Sequence
  Description of Artificial Sequence: Synthetic coding sequence
atgggcctggccggcgtgtgtgccctgcggcgctctgctggctacatcctggtgggcggggccggcggccagagcgctgctgctgctgcccggcgctacagcgagggggagtgggccagcggcggcgtgcgctccttcagcagagctgctgctgccatggcccccatcaaggtgggagatgccatcccagctgtggaggtgtttgaaggagagcccggcaacaaggtgaacctggccgagctgttcaagggcaagaagggcgtgctgtttggagtgcctggggccttcaccccaggctgcagcaagacccacctgcccggctttgtggagcaggccgaggccctgaaggccaagggcgtgcaggtggtggcctgcctgtctgtgaatgatgcctttgtgactggagagtggggccgggcccacaaggccgagggcaaggtgcggctgctggccgaccccaccggggccttcggcaaggagacagacctgctgctggatgacagcctggtgtccatctttggaaacagaaggctgaagcgcttctccatggtggtgcaggacggcatcgtgaaggccctgaatgtggagccagatggcaccggcctgacctgcagcctggcccccaacatcatcagccagctgtag

SEQ ID NO: 163584 - DNA, 378 bp, Artificial Sequence
  Description of Artificial Sequence: Synthetic coding sequence
atgggcctggccggcgtgtgtgccctgcggcgctctgctggctacatcctggtgggcggggccggcggccagagcgctgctgctgctgcccggcgctacagcgagggggagtgggccagcggcggcgtgcgctccttcagcagagctgctgctgccatggcccccatcaaggtgcggctgctggccgaccccactggagccttcggcaaggagacagacctgctgctggatgacagcctggtgtccatcttcggcaacagaaggctgaagcgcttctccatggtggtgcaggacggcatcgtgaaggccctgaatgtggagccagatggcaccggcctgacctgcagcctggcccccaacatcatcagccagctgtag

SEQ ID NO: 163585 - DNA, 513 bp, Artificial Sequence
  Description of Artificial Sequence: Synthetic coding sequence
atgggcctggccggcgtgtgtgccctgcggcgctctgctggctacatcctggtgggcggggccggcggccagagcgctgctgctgctgcccggcgctacagcgagggggagtgggccagcggcggcgtgcgctccttcagcagagctgctgctgccatggcccccatcaaggtgggagatgccatcccagctgtggaggtgtttgaaggagagcccggcaacaaggtgaacctggccgagctgttcaagggcaagaagggcgtgctgtttggagtgcctggggccttcaccccaggctgcagcaaggtgcggctgctggccgaccccaccggggccttcggcaaggagacagacctgctgctggatgacagcctggtgtccatctttggaaacagaaggctgaagcgcttctccatggtggtgcaggacggcatcgtgaaggccctgaatgtggagccagatggcaccggcctgacctgcagcctggcccccaacatcatcagccagctgtag

SEQ ID NO: 163586 - DNA, 675 bp, Artificial Sequence
  Description of Artificial Sequence: Synthetic coding sequence
atgcctgggggcctgctgctgggagatgtggcccccaactttgaggccaacaccaccgtgggccgcatccgcttccatgacttcctgggggacagctggggcatcctcttcagccacccccgggacttcacccctgtgtgcaccacagagctgggccgggccgccaagctggcccctgagtttgccaagagaaatgtgaagctgattgccctgagcattgattctgtggaggaccacctggcctggagcaaggacatcaatgcctacaactgtgaggagcccacagagaagctgcccttccccatcattgatgacaggaaccgggagctggccatcctgctgggcatgctggaccctgctgagaaggatgagaagggcatgcctgtgacagcccgggtggtgtttgtgtttggaccagacaagaagctgaagctgagcatcctgtacccagccaccactggaagaaactttgatgagatcctgcgggtggtgatcagcctgcagctgacagctgagaagagggtggccacccctgtggactggaaggatggagacagcgtgatggtgctgcccaccatccctgaggaggaggccaagaagctgttccccaagggcgtcttcaccaaggagctgcccagcggcaagaagtacctgcgctacaccccccagccctag

SEQ ID NO: 163587 - DNA, 3852 bp, Artificial Sequence
  Description of Artificial Sequence: Synthetic coding sequence
atgtggggcagtgaccggctggccggggccggcggcggcggcgctgctgtgacagtggccttcaccaatgcccgggactgcttcctgcacctgccccggcggctggtggcccagctgcacctgctgcagaaccaggccatcgaggtggtgtggagccaccagcctgccttcctgtcctgggtggagggccgccacttcagtgaccagggagaaaatgtggccgagatcaaccggcaggtgggccagaagctgggcctgagcaatggaggccaggtgttcctgaagccctgcagccacgtggtgtcctgccagcaggtggaggtggagcccctgtctgcagatgactgggagatcctggagctgcatgctgtgtccctggagcagcacctgctggaccagatccgcatcgtgttccccaaggccatcttccctgtgtgggtggaccagcagacctacatcttcatccagatcgtggccctgatcccagctgccagctatggccgcctggagacagacaccaagctgctgatccagcccaagacccggcgggccaaggagaacaccttcagcaaggcagatgctgagtacaagaagctgcacagctatggccgggaccagaagggcatgatgaaggagctgcagaccaagcagctgcagagcaacacagtgggcatcacagagagcaatgaaaatgaaagtgagatccctgtggacagcagctctgtggccagcctgtggaccatgattggcagcatcttctccttccagagcgagaagaagcaggagacctcctggggcctgacagagatcaatgccttcaagaacatgcagagcaaggtggtgcccctggacaacatcttccgggtgtgcaagagccagccccccagcatctacaatgccagcgccaccagcgtcttccacaagcactgtgccatccacgtgttcccctgggaccaggagtactttgatgtggagcccagcttcaccgtgacctacggcaagctggtgaagctgctgagccccaagcagcagcagagcaagaccaagcagaatgtgctgagccctgagaaggagaagcagatgtctgagcccctggaccagaagaagatccgcagtgaccacaatgaagaagatgagaaggcctgtgtgctgcaggtggtgtggaatggcctggaggagctgaacaatgccatcaagtacaccaagaatgtggaggtgctgcacctgggcaaggtgtggatcccagatgacctgaggaagaggctgaacatcgagatgcatgctgtggtgcgcatcacccctgtggaggtgacccccaagatccccaggagcctgaagctgcagccccgggagaacctgcccaaggacatcagcgaggaggacatcaagacagtgttctacagctggctgcagcagagcaccaccaccatgctgcccctggtgatcagcgaggaggagttcatcaagctggagaccaaggatggcctgaaggagttcagcctgagcatcgtgcacagctgggagaaggagaaggacaagaacatcttcctgctgagccccaacctgctgcagaagaccaccatccaggtgctgctggaccccatggtgaaggaggagaacagcgaggagattgacttcatcctgcccttcctgaagctgagcagcctgggcggcgtgaacagcctgggcgtgagcagcctggagcacatcacccacagcctgctgggccggcccctgagccggcagctgatgagcctggtggccggcctgagaaatggagccctgctgctgaccggcggcaaaggaagtggcaagagcaccctggccaaggccatctgcaaggaggcctttgacaagctggatgcccacgtggagcgggtggactgcaaggccctgcggggcaagaggctggagaacatccagaagaccctggaggtggccttcagcgaggccgtgtggatgcagcccagcgtggtgctgctggatgacctggacctgattgctggcctgcctgctgtgcctgagcacgagcacagcccagatgctgtgcagagccagaggctggcccacgccctgaatgacatgatcaaggagttcatctccatgggcagcctggtggccctgattgccaccagccagagccagcagagcctgcaccccctgctggtgtctgcccagggcgtgcacatcttccagtgtgtgcagcacatccagccccccaaccaggagcagagatgtgagatcctgtgcaacgtcatcaagaacaagctggactgtgacatcaacaagttcacagacctggacctgcagcacgtggccaaggagaccggcggctttgtggcccgggacttcaccgtgctggtggaccgggccatccacagccggctgagccggcagagcatcagcacccgggagaagctggtgctgaccaccctggacttccagaaggccctgcggggcttcctgcctgccagcctgcggtctgtgaacctgcacaagccccgggacctgggctgggacaagattggaggcctgcacgaggtgcggcagatcctgatggacaccatccagctgcctgccaagtacccagagctgtttgccaacctgcccatccggcagaggacaggcatcctgctgtatggccccccaggcaccgggaagaccctgctggccggggtcatcgcccgggagagcaggatgaacttcatctctgtgaagggccctgagctgctgagcaagtacatcggggccagcgagcaggccgtgcgggacatcttcatccgggcccaggccgccaagccctgcatcctcttctttgatgaatttgagagcatcgccccccggcggggccatgacaacacaggagtgacagacagagtggtgaaccagctgctgacccagctggatggagtggagggcctgcagggcgtgtatgtgctggccgccaccagcaggccagacctgattgatcctgccctgctgcggcccggccgcctggacaagtgtgtgtactgccccccaccagaccaggtgtcccggctggagatcctgaatgtgctgagtgacagcctgcccctggctgatgatgtggacctgcagcacgtggcctctgtgacagacagcttcaccggggctgacctgaaggccctgctgtacaatgcccagctggaggccctgcacggcatgctgctgagcagcggcctgcaggacggcagcagcagcagtgacagcgacctgagcctgagctccatggtgttcctgaaccacagcagcggcagtgatgacagcgctggagatggagaatgtggcctggaccagagcctggtgtccctggagatgtctgagatcctgcctgatgagagcaagttcaacatgtaccgcctgtacttcggcagcagctatgagagcgagctgggcaatggcaccagcagtgacctgagcagccagtgcctgagcgcccccagctccatgacccaggacctgcccggggtgcctgggaaggaccagctgttcagccagccccctgtgctgaggacagccagccaggagggctgccaggagctgacccaggagcagagggaccagctgcgggctgacatcagcatcatcaagggccgctaccgcagccagagcggagaagatgagagcatgaaccagcccggccccatcaagacccggctggccatcagccagagccacctgatgacagccctgggccacacccggcccagcatcagtgaagatgactggaagaactttgctgagctgtatgagagcttccagaaccccaagaggaggaagaaccagagcggcaccatgttccggcccggccagaaggtgaccctggcctag

SEQ ID NO: 163588 - DNA, 3681 bp, Artificial Sequence
  Description of Artificial Sequence: Synthetic coding sequence
atgtggggcagtgaccggctggccggggccggcggcggcggcgctgctgtgacagtggccttcaccaatgcccgggactgcttcctgcacctgccccggcggctggtggcccagctgcacctgctgcagaaccaggccatcgaggtggtgtggagccaccagcctgccttcctgtcctgggtggagggccgccacttcagtgaccagggagaaaatgtggccgagatcaaccggcaggtgggccagaagctgggcctgagcaatggaggccaggtgttcctgaagccctgcagccacgtggtgtcctgccagcaggtggaggtggagcccctgtctgcagatgactgggagatcctggagctgcatgctgtgtccctggagcagcacctgctggaccagatccgcatcgtgttccccaaggccatcttccctgtgtgggtggaccagcagacctacatcttcatccagatcgtggccctgatcccagctgccagctatggccgcctggagacagacaccaagctgctgatccagcccaagacccggcgggccaaggagaacaccttcagcaaggcagatgctgagtacaagaagctgcacagctatggccgggaccagaagggcatgatgaaggagctgcagaccaagcagctgcagagcaacacagtgggcatcacagagagcaatgaaaatgaaagtgagatccctgtggacagcagctctgtggccagcctgtggaccatgattggcagcatcttctccttccagagcgagaagaagcaggagacctcctggggcctgacagagatcaatgccttcaagaacatgcagagcaaggtggtgcccctggacaacatcttccgggtgtgcaagagccagccccccagcatctacaatgccagcgccaccagcgtcttccacaagcactgtgccatccacgtgttcccctgggaccaggagtactttgatgtggagcccagcttcaccgtgacctacggcaagctggtgaagctgctgagccccaagcagcagcagagcaagaccaagcagaatgtgctgagccctgagaaggagaagcagatgtctgagcccctggaccagaagaagatccgcagtgaccacaatgaagaagatgagaaggcctgtgtgctgcaggtggtgtggaatggcctggaggagctgaacaatgccatcaagtacaccaagaatgtggaggtgctgcacctgggcaaggtgtggatcccagatgacctgaggaagaggctgaacatcgagatgcatgctgtggtgcgcatcacccctgtggaggtgacccccaagatccccaggagcctgaagctgcagccccgggagaacctgcccaaggacatcagcgaggaggacatcaagacagtgttctacagctggctgcagcagagcaccaccaccatgctgcccctggtgatcagcgaggaggagttcatcaagctggagaccaaggatggcctgaaggagttcagcctgagcatcgtgcacagctgggagaaggagaaggacaagaacatcttcctgctgagccccaacctgctgcagaagaccaccatccaggtgctgctggaccccatggtgaaggaggagaacagcgaggagattgacttcatcctgcccttcctgaagctgagcagcctgggcggcgtgaacagcctgggcgtgagcagcctggagcacatcacccacagcctgctgggccggcccctgagccggcagctgatgagcctggtggccggcctgagaaatggagccctgctgctgaccggcggcaaaggaagtggcaagagcaccctggccaaggccatctgcaaggaggcctttgacaagctggatgcccacgtggagcgggtggactgcaaggccctgcgggccctgaatgacatgatcaaggagttcatctccatgggcagcctggtggccctgattgccaccagccagagccagcagagcctgcaccccctgctggtgtctgcccagggcgtgcacatcttccagtgtgtgcagcacatccagccccccaaccaggagcagagatgtgagatcctgtgcaacgtcatcaagaacaagctggactgtgacatcaacaagttcacagacctggacctgcagcacgtggccaaggagactggaggctttgtggcccgggacttcaccgtgctggtggaccgggccatccacagccggctgagccggcagagcatcagcacccgggagaagctggtgctgaccaccctggacttccagaaggccctgcggggcttcctgcctgccagcctgcggtctgtgaacctgcacaagccccgggacctgggctgggacaagattggaggcctgcacgaggtgcggcagatcctgatggacaccatccagctgcctgccaagtacccagagctgtttgccaacctgcccatccggcagaggacaggcatcctgctgtatggccccccaggcaccgggaagaccctgctggccggcgtgattgcccgggagagcaggatgaacttcatctctgtgaagggccctgagctgctgagcaagtacatcggggccagcgagcaggccgtgcgggacatcttcatccgggcccaggccgccaagccctgcatcctcttctttgatgaatttgagagcatcgccccccggcggggccatgacaacacaggagtgacagacagagtggtgaaccagctgctgacccagctggatggagtggagggcctgcagggcgtgtatgtgctggccgccaccagcaggccagacctgattgatcctgccctgctgcggcccggccgcctggacaagtgtgtgtactgccccccaccagaccaggtgtcccggctggagatcctgaatgtgctgagtgacagcctgcccctggctgatgatgtggacctgcagcacgtggcctctgtgacagacagcttcaccggggctgacctgaaggccctgctgtacaatgcccagctggaggccctgcacggcatgctgctgagcagcggcctgcaggacggcagcagcagcagtgacagcgacctgagcctgagctccatggtgttcctgaaccacagcagcggcagtgatgattctgctggagatggagaatgtggcctggaccagagcctggtgtccctggagatgtctgagatcctgcctgatgagagcaagttcaacatgtaccgcctgtacttcggcagcagctatgaaagtgagctgggcaatggcaccagcagtgacctgagcagccagtgcctgagcgcccccagctccatgacccaggacctgcccggggtgcctgggaaggaccagctgttcagccagccccctgtgctgaggacagccagccaggagggctgccaggagctgacccaggagcagagggaccagctgcgggctgacatcagcatcatcaagggccgctaccgcagccagagcggggaggatgagagcatgaaccagcccggccccatcaagacccggctggccatcagccagagccacctgatgacagccctgggccacacccggcccagcatcagtgaagatgactggaagaactttgctgagctgtatgagagcttccagaaccccaagaggaggaagaaccagagcggcaccatgttccggcccggccagaaggtgaccctggcctag

SEQ ID NO: 163589 - DNA, 483 bp, Artificial Sequence
  Description of Artificial Sequence: Synthetic coding sequence
atgagcctggtggccggcctgagaaatggagccctgctgctgactggaggcaagggcagcggcaagagcaccctggccaaggccatctgcaaggaggcctttgacaagctggatgcccacgtggagcgggtggactgcaaggccctgcggggcaagaggctggagaacatccagaagaccctggaggtggccttcagcgaggccgtgtggatgcagcccagcgtggtgctgctggatgacctggacctgattgctggcctgcctgctgtgcctgagcacgagcacagcccagatgctgtgcagagccagaggctggcccacgccctgaatgacatgatcaaggagttcatctccatgggcagcctggtggccctgattgccaccagccagagccagcagagcctgcaccccctgctggtgtctgcccagggcgtgcacatcttccagtgtgtgcagcacatccagccccccaaccagaactag

SEQ ID NO: 163590 - DNA, 1899 bp, Artificial Sequence
  Description of Artificial Sequence: Synthetic coding sequence
atgtggggcagtgaccggctggccggggccggcggcggcggcgctgctgtgacagtggccttcaccaatgcccgggactgcttcctgcacctgccccggcggctggtggcccagctgcacctgctgcagaaccaggccatcgaggtggtgtggagccaccagcctgccttcctgtcctgggtggagggccgccacttcagtgaccagggagaaaatgtggccgagatcaaccggcaggtgggccagaagctgggcctgagcaatggaggccaggtgttcctgaagccctgcagccacgtggtgtcctgccagcaggtggaggtggagcccctgtctgcagatgactgggagatcctggagctgcatgctgtgtccctggagcagcacctgctggaccagatccgcatcgtgttccccaaggccatcttccctgtgtgggtggaccagcagacctacatcttcatccagatcgtggccctgatcccagctgccagctatggccgcctggagacagacaccaagctgctgatccagcccaagacccggcgggccaaggagaacaccttcagcaaggcagatgctgagtacaagaagctgcacagctatggccgggaccagaagggcatgatgaaggagctgcagaccaagcagctgcagagcaacacagtgggcatcacagagagcaatgaaaatgaaagtgagatccctgtggacagcagctctgtggccagcctgtggaccatgattggcagcatcttctccttccagagcgagaagaagcaggagacctcctggggcctgacagagatcaatgccttcaagaacatgcagagcaaggtggtgcccctggacaacatcttccgggtgtgcaagagccagccccccagcatctacaatgccagcgccaccagcgtcttccacaagcactgtgccatccacgtgttcccctgggaccaggagtactttgatgtggagcccagcttcaccgtgacctacggcaagctggtgaagctgctgagccccaagcagcagcagagcaagaccaagcagaatgtgctgagccctgagaaggagaagcagatgtctgagcccctggaccagaagaagatccgcagtgaccacaatgaagaagatgagaaggcctgtgtgctgcaggtggtgtggaatggcctggaggagctgaacaatgccatcaagtacaccaagaatgtggaggtgctgcacctgggcaaggtgtggatcccagatgacctgaggaagaggctgaacatcgagatgcatgctgtggtgcgcatcacccctgtggaggtgacccccaagatccccaggagcctgaagctgcagccccgggagaacctgcccaaggacatcagcgaggaggacatcaagacagtgttctacagctggctgcagcagagcaccaccaccatgctgcccctggtgatcagcgaggaggagttcatcaagctggagaccaaggatggcctgaaggagttcagcctgagcatcgtgcacagctgggagaaggagaaggacaagaacatcttcctgctgagccccaacctgctgcagaagaccaccatccaggtgctgctggaccccatggtgaaggaggagaacagcgaggagattgacttcatcctgcccttcctgaagctgagcagcctgggcggcgtgaacagcctgggcgtgagcagcctggagcacatcacccacagcctgctgggccggcccctgagccggcagctgatgagcctggtggccggcctgagaaatggagccctgctgctgaccggcggcaaaggaagtggcaagagcaccctggccaaggccatctgcaaggaggcctttgacaagctggatgcccacgtggagcgggtggactgcaaggccctgtag

SEQ ID NO: 163591 - DNA, 1041 bp, Artificial Sequence
  Description of Artificial Sequence: Synthetic coding sequence
atggccccagctgctgccagccccccagaggtgatccgggccgcccagaaggatgagtactacagaggaggcctgcggtctgctgctggaggagccctgcacagcctggccggggccaggaagtggctggagtggaggaaggaggtggagctgctgagtgatgtggcctacttcggcctgaccaccctggccggctaccagaccctgggggaggagtatgtgtccatcatccaggtggaccccagccgcatccacgtgcccagcagcctgcggcggggcgtgctggtgaccctgcatgctgtgctgccctacctgctggacaaggccctgctgcccctggagcaggagctgcaggccgaccctgattctggccggcccctgcagggcagcctgggccctgggggccggggctgcagcggggcccggcgctggatgaggcaccacacagccaccctgacagagcagcagaggcgggccctgctgcgggctgtgtttgtgctgcggcagggcctggcctgcctgcagaggctgcacgtggcctggttctacatccatggagtcttctaccacctggccaagaggctgaccggcatcacctaccaggccctgcggccagaccccctgcgggtgctgatgtctgtggcccccagcgccctgcagctgcgggtgcgcagcctgcctggagaggacctgcgggcccgggtgtcctaccgcctgctgggcgtcatcagcctgctgcacctggtgctgtccatgggcctgcagctgtatggcttccggcagaggcagagggccaggaaggagtggaggctgcaccggggcctgagccaccggcgggccagcctggaggagagagctgtgtccaggaaccccctgtgcaccctgtgcctggaggagcggcggcaccccacagccaccccctgtggccacctgttctgctgggagtgcatcacagcctggtgcagcagcaaggccgagtgccccctgtgccgggagaagtttcctccccagaagctgatctacctgcggcactacagatag

SEQ ID NO: 163592 - DNA, 981 bp, Artificial Sequence
  Description of Artificial Sequence: Synthetic coding sequence
atggccccagctgctgccagccccccagaggtgatccgggccgcccagaaggatgagtactacagaggaggcctgcggtctgctgctggaggagccctgcacagcctggccggggccaggaagtggctggagtggaggaaggaggtggagctgctgagtgatgtggcctacttcggcctgaccaccctggccggctaccagaccctgggggaggagtatgtgtccatcatccaggtggaccccagccgcatccacgtgcccagcagcctgcggcggggcgtgctggtgaccctgcatgctgtgctgccctacctgctggacaaggccctgctgcccctggagcaggagctgcaggccgaccctgattctggccggcccctgcagggcagcctgggccctgggggccggggctgcagcggggcccggcgctggatgaggcaccacacagccaccctgacagagcagcagaggcgggccctgctgcgggctgtgtttgtgctgcggcagggcctggcctgcctgcagaggctgcacgtggcctggttctacatccatggagtcttctaccacctggccaagaggctgaccggcatcacctacctgcgggtgcgcagcctgcctggagaggacctgcgggcccgggtgtcctaccgcctgctgggcgtcatcagcctgctgcacctggtgctgtccatgggcctgcagctgtatggcttccggcagaggcagagggccaggaaggagtggaggctgcaccggggcctgagccaccggcgggccagcctggaggagagagctgtgtccaggaaccccctgtgcaccctgtgcctggaggagcggcggcaccccacagccaccccctgtggccacctgttctgctgggagtgcatcacagcctggtgcagcagcaaggccgagtgccccctgtgccgggagaagtttcctccccagaagctgatctacctgcggcactacagatag

SEQ ID NO: 163593 - DNA, 744 bp, Artificial Sequence
  Description of Artificial Sequence: Synthetic coding sequence
atggatgccttcacccgcttcaccaaccagacccagggccgggacaggctcttccgggccacccagtacacctgcatgctgctgcgctacctgctggagcccaaggccggcaaggagaaggtggtgatgaagctgaagaagctggagagctctgtgtccacaggcaggaagtggttccggctgggcaatgtggtgcacgccatccaggccacagagcagagcatccacgccacagacctggtgccccggctgtgcctgaccctggccaacctgaacagagtcatctacttcatctgtgacaccatcctgtgggtgcgctctgtgggcctgaccagcggcatcaacaaggagaagtggaggaccagggctgcccaccactactactacagcctgctgctgagcctggtgcgggacctgtatgagatcagcctgcagatgaagagggtgacctgtgaccgggccaagaaggagaagagcgccagccaggaccccctgtggttctctgtggccgaggaggagacagagtggctgcagagcttcctgctgctgctcttccgcagcctgaagcagcacccccccctgctgctggacacagtgaagaacctgtgtgacatcctgaaccccctggaccagctgggcatctacaagagcaaccctggcatcatcggcctgggcggcctggtgagcagcattgctggcatgatcaccgtggcctacccccagatgaagctgaagaccaggtag

SEQ ID NO: 163594 - DNA, 1209 bp, Artificial Sequence
  Description of Artificial Sequence: Synthetic coding sequence
atgccctggaagctgtggaggggctctgtgggctgccctggggacctgagcagtgatggcctgctcttccggctgggcccccccaagccacccacagagctggagcctgagcctgagattgagggcctgctgacccctgtgctggaggccggagatgtggatgagggccctgtggcccggcccctgagccccacccggctgcagcctgccctgcccccagaggcccagagcgtgcctgagctggaggaggtggcccgggtgctggccgagatcccccggcccctgaagagaagaggctccatggagcaggccccagctgtggccctgccccccacccacaagaagcagtaccagcagatcatcagccgcctcttccaccgccacggcggccctggccctgggggccctgagcctgagctgagccccatcacagagggcagcgaggcccgggccggccccccagccccagcccccccagcccccatccccccaccagcccccagccagagcagccccccagagcagccccagagcatggagatgaggtctgtgctgaggaaggccggcagccccaggaaggcccggcgggcccggctgaaccccctggtgctgctgctggatgctgccctgactggagagctggaggtggtgcagcaggccgtgaaggagatgaatgaccccagccagcccaatgaggagggcatcacagccctgcacaatgccatctgtggggccaactacagcatcgtggacttcctgatcacagctggggccaacgtgaacagcccagacagccacggctggacccccctgcactgtgccgccagctgcaatgacaccgtcatctgcatggccctggtgcagcacggggccgccatctttgccaccaccctgagtgatggagccacagcctttgagaagtgtgacccctaccgggagggctacgccgactgtgccacctacctggctgatgtggagcagagcatgggcctgatgaacagcggggctgtgtatgccctgtgggactacagcgctgagtttggagatgagctgtccttccgggagggggagagcgtgacagtgctgcggagagatggccctgaggagacagactggtggtgggccgccctgcacggccaggagggctacgtgcccaggaactacttcggcctcttcccccgggtgaagccccagaggagcaaggtgtag

SEQ ID NO: 163595 - DNA, 507 bp, Artificial Sequence
  Description of Artificial Sequence: Synthetic coding sequence
tgataccggggccgggacaggctcatccgggtgctgggctactgctgccagctggtgggcggcgtgctggtggagcagtgcccagcccggtctgaggtgggcacccggctgctggtggtgtccacccagctgagccactgcaggaccatcctgcggctgtttgatgacctggccatgtttgtgtacaccaagcagtatggcctgggcgcccaggaggaggatgcctttgtgcgctgtgtgtctgtgctgggcaacctggccgaccagctgtactacccctgtgagcacgtggcctgggccgcagatgcccgggtgctgcacgtggacagcagccgctggtggaccctgagcaccaccctgtgggccctgagcctgctgctgggcgtggcccggagcctgtggatgctgctgaagctgcggcagaggctgcggagccccacagcccccttcacctccatgtaccaggccgcccgggccggcggccaggccgaggccaccaccccctag

SEQ ID NO: 163596 - DNA, 1212 bp, Artificial Sequence
  Description of Artificial Sequence: Synthetic coding sequence
atggccagccagcccccacctccacccaagccctgggagacccggcgcatccctggggccggccctggccctggccctggccccaccttccagagcgctgacctgggccccaccctgatgaccaggcctggccagcctgccctgaccagggtgcccccacccatcctgccccggcccagccagcagacaggcagcagctctgtgaacaccttccggcctgcctacagcagcttcagcagcggctacggggcctacggcaacagcttctacggcggctacagcccctacagctatggctacaacggcctgggctacaaccggctgcgggtggatgacctgccccccagcagatttgtgcagcaggccgaggagagcagcagaggagccttccagagcattgagagcatcgtgcacgcctttgcctctgtgtccatgatgatggatgccaccttctctgctgtgtacaacagcttccgggctgtgctggatgtggccaaccacttcagccggctgaagatccacttcaccaaggtgttcagcgcctttgccctggtgaggaccatccgctacctgtacagaaggctgcagaggatgctgggcctgcggcggggctctgaaaatgaagacctgtgggccgagagcgagggcaccgtggcctgcctgggcgctgaggacagagctgccaccagcgccaagtcctggcccatcttcctgttctttgctgtgatcctgggcggcccctacctgatctggaagctgctgagcacccacagtgatgaggtgacagacagcatcaactgggccagcggagaagatgaccacgtggtggcccgggcagaatatgactttgctgctgtgtctgaggaggagatctccttccgggccggggacatgctgaacctggccctgaaggagcagcagcccaaggtgcggggctggctgctggccagcctggatggccagaccaccggcctcatcccagccaactacgtgaagatcctgggcaagaggaagggcaggaagacagtggagagcagcaaggtgtccaagcagcagcagagcttcaccaaccccaccctgaccaagggggccaccgtggccgacagcctggatgagcaggaggccgcctttgaatctgtgtttgtggagaccaacaaggtgcctgtggccccagacagcatcggcaaggatggagagaagcaggacctgtag

SEQ ID NO: 163597 - DNA, 1134 bp, Artificial Sequence
  Description of Artificial Sequence: Synthetic coding sequence
atggccagcagcgagcaggccgagcagcccagccagcccagcagcaccccaggctctgaaaatgtgctgccccgggagcccctgattgccacagctgtgaagttcctgcagaacagccgggtgcggcagagccccctggccacccggcgggccttcctgaagaagaagggcctgacagatgaggagattgacatggccttccagcagagcggcacagctgctgatgagcccagcagcctgggccctgccacccaggtggtgcctgtgcagcccccccacctgatcagccagccctacagccctgctggcagccgctggagggactatggagccctggccatcatcatggccggcatcgccttcggcttccaccagctgtacaagaagtacctgctgcccctcatcctgggcggccgggaggacaggaagcagctggagaggatggaggccggcctgtctgagctgagcggctctgtggcccagacagtgacccagctgcagaccaccctggcctctgtgcaggagctgctgatccagcagcagcagaagatccaggagctggcccacgagctggccgccgccaaggccaccaccagcaccaactggatcctggagagccagaacatcaatgagctgaagtctgagatcaacagcctgaagggcctgctgctgaacagacggcagttcccccccagccccagcgcccccaagatccccagctggcagatccctgtgaagagccccagccccagcagccctgctgctgtgaaccaccacagcagcagtgacatcagccctgtgtccaatgaaagcaccagcagcagccctgggaaggagggccacagccctgagggcagcacagtgacctaccacctgctgggcccccaggaggagggggagggcgtggtggatgtgaagggccaggtgaggatggaggtgcagggcgaggaggagaagcgggaggacaaggaggatgaagaagatgaggaggatgatgatgtgagccacgtggatgaggaggactgcctgggcgtgcagcgggaggacagaagaggaggagatggccagatcaatgagcaggtggagaagctgcggcggcctgagggcgccagcaatgaaagtgagcgggactag

SEQ ID NO: 163598 - DNA, 942 bp, Artificial Sequence
  Description of Artificial Sequence: Synthetic coding sequence
atggccttccagcagagcggcacagctgctgatgagcccagcagcctgggccctgccacccaggtggtgcctgtgcagcccccccacctgatcagccagccctacagccctgctggcagccgctggagggactatggagccctggccatcatcatggccggcatcgccttcggcttccaccagctgtacaagaagtacctgctgcccctcatcctgggcggccgggaggacaggaagcagctggagaggatggaggccggcctgtctgagctgagcggctctgtggcccagacagtgacccagctgcagaccaccctggcctctgtgcaggagctgctgatccagcagcagcagaagatccaggagctggcccacgagctggccgccgccaaggccaccaccagcaccaactggatcctggagagccagaacatcaatgagctgaagtctgagatcaacagcctgaagggcctgctgctgaacagacggcagttcccccccagccccagcgcccccaagatccccagctggcagatccctgtgaagagccccagccccagcagccctgctgctgtgaaccaccacagcagcagtgacatcagccctgtgtccaatgaaagcaccagcagcagccctgggaaggagggccacagccctgagggcagcacagtgacctaccacctgctgggcccccaggaggagggggagggcgtggtggatgtgaagggccaggtgaggatggaggtgcagggcgaggaggagaagcgggaggacaaggaggatgaagaagatgaggaggatgatgatgtgagccacgtggatgaggaggactgcctgggcgtgcagcgggaggacagaagaggaggagatggccagatcaatgagcaggtggagaagctgcggcggcctgagggcgccagcaatgaaagtgagcgggactag

SEQ ID NO: 163599 - DNA, 1041 bp, Artificial Sequence
  Description of Artificial Sequence: Synthetic coding sequence
atggagaagctgcggctgctgggcctgcgctaccaggagtatgtgaccaggcaccctgctgccacagcccagctggagacagctgtgcggggcttctcctacctgctggccggccgctttgctgacagccatgagctgtctgagctggtgtacagcgccagcaacctgctggtgctgctgaatgatggcatcctgaggaaggagctgaggaagaagctgcctgtgtccctgagccagcagaagctgctgacctggctgtctgtgctggagtgtgtggaggtgttcatggagatgggcgccgccaaggtgtggggcgaggtgggccgctggctggtgattgccctggtgcagctggccaaggctgtgctgaggatgctgctgctgctgtggttcaaggccggcctgcagaccagcccccccatcgtgcccctggaccgggagacccaggcccagcccccagatggagaccacagccctggcaaccacgagcagagctatgtgggcaagaggagcaacagagtggtgaggaccctgcagaacacccccagcctgcacagccgccactggggcgccccccagcagcgggagggccggcagcagcagcaccacgaggagctgagcgccacccccacccccctgggcctgcaggagaccatcgccgagttcctgtacatcgcccggcccctgctgcacctgctgagcctgggcctgtggggccagaggtcctggaagccctggctgctggccggcgtggtggatgtgaccagcctgagcctgctgagtgacaggaagggcctgacccggcgggagcggcgggagctgcggcggaggaccatcctgctgctgtactacctgctgcggagccccttctatgaccgcttcagcgaggcccgcatcctcttcctgctgcagctgctggccgaccacgtgcctggggtgggcctggtgaccaccagccagagagctgccagcccctgcctgcctgcccggccccacacccagccctggagccccccagccttcctgcccggccacccctag

SEQ ID NO: 163600 - DNA, 1011 bp, Artificial Sequence
  Description of Artificial Sequence: Synthetic coding sequence
atggagaagctgcggctgctgggcctgcgctaccaggagtatgtgaccaggcaccctgctgccacagcccagctggagacagctgtgcggggcttctcctacctgctggccggccgctttgctgacagccatgagctgtctgagctggtgtacagcgccagcaacctgctggtgctgctgaatgatggcatcctgaggaaggagctgaggaagaagctgcctgtgtccctgagccagcagaagctgctgacctggctgtctgtgctggagtgtgtggaggtgttcatggagatgggcgccgccaaggtgtggggcgaggtgggccgctggctggtgattgccctggtgcagctggccaaggctgtgctgaggatgctgctgctgctgtggttcaaggccggcctgcagaccagcccccccatcgtgcccctggaccgggagacccaggcccagcccccagatggagaccacagccctggcaaccacgagcagagctatgtgggcaagaggagcaacagagtggtgaggaccctgcagaacacccccagcctgcacagccgccactggggcgccccccagcagcgggagggccggcagcagcagcaccacgaggagctgagcgccacccccacccccctgggcctgcaggagaccatcgccgagttcctgtacatcgcccggcccctgctgcacctgctgagcctgggcctgtggggccagaggtcctggaagccctggctgctggccggcgtggtggatgtgaccagcctgagcctgctgagtgacaggaagggcctgacccggcgggagcggcgggagctgcggcggaggaccatcctgctgctgtactacctgctgcggagccccttctatgaccgcttcagcgaggcccgcatcctcttcctgctgcagctgctggccgaccacgtgcctggggtgggcctggtgacccggcccctgatggactacctgcccacctggcagaagatctacttctacagctggggctag

SEQ ID NO: 163601 - DNA, 900 bp, Artificial Sequence
  Description of Artificial Sequence: Synthetic coding sequence
atggctgctgctgaggagggctgcagcgtgggcgctgaggccgaccgggagctggaggagctgctggagagcgccctggatgactttgacaaggccaagcccagccctgccccacccagcaccaccacagccccagatgccagcggcccccagaagaggagccctggggacacagccaaggatgccctgtttgccagccaggagaagttcttccaggagctgtttgattctgagctggccagccaggccacagctgagtttgagaaggccatgaaggagctggccgaggaggagccccacctggtggagcagttccagaagctgtctgaggccgccggccgggtgggcagtgacatgaccagccagcaggagttcaccagctgcctgaaggagaccctgagcggcctggccaagaatgccacagacctgcagaacagctccatgtctgaggaggagctgaccaaggccatggagggcctgggcatggatgaaggagatggagagggcaacatcctgcccatcatgcagagcatcatgcagaacctgctgagcaaggatgtgctgtaccccagcctgaaggagatcacagagaagtacccagagtggctgcagagccaccgggagagcctgcccccagagcagtttgagaagtaccaggagcagcacagcgtgatgtgcaagatctgtgagcagtttgaggccgagacccccacagacagcgagaccacccagaaggccaggtttgagatggtgctggacctgatgcagcagctgcaggacctgggccacccccccaaggagctggccggggagatgcctcctggcctgaactttgacctggatgccctgaacctgagcggccccccaggggccagcggggagcagtgcctgatcatgtag

SEQ ID NO: 163602 - DNA, 708 bp, Artificial Sequence
  Description of Artificial Sequence: Synthetic coding sequence
atggagagcggggccctggatgactttgacaaggccaagcccagccctgccccacccagcaccaccacagccccagatgccagcggcccccagaagaggagccctggggacacagccaaggatgccctgtttgccagccaggagaagttcttccaggagctgtttgattctgagctggccagccaggccacagctgagtttgagaaggccatgaaggagctggccgaggaggagccccacctggtggagcagttccagaagctgtctgaggccgccggccgggtgggcagtgacatgaccagccagcaggagttcaccagctgcctgaaggagaccctgagcggcctggccaagaatgccacagacctgcagaacagctccatgtctgaggaggagctgaccaaggccatggagggcctgggcatggatgaaggagatggagagggcaacatcctgcccatcatgcagagcatcatgcagaacctgctgagcaaggatgtgctgtaccccagcctgaaggagatcacagagaagtacccagagtggctgcagagccaccgggagagcctgcccccagagcagtttgagaagtaccaggagcagcacagcgtgatgtgcaagatctgtgagcagtttgaggccgagacccccacagacagcgagaccacccagaaggccaggtttgagatggtgctggacctgatgtag

SEQ ID NO: 163603 - DNA, 840 bp, Artificial Sequence
  Description of Artificial Sequence: Synthetic coding sequence
atggagagcggggccctggatgactttgacaaggccaagcccagccctgccccacccagcaccaccacagccccagatgccagcggcccccagaagaggagccctggggacacagccaaggatgccctgtttgccagccaggagaagttcttccaggagctgtttgattctgagctggccagccaggccacagctgagtttgagaaggccatgaaggagctggccgaggaggagccccacctggtggagcagttccagaagctgtctgaggccgccggccgggtgggcagtgacatgaccagccagcaggagttcaccagctgcctgaaggagaccctgagcggcctggccaagaatgccacagacctgcagaacagctccatgtctgaggaggagctgaccaaggccatggagggcctgggcatggatgaaggagatggagagggcaacatcctgcccatcatgcagagcatcatgcagaacctgctgagcaaggatgtgctgtaccccagcctgaaggagatcacagagaagtacccagagtggctgcagagccaccgggagagcctgcccccagagcagtttgagaagtaccaggagcagcacagcgtgatgtgcaagatctgtgagcagtttgaggccgagacccccacagacagcgagaccacccagaaggccaggtttgagatggtgctggacctgatgcagcagctgcaggacctgggccacccccccaaggagctggccggggagatgcctcctggcctgaactttgacctggatgccctgaacctgagcggccccccaggggccagcggggagcagtgcctgatcatgtag

SEQ ID NO: 163604 - DNA, 630 bp, Artificial Sequence
  Description of Artificial Sequence: Synthetic coding sequence
atgaaggagctggccgaggaggagccccacctggtggagcagttccagaagctgtctgaggccgccggccgggtgggcagtgacatgaccagccagcaggagttcaccagctgcctgaaggagaccctgagcggcctggccaagaatgccacagacctgcagaacagctccatgtctgaggaggagctgaccaaggccatggagggcctgggcatggatgaaggagatggagagggcaacatcctgcccatcatgcagagcatcatgcagaacctgctgagcaaggatgtgctgtaccccagcctgaaggagatcacagagaagtacccagagtggctgcagagccaccgggagagcctgcccccagagcagtttgagaagtaccaggagcagcacagcgtgatgtgcaagatctgtgagcagtttgaggccgagacccccacagacagcgagaccacccagaaggccaggtttgagatggtgctggacctgatgcagcagctgcaggacctgggccacccccccaaggagctggccggggagatgcctcctggcctgaactttgacctggatgccctgaacctgagcggccccccaggggccagcggggagcagtgcctgatcatgtag

SEQ ID NO: 163605 - DNA, 561 bp, Artificial Sequence
  Description of Artificial Sequence: Synthetic coding sequence
atggctgctgctgaggagggctgcagcgtgggcgctgaggccgaccgggagctggaggagctgctggagagcgccctggatgactttgacaaggccaagcccagccctgccccacccagcaccaccacagccccagatgccagcggcccccagaagaggagccctggggacacagccaaggatgccctgtttgccagccaggagaagttcttccaggagctgtttgattctgagctggccagccaggccacagctgagtttgagaaggccatgaaggagctggccgaggaggagccccacctggtggagcagttccagaagctgtctgaggccgccggccgggtggagctgcagcacgtgggccggcgggctgaccagggccacggcggggcccggcatggaagaagaggctggggccgggagcaccccccccaccacgccgagtactatgcagagcccaccctgcagggctgtgctgtgcccatcacagaaggagaccacaggaaggtgtccaggatggtggccgagagcagcggcatcagcaccagcagagctgtgtag

SEQ ID NO: 163606 - DNA, 918 bp, Artificial Sequence
  Description of Artificial Sequence: Synthetic coding sequence
atggccagcaggaaagaaaatgccaagagcgccaacagagtgctgcgcatcagccagctggatgccctggagctgaacaaggccctggagcagctggtgtggagccagttcacccagtgcttccacggcttcaagccaggcctgctggccaggtttgagcctgaggtgaaggcctgcctgtgggtgttcctgtggaggttcaccatctacagcaagaatgccaccgtgggccagagcgtgctgaacatcaagtacaagaatgacttcagccccaacctgcgctaccagccccccagcaagaaccagaagatctggtatgctgtgtgcaccatcggcggccgctggctggaggagcgctgctatgacctcttcaggaaccaccacctggccagctttgggaaggtgaagcagtgtgtgaactttgtgattggcctgctgaagctgggcggcctcatcaacttcctgatcttcctgcagaggggcaagtttgccaccctgacagagcggctgctgggcatccacagcgtcttctgcaagccccagaacatctgtgaggtgggctttgagtacatgaaccgggagctgctgtggcacggctttgctgagttcctgatcttcctgctgcccctcatcaacgtgcagaagctgaaggccaagctgagctcctggtgcatccccctgaccggggcccccaacagcgacaacaccctggccaccagcggcaaggaatgtgccctgtgtggggagtggcccaccatgccccacaccatcggctgtgagcacatcttctgctacttctgtgccaagagcagcttcctgtttgatgtgtacttcacctgccccaagtgtggcacagaggtgcacagcctgcagcccctgaagtctggaattgagatgtctgaggtgaatgccctgtag

SEQ ID NO: 163607 - DNA, 918 bp, Artificial Sequence; identical to SEQ ID NO: 163606
  Description of Artificial Sequence: Synthetic coding sequence

SEQ ID NO: 163608 - DNA, 543 bp, Artificial Sequence
  Description of Artificial Sequence: Synthetic coding sequence
atggccagcaggaaagaaaatgccaagagcgccaacagagtgctgcgcatcagccagctggatgccctggagctgaacaaggccctggagcagctggtgtggagccagttcacccagtgcttccacggcttcaagccaggcctgctggccaggtttgagcctgaggtgaaggcctgcctgtgggtgttcctgtggaggttcaccatctacagcaagaatgccaccgtgggccagagcgtgctgaacatcaagtacaagaatgacttcagccccaacctgcgctaccagccccccagcaagaaccagaagatctggtatgctgtgtgcaccatcggcggccgctggctggaggagcgctgctatgacctcttcaggaaccaccacctggccagctttgggaaggtgaagcagtgtgtgaactttgtgattggcctgctgaagctgggcggcctcatcaacttcctgatcttcctgcagaggggcaagtttgccaccctgacagagcggctgctgggcatccacagcgtcttctgcaagccctag

SEQ ID NO: 163609 - DNA, 12 bp, Artificial Sequence
  Description of Artificial Sequence: Synthetic coding sequence
atggccagctag

SEQ ID NO: 163610 - DNA, 918 bp, Artificial Sequence; identical to SEQ ID NO: 163606
  Description of Artificial Sequence: Synthetic coding sequence

SEQ ID NO: 163611 - DNA, 918 bp, Artificial Sequence; identical to SEQ ID NO: 163606
  Description of Artificial Sequence: Synthetic coding sequence

SEQ ID NO: 163612 - DNA, 918 bp, Artificial Sequence
  Description of Artificial Sequence: Synthetic coding sequence
atgaagagtgacagcagcaccagcgctgcccccctgcggggcctgggcggccccctgcggagcagcgagcctgtgcgggctgtgcctgcccgggccccagctgtggacctgctggaggaggccgctgacctgctggtggtgcacctggacttccgggccgccctggagacctgtgagcgggcctggcagagcctggccaaccacgctgtggccgaggagcctgctggcaccagcctggaggtgaagtgcagcctgtgtgtggtgggcatccaggccctggccgagatggaccgctggcaggaggtgctgtcctgggtgctgcagtactaccaggtgcctgagaagctgccccccaaggtgctggagctgtgcatcctgctgtacagcaagatgcaggagcccggggctgtgctggatgtggtgggcgcctggctgcaggaccctgccaaccagaacctgcctgaatatggagccctggccgagttccacgtgcagagggtgctgctgcccctgggctgcctgtctgaggccgaggagctggtggtgggcagcgctgcctttggagaggagcggcggctggatgtgctgcaggccatccacacagcccggcagcagcagaagcaggagcacagcggcagcgaggaggcccagaagcccaacctggagggctctgtgagccacaagttcctgagcctgcccatgctggtgcggcagctgtgggacagcgctgtgagccacttcttcagcctgcccttcaagaagagcctgctggccgccctgatcctgtgcctgctggtggtgcgctttgatcctgccagccccagcagcctgcacttcctgtacaagctggcccagctgttccgctggatcaggaaggccgccttcagccggctgtaccagctgcgcatccgggactag

SEQ ID NO: 163613 - DNA, 918 bp, Artificial Sequence; identical to SEQ ID NO: 163612
  Description of Artificial Sequence: Synthetic coding sequence

SEQ ID NO: 163614 - DNA, 1098 bp, Artificial Sequence
  Description of Artificial Sequence: Synthetic coding sequence
atgaagagtgacagcagcaccagcgctgcccccctgcggggcctgggcggccccctgcggagcagcgagcctgtgcgggctgtgcctgcccgggccccagctgtggacctgctggaggaggccgctgacctgctggtggtgcacctggacttccgggccgccctggagacctgtgagcgggcctggcagagcctggccaaccacgctgtggccgaggagcctgctggcaccagcctggaggtgaagtgcagcctgtgtgtggtgggcatccaggccctggccgagatggaccgctggcaggaggtgctgtcctgggtgctgcagtactaccaggtgcctgagaagctgccccccaaggtgctggagctgtgcatcctgctgtacagcaagatgcaggagcccggggctgtgctggatgtggtgggcgcctggctgcaggaccctgccaaccagaacctgcctgaatatggagccctggccgagttccacgtgcagagggtgctgctgcccctgggctgcctgtctgaggccgaggagctggtggtgggcagcgctgcctttggagaggagcggcggctggatgtgctgcaggccatccacacagcccggcagcagcagaagcaggagcacagcggcagcgaggaggcccagaagcccaacctggagggctctgtgagccacaagttcctgagcctgcccatgctggtgcggcagctgtgggacagcgctgtgagccacttcttcagcctgcccttcaagaagagcctgctggccgccctgatcctgtgcctgctggtggtgcgctttgatcctgccagccccagcagcctgcacttcctgtacaagctggcccagctgtttgctggcagcggccgcctgcacttcctggccagcaccagcagcgcctctgtgacagagggcccctgtgccccccagcccctgtgcagcagccggccctggccccagaagcagagcgaccgggccacccacccccaggcccccctgggcaagtgggaccagcccaacctggctgaatgtactgtgtcctgctgcctgggcgccctgagctttgccccctacttcggctggagcaggtag

SEQ ID NO: 163615 - DNA, 771 bp, Artificial Sequence
  Description of Artificial Sequence: Synthetic coding sequence
atgaagagtgacagcagcaccagcgctgcccccctgcggggcctgggcggccccctgcggagcagcgagcctgtgcgggctgtgcctgcccgggccccagctgtggacctgctggaggaggccgctgacctgctggtggtgcacctggacttccgggccgccctggagacctgtgagcgggcctggcagagcctggccaaccacgctgtggccgaggagcctgctggcaccagcctggaggtgaagtgcagcctgtgtgtggtgggcatccaggccctggccgagatggaccgctggcaggaggtgctgtcctgggtgctgcagtactaccaggtgcctgagaagctgccccccaaggtgctggagctgtgcatcctgctgtacagcaagatgcaggagcccggggctgtgctggatgtggtgggcgcctggctgcaggaccctgccaaccagaacctgcctgaatatggagccctggccgagttccacgtgcagagggtgctgctgcccctgggctgcctgtctgaggccgaggagctggtggtgggcagcgctgcctttggagaggagcggcggctggatgtgctgcaggccatccacacagcccggcagcagcagaagcaggagcacagcggcagcgaggaggcccagaagcccaacctggaggccagccccagcagcctgcacttcctgtacaagctggcccagctgttccgctggatcaggaaggccgccttcagccggctgtaccagctgcgcatccgggactag

SEQ ID NO: 163616 - DNA, 549 bp, Artificial Sequence
  Description of Artificial Sequence: Synthetic coding sequence
atgctgcggtctgtgtggaacttcctgaagaggcacaagaagaagtgcatcttcctgggcaccgtgctgggcgtgctgtccatgctgcccaccctgcgggaggccctgatgcagcagctgaacagcgagagcctgacagccctgctgaagaaccggcccagcaacaagctggagatctgggaggacctgaagatcatctccttcaccaggagcacagtggccgtgtacagcacctgcatgctggtggtgctgctgcgggtgcagctgaacatcatcggcggctacatctacctggacaatgctgctgtgggcaagaatggcaccaccatcctggcccccccagatgtgcagcagcagtacctgagcagcatccagcacctgctgggagatggcctgacagagctgatcaccgtcatcaagcaggccgtgcagaaggtgctgggctctgtgtccctgaagcacagcctgagcctgctggacctggagcagaagctgaaggagatccggaacctggtggagcagcacaagagcagctcctggatcaactag

SEQ ID NO: 163617 - DNA, 1122 bp, Artificial Sequence
  Description of Artificial Sequence: Synthetic coding sequence
atgctgcggtctgtgtggaacttcctgaagaggcacaagaagaagtgcatcttcctgggcaccgtgctgggcggcgtgtacatcctgggcaagtatggccagaagaagatccgggagatccaggagcgggaggccgctgagtacatcgcccaggcccggcggcagtaccactttgagagcaaccagaggacctgcaacatgacagtgctgtccatgctgcccaccctgcgggaggccctgatgcagcagctgaacagcgagagcctgacagccctgctgaagaaccggcccagcaacaagctggagatctgggaggacctgaagatcatctccttcaccaggagcacagtggccgtgtacagcacctgcatgctggtggtgctgctgcgggtgcagctgaacatcatcggcggctacatctacctggacaatgctgctgtgggcaagaatggcaccaccatcctggcccccccagatgtgcagcagcagtacctgagcagcatccagcacctgctgggagatggcctgacagagctgatcaccgtcatcaagcaggccgtgcagaaggtgctgggctctgtgtccctgaagcacagcctgagcctgctggacctggagcagaagctgaaggagatccggaacctggtggagcagcacaagagcagctcctggatcaacaaggatggcagcaagcccctgctgtgccactacatgatgccagatgaggagacccccctggccgtgcaggcctgtggcctgagcccccgggacatcaccaccatcaagctgctgaatgagacccgggacatgctggagagcccagacttcagcacagtgctgaacacctgcctgaacagaggcttcagccggctgctggacaacatggccgagttcttccggcccacagagcaggacctgcagcacggcaacagcatgaacagcctgagctctgtgtccctgcccctggccaagatcatccccatcgtgaatggccagatccacagcgtgtgcagcgagacccccagccactttgtgcaggacctgctgaccatggagcaggtgaaggactttgctgccaacgtgtatgaggccttcagcaccccccagcagctggagaagtag

SEQ ID NO: 163618 - DNA, 549 bp, Artificial Sequence; identical to SEQ ID NO: 163616
  Description of Artificial Sequence: Synthetic coding sequence

SEQ ID NO: 163619 - DNA, 1809 bp, Artificial Sequence
  Description of Artificial Sequence: Synthetic coding sequence
atggccatgagggagctggtggaggccgagtgtggcggggccaaccccctgatgaagctggccggccacttcacccaggacaaggccctgcggcaggagggcctgcggcccggcccctggcccccaggggccccagccagcgaggccgccagcaagcccctgggcgtggcctctgaagatgagctggtggccgagttcctgcaggaccagaatgcccccctggtgtcccgggccccccagaccttcaagatggatgacctgctggccgagatgcagcagatcgagcagagcaacttccggcaggccccccagagggcccctggggtggccgacctggccctgtctgagaactgggcccaggagttcctggccgctggagatgctgtggatgtgacccaggactacaatgaaacagactggagccaggagttcatcagcgaggtgacagaccccctgtctgtgtccccagcccgctgggccgaggagtacctggagcagagcgaggagaagctgtggctgggggagcctgagggcacagccacagaccgctggtatgatgagtaccaccctgaggaggacctgcagcacacagccagtgactttgtggccaaggtggatgaccccaagctggccaacagcgagggcaccagtgatgcctgggtggaccagttcaccaggcctgtgaacaccagcgccctggacatggagtttgagcgggccaagagcgccatcgagagtgatgtggacttctgggacaagctgcaggccgagctggaggagatggccaagagagatgctgaggcccacccctggctgagtgactatgatgacctgaccagcgccacctatgacaagggctaccagtttgaggaggagaaccccctgcgggaccacccccagccctttgaggagggcctgcggcggctgcaggagggggacctgcccaatgctgtgctgctgtttgaagctgctgtgcagcaggaccccaagcacatggaggcctggcagtacctgggcaccacccaggccgagaatgagcaggagctgctggccatcagcgccctgcggcgctgcctggagctgaagccagacaaccagacagccctgatggccctggccgtgtccttcaccaatgaaagcctgcagaggcaggcctgtgagaccctgcgggactggctgcgctacaccccagcctatgcccacctggtgaccccagctgaggagggcgctgggggcgccggcctgggccccagcaagaggatcctgggcagcctgctgagtgacagcctcttcctggaggtgaaggagctgttcctggccgctgtgcggctggaccccaccagcattgatcctgatgtgcagtgtggcctgggcgtgctcttcaacctgagcggggagtatgacaaggctgtggactgcttcaccgctgccctgtctgtgcggcccaatgactacctgctgtggaacaagctgggcgccaccctggccaatggaaaccagagcgaggaggccgtggccgcctacagaagagccctggagctgcagcccggctacatccgcagccgctacaacctgggcatcagctgcatcaacctgggcgcccaccgggaggccgtggagcacttcctggaggccctgaacatgcagaggaagagccggggccccagaggagagggcggggccatgtctgagaacatctggagcaccctgcggctggccctgtccatgctgggccagagtgatgcctatggagctgctgatgcccgggacctgagcaccctgctgaccatgtttggcctgccccagtag

SEQ ID NO: 163620 - DNA, 1896 bp, Artificial Sequence
  Description of Artificial Sequence: Synthetic coding sequence
atggccatgagggagctggtggaggccgagtgtggcggggccaaccccctgatgaagctggccggccacttcacccaggacaaggccctgcggcaggagggcctgcggcccggcccctggcccccaggggccccagccagcgaggccgccagcaagcccctgggcgtggcctctgaagatgagctggtggccgagttcctgcaggaccagaatgcccccctggtgtcccgggccccccagaccttcaagatggatgacctgctggccgagatgcagcagatcgagcagagcaacttccggcaggccccccagagggcccctggggtggccgacctggccctgtctgagaactgggcccaggagttcctggccgctggagatgctgtggatgtgacccaggactacaatgaaacagactggagccaggagttcatcagcgaggtgacagaccccctgtctgtgtccccagcccgctgggccgaggagtacctggagcagagcgaggagaagctgtggctgggggagcctgagggcacagccacagaccgctggtatgatgagtaccaccctgaggaggacctgcagcacacagccagtgactttgtggccaaggtggatgaccccaagctggccaacagcgagttcctgaagtttgtgcggcagatcggggagggccaggtgtccctggagagcggggccggcagcggccgggcccaggccgagcagtgggccgctgagttcatccagcagcagggcaccagtgatgcctgggtggaccagttcaccaggcctgtgaacaccagcgccctggacatggagtttgagcgggccaagagcgccatcgagctgcaggccgagctggaggagatggccaagagagatgctgaggcccacccctggctgagtgactatgatgacctgaccagcgccacctatgacaagggctaccagtttgaggaggagaaccccctgcgggaccacccccagccctttgaggagggcctgcggcggctgcaggagggggacctgcccaatgctgtgctgctgtttgaggccgctgtgcagcaggaccccaagcacatggaggcctggcagtacctgggcaccacccaggctgaaaatgagcaggagctgctggccatcagcgccctgcggcgctgcctggagctgaagccagacaaccagacagccctgatggccctggccgtgtccttcaccaatgaaagcctgcagaggcaggcctgtgagaccctgcgggactggctgcgctacaccccagcctatgcccacctggtgaccccagctgaggagggcgccggcggggccggcctgggccccagcaagaggatcctgggcagcctgctgagtgacagcctcttcctggaggtgaaggagctgttcctggccgctgtgcggctggaccccaccagcattgatcctgatgtgcagtgtggcctgggcgtgctcttcaacctgtctggagaatatgacaaggctgtggactgcttcaccgctgccctgtctgtgcggcccaatgactacctgctgtggaacaagctgggcgccaccctggccaacggcaaccagagcgaggaggccgtggccgcctaccgccgggccctggagctgcagcccggctacatccgcagccgctacaacctgggcatcagctgcatcaacctgggcgcccaccgggaggccgtggagcacttcctggaggccctgaacatgcagaggaagagccggggccccagaggagagggcggggccatgtctgagaacatctggagcaccctgcggctggccctgtccatgctgggccagagtgatgcctacggggctgctgatgcccgggacctgagcaccctgctgaccatgtttggcctgccccagtag

SEQ ID NO: 163621 - DNA, 1233 bp, Artificial Sequence
  Description of Artificial Sequence: Synthetic coding sequence
atggccatgagggagctggtggaggccgagtgtggcggggccaaccccctgatgaagctggccggccacttcacccaggacaaggccctgcggcaggagggcctgcggcccggcccctggcccccaggggccccagccagcgaggccgtgtctgtgctggaggtggagagccctggggccgccagcgaggccgccagcaagcccctgggcgtggcctctgaagatgagctggtggccgagttcctgcaggaccagaatgcccccctggtgtcccgggccccccagaccttcaagatggatgacctgctggccgagatgcagcagatcgagcagagcaacttccggcaggccccccagagggcccctggggtggccgacctggccctgtctgagaactgggcccaggagttcctggccgctggagatgctgtggatgtgacccaggactacaatgaaacagactggagccaggagttcatcagcgaggtgacagaccccctgtctgtgtccccagcccgctgggccgaggagtacctggagcagagcgaggagaagctgtggctgggggagcctgagggcacagccacagaccgctggtatgatgagtaccaccctgaggaggacctgcagcacacagccagtgactttgtggccaaggtggatgaccccaagctggccaacagcgagggcaccagtgatgcctgggtggaccagttcaccaggcctgtgaacaccagcgccctggacatggagtttgagcgggccaagagcgccatcgagctgcaggccgagctggaggagatggccaagagagatgctgaggcccacccctggctgagtgactatgatgacctgaccagcgccacctatgacaagggctaccagtttgaggaggagaaccccctgcgggaccacccccagccctttgaggagggcctgcggcggctgcaggagggggacctgcccaatgctgtgctgctgtttgaggccgctgtgcagcaggaccccaagcacatggaggcctggcagtacctgggcaccacccaggctgaaaatgagcaggagctgctggccatcagcgccctgcggcgctgcctggagctgaagccagacaaccagacagccctgatggccctggccgtgtccttcaccaatgaaagcctgcagaggcaggcctgtgagaccctgcgggactggctgcgctacaccccagcctatgcccacctggtgtag

SEQ ID NO: 163622 - DNA, 1983 bp, Artificial Sequence
  Description of Artificial Sequence: Synthetic coding sequence
atgctgctgtgccgggcccaccgggtgctgggcctgcggggggcccgggagctggccgtgaccatggccatgagggagctggtggaggctgaatgtggcggggccaaccccctgatgaagctggccggccacttcacccaggacaaggccctgcggcaggagggcctgcggcccggcccctggcccccaggggccccagccagcgaggccgccagcaagcccctgggcgtggcctctgaagatgagctggtggccgagttcctgcaggaccagaatgcccccctggtgtcccgggccccccagaccttcaagatggatgacctgctggccgagatgcagcagatcgagcagagcaacttccggcaggccccccagagggcccctggggtggccgacctggccctgtctgagaactgggcccaggagttcctggccgctggagatgctgtggatgtgacccaggactacaatgaaacagactggagccaggagttcatcagcgaggtgacagaccccctgtctgtgtccccagcccgctgggccgaggagtacctggagcagagcgaggagaagctgtggctgggggagcctgagggcacagccacagaccgctggtatgatgagtaccaccctgaggaggacctgcagcacacagccagtgactttgtggccaaggtggatgaccccaagctggccaacagcgagttcctgaagtttgtgcggcagattggagagggccaggtgtccctggagagcggggccggcagcggccgggcccaggccgagcagtgggccgctgagttcatccagcagcagggcaccagtgatgcctgggtggaccagttcaccaggcctgtgaacaccagcgccctggacatggagtttgagcgggccaagagcgccatcgagagtgatgtggacttctgggacaagctgcaggccgagctggaggagatggccaagagagatgctgaggcccacccctggctgagtgactatgatgacctgaccagcgccacctatgacaagggctaccagtttgaggaggagaaccccctgcgggaccacccccagccctttgaggagggcctgcggcggctgcaggagggggacctgcccaatgctgtgctgctgtttgaagctgctgtgcagcaggaccccaagcacatggaggcctggcagtacctgggcaccacccaggccgagaatgagcaggagctgctggccatcagcgccctgcggcgctgcctggagctgaagccagacaaccagacagccctgatggccctggccgtgtccttcaccaatgaaagcctgcagaggcaggcctgtgagaccctgcgggactggctgcgctacaccccagcctatgcccacctggtgaccccagctgaggagggcgctgggggcgccggcctgggccccagcaagaggatcctgggcagcctgctgagtgacagcctcttcctggaggtgaaggagctgttcctggccgctgtgcggctggaccccaccagcattgatcctgatgtgcagtgtggcctgggcgtgctcttcaacctgagcggggagtatgacaaggctgtggactgcttcaccgctgccctgtctgtgcggcccaatgactacctgctgtggaacaagctgggcgccaccctggccaatggaaaccagagcgaggaggccgtggccgcctacagaagagccctggagctgcagcccggctacatccgcagccgctacaacctgggcatcagctgcatcaacctgggcgcccaccgggaggccgtggagcacttcctggaggccctgaacatgcagaggaagagccggggccccagaggagagggcggggccatgtctgagaacatctggagcaccctgcggctggccctgtccatgctgggccagagtgatgcctatggagctgctgatgcccgggacctgagcaccctgctgaccatgtttggcctgccccagtag

SEQ ID NO: 163623 - DNA, 1920 bp, Artificial Sequence
  Description of Artificial Sequence: Synthetic coding sequence
atggccatgagggagctggtggaggccgagtgtggcggggccaaccccctgatgaagctggccggccacttcacccaggacaaggccctgcggcaggagggcctgcggcccggcccctggcccccaggggccccagccagcgaggccgccagcaagcccctgggcgtggcctctgaagatgagctggtggccgagttcctgcaggaccagaatgcccccctggtgtcccgggccccccagaccttcaagatggatgacctgctggccgagatgcagcagatcgagcagagcaacttccggcaggccccccagagggcccctggggtggccgacctggccctgtctgagaactgggcccaggagttcctggccgctggagatgctgtggatgtgacccaggactacaatgaaacagactggagccaggagttcatcagcgaggtgacagaccccctgtctgtgtccccagcccgctgggccgaggagtacctggagcagagcgaggagaagctgtggctgggggagcctgagggcacagccacagaccgctggtatgatgagtaccaccctgaggaggacctgcagcacacagccagtgactttgtggccaaggtggatgaccccaagctggccaacagcgagttcctgaagtttgtgcggcagatcggggagggccaggtgtccctggagagcggggccggcagcggccgggcccaggccgagcagtgggccgctgagttcatccagcagcagggcaccagtgatgcctgggtggaccagttcaccaggcctgtgaacaccagcgccctggacatggagtttgagcgggccaagagcgccattgaaagtgatgtggacttctgggacaagctgcaggccgagctggaggagatggccaagagagatgctgaggcccacccctggctgagtgactatgatgacctgaccagcgccacctatgacaagggctaccagtttgaggaggagaaccccctgcgggaccacccccagccctttgaggagggcctgcggcggctgcaggagggggacctgcccaatgctgtgctgctgtttgaggccgctgtgcagcaggaccccaagcacatggaggcctggcagtacctgggcaccacccaggctgaaaatgagcaggagctgctggccatcagcgccctgcggcgctgcctggagctgaagccagacaaccagacagccctgatggccctggccgtgtccttcaccaatgaaagcctgcagaggcaggcctgtgagaccctgcgggactggctgcgctacaccccagcctatgcccacctggtgaccccagctgaggagggcgccggcggggccggcctgggccccagcaagaggatcctgggcagcctgctgagtgacagcctcttcctggaggtgaaggagctgttcctggccgctgtgcggctggaccccaccagcattgatcctgatgtgcagtgtggcctgggcgtgctcttcaacctgtctggagaatatgacaaggctgtggactgcttcaccgctgccctgtctgtgcggcccaatgactacctgctgtggaacaagctgggcgccaccctggccaacggcaaccagagcgaggaggccgtggccgcctaccgccgggccctggagctgcagcccggctacatccgcagccgctacaacctgggcatcagctgcatcaacctgggcgcccaccgggaggccgtggagcacttcctggaggccctgaacatgcagaggaagagccggggccccagaggagagggcggggccatgtctgagaacatctggagcaccctgcggctggccctgtccatgctgggccagagtgatgcctacggggctgctgatgcccgggacctgagcaccctgctgaccatgtttggcctgccccagtag

SEQ ID NO: 163624 - DNA, 1965 bp, Artificial Sequence
  Description of Artificial Sequence: Synthetic coding sequence
atggccatgagggagctggtggaggccgagtgtggcggggccaaccccctgatgaagctggccggccacttcacccaggacaaggccctgcggcaggagggcctgcggcccggcccctggcccccaggggccccagccagcgaggccgtgtctgtgctggaggtggagagccctggggccgccagcgaggccgccagcaagcccctgggcgtggcctctgaagatgagctggtggccgagttcctgcaggaccagaatgcccccctggtgtcccgggccccccagaccttcaagatggatgacctgctggccgagatgcagcagatcgagcagagcaacttccggcaggccccccagagggcccctggggtggccgacctggccctgtctgagaactgggcccaggagttcctggccgctggagatgctgtggatgtgacccaggactacaatgaaacagactggagccaggagttcatcagcgaggtgacagaccccctgtctgtgtccccagcccgctgggccgaggagtacctggagcagagcgaggagaagctgtggctgggggagcctgagggcacagccacagaccgctggtatgatgagtaccaccctgaggaggacctgcagcacacagccagtgactttgtggccaaggtggatgaccccaagctggccaacagcgagttcctgaagtttgtgcggcagattggagagggccaggtgtccctggagagcggggccggcagcggccgggcccaggccgagcagtgggccgctgagttcatccagcagcagggcaccagtgatgcctgggtggaccagttcaccaggcctgtgaacaccagcgccctggacatggagtttgagcgggccaagagcgccatcgagagtgatgtggacttctgggacaagctgcaggccgagctggaggagatggccaagagagatgctgaggcccacccctggctgagtgactatgatgacctgaccagcgccacctatgacaagggctaccagtttgaggaggagaaccccctgcgggaccacccccagccctttgaggagggcctgcggcggctgcaggagggggacctgcccaatgctgtgctgctgtttgaagctgctgtgcagcaggaccccaagcacatggaggcctggcagtacctgggcaccacccaggccgagaatgagcaggagctgctggccatcagcgccctgcggcgctgcctggagctgaagccagacaaccagacagccctgatggccctggccgtgtccttcaccaatgaaagcctgcagaggcaggcctgtgagaccctgcgggactggctgcgctacaccccagcctatgcccacctggtgaccccagctgaggagggcgctgggggcgccggcctgggccccagcaagaggatcctgggcagcctgctgagtgacagcctcttcctggaggtgaaggagctgttcctggccgctgtgcggctggaccccaccagcattgatcctgatgtgcagtgtggcctgggcgtgctcttcaacctgagcggggagtatgacaaggctgtggactgcttcaccgctgccctgtctgtgcggcccaatgactacctgctgtggaacaagctgggcgccaccctggccaatggaaaccagagcgaggaggccgtggccgcctacagaagagccctggagctgcagcccggctacatccgcagccgctacaacctgggcatcagctgcatcaacctgggcgcccaccgggaggccgtggagcacttcctggaggccctgaacatgcagaggaagagccggggccccagaggagagggcggggccatgtctgagaacatctggagcaccctgcggctggccctgtccatgctgggccagagtgatgcctatggagctgctgatgcccgggacctgagcaccctgctgaccatgtttggcctgccccagtag

SEQ ID NO: 163625 - DNA, 1920 bp, Artificial Sequence; identical to SEQ ID NO: 163623
  Description of Artificial Sequence: Synthetic coding sequence

SEQ ID NO: 163626 - DNA, 345 bp, Artificial Sequence
  Description of Artificial Sequence: Synthetic coding sequence
atggccatgagggagctggtggaggccgagtgtggcggggccaaccccctgatgaagctggccggccacttcacccaggacaaggccctgcggcaggagggcctgcggcccggcccctggcccccaggggccccagccagcgaggccgccagcaagcccctgggcgtggcctctgaagatgagctggtggccgagttcctgcaggaccagaatgcccccctggtgtcccgggccccccagaccttcaagatggatgacctgctggccgagatgcagcagatcgagcagagcaacttccggcaggccccccagagggcccctggggtggccgacctggccctgtag

SEQ ID NO: 163627 - DNA, 309 bp, Artificial Sequence
  Description of Artificial Sequence: Synthetic coding sequence
atggccatgagggagctggtggaggccgagtgtggcggggccaaccccctgatgaagctggccggccacttcacccaggacaaggccctgcggcaggagggcctgcggcccggcccctggcccccaggggccccagccagcgaggccgccagcaagcccctgggcgtggcctctgaagatgagctggtggccgagttcctgcaggaccagaatgcccccctggtgtcccgggccccccagaccttcaagatggatgacctgctggccgagatgcagcagatcgagcagagcaacttccggcaggcctag

SEQ ID NO: 163628 - DNA, 747 bp, Artificial Sequence
  Description of Artificial Sequence: Synthetic coding sequence
atggccatgagggagctggtggaggccgagtgtggcggggccaaccccctgatgaagctggccggccacttcacccaggacaaggccctgcggcaggagggcctgcggcccggcccctggcccccaggggccccagccagcgaggccgccagcaagcccctgggcgtggcctctgaagatgagctggtggccgagttcctgcaggaccagaatgcccccctggtgtcccgggccccccagaccttcaagatggatgacctgctggccgagatgcagcagatcgagcagagcaacttccggcaggccccccagagggcccctggggtggccgacctggccctgtctgagaactgggcccaggagttcctggccgctggagatgctgtggatgtgacccaggactacaatgaaacagactggagccaggagttcatcagcgaggtgacagaccccctgtctgtgtccccagcccgctgggccgaggagtacctggagcagagcgaggagaagctgtggctgggggagcctgagggcacagccacagaccgctggtatgatgagtaccaccctgaggaggacctgcagcacacagccagtgactttgtggccaaggtggatgaccccaagctggccaacagcgagttcctgaagtttgtgcggcagatcggggagggccaggtgtccctggagagcggggccggcagcggccgggcccaggccgagcagtgggccgctgagttcatctag

SEQ ID NO: 163629 - DNA, 315 bp, Artificial Sequence
  Description of Artificial Sequence: Synthetic coding sequence
atggccatgagggagctggtggaggccgagtgtggcggggccaaccccctgatgaagctggccggccacttcacccaggacaaggccctgcggcaggagggcctgcggcccggcccctggcccccaggggccccagccagcgaggccgccagcaagcccctgggcgtggcctctgaagatgagctggtggccgagttcctgcaggaccagaatgcccccctggtgtcccgggccccccagaccttcaagatggatgacctgctggccgagatgcagcagatcgagcagagcaacttccggcaggccccccagtag

SEQ ID NO: 163630 - DNA, 1875 bp, Artificial Sequence
  Description of Artificial Sequence: Synthetic coding sequence
atgtaccagggccacatgcaggtggtgggcgtgaccctgaagaagaagtggcactgcctgcagaagagtgacctgaccctggccctgggcaagggcagcagagctgctgacaaggctgtggccatggtgatgaaggagatcccccgggaggagagcgctgaggagaagcccctgctgaccatgaccagccagctggtgaatgagcagcaggagagccggcccctgctgagccccagcattgatgacttcctgtgtgagaccaagtctgaggccatcgcccggcctgtgaccagcaacacagctgtgctgaccaccggcctggacctgctggacctgtctgagcctgtgtcccagacccagaccaaggccaagaagtctgagcccagcagcaagaccagcagcctgaagaagaaggcagatggcagtgacctgatcagcacagatgctgagcagaggggccagcccctgcgggtgcctgagaccagcagcctggacctggacatccagacccagctggagaagtgggatgatgtgaagttccatggagacaggaacaccaagggccaccccatggccgagaggaagagcagcagcagcaggacaggcagcaaggagctgctgtggagcagcgagcacaggagccagcctgagctgagcggcggcaagagcgccctgaacagcgagagcgccagcgagctggagctggtggcccccacccaggcccggctgaccaaggagcaccgctggggcagcgccctgctgagcaggaaccacagcctggaggaggagtttgagcgggccaaggctgctgtggagagtgacacagagttctgggacaagatgcaggccgagtgggaggagatggcccggaggaactggatcagcgagaaccaggaggcccagaaccaggtgaccatcagcgccagcgagaagggctactacttccacacagagaaccccttcaaggactggccaggggcctttgaggagggcctgaagaggctgaaggagggggacctgcctgtgaccatcctcttcatggaggccgccatcctgcaggaccctggagatgctgaggcctggcagttcctgggcatcacccaggccgagaatgaaaatgagcaggccgccatcgtggccctgcagcgctgcctggagctgcagcccaacaacctgaaggccctgatggccctggccgtgtcctacaccaacacaggccaccagcaggatgcctgtgatgccctgaagaactggatcaagcagaaccccaagtacaagtacctggtgaagagcaagaagggcagccctggcctgaccaggaggatgagcaagagccctgtggacagctctgtgctggagggcgtgaaggagctgtacctggaggccgcccaccagaatggagacatgattgatcctgacctgcagacaggcctgggcgtgctcttccacctgtctggagagttcaacagagccattgatgccttcaatgctgccctgactgtgcggcctgaggactacagcctgtggaaccggctgggcgccaccctggccaacggggacagaagtgaggaggccgtggaggcctacacccgggccctggagatccagcccggcttcatccgcagccgctacaacctgggcatcagctgcatcaacctgggcgcctaccgggaggccgtgagcaacttcctgacagccctgagcctgcagaggaagagcaggaaccagcagcaggtgccccacccagccatcagcggcaacatctgggccgccctgcgcatcgccctgagcctgatggaccagcctgagctgttccaggccgccaacctgggggacctggatgtgctgctgcgggccttcaacctggacccctag

SEQ ID NO: 163631 - DNA, 1875 bp, Artificial Sequence
  Description of Artificial Sequence: Synthetic coding sequence
atgcaccagaatggcagccaggtggtgggcgtgaccctgaagaagaagtggcactgcctgcagaagagtgacctgaccctggccctgggcaagggcagcagagctgctgacaaggctgtggccatggtgatgaaggagatcccccgggaggagagcgctgaggagaagcccctgctgaccatgaccagccagctggtgaatgagcagcaggagagccggcccctgctgagccccagcattgatgacttcctgtgtgagaccaagtctgaggccatcgcccggcctgtgaccagcaacacagctgtgctgaccaccggcctggacctgctggacctgtctgagcctgtgtcccagacccagaccaaggccaagaagtctgagcccagcagcaagaccagcagcctgaagaagaaggcagatggcagtgacctgatcagcacagatgctgagcagaggggccagcccctgcgggtgcctgagaccagcagcctggacctggacatccagacccagctggagaagtgggatgatgtgaagttccatggagacaggaacaccaagggccaccccatggccgagaggaagagcagcagcagcaggacaggcagcaaggagctgctgtggagcagcgagcacaggagccagcctgagctgagcggcggcaagagcgccctgaacagcgagagcgccagcgagctggagctggtggcccccacccaggcccggctgaccaaggagcaccgctggggcagcgccctgctgagcaggaaccacagcctggaggaggagtttgagcgggccaaggctgctgtggagagtgacacagagttctgggacaagatgcaggccgagtgggaggagatggcccggaggaactggatcagcgagaaccaggaggcccagaaccaggtgaccatcagcgccagcgagaagggctactacttccacacagagaaccccttcaaggactggccaggggcctttgaggagggcctgaagaggctgaaggagggggacctgcctgtgaccatcctcttcatggaggccgccatcctgcaggaccctggagatgctgaggcctggcagttcctgggcatcacccaggccgagaatgaaaatgagcaggccgccatcgtggccctgcagcgctgcctggagctgcagcccaacaacctgaaggccctgatggccctggccgtgtcctacaccaacacaggccaccagcaggatgcctgtgatgccctgaagaactggatcaagcagaaccccaagtacaagtacctggtgaagagcaagaagggcagccctggcctgaccaggaggatgagcaagagccctgtggacagctctgtgctggagggcgtgaaggagctgtacctggaggccgcccaccagaatggagacatgattgatcctgacctgcagacaggcctgggcgtgctcttccacctgtctggagagttcaacagagccattgatgccttcaatgctgccctgactgtgcggcctgaggactacagcctgtggaaccggctgggcgccaccctggccaacggggacagaagtgaggaggccgtggaggcctacacccgggccctggagatccagcccggcttcatccgcagccgctacaacctgggcatcagctgcatcaacctgggcgcctaccgggaggccgtgagcaacttcctgacagccctgagcctgcagaggaagagcaggaaccagcagcaggtgccccacccagccatcagcggcaacatctgggccgccctgcgcatcgccctgagcctgatggaccagcctgagctgttccaggccgccaacctgggggacctggatgtgctgctgcgggccttcaacctggacccctag

SEQ ID NO: 163632 - DNA, 1557 bp, Artificial Sequence
  Description of Artificial Sequence: Synthetic coding sequence
atggtgatgaaggagatcccccgggaggagagcgctgaggagaagcccctgctgaccatgaccagccagctggtgaatgagcagcaggagagccggcccctgctgagccccagcattgatgacttcctgtgtgagaccaagtctgaggccatcgcccggcctgtgaccagcaacacagctgacatccagacccagctggagaagtgggatgatgtgaagttccatggagacaggaacaccaagggccaccccatggccgagaggaagagcagcagcagcaggacaggcagcaaggagctgctgtggagcagcgagcacaggagccagcctgagctgagcggcggcaagagcgccctgaacagcgagagcgccagcgagctggagctggtggcccccacccaggcccggctgaccaaggagcaccgctggggcagcgccctgctgagcaggaaccacagcctggaggaggagtttgagcgggccaaggctgctgtggagagtgacacagagttctgggacaagatgcaggccgagtgggaggagatggcccggaggaactggatcagcgagaaccaggaggcccagaaccaggtgaccatcagcgccagcgagaagggctactacttccacacagagaaccccttcaaggactggccaggggcctttgaggagggcctgaagaggctgaaggagggggacctgcctgtgaccatcctcttcatggaggccgccatcctgcaggaccctggagatgctgaggcctggcagttcctgggcatcacccaggccgagaatgaaaatgagcaggccgccatcgtggccctgcagcgctgcctggagctgcagcccaacaacctgaaggccctgatggccctggccgtgtcctacaccaacacaggccaccagcaggatgcctgtgatgccctgaagaactggatcaagcagaaccccaagtacaagtacctggtgaagagcaagaagggcagccctggcctgaccaggaggatgagcaagagccctgtggacagctctgtgctggagggcgtgaaggagctgtacctggaggccgcccaccagaatggagacatgattgatcctgacctgcagacaggcctgggcgtgctcttccacctgtctggagagttcaacagagccattgatgccttcaatgctgccctgactgtgcggcctgaggactacagcctgtggaaccggctgggcgccaccctggccaacggggacagaagtgaggaggccgtggaggcctacacccgggccctggagatccagcccggcttcatccgcagccgctacaacctgggcatcagctgcatcaacctgggcgcctaccgggaggccgtgagcaacttcctgacagccctgagcctgcagaggaagagcaggaaccagcagcaggtgccccacccagccatcagcggcaacatctgggccgccctgcgcatcgccctgagcctgatggaccagcctgagctgttccaggccgccaacctgggggacctggatgtgctgctgcgggccttcaacctggacccctag

SEQ ID NO: 163633 - DNA, 1809 bp, Artificial Sequence
  Description of Artificial Sequence: Synthetic coding sequence
atgtaccagggccacatgcagggcaagggcagcagagctgctgacaaggctgtggccatggtgatgaaggagatcccccgggaggagagcgctgaggagaagcccctgctgaccatgaccagccagctggtgaatgagcagcaggagagccggcccctgctgagccccagcattgatgacttcctgtgtgagaccaagtctgaggccatcgcccggcctgtgaccagcaacacagctgtgctgaccaccggcctggacctgctggacctgtctgagcctgtgtcccagacccagaccaaggccaagaagtctgagcccagcagcaagaccagcagcctgaagaagaaggcagatggcagtgacctgatcagcacagatgctgagcagaggggccagcccctgcgggtgcctgagaccagcagcctggacctggacatccagacccagctggagaagtgggatgatgtgaagttccatggagacaggaacaccaagggccaccccatggccgagaggaagagcagcagcagcaggacaggcagcaaggagctgctgtggagcagcgagcacaggagccagcctgagctgagcggcggcaagagcgccctgaacagcgagagcgccagcgagctggagctggtggcccccacccaggcccggctgaccaaggagcaccgctggggcagcgccctgctgagcaggaaccacagcctggaggaggagtttgagcgggccaaggctgctgtggagagtgacacagagttctgggacaagatgcaggccgagtgggaggagatggcccggaggaactggatcagcgagaaccaggaggcccagaaccaggtgaccatcagcgccagcgagaagggctactacttccacacagagaaccccttcaaggactggccaggggcctttgaggagggcctgaagaggctgaaggagggggacctgcctgtgaccatcctcttcatggaggccgccatcctgcaggaccctggagatgctgaggcctggcagttcctgggcatcacccaggccgagaatgaaaatgagcaggccgccatcgtggccctgcagcgctgcctggagctgcagcccaacaacctgaaggccctgatggccctggccgtgtcctacaccaacacaggccaccagcaggatgcctgtgatgccctgaagaactggatcaagcagaaccccaagtacaagtacctggtgaagagcaagaagggcagccctggcctgaccaggaggatgagcaagagccctgtggacagctctgtgctggagggcgtgaaggagctgtacctggaggccgcccaccagaatggagacatgattgatcctgacctgcagacaggcctgggcgtgctcttccacctgtctggagagttcaacagagccattgatgccttcaatgctgccctgactgtgcggcctgaggactacagcctgtggaaccggctgggcgccaccctggccaacggggacagaagtgaggaggccgtggaggcctacacccgggccctggagatccagcccggcttcatccgcagccgctacaacctgggcatcagctgcatcaacctgggcgcctaccgggaggccgtgagcaacttcctgacagccctgagcctgcagaggaagagcaggaaccagcagcaggtgccccacccagccatcagcggcaacatctgggccgccctgcgcatcgccctgagcctgatggaccagcctgagctgttccaggccgccaacctgggggacctggatgtgctgctgcgggccttcaacctggacccctag

SEQ ID NO: 163634 - DNA, 1545 bp, Artificial Sequence
  Description of Artificial Sequence: Synthetic coding sequence
atgagcagcctgagcctgaagcccctggtgcaggtgtctgtgggcgcctttgtgcagctggtgaatgagcagcaggagagccggcccctgctgagccccagcattgatgacttcctgtgtgagaccaagtctgaggccatcgcccggcctgtgaccagcaacacagctgacatccagacccagctggagaagtgggatgatgtgaagttccatggagacaggaacaccaagggccaccccatggccgagaggaagagcagcagcagcaggacaggcagcaaggagctgctgtggagcagcgagcacaggagccagcctgagctgagcggcggcaagagcgccctgaacagcgagagcgccagcgagctggagctggtggcccccacccaggcccggctgaccaaggagcaccgctggggcagcgccctgctgagcaggaaccacagcctggaggaggagtttgagcgggccaaggctgctgtggagagtgacacagagttctgggacaagatgcaggccgagtgggaggagatggcccggaggaactggatcagcgagaaccaggaggcccagaaccaggtgaccatcagcgccagcgagaagggctactacttccacacagagaaccccttcaaggactggccaggggcctttgaggagggcctgaagaggctgaaggagggggacctgcctgtgaccatcctcttcatggaggccgccatcctgcaggaccctggagatgctgaggcctggcagttcctgggcatcacccaggccgagaatgaaaatgagcaggccgccatcgtggccctgcagcgctgcctggagctgcagcccaacaacctgaaggccctgatggccctggccgtgtcctacaccaacacaggccaccagcaggatgcctgtgatgccctgaagaactggatcaagcagaaccccaagtacaagtacctggtgaagagcaagaagggcagccctggcctgaccaggaggatgagcaagagccctgtggacagctctgtgctggagggcgtgaaggagctgtacctggaggccgcccaccagaatggagacatgattgatcctgacctgcagacaggcctgggcgtgctcttccacctgtctggagagttcaacagagccattgatgccttcaatgctgccctgactgtgcggcctgaggactacagcctgtggaaccggctgggcgccaccctggccaacggggacagaagtgaggaggccgtggaggcctacacccgggccctggagatccagcccggcttcatccgcagccgctacaacctgggcatcagctgcatcaacctgggcgcctaccgggaggccgtgagcaacttcctgacagccctgagcctgcagaggaagagcaggaaccagcagcaggtgccccacccagccatcagcggcaacatctgggccgccctgcgcatcgccctgagcctgatggaccagcctgagctgttccaggccgccaacctgggggacctggatgtgctgctgcgggccttcaacctggacccctag

SEQ ID NO: 163635 - DNA, 1881 bp, Artificial Sequence
  Description of Artificial Sequence: Synthetic coding sequence
atgtaccagggccacatgcagaagagcaaggagcagggctacggcaagctgagcagtgatgaggacctggagatcatcgtggaccagaagcagggcaagggcagcagagctgctgacaaggctgtggccatggtgatgaaggagatcccccgggaggagagcgctgaggagaagcccctgctgaccatgaccagccagctggtgaatgagcagcaggagagccggcccctgctgagccccagcattgatgacttcctgtgtgagaccaagtctgaggccatcgcccggcctgtgaccagcaacacagctgtgctgaccaccggcctggacctgctggacctgtctgagcctgtgtcccagacccagaccaaggccaagaagtctgagcccagcagcaagaccagcagcctgaagaagaaggcagatggcagtgacctgatcagcacagatgctgagcagaggggccagcccctgcgggtgcctgagaccagcagcctggacctggacatccagacccagctggagaagtgggatgatgtgaagttccatggagacaggaacaccaagggccaccccatggccgagaggaagagcagcagcagcaggacaggcagcaaggagctgctgtggagcagcgagcacaggagccagcctgagctgagcggcggcaagagcgccctgaacagcgagagcgccagcgagctggagctggtggcccccacccaggcccggctgaccaaggagcaccgctggggcagcgccctgctgagcaggaaccacagcctggaggaggagtttgagcgggccaaggctgctgtggagagtgacacagagttctgggacaagatgcaggccgagtgggaggagatggcccggaggaactggatcagcgagaaccaggaggcccagaaccaggtgaccatcagcgccagcgagaagggctactacttccacacagagaaccccttcaaggactggccaggggcctttgaggagggcctgaagaggctgaaggagggggacctgcctgtgaccatcctcttcatggaggccgccatcctgcaggaccctggagatgctgaggcctggcagttcctgggcatcacccaggccgagaatgaaaatgagcaggccgccatcgtggccctgcagcgctgcctggagctgcagcccaacaacctgaaggccctgatggccctggccgtgtcctacaccaacacaggccaccagcaggatgcctgtgatgccctgaagaactggatcaagcagaaccccaagtacaagtacctggtgaagagcaagaagggcagccctggcctgaccaggaggatgagcaagagccctgtggacagctctgtgctggagggcgtgaaggagctgtacctggaggccgcccaccagaatggagacatgattgatcctgacctgcagacaggcctgggcgtgctcttccacctgtctggagagttcaacagagccattgatgccttcaatgctgccctgactgtgcggcctgaggactacagcctgtggaaccggctgggcgccaccctggccaacggggacagaagtgaggaggccgtggaggcctacacccgggccctggagatccagcccggcttcatccgcagccgctacaacctgggcatcagctgcatcaacctgggcgcctaccgggaggccgtgagcaacttcctgacagccctgagcctgcagaggaagagcaggaaccagcagcaggtgccccacccagccatcagcggcaacatctgggccgccctgcgcatcgccctgagcctgatggaccagcctgagctgttccaggccgccaacctgggggacctggatgtgctgctgcgggccttcaacctggacccctag

SEQ ID NO: 163636 - DNA, 1752 bp, Artificial Sequence
  Description of Artificial Sequence: Synthetic coding sequence
atggtgatgaaggagatcccccgggaggagagcgctgaggagaagcccctgctgaccatgaccagccagctggtgaatgagcagcaggagagccggcccctgctgagccccagcattgatgacttcctgtgtgagaccaagtctgaggccatcgcccggcctgtgaccagcaacacagctgtgctgaccaccggcctggacctgctggacctgtctgagcctgtgtcccagacccagaccaaggccaagaagtctgagcccagcagcaagaccagcagcctgaagaagaaggcagatggcagtgacctgatcagcacagatgctgagcagaggggccagcccctgcgggtgcctgagaccagcagcctggacctggacatccagacccagctggagaagtgggatgatgtgaagttccacggggacaggaacaccaagggccaccccatggccgagaggaagagcagcagcagcaggacaggcagcaaggagctgctgtggagcagcgagcacaggagccagcctgagctgagcggcggcaagagcgccctgaacagcgagagcgccagcgagctggagctggtggcccccacccaggcccggctgaccaaggagcaccgctggggcagcgccctgctgagcaggaaccacagcctggaggaggagtttgagcgggccaaggctgctgtggagagtgacacagagttctgggacaagatgcaggccgagtgggaggagatggcccggaggaactggatcagcgagaaccaggaggcccagaaccaggtgaccatcagcgccagcgagaagggctactacttccacacagagaaccccttcaaggactggccaggggcctttgaggagggcctgaagaggctgaaggagggggacctgcctgtgaccatcctcttcatggaggccgccatcctgcaggaccctggagatgctgaggcctggcagttcctgggcatcacccaggctgaaaatgaaaatgagcaggccgccatcgtggccctgcagcgctgcctggagctgcagcccaacaacctgaaggccctgatggccctggccgtgtcctacaccaacacaggccaccagcaggatgcctgtgatgccctgaagaactggatcaagcagaaccccaagtacaagtacctggtgaagagcaagaagggcagccctggcctgaccaggaggatgagcaagagccctgtggacagctctgtgctggagggcgtgaaggagctgtacctggaggccgcccaccagaatggagacatgattgatcctgacctgcagacaggcctgggcgtgctcttccacctgagcggggagttcaacagagccattgatgccttcaatgctgccctgactgtgcggcctgaggactacagcctgtggaaccggctgggcgccaccctggccaatggagacagaagtgaggaggccgtggaggcctacacccgggccctggagatccagcccggcttcatccgcagccgctacaacctgggcatcagctgcatcaacctgggcgcctaccgggaggccgtgagcaacttcctgacagccctgagcctgcagaggaagagcaggaaccagcagcaggtgccccacccagccatcagcggcaacatctgggccgccctgagaattgccctgagcctgatggaccagcctgagctgttccaggccgccaacctgggggacctggatgtgctgctgcgggccttcaacctggacccctag

SEQ ID NO: 163637 - DNA, 1776 bp, Artificial Sequence
  Description of Artificial Sequence: Synthetic coding sequence
atgtaccagggccacatgcagaagagcaaggagcagggctacggcaagctgagcagtgatgaggacctggagatcatcgtggaccagaagcagctggtgaatgagcagcaggagagccggcccctgctgagccccagcattgatgacttcctgtgtgagaccaagtctgaggccatcgcccggcctgtgaccagcaacacagctgtgctgaccaccggcctggacctgctggacctgtctgagcctgtgtcccagacccagaccaaggccaagaagtctgagcccagcagcaagaccagcagcctgaagaagaaggcagatggcagtgacctgatcagcacagatgctgagcagaggggccagcccctgcgggtgcctgagaccagcagcctggacctggacatccagacccagctggagaagtgggatgatgtgaagttccacggggacaggaacaccaagggccaccccatggccgagaggaagagcagcagcagcaggacaggcagcaaggagctgctgtggagcagcgagcacaggagccagcctgagctgagcggcggcaagagcgccctgaacagcgagagcgccagcgagctggagctggtggcccccacccaggcccggctgaccaaggagcaccgctggggcagcgccctgctgagcaggaaccacagcctggaggaggagtttgagcgggccaaggctgctgtggagagtgacacagagttctgggacaagatgcaggccgagtgggaggagatggcccggaggaactggatcagcgagaaccaggaggcccagaaccaggtgaccatcagcgccagcgagaagggctactacttccacacagagaaccccttcaaggactggccaggggcctttgaggagggcctgaagaggctgaaggagggggacctgcctgtgaccatcctcttcatggaggccgccatcctgcaggaccctggagatgctgaggcctggcagttcctgggcatcacccaggctgaaaatgaaaatgagcaggccgccatcgtggccctgcagcgctgcctggagctgcagcccaacaacctgaaggccctgatggccctggccgtgtcctacaccaacacaggccaccagcaggatgcctgtgatgccctgaagaactggatcaagcagaaccccaagtacaagtacctggtgaagagcaagaagggcagccctggcctgaccaggaggatgagcaagagccctgtggacagctctgtgctggagggcgtgaaggagctgtacctggaggccgcccaccagaatggagacatgattgatcctgacctgcagacaggcctgggcgtgctcttccacctgagcggggagttcaacagagccattgatgccttcaatgctgccctgactgtgcggcctgaggactacagcctgtggaaccggctgggcgccaccctggccaatggagacagaagtgaggaggccgtggaggcctacacccgggccctggagatccagcccggcttcatccgcagccgctacaacctgggcatcagctgcatcaacctgggcgcctaccgggaggccgtgagcaacttcctgacagccctgagcctgcagaggaagagcaggaaccagcagcaggtgccccacccagccatcagcggcaacatctgggccgccctgagaattgccctgagcctgatggaccagcctgagctgttccaggccgccaacctgggggacctggatgtgctgctgcgggccttcaacctggacccctag

SEQ ID NO: 163638 - DNA, 2217 bp, Artificial Sequence
  Description of Artificial Sequence: Synthetic coding sequence
atggccctggccgtgctgcgggtgctggagcccttccccacagagaccccacccctggccgtgctgctgcccccaggcggcccctggccagctgctgagctgggcctggtgctggccctgcggcctgctggggagagccctgctggccctgccctgctggtggccgccctggagggcccagatgctggaacagaggagcagggccctggccccccccagctgctggtgtcccgggccctgctgcggctgctggccctgggcagcggggcctgggtgcgggcccgggctgtgcggcggcccccagccctgggctgggccctgctgggcaccagcctgggccctggcctgggcccccgggtgggccccctgctggtgcggcggggggagaccctgcctgtgcccggcccccgggtgctggagaccaggcctgccctgcagggcctgctgggccctggcacccggctggccgtgacagagctgcggggccgggcccggctgtgcccagagagcggggacagcagccggcccccacctcctcctgtggtgagcagctttgctgtgtctggcaccgtgcggcggctgcagggcgtgctgggcggcactggagacagcctgggcgtgagccgcagctgcctgcggggcctgggcctcttccagggcgagtgggtgtgggtggcccaggcccgggagagcagcaacaccagccagccccacctggcccgggtgcaggtgctggagccccgctgggacctgagtgaccggctgggccctggcagcggccccctgggggagcccctggctgatggcctggccctggtgcctgccaccctggccttcaacctgggctgtgaccccctggagatgggagagctgcgcatccagcgctacctggagggcagcatcgcccctgaggacaagggcagctgcagcctgctgcccggccccccatttgcccgggagctgcacattgaaattgtgagcagcccccactacagcaccaacggcaactatgatggagtgctgtaccgccacttccagatcccccgggtggtgcaggagggagatgtgctgtgtgtgcccaccatcggccaggtggagatcctggagggcagccctgagaagctgccccgctggagggagatgttcttcaaggtgaagaagacagtgggggaggccccagatggccctgccagcgcctacctggccgacaccacccacaccagcctgtacatggtgggcagcaccctgagccctgtgccctggctgcccagcgaggagagcaccctgtggagcagcctgagccccccaggcctggaggccctggtgtctgagctgtgtgctgtgctgaagccccggctgcagcctggaggagccctgctgaccggcaccagctctgtgctgctgcggggccccccaggctgtgggaagaccaccgtggtggccgccgcctgcagccacctgggcctgcacctgctgaaggtgccctgcagcagcctgtgtgccgagagcagcggggctgtggagaccaagctgcaggccatcttcagccgggcccggcgctgcaggcctgctgtgctgctgctgacagctgtggacctgctgggccgggacagagatggcctgggagaagatgcccgggtgatggctgtgctgcggcacctgctgctgaatgaagaccccctgaacagctgcccccccctgatggtggtggccaccaccagccgggcccaggacctgcctgcagatgtgcagacagccttcccccatgagctggaggtgcctgccctgtctgagggccagaggctgagcatcctgcgggccctgacagcccacctgcccctgggccaggaggtgaacctggcccagctggcccggcgctgtgccggctttgtggtgggggacctgtatgccctgctgacccacagcagcagagctgcctgcacccgcatcaagaacagcggcctggccggcggcctgacagaggaggatgaaggagagctgtgtgccgccggcttccccctgctggctgaagattttggccaggccctggagcagctgcagacagcccacagccaggccgtgggcgcccccaaggtggagaccaagagcctggagtgcctgcccggccctggcctgcagctgcacgccctgagcagcctgatgaactggaccctgtggccccaggccggcggggaggtggagatcctggaggagtag

SEQ ID NO: 163639 - DNA, 2943 bp, Artificial Sequence
  Description of Artificial Sequence: Synthetic coding sequence
atggccctggccgtgctgcgggtgctggagcccttccccacagagaccccacccctggccgtgctgctgcccccaggcggcccctggccagctgctgagctgggcctggtgctggccctgcggcctgctggggagagccctgctggccctgccctgctggtggccgccctggagggcccagatgctggaacagaggagcagggccctggccccccccagctgctggtgtcccgggccctgctgcggctgctggccctgggcagcggggcctgggtgcgggcccgggctgtgcggcggcccccagccctgggctgggccctgctgggcaccagcctgggccctggcctgggcccccgggtgggccccctgctggtgcggcggggggagaccctgcctgtgcccggcccccgggtgctggagaccaggcctgccctgcagggcctgctgggccctggcacccggctggccgtgacagagctgcggggccgggcccggctgtgcccagagagcggggacagcagccggcccccacctcctcctgtggtgagcagctttgctgtgtctggcaccgtgcggcggctgcagggcgtgctgggcggcactggagacagcctgggcgtgagccgcagctgcctgcggggcctgggcctcttccagggcgagtgggtgtgggtggcccaggcccgggagagcagcaacaccagccagccccacctggcccgggtgcaggtgctggagccccgctgggacctgagtgaccggctgggccctggcagcggccccctgggggagcccctggctgatggcctggccctggtgcctgccaccctggccttcaacctgggctgtgaccccctggagatgggagagctgcgcatccagcgctacctggagggcagcatcgcccctgaggacaagggcagctgcagcctgctgcccggccccccatttgcccgggagctgcacattgaaattgtgagcagcccccactacagcaccaacggcaactatgatggagtgctgtaccgccacttccagatcccccgggtggtgcaggagggagatgtgctgtgtgtgcccaccatcggccaggtggagatcctggagggcagccctgagaagctgccccgctggagggagatgttcttcaaggtgaagaagacagtgggggaggccccagatggccctgccagcgcctacctggccgacaccacccacaccagcctgtacatggtgggcagcaccctgagccctgtgccctggctgcccagcgaggagagcaccctgtggagcagcctgagccccccaggcctggaggccctggtgtctgagctgtgtgctgtgctgaagccccggctgcagcctggaggagccctgctgaccggcaccagctctgtgctgctgcggggccccccaggctgtgggaagaccaccgtggtggccgccgcctgcagccacctgggcctgcacctgctgaaggtgccctgcagcagcctgtgtgccgagagcagcggggctgtggagaccaagctgcaggccatcttcagccgggcccggcgctgcaggcctgctgtgctgctgctgacagctgtggacctgctgggccgggacagagatggcctgggagaagatgcccgggtgatggctgtgctgcggcacctgctgctgaatgaagaccccctgaacagctgcccccccctgatggtggtggccaccaccagccgggcccaggacctgcctgcagatgtgcagacagccttcccccatgagctggaggtgcctgccctgtctgagggccagaggctgagcatcctgcgggccctgacagcccacctgcccctgggccaggaggtgaacctggcccagctggcccggcgctgtgccggctttgtggtgggggacctgtatgccctgctgacccacagcagcagagctgcctgcacccgcatcaagaacagcggcctggccggcggcctgacagaggaggatgaaggagagctgtgtgccgccggcttccccctgctggctgaagattttggccaggccctggagcagctgcagacagcccacagccaggccgtgggcgcccccaagatccccagcgtgtcctggcatgatgtgggcggcctgcaggaggtgaagaaggagatcctggagaccatccagctgcccctggagcaccctgagctgctgagcctgggcctgcggcgcagcggcctgctgctgcacggccccccaggcaccgggaagaccctgctggccaaggctgtggccacagagtgcagcctgaccttcctgtctgtgaagggccctgagctgatcaacatgtatgtgggccagagtgaagaaaatgtgcgggaggtgtttgcccgggcccgggctgctgccccctgcatcatcttctttgatgagctggacagcctggcccccagccggggccgcagcggggacagcggcggcgtgatggacagagtggtgtcccagctgctggccgagctggatggcctgcacagcacccaggatgtgtttgtgattggagccaccaacagaccagacctgctggaccctgccctgctgcggcccggccgctttgacaagctggtgtttgtgggcgccaatgaagatcgggccagccagctgcgggtgctgagcgccatcaccaggaagttcaagctggagcccagcgtgtccctggtgaatgtgctggactgctgccccccccagctgaccggggctgacctgtacagcctgtgcagtgatgccatgacagctgccctgaagagaagagtgcatgacctggaggagggcctggagcccggcagcagcgccctgatgctgaccatggaggacctgctgcaggccgccgcccggctgcagcccagcgtgtctgagcaggagctgctgcgctacaagaggatccagaggaagtttgctgcctgctag

SEQ ID NO: 163640 - DNA, 972 bp, Artificial Sequence
  Description of Artificial Sequence: Synthetic coding sequence
atgtctgctgtgtgtggcggggccgccaggatgctgcggaccccaggccgccacggctatgctgctgagttcagcccctacctgcccggccgcctggcctgtgccacagcccagcactacggcattgctggctgcggcaccctgctgatcctggaccctgatgaggccggcctgcggctcttccgcagctttgactggaatgatggcctgtttgatgtgacctggagcgaaaataatgaacatgtgctgatcacctgcagcggagatggcagcctgcagctgtgggacacagccaaggctgctggccccctgcaggtgtacaaggagcacgcccaggaggtgtacagcgtggactggagccagaccagaggagagcagctggtggtgtctggctcctgggaccagacagtgaagctgtgggaccccaccgtgggcaagagcctgtgcaccttccggggccacgagagcatcatctacagcaccatctggagcccccacatccctggctgctttgccagcgccagcggggaccagaccctgcgcatctgggatgtgaaggccgccggcgtgcgcatcgtcatcccagcccaccaggccgagatcctgagctgtgactggtgcaagtacaatgaaaacctgctggtgactggagctgtggactgcagcctgcggggctgggacctgagaaatgtgcggcagcctgtgtttgagctgctgggccacacctacgccatccggcgggtgaagttcagccccttccacgcctctgtgctggccagctgcagctatgacttcaccgtgcgcttctggaacttcagcaagccagacagcctgctggagaccgtggagcaccacacagagttcacctgtggcctggacttcagcctgcagagccccacccaggtggccgactgctcctgggatgagaccatcaagatctatgaccctgcctgcctgaccatcccagcctag

SEQ ID NO: 163641 - DNA, 369 bp, Artificial Sequence
  Description of Artificial Sequence: Synthetic coding sequence
atgtctgctgtgtgtggcggggccgccaggatgctgcggaccccaggccgccacggctatgctgctgagttcagcccctacctgcccggccgcctggcctgtgccacagcccagcactacggcattgctggctgcggcaccctgctgatcctggaccctgatgaggccggcctgcggctcttccgcagctttgactggaatgatggcctgtttgatgtgacctggagcgaaaataatgaacatgtgctgatcacctgcagcggagatggcagcctgcagctgtgggacacagccaaggctgctggccccctgcaggtgtacaaggagcacgcccaggagtatgtgcagggcagctgtgtggtgaagtag

SEQ ID NO: 163642 - DNA, 843 bp, Artificial Sequence
  Description of Artificial Sequence: Synthetic coding sequence
atgtctgctgtgtgtggcggggccgccaggatgctgcggaccccaggccgccacggctatgctgctgagttcagcccctacctgcccggccgcctggcctgtgccacagcccagcactacggcattgctggctgcggcaccctgctgatcctggaccctgatgaggccggcctgcggctcttccgcagctttgactggaatgatggcctgtttgatgtgacctggagcgaaaataatgaacatgtgctgatcacctgcagcggagatggcagcctgcagctgtgggacacagccaaggctgctggccccctgcaggtgtacaaggagcacgcccaggaggtgtacagcgtggactggagccagaccagaggagagcagctggtggtgtctggctcctgggaccagacagtgaagctgtgggaccccaccgtgggcaagagcctgtgcaccttccggggccacgagagcatcatctacagcaccatctggagcccccacatccctggctgctttgccagcgccagcggggaccagaccctgcgcatctgggatgtgaaggccgccggcgtgcgcatcgtcatcccagcccaccaggccgagatcctgagctgtgactggtgcaagtacaatgaaaacctgctggtgactggagctgtggactgcagcctgcggggctgggacctgagaaatgtgcggcagcctgtgtttgagctgctgggccacacctacgccatccggcgggtgaagatggagagctgccctgtgacccagaccaggagccagctgacagccaccagcgccttctgggtgcaggccgtgctgctgccccagcccacagaatag

SEQ ID NO: 163643 - DNA, 912 bp, Artificial Sequence
  Description of Artificial Sequence: Synthetic coding sequence
atggcctcctgggccaagggccgcagctacctggcccctggcctgctgcagggccaggtggccatcgtgactggaggagccaccggcatcggcaaggccatcgtgaaggagctgctggagctgggcagcaatgtggtgattgccagcaggaagctggagcggctgaagtctgctgctgatgagctgcaggccaacctgccccccaccaagcaggcccgggtcatccccatccagtgcaacatcagaaatgaggaggaggtgaacaacctggtgaagagcaccctggacaccttcggcaagatcaacttcctggtgaacaatggaggcggccagttcctgagccctgctgagcacatcagcagcaagggctggcatgctgtgctggagaccaacctgaccggcaccttctacatgtgcaaggctgtgtacagctcctggatgaaggagcacggcggcagcatcgtgaacatcatcgtgcccaccaaggccggcttccccctggccgtgcacagcggggccgcccgggccggcgtgtacaacctgaccaagagcctggccctggagtgggcctgcagcggcatccgcatcaactgtgtggcccctggggtcatctacagccagacagctgtggagaactacggctcctggggccagagcttctttgagggcagcttccagaagatcccagccaagagaattggagtgcctgaggaggtgtcctctgtggtgtgcttcctgctgagccctgctgccagcttcatcaccggccagagcgtggatgtggatggcggccgcagcctgtacacccacagctatgaggtgcctgaccatgacaactggcccaagggggccggggacctgtctgtggtgaagaagatgaaggagaccttcaaggagaaggccaagctgtag

SEQ ID NO: 163644 - DNA, 1407 bp, Artificial Sequence
  Description of Artificial Sequence: Synthetic coding sequence
atggtggacacagagagccccctgtgccccctgagccccctggaggccggggacctggagagccccctgtctgaggagttcctgcaggagatgggcaacatccaggagatcagccagagcattggagaggacagcagcggcagctttggcttcacagagtaccagtacctgggcagctgccccggcagtgatggcagcgtcatcacagacaccctgagccctgccagcagccccagctctgtgacctaccctgtggtgcccggctctgtggatgagagccccagcggggccctgaacattgaatgtcgcatctgtggggacaaggccagcggctaccactacggcgtgcacgcctgtgagggctgcaagggcttcttccggaggaccatccggctgaagctggtgtatgacaagtgtgacaggagctgcaagatccagaagaagaacagaaacaagtgccagtactgccgcttccacaagtgcctgtctgtgggcatgagccacaatgccatccgctttggaaggatgcccaggtctgagaaggccaagctgaaggccgagatcctgacctgtgaacatgacatcgaggacagcgagacagctgacctgaagagcctggccaagaggatctatgaggcctacctgaagaacttcaacatgaacaaggtgaaggcccgggtcatcctgagcggcaaggccagcaacaaccccccatttgtgattcatgacatggagaccctgtgcatggccgagaagaccctggtggccaagctggtggccaacggcatccagaacaaggaggccgaggtgcgcatcttccactgctgccagtgcacctctgtggagaccgtgacagagctgacagaatttgccaaggccatccctggctttgccaacctggacctgaatgaccaggtgaccctgctgaagtatggagtgtatgaggccatctttgccatgctgagctctgtgatgaacaaggatggcatgctggtggcctatggaaatggcttcatcacccgggagttcctgaagagcctgaggaagcccttctgtgacatcatggagcccaagtttgattttgccatgaagttcaatgccctggagctggatgacagcgacatcagcctgtttgtggccgccatcatctgctgcggggacaggcctggcctgctgaatgtgggccacatcgagaagatgcaggagggcatcgtgcacgtgctgcggctgcacctgcagagcaaccacccagatgacatcttcctgttccccaagctgctgcagaagatggctgacctgcggcagctggtgacagagcacgcccagctggtgcagatcatcaagaagacagaaagtgatgctgccctgcaccccctgctgcaggagatctacagagacatgtactag

SEQ ID NO: 163645 - DNA, 1407 bp, Artificial Sequence; identical to SEQ ID NO: 163644
  Description of Artificial Sequence: Synthetic coding sequence

SEQ ID NO: 163646 - DNA, 1407 bp, Artificial Sequence; identical to SEQ ID NO: 163644
  Description of Artificial Sequence: Synthetic coding sequence

SEQ ID NO: 163647 - DNA, 1407 bp, Artificial Sequence; identical to SEQ ID NO: 163644
  Description of Artificial Sequence: Synthetic coding sequence

SEQ ID NO: 163648 - DNA, 210 bp, Artificial Sequence
  Description of Artificial Sequence: Synthetic coding sequence
atggtggacacagagagccccctgtgccccctgagccccctggaggccggggacctggagagccccctgtctgaggagttcctgcaggagatgggcaacatccaggagatcagccagagcattggagaggacagcagcggcagctttggcttcacagagtaccagtacctgggcagctgccccggcagtgatggcagcgtcatcacctag

SEQ ID NO: 163649 - DNA, 402 bp, Artificial Sequence
  Description of Artificial Sequence: Synthetic coding sequence
atggtggacacagagagccccctgtgccccctgagccccctggaggccggggacctggagagccccctgtctgaggagttcctgcaggagatgggcaacatccaggagatcagccagagcattggagaggacagcagcggcagctttggcttcacagagtaccagtacctgggcagctgccccggcagtgatggcagcgtcatcacagacaccctgagccctgccagcagccccagctctgtgacctaccctgtggtgcccggctctgtggatgagagccccagcggggccctgaacattgaatgtcgcatctgtggggacaaggccagcggctaccactacggcgtgcacgcctgtgagggctgcaaggtggagggctcctggaacagagcctggtggtag

SEQ ID NO: 163650 - DNA, 525 bp, Artificial Sequence
  Description of Artificial Sequence: Synthetic coding sequence
atggtggacacagagagccccctgtgccccctgagccccctggaggccggggacctggagagccccctgtctgaggagttcctgcaggagatgggcaacatccaggagatcagccagagcattggagaggacagcagcggcagctttggcttcacagagtaccagtacctgggcagctgccccggcagtgatggcagcgtcatcacagacaccctgagccctgccagcagccccagctctgtgacctaccctgtggtgcccggctctgtggatgagagccccagcggggccctgaacattgaatgtcgcatctgtggggacaaggccagcggctaccactacggcgtgcacgcctgtgagggctgcaagggcttcttccggaggaccatccggctgaagctggtgtatgacaagtgtgacaggagctgcaagatccagaagaagaacagaaacaagtgccagtactgccgcttccacaagtgcctgtctgtgggcatgagccacaatgccttctgccacacctag

SEQ ID NO: 163651 - DNA, 30 bp, Artificial Sequence
  Description of Artificial Sequence: Synthetic coding sequence
atggtggacacagagagccccctgtgctag

SEQ ID NO: 163652 - DNA, 489 bp, Artificial Sequence
  Description of Artificial Sequence: Synthetic coding sequence
atgaacaaggtgaaggcccgggtcatcctgagcggcaaggccagcaacaacccccccttcgtcatccatgacatggagaccctgtgcatggccgagaagaccctggtggccaagctggtggccaacggcatccagaacaaggaggccgaggtgcgcatcttccactgctgccagtgcacctctgtggagaccgtgacagagctgacagaatttgccaaggccatccctggctttgccaacctggacctgaatgaccaggtgaccctgctgaagtatggagtgtatgaggccatctttgccatgctgagctctgtgatgaacaaggatggcatgctggtggcctatggaaatggcttcatcacccgggagttcctgaagagcctgaggaagcccttctgtgacatcatggagcccaagtttgattttgccatgaagttcaatgccctggagctggatgacagcgacatcagcctgtttgtggccgcctag

SEQ ID NO: 163653 - DNA, 1326 bp, Artificial Sequence
  Description of Artificial Sequence: Synthetic coding sequence
atggagcagccccaggaggaggcccctgaggtgcgggaggaggaggagaaggaggaggtggccgaggccgagggcgcccctgagctgaatggaggcccccagcacgccctgcccagcagcagctacacagacctgagccgcagcagcagcccccccagcctgctggaccagctgcagatgggctgtgatggagccagctgtggcagcctgaacatggagtgccgggtgtgtggggacaaggccagcggcttccactacggcgtgcacgcctgtgagggctgcaagggcttcttccggaggaccatccgcatgaagctggagtatgagaagtgtgagaggagctgcaagatccagaagaagaacagaaacaagtgccagtactgccgcttccagaagtgcctggccctgggcatgagccacaatgccatccgctttggaaggatgcctgaggccgagaagaggaagctggtggccggcctgacagccaatgaaggcagccagtacaacccccaggtggccgacctgaaggccttcagcaagcacatctacaatgcctacctgaagaacttcaacatgaccaagaagaaggcccggagcatcctgaccgggaaggccagccacacagccccctttgtgattcatgacatcgagaccctgtggcaggccgagaagggcctggtgtggaagcagctggtgaatggcctgcccccctacaaggagatctctgtgcacgtgttctaccgctgccagtgcaccaccgtggagaccgtgcgggagctgacagaatttgccaagagcatccccagcttcagcagcctcttcctgaatgaccaggtgaccctgctgaagtatggagtgcatgaggccatctttgccatgctggccagcatcgtgaacaaggatggcctgctggtggccaatggaagtggctttgtgacccgggagttcctgcggagcctgaggaagcccttcagtgacatcatcgagcccaagtttgaatttgctgtgaagttcaatgccctggagctggatgacagcgacctggccctcttcatcgccgccatcatcctgtgtggggaccggcccggcctgatgaatgtgccccgggtggaggccatccaggacaccatcctgcgggccctggagttccacctgcaggccaaccacccagatgcccagtacctgttccccaagctgctgcagaagatggctgacctgcggcagctggtgacagaacatgcccagatgatgcagaggatcaagaagacagaaacagagaccagcctgcaccccctgctgcaggagatctacaaggacatgtactag

SEQ ID NO: 163654 - DNA, 1086 bp, Artificial Sequence
  Description of Artificial Sequence: Synthetic coding sequence
atggagcagccccaggaggaggcccctgaggtgcgggaggaggaggagaaggaggaggtggccgaggccgagggcgcccctgagctgaatggaggcccccagcacgccctgcccagcagcagctacacagacctgagccgcagcagcagcccccccagcctgctggaccagctgcagatgggctgtgatggagccagctgtggcagcctgaacatggagtgccgggtgtgtggggacaaggccagcggcttccactacggcgtgcacgcctgtgagggctgcaagggcttcttccggaggaccatccgcatgaagctggagtatgagaagtgtgagaggagctgcaagatccagaagaagaacagaaacaagtgccagtactgccgcttccagaagtgcctggccctgggcatgagccacaatgccatccgctttggaaggatgcctgaggccgagaagaggaagctggtggccggcctgacagccaatgaaggcagccagtacaacccccaggtggccgacctgaaggccttcagcaagcacatctacaatgcctacctgaagaacttcaacatgaccaagaagaaggcccggagcatcctgaccgggaaggccagccacacagccccctttgtgattcatgacatcgagaccctgtggcaggccgagaagggcctggtgtggaagcagctggtgaatggcctgcccccctacaaggagatctctgtgcacgtgttctaccgctgccagtgcaccaccgtggagaccgtgcgggagctgacagaatttgccaagagcatccccagcttcagcagcctcttcctgaatgaccaggtgaccctgctgaagtatggagtgcatgaggccatctttgccatgctggccagcatcgtgaacaaggatggcctgctggtggccaatggaagtggctttgtgacccgggagttcctgcggagcctgaggaagcccttcagtgacatcatcgagcccaagtttgaatttgctgtgaagttcaatgccctggagctggatgacagcgacctggccctcttcatcgccgccatcatcctgtgtggcggggagtag

SEQ ID NO: 163655 - DNA, 1326 bp, Artificial Sequence; identical to SEQ ID NO: 163653
  Description of Artificial Sequence: Synthetic coding sequence

SEQ ID NO: 163656 - DNA, 1032 bp, Artificial Sequence
  Description of Artificial Sequence: Synthetic coding sequence
atggagcagccccaggaggaggcccctgaggtgcgggaggaggaggagaaggaggaggtggccgaggccgagggcgcccctgagctgaatggaggcccccagcacgccctgcccagcagcagctacacagccatccgctttggaaggatgcctgaggccgagaagaggaagctggtggccggcctgacagccaatgaaggcagccagtacaacccccaggtggccgacctgaaggccttcagcaagcacatctacaatgcctacctgaagaacttcaacatgaccaagaagaaggcccggagcatcctgaccgggaaggccagccacacagccccctttgtgattcatgacatcgagaccctgtggcaggccgagaagggcctggtgtggaagcagctggtgaatggcctgcccccctacaaggagatctctgtgcacgtgttctaccgctgccagtgcaccaccgtggagaccgtgcgggagctgacagaatttgccaagagcatccccagcttcagcagcctcttcctgaatgaccaggtgaccctgctgaagtatggagtgcatgaggccatctttgccatgctggccagcatcgtgaacaaggatggcctgctggtggccaatggaagtggctttgtgacccgggagttcctgcggagcctgaggaagcccttcagtgacatcatcgagcccaagtttgaatttgctgtgaagttcaatgccctggagctggatgacagcgacctggccctcttcatcgccgccatcatcctgtgtggggaccggcccggcctgatgaatgtgccccgggtggaggccatccaggacaccatcctgcgggccctggagttccacctgcaggccaaccacccagatgcccagtacctgttccccaagctgctgcagaagatggctgacctgcggcagctggtgacagaacatgcccagatgatgcagaggatcaagaagacagaaacagagaccagcctgcaccccctgctgcaggagatctacaaggacatgtactag

SEQ ID NO: 163657 - DNA, 1086 bp, Artificial Sequence; identical to SEQ ID NO: 163654
  Description of Artificial Sequence: Synthetic coding sequence

SEQ ID NO: 163658 - DNA, 1209 bp, Artificial Sequence
  Description of Artificial Sequence: Synthetic coding sequence
atgcaccagagggacctgagccgcagcagcagcccccccagcctgctggaccagctgcagatgggctgtgatggagccagctgtggcagcctgaacatggagtgccgggtgtgtggggacaaggccagcggcttccactatggagtgcacgcctgtgagggctgcaagggcttcttccggaggaccatccgcatgaagctggagtatgaaaaatgtgagaggagctgcaagatccagaagaagaacagaaacaagtgccagtactgccgcttccagaagtgcctggccctgggcatgagccacaatgccatccgcttcggccgcatgcctgaggccgagaagaggaagctggtggccggcctgacagccaatgaaggcagccagtacaacccccaggtggccgacctgaaggccttcagcaagcacatctacaatgcctacctgaagaacttcaacatgaccaagaagaaggcccggagcatcctgaccgggaaggccagccacacagcccccttcgtcatccatgacatcgagaccctgtggcaggccgagaagggcctggtgtggaagcagctggtgaatggcctgcccccctacaaggagatctctgtgcacgtgttctaccgctgccagtgcaccaccgtggagaccgtgcgggagctgacagaatttgccaagagcatccccagcttcagcagcctcttcctgaatgaccaggtgaccctgctgaagtatggagtgcatgaggccatctttgccatgctggccagcatcgtgaacaaggatggcctgctggtggccaacggcagcggctttgtgacccgggagttcctgcggagcctgaggaagcccttcagtgacatcatcgagcccaagtttgaatttgctgtgaagttcaatgccctggagctggatgacagcgacctggccctcttcatcgccgccatcatcctgtgtggggacaggcctggcctgatgaatgtgccccgggtggaggccatccaggacaccatcctgcgggccctggagttccacctgcaggccaaccacccagatgcccagtacctgttccccaagctgctgcagaagatggctgacctgcggcagctggtgacagagcacgcccagatgatgcagaggatcaagaagacagaaacagagaccagcctgcaccccctgctgcaggagatctacaaggacatgtactag

SEQ ID NO: 163659 - DNA, 1017 bp, Artificial Sequence
  Description of Artificial Sequence: Synthetic coding sequence
atgaagctggagtatgaaaaatgtgagaggagctgcaagatccagaagaagaacagaaacaagtgccagtactgccgcttccagaagtgcctggccctgggcatgagccacaatgccatccgcttcggccgcatgcctgaggccgagaagaggaagctggtggccggcctgacagccaatgaaggcagccagtacaacccccaggtggccgacctgaaggccttcagcaagcacatctacaatgcctacctgaagaacttcaacatgaccaagaagaaggcccggagcatcctgaccgggaaggccagccacacagcccccttcgtcatccatgacatcgagaccctgtggcaggccgagaagggcctggtgtggaagcagctggtgaatggcctgcccccctacaaggagatctctgtgcacgtgttctaccgctgccagtgcaccaccgtggagaccgtgcgggagctgacagaatttgccaagagcatccccagcttcagcagcctcttcctgaatgaccaggtgaccctgctgaagtatggagtgcatgaggccatctttgccatgctggccagcatcgtgaacaaggatggcctgctggtggccaacggcagcggctttgtgacccgggagttcctgcggagcctgaggaagcccttcagtgacatcatcgagcccaagtttgaatttgctgtgaagttcaatgccctggagctggatgacagcgacctggccctcttcatcgccgccatcatcctgtgtggggacaggcctggcctgatgaatgtgccccgggtggaggccatccaggacaccatcctgcgggccctggagttccacctgcaggccaaccacccagatgcccagtacctgttccccaagctgctgcagaagatggctgacctgcggcagctggtgacagagcacgcccagatgatgcagaggatcaagaagacagaaacagagaccagcctgcaccccctgctgcaggagatctacaaggacatgtactag

SEQ ID NO: 163660 - DNA, 1518 bp, Artificial Sequence
  Description of Artificial Sequence: Synthetic coding sequence
atgggagagaccctgggggacagccccatcgaccctgagagtgacagcttcacagacaccctgagcgccaacatcagccaggagatgaccatggtggacacagagatgcccttctggcccaccaactttggcatcagctctgtggacctgtctgtgatggaggaccacagccacagctttgacatcaagcccttcaccaccgtggacttcagcagcatcagcaccccccactatgaggacatccccttcaccaggacagatcctgtggtggccgactacaagtatgacctgaagctgcaggagtaccagagcgccatcaaggtggagcccgccagccccccctactacagcgagaagacccagctgtacaacaagccccatgaggagcccagcaacagcctgatggccatcgagtgccgggtgtgtggggacaaggccagcggcttccactatggagtgcacgcctgtgagggctgcaagggcttcttccggaggaccatccggctgaagctgatctatgacagatgtgacctgaactgccgcatccacaagaagagcaggaacaagtgccagtactgccgcttccagaagtgcctggccgtgggcatgagccacaatgccatccgcttcggccgcatgccccaggccgagaaggagaagctgctggccgagatcagcagtgacatcgaccagctgaaccctgagagcgctgacctgcgggccctggccaagcacctgtatgacagctacatcaagagcttccccctgaccaaggccaaggcccgggccatcctgaccgggaagaccacagacaagagcccctttgtgatctatgacatgaacagcctgatgatgggagaggacaagatcaagttcaagcacatcacccccctgcaggagcagagcaaggaggtggccatccgcatcttccagggctgccagttccgctctgtggaggccgtgcaggagatcacagaatatgccaagagcatccctggctttgtgaacctggacctgaatgaccaggtgaccctgctgaagtatggagtgcatgagatcatctacaccatgctggccagcctgatgaacaaggatggagtgctgatcagcgagggccagggcttcatgacccgggagttcctgaagagcctgaggaagccctttggagacttcatggagcccaagtttgaatttgctgtgaagttcaatgccctggagctggatgacagcgacctggccatcttcatcgctgtgatcatcctgagcggggaccggcccggcctgctgaatgtgaagcccatcgaggacatccaggacaacctgctgcaggccctggagctgcagctgaagctgaaccaccctgagagcagccagctgtttgccaagctgctgcagaagatgacagacctgcggcagatcgtgacagaacatgtgcagctgctgcaggtgatcaagaagacagaaacagacatgagcctgcaccccctgctgcaggagatctacaaggacctgtactag

SEQ ID NO: 163661 - DNA, 1434 bp, Artificial Sequence
  Description of Artificial Sequence: Synthetic coding sequence
atgaccatggtggacacagagatgcccttctggcccaccaactttggcatcagctctgtggacctgtctgtgatggaggaccacagccacagctttgacatcaagcccttcaccaccgtggacttcagcagcatcagcaccccccactatgaggacatccccttcaccaggacagatcctgtggtggccgactacaagtatgacctgaagctgcaggagtaccagagcgccatcaaggtggagcccgccagccccccctactacagcgagaagacccagctgtacaacaagccccatgaggagcccagcaacagcctgatggccatcgagtgccgggtgtgtggggacaaggccagcggcttccactatggagtgcacgcctgtgagggctgcaagggcttcttccggaggaccatccggctgaagctgatctatgacagatgtgacctgaactgccgcatccacaagaagagcaggaacaagtgccagtactgccgcttccagaagtgcctggccgtgggcatgagccacaatgccatccgcttcggccgcatgccccaggccgagaaggagaagctgctggccgagatcagcagtgacatcgaccagctgaaccctgagagcgctgacctgcgggccctggccaagcacctgtatgacagctacatcaagagcttccccctgaccaaggccaaggcccgggccatcctgaccgggaagaccacagacaagagcccctttgtgatctatgacatgaacagcctgatgatgggagaggacaagatcaagttcaagcacatcacccccctgcaggagcagagcaaggaggtggccatccgcatcttccagggctgccagttccgctctgtggaggccgtgcaggagatcacagaatatgccaagagcatccctggctttgtgaacctggacctgaatgaccaggtgaccctgctgaagtatggagtgcatgagatcatctacaccatgctggccagcctgatgaacaaggatggagtgctgatcagcgagggccagggcttcatgacccgggagttcctgaagagcctgaggaagccctttggagacttcatggagcccaagtttgaatttgctgtgaagttcaatgccctggagctggatgacagcgacctggccatcttcatcgctgtgatcatcctgagcggggaccggcccggcctgctgaatgtgaagcccatcgaggacatccaggacaacctgctgcaggccctggagctgcagctgaagctgaaccaccctgagagcagccagctgtttgccaagctgctgcagaagatgacagacctgcggcagatcgtgacagaacatgtgcagctgctgcaggtgatcaagaagacagaaacagacatgagcctgcaccccctgctgcaggagatctacaaggacctgtactag

SEQ ID NO: 163662 - DNA, 753 bp, Artificial Sequence
  Description of Artificial Sequence: Synthetic coding sequence
atgaccatggtggacacagagatgcccttctggcccaccaactttggcatcagctctgtggacctgtctgtgatggaggaccacagccacagctttgacatcaagcccttcaccaccgtggacttcagcagcatcagcaccccccactatgaggacatccccttcaccaggacagatcctgtggtggccgactacaagtatgacctgaagctgcaggagtaccagagcgccatcaaggtggagcccgccagccccccctactacagcgagaagacccagctgtacaacaagccccatgaggagcccagcaacagcctgatggccatcgagtgccgggtgtgtggggacaaggccagcggcttccactatggagtgcacgcctgtgagggctgcaagggcttcttccggaggaccatccggctgaagctgatctatgacagatgtgacctgaactgccgcatccacaagaagagcaggaacaagtgccagtactgccgcttccagaagtgcctggccgtgggcatgagccacaatgccatccgcttcggccgcatgccccaggccgagaaggagaagctgctggccgagatcagcagtgacatcgaccagctgaaccctgagagcgctgacctgcgggccctggccaagcacctgtatgacagctacatcaagagcttccccctgaccaaggccaaggcccgggccatcctgaccgggaagaccacagacaagagcacagcccaggtgtgctag

SEQ ID NO: 163663 - DNA, 1434 bp, Artificial Sequence; identical to SEQ ID NO: 163661
  Description of Artificial Sequence: Synthetic coding sequence

SEQ ID NO: 163664 - DNA, 1434 bp, Artificial Sequence; identical to SEQ ID NO: 163661
  Description of Artificial Sequence: Synthetic coding sequence

SEQ ID NO: 163665 - DNA, 1434 bp, Artificial Sequence; identical to SEQ ID NO: 163661
  Description of Artificial Sequence: Synthetic coding sequence

SEQ ID NO: 163666 - DNA, 1452 bp, Artificial Sequence
  Description of Artificial Sequence: Synthetic coding sequence
atgaagggcttcagcgagatgaccatggtggacacagagatgcccttctggcccaccaactttggcatcagctctgtggacctgtctgtgatggaggaccacagccacagctttgacatcaagcccttcaccaccgtggacttcagcagcatcagcaccccccactatgaggacatccccttcaccaggacagatcctgtggtggccgactacaagtatgacctgaagctgcaggagtaccagagcgccatcaaggtggagcccgccagccccccctactacagcgagaagacccagctgtacaacaagccccatgaggagcccagcaacagcctgatggccatcgagtgccgggtgtgtggggacaaggccagcggcttccactatggagtgcacgcctgtgagggctgcaagggcttcttccggaggaccatccggctgaagctgatctatgacagatgtgacctgaactgccgcatccacaagaagagcaggaacaagtgccagtactgccgcttccagaagtgcctggccgtgggcatgagccacaatgccatccgcttcggccgcatgccccaggccgagaaggagaagctgctggccgagatcagcagtgacatcgaccagctgaaccctgagagcgctgacctgcgggccctggccaagcacctgtatgacagctacatcaagagcttccccctgaccaaggccaaggcccgggccatcctgaccgggaagaccacagacaagagcccctttgtgatctatgacatgaacagcctgatgatgggagaggacaagatcaagttcaagcacatcacccccctgcaggagcagagcaaggaggtggccatccgcatcttccagggctgccagttccgctctgtggaggccgtgcaggagatcacagaatatgccaagagcatccctggctttgtgaacctggacctgaatgaccaggtgaccctgctgaagtatggagtgcatgagatcatctacaccatgctggccagcctgatgaacaaggatggagtgctgatcagcgagggccagggcttcatgacccgggagttcctgaagagcctgaggaagccctttggagacttcatggagcccaagtttgaatttgctgtgaagttcaatgccctggagctggatgacagcgacctggccatcttcatcgctgtgatcatcctgagcggggaccggcccggcctgctgaatgtgaagcccatcgaggacatccaggacaacctgctgcaggccctggagctgcagctgaagctgaaccaccctgagagcagccagctgtttgccaagctgctgcagaagatgacagacctgcggcagatcgtgacagaacatgtgcagctgctgcaggtgatcaagaagacagaaacagacatgagcctgcaccccctgctgcaggagatctacaaggacctgtactag

SEQ ID NO: 163667 - DNA, 399 bp, Artificial Sequence
  Description of Artificial Sequence: Synthetic coding sequence
atgaccatggtggacacagagatgcccttctggcccaccaactttggcatcagctctgtggacctgtctgtgatggaggaccacagccacagctttgacatcaagcccttcaccaccgtggacttcagcagcatcagcaccccccactatgaggacatccccttcaccaggacagatcctgtggtggccgactacaagtatgacctgaagctgcaggagtaccagagcgccatcaaggtggagcccgccagccccccctactacagcgagaagacccagctgtacaacaagccccatgaggagcccagcaacagcctgatggccatcgagtgccgggtgtgtggggacaaggccagcggcttccactatggagtgcacgcctgtgagggctgcaagtag

SEQ ID NO: 163668 - DNA, 300 bp, Artificial Sequence
  Description of Artificial Sequence: Synthetic coding sequence
atgaccatggtggacacagagatgcccttctggcccaccaactttggcatcagctctgtggacctgtctgtgatggaggaccacagccacagctttgacatcaagcccttcaccaccgtggacttcagcagcatcagcaccccccactatgaggacatccccttcaccaggacagatcctgtggtggccgactacaagtatgacctgaagctgcaggagtaccagagcgccatcaaggtggagcccgccagccccccctactacagcgagaagacccagctgtacaacaagccccactag

SEQ ID NO: 163669 - DNA, 132 bp, Artificial Sequence
  Description of Artificial Sequence: Synthetic coding sequence
atgaccatggtggacacagagatgcccttctggcccaccaactttggcatcagctctgtggacctgtctgtgatggaggaccacagccacagctttgacatcaagcccttcaccaccgtggacttctcctag

SEQ ID NO: 163670 - DNA, 747 bp, Artificial Sequence
  Description of Artificial Sequence: Synthetic coding sequence
atggtggacacagagatgcccttctggcccaccaactttggcatcagctctgtggacctgtctgtgatggaggaccacagccacagctttgacatcaagcccttcaccaccgtggacttcagcagcatcagcaccccccactatgaggacatccccttcaccaggacagatcctgtggtggccgactacaagtatgacctgaagctgcaggagtaccagagcgccatcaaggtggagcccgccagccccccctactacagcgagaagacccagctgtacaacaagccccatgaggagcccagcaacagcctgatggccatcgagtgccgggtgtgtggggacaaggccagcggcttccactatggagtgcacgcctgtgagggctgcaagggcttcttccggaggaccatccggctgaagctgatctatgacagatgtgacctgaactgccgcatccacaagaagagcaggaacaagtgccagtactgccgcttccagaagtgcctggccgtgggcatgagccacaatgccatccgcttcggccgcatgccccaggccgagaaggagaagctgctggccgagatcagcagtgacatcgaccagctgaaccctgagagcgctgacctgcgggccctggccaagcacctgtatgacagctacatcaagagcttccccctgaccaaggccaaggcccgggccatcctgaccgggaagaccacagacaagagcacagcccaggtgtgctag

SEQ ID NO: 163671 - DNA, 2955 bp, Artificial Sequence
  Description of Artificial Sequence: Synthetic coding sequence
atggctggaaatgactgtggggccctgctggatgaggagctgagcagcttcttcctgaactacctggccgacacccagggcggcggcagcggggaggagcagctgtatgctgacttccctgagctggacctgagccagctggatgccagtgactttgacagcgccacctgcttcggggagctgcagtggtgcccagagaacagcgagacagagcccaaccagtacagcccagatgacagcgagctgttccagattgattctgaaaatgaggccctgctggccgagctgaccaagaccctggatgacatcccagaagatgatgtgggcctggccgccttccctgccctggatggaggagatgccctgagctgcaccagcgccagccctgcccccagcagcgccccacccagccctgcccctgagaagcccagcgccccagcccctgaggtggatgagctgagcctggccgacagcacccaggacaagaaggcccccatgatgcagagccagagccgcagctgcacagagctgcacaagcacctgaccagcgcccagtgctgcctgcaggaccggggcctgcagcccccctgcctgcagagcccccggctgcctgccaaggaggacaaggagcctggagaggactgccccagcccccagcctgccccagccagcccccgggacagcctggccctgggccgggctgaccccggggcccctgtgtcccaggaggacatgcaggccatggtgcagctgatccgctacatgcacacctactgcctgccccagaggaagctgcccccccagaccccagagcccctgcccaaggcctgcagcaaccccagccagcaggtgcgcagccggccctggagccgccaccacagcaaggcctcctgggccgagttcagcatcctgcgggagctgctggcccaggatgtgctgtgtgatgtgtccaagccctaccgcctggccacccctgtgtatgccagcctgacccccaggagccggccccggccccccaaggacagccaggccagccctggccggcccagctctgtggaggaggtgagaattgctgccagccccaagagcacaggcccccggcccagcctgcggcccctgcggctggaggtgaagcgggaggtgcggcggcctgcccggctgcagcagcaggaggaggaggatgaggaggaggaggaggaggaggaggaggaggagaaggaggaggaggaggagtggggcaggaagaggcctggccggggcctgccctggaccaagctgggcaggaagctggagagctctgtgtgccctgtgcggcgcagccggcggctgaaccctgagctgggcccctggctgacctttgctgatgagcccctggtgcccagcgagccccagggcgccctgcccagcctgtgcctggcccccaaggcctatgatgtggagcgggagctgggcagccccacagatgaagattctggccaggaccagcagctgctgcggggcccccagatcccagccctggagagcccctgtgagagcggctgtggggacatggatgaggaccccagctgcccccagctgcccccccgggacagcccccgctgcctgatgctggccctgagccagagcgaccccaccttcggcaagaagagctttgagcagaccctgactgtggagctgtgtggcacagctggcctgaccccacccaccaccccaccctacaagcccacagaggaggaccccttcaagccagacatcaagcacagcctgggcaaggagatcgccctgagcctgcccagccctgagggcctgagcctgaaggccaccccaggagctgcccacaagctgcccaagaagcaccctgagaggtctgagctgctgagccacctgcggcatgccacagcccagcctgccagccaggccggccagaagaggcccttcagctgcagctttggagaccatgactactgccaggtgctgcggcctgagggcgtgctgcagaggaaggtgctgcgctcctgggagcccagcggcgtgcacctggaggactggccccagcagggcgccccctgggccgaggcccaggcccctggccgggaggaggacaggagctgtgatgctggggccccacccaaggacagcaccctgctgcgggaccacgagatccgggccagcctgaccaagcacttcggcctgctggagacagccctggaggaggaggacctggccagctgcaagagcccagaatatgacacagtgtttgaggacagcagcagcagcagcggggagagcagcttcctgcctgaggaggaggaggaggagggggaggaggaggaggaggatgatgaggaggaggacagcggcgtgagccccacctgcagcgaccactgcccctaccagagcccccccagcaaggccaaccggcagctgtgcagccgcagccgcagcagcagcggcagcagcccctgccacagctggagccctgccaccaggaggaacttccgctgtgagagccggggcccctgcagcgacaggacccccagcatcagacatgccaggaagaggcgggagaaggccatcggggagggccgggtggtgtacatccagaacctgagcagtgacatgagcagccgggagctgaagagaagatttgaggtgtttggagaaattgaagaatgtgaggtgctgaccaggaacagaagaggagagaagtatggcttcatcacctaccgctgcagcgagcacgccgccctgagcctgaccaagggagctgccctgaggaagagaaatgagcccagcttccagctgtcctatggaggcctgcggcacttctgctggccccgctacacagattatgacagcaacagcgaggaggccctgcctgccagcggcaagagcaaatatgaggccatggactttgacagcctgctgaaggaggcccagcagagcctgcactag

SEQ ID NO: 163672 - DNA, 2880 bp, Artificial Sequence
  Description of Artificial Sequence: Synthetic coding sequence
atgggcggcggcagcggggaggagcagctgtatgctgacttccctgagctggacctgagccagctggatgccagtgactttgattctgccacctgctttggagagctgcagtggtgcccagaaaattctgaaacagagcccaaccagtacagcccagatgattctgagctgttccagattgacagtgaaaatgaggccctgctggccgagctgaccaagaccctggatgacatcccagaagatgatgtgggcctggccgccttccctgccctggatggaggagatgccctgagctgcaccagcgccagccctgcccccagcagcgccccacccagccctgcccctgagaagcccagcgccccagcccctgaggtggatgagctgagcctggccgacagcacccaggacaagaaggcccccatgatgcagagccagagccgcagctgcacagagctgcacaagcacctgaccagcgcccagtgctgcctgcaggaccggggcctgcagcccccctgcctgcagagcccccggctgcctgccaaggaggacaaggagcccggggaggactgccccagcccccagcctgccccagccagcccccgggacagcctggccctgggccgggctgaccccggggcccctgtgtcccaggaggacatgcaggccatggtgcagctgatccgctacatgcacacctactgcctgccccagaggaagctgcccccccagaccccagagcccctgcccaaggcctgcagcaaccccagccagcaggtgcgcagccggccctggagccgccaccacagcaaggcctcctgggccgagttcagcatcctgcgggagctgctggcccaggatgtgctgtgtgatgtgtccaagccctaccgcctggccacccctgtgtatgccagcctgacccccaggagccggcccaggcctcccaaggacagccaggccagccctggccggcccagctctgtggaggaggtgagaattgctgccagccccaagagcacaggcccccggcccagcctgcggcccctgcggctggaggtgaagcgggaggtgagaagacctgcccggctgcagcagcaggaggaggaggatgaggaggaggaggaggaggaggaggaggaggagaaggaggaggaggaggagtggggcaggaagaggcctggccggggcctgccctggaccaagctgggcaggaagctggagagctctgtgtgccctgtgagaagaagccggcggctgaaccctgagctgggcccctggctgacctttgctgatgagcccctggtgcccagcgagccccagggcgccctgcccagcctgtgcctggcccccaaggcctatgatgtggagcgggagctgggcagccccacagatgaggacagcggccaggaccagcagctgctgcggggcccccagatcccagccctggagagcccctgtgagagcggctgtggggacatggatgaggaccccagctgcccccagctgcccccccgggacagcccccgctgcctgatgctggccctgagccagagcgaccccaccttcggcaagaagagctttgagcagaccctgactgtggagctgtgtggcacagctggcctgaccccacccaccaccccaccctacaagcccacagaggaggaccccttcaagccagacatcaagcacagcctgggcaaggagatcgccctgagcctgcccagccctgagggcctgagcctgaaggccacccctggggccgcccacaagctgcccaagaagcaccctgagaggtctgagctgctgagccacctgcggcatgccacagcccagcctgccagccaggccggccagaagaggcccttcagctgcagctttggagaccatgactactgccaggtgctgcggcctgagggcgtgctgcagaggaaggtgctgcgctcctgggagcccagcggcgtgcacctggaggactggccccagcagggcgccccctgggccgaggcccaggcccctggccgggaggaggacaggagctgtgatgctggggccccacccaaggacagcaccctgctgcgggaccacgagatccgggccagcctgaccaagcacttcggcctgctggagacagccctggaggaggaggacctggccagctgcaagagcccagaatatgacacagtgtttgaggacagcagcagcagcagtggagagagcagcttcctgcctgaggaggaggaggaggagggggaggaggaggaggaggatgatgaggaggaggacagcggcgtgagccccacctgcagcgaccactgcccctaccagagcccccccagcaaggccaaccggcagctgtgcagccgcagccgcagcagcagcggcagcagcccctgccacagctggagccctgccaccaggaggaacttccgctgtgagagccggggcccctgcagcgacaggacccccagcatcagacatgccaggaagagaagagagaaggccatcggggagggccgggtggtgtacatccagaacctgagcagtgacatgagcagccgggagctgaagagaagatttgaggtgtttggagaaattgaggagtgtgaggtgctgaccaggaacagaagaggagagaagtatggcttcatcacctaccgctgcagcgagcacgccgccctgagcctgaccaagggggccgccctgaggaagagaaatgagcccagcttccagctgtcctatggaggcctgcggcacttctgctggccccgctacacagattatgacagcaacagcgaggaggccctgcctgccagcggcaagagcaaatatgaggccatggactttgacagcctgctgaaggaggcccagcagagcctgcactag

SEQ ID NO: 163673 - DNA, 2397 bp, Artificial Sequence
  Description of Artificial Sequence: Synthetic coding sequence
atggcctgggacatgtgcaaccaggacagcgagagcgtgtggagcgacattgaatgtgccgccctggtgggggaggaccagcccctgtgcccagacctgcctgagctggacctgtctgagctggatgtgaatgacctggacacagacagcttcctgggcggcctgaagtggtgcagcgaccagagcgagatcatcagcaaccagtacaacaatgagcccagcaacatctttgagaagattgatgaagaaaatgaggccaacctgctggccgtgctgacagagaccctggacagcctgcctgtggatgaagatggcctgcccagctttgatgccctgacagatggagatgtgaccacagacaatgaggccagccccagctccatgccagatggcaccccaccaccccaggaggccgaggagcccagcctgctgaagaagctgctgctggccccagccaacacccagctgagctacaatgaatgttctggcctgagcacccagaaccacgccaaccacaaccaccgcatccgcaccaacccagccatcgtgaagacagagaacagctggagcaacaaggccaagagcatctgccagcagcagaagccccagaggcggccctgcagcgagctgctgaagtacctgaccaccaatgatgaccccccccacaccaagcccacagaaaatagaaacagcagccgggacaagtgcaccagcaagaagaagagccacacccagagccagagccagcacctgcaggccaagcccaccaccctgagcctgcccctgaccccagagagccccaatgaccccaagggcagcccctttgagaacaagaccatcgagaggaccctgtctgtggagctgtctggaacagctggcctgaccccacccaccaccccaccccacaaggccaaccaggacaaccccttccgggccagccccaagctgaagagcagctgcaagacagtggtgcccccacccagcaagaagccccgctacagcgagagcagcggcacccagggcaacaacagcaccaagaagggccctgagcagagcgagctgtatgcccagctgagcaagagctctgtgctgactggaggccacgaggagaggaagaccaagaggcccagcctgcggctgtttggagaccatgactactgccagagcatcaacagcaagacagagatcctgatcaacatcagccaggagctgcaggacagccggcagctggagaacaaggatgtgtccagtgactggcagggccagatctgcagcagcacagacagcgaccagtgctacctgcgggagaccctggaggccagcaagcaggtgagcccctgcagcaccaggaagcagctgcaggaccaggagatccgggcagagctgaacaagcacttcggccaccccagccaggccgtgtttgatgatgaggccgacaagacaggagagctgcgggacagcgacttcagcaatgagcagttcagcaagctgcccatgttcatcaacagcggcctggccatggatggcctgtttgatgacagtgaagatgaaagtgacaagctgagctacccctgggatggcacccagagctacagcctcttcaacgtgagccccagctgcagcagcttcaacagcccctgccgggacagcgtgtccccacccaagagcctcttcagccagaggccccagaggatgaggagccgcagccgctccttcagccgccacaggagctgcagccgcagcccctacagccgcagccgcagccgcagccctggcagccgcagcagcagccgcagctgctactactatgagagcagccactaccgccacaggacccacaggaacagccccctgtatgtgcgcagccgcagccgcagcccctacagccggcggcccaggtatgacagctatgaggagtaccagcacgagcggctgaagcgggaggagtacagaagagaatatgagaagcgggagagcgagcgggccaagcagcgggagcggcagaggcagaaggccatcgaggagcggcgggtcatctacgtgggcaagatccggccagacaccaccaggacagagctgcgggacagatttgaggtgtttggagaaattgaagaatgtactgtgaacctgagagatgatggagacagctatggcttcatcacctaccgctacacctgtgatgcctttgctgccctggagaatggctacaccctgcggcgcagcaatgaaacagactttgagctgtacttctgtggcaggaagcagttcttcaagagcaactatgctgacctggacagcaacagtgatgactttgatcctgccagcaccaagagcaaatatgacagcctggactttgacagcctgctgaaggaggcccagaggagcctgcggaggtag

SEQ ID NO: 163674 - DNA, 3072 bp, Artificial Sequence
  Description of Artificial Sequence: Synthetic coding sequence
atggctggaaatgactgtggggccctgctggatgaggagctgagcagcttcttcctgaactacctggccgacacccagggcggcggcagcggggaggagcagctgtatgctgacttccctgagctggacctgagccagctggatgccagtgactttgacagcgccacctgcttcggggagctgcagtggtgcccagagaacagcgagacagagcccaaccagtacagcccagatgacagcgagctgttccagattgattctgaaaatgaggccctgctggccgagctgaccaagaccctggatgacatcccagaagatgatgtgggcctggccgccttccctgccctggatggaggagatgccctgagctgcaccagcgccagccctgcccccagcagcgccccacccagccctgcccctgagaagcccagcgccccagcccctgaggtggatgagctgagcctgctgcagaagctgctgctggccaccagctaccccaccagcagcagtgacacccagaaggagggcacagcctggaggcaggccggcctgcggagcaagagccagaggccctgtgtgaaggctgacagcacccaggacaagaaggcccccatgatgcagagccagagccgcagctgcacagagctgcacaagcacctgaccagcgcccagtgctgcctgcaggaccggggcctgcagcccccctgcctgcagagcccccggctgcctgccaaggaggacaaggagcccggggaggactgccccagcccccagcctgccccagccagcccccgggacagcctggccctgggccgggctgaccccggggcccctgtgtcccaggaggacatgcaggccatggtgcagctgatccgctacatgcacacctactgcctgccccagaggaagctgcccccccagaccccagagcccctgcccaaggcctgcagcaaccccagccagcaggtgcgcagccggccctggagccgccaccacagcaaggcctcctgggccgagttcagcatcctgcgggagctgctggcccaggatgtgctgtgtgatgtgtccaagccctaccgcctggccacccctgtgtatgccagcctgacccccaggagccggcccaggcctcccaaggacagccaggccagccctggccggcccagctctgtggaggaggtgagaattgctgccagccccaagagcacaggcccccggcccagcctgcggcccctgcggctggaggtgaagcgggaggtgagaagacctgcccggctgcagcagcaggaggaggaggatgaggaggaggaggaggaggaggaggaggaggagaaggaggaggaggaggagtggggcaggaagaggcctggccggggcctgccctggaccaagctgggcaggaagctggagagctctgtgtgccctgtgagaagaagccggcggctgaaccctgagctgggcccctggctgacctttgctgatgagcccctggtgcccagcgagccccagggcgccctgcccagcctgtgcctggcccccaaggcctatgatgtggagcgggagctgggcagccccacagatgaggacagcggccaggaccagcagctgctgcggggcccccagatcccagccctggagagcccctgtgagagcggctgtggggacatggatgaggaccccagctgcccccagctgcccccccgggacagcccccgctgcctgatgctggccctgagccagagcgaccccaccttcggcaagaagagctttgagcagaccctgactgtggagctgtgtggcacagctggcctgaccccacccaccaccccaccctacaagcccacagaggaggaccccttcaagccagacatcaagcacagcctgggcaaggagatcgccctgagcctgcccagccctgagggcctgagcctgaaggccacccctggggccgcccacaagctgcccaagaagcaccctgagaggtctgagctgctgagccacctgcggcatgccacagcccagcctgccagccaggccggccagaagaggcccttcagctgcagctttggagaccatgactactgccaggtgctgcggcctgagggcgtgctgcagaggaaggtgctgcgctcctgggagcccagcggcgtgcacctggaggactggccccagcagggcgccccctgggccgaggcccaggcccctggccgggaggaggacaggagctgtgatgctggggccccacccaaggacagcaccctgctgcgggaccacgagatccgggccagcctgaccaagcacttcggcctgctggagacagccctggaggaggaggacctggccagctgcaagagcccagaatatgacacagtgtttgaggacagcagcagcagcagtggagagagcagcttcctgcctgaggaggaggaggaggagggggaggaggaggaggaggatgatgaggaggaggacagcggcgtgagccccacctgcagcgaccactgcccctaccagagcccccccagcaaggccaaccggcagctgtgcagccgcagccgcagcagcagcggcagcagcccctgccacagctggagccctgccaccaggaggaacttccgctgtgagagccggggcccctgcagcgacaggacccccagcatcagacatgccaggaagagaagagagaaggccatcggggagggccgggtggtgtacatccagaacctgagcagtgacatgagcagccgggagctgaagagaagatttgaggtgtttggagaaattgaggagtgtgaggtgctgaccaggaacagaagaggagagaagtatggcttcatcacctaccgctgcagcgagcacgccgccctgagcctgaccaagggggccgccctgaggaagagaaatgagcccagcttccagctgtcctatggaggcctgcggcacttctgctggccccgctacacagattatgacagcaacagcgaggaggccctgcctgccagcggcaagagcaaatatgaggccatggactttgacagcctgctgaaggaggcccagcagagcctgcactag

SEQ ID NO: 163675 - DNA, 3054 bp, Artificial Sequence
  Description of Artificial Sequence: Synthetic coding sequence
atggctggaaatgactgtggggccctgctggatgaggagctgagcagcttcttcctgaactacctggccgacacccagggcggcggcagcggggaggagcagctgtatgctgacttccctgagctggacctgagccagctggatgccagtgactttgacagcgccacctgcttcggggagctgcagtggtgcccagagaacagcgagacagagcccaaccagtacagcccagatgacagcgagctgttccagattgattctgaaaatgaggccctgctggccgagctgaccaagaccctggatgacatcccagaagatgatgtgggcctggccgccttccctgccctggatggaggagatgccctgagctgcaccagcgccagccctgcccccagcagcgccccacccagccctgcccctgagaagcccagcgccccagcccctgaggtggatgagctgagcctgctgcagaagctgctgctggccaccagctaccccaccagcagcagtgacacccagaaggagggcacagcctggaggcaggccggcctgcggagcaagagccagaggccctgtgtgaaggctgacagcacccaggacaagaaggcccccatgatgcagagccagagccgcagctgcacagagctgcacaagcacctgaccagcgcccagtgctgcctgcaggaccggggcctgcagcccccctgcctgcagagcccccggctgcctgccaaggaggacaaggagcccggggaggactgccccagcccccagcctgccccagccagcccccgggacagcctggccctgggccgggctgaccccggggcccctgtgtcccaggaggacatgcaggccatggtgcagctgatccgctacatgcacacctactgcctgccccagaggaagctgcccccccagaccccagagcccctgcccaaggcctgcagcaaccccagccagcaggtgcgcagccggccctggagccgccaccacagcaaggcctcctgggccgagttcagcatcctgcgggagctgctggcccaggatgtgctgtgtgatgtgtccaagccctaccgcctggccacccctgtgtatgccagcctgacccccaggagccggcccaggcctcccaaggacagccaggccagccctggccggcccagctctgtggaggaggtgagaattgctgccagccccaagagcacaggcccccggcccagcctgcggcccctgcggctggaggtgaagcgggaggtgagaagacctgcccggctgcagcagcaggaggaggaggatgaggaggaggaggaggaggaggaggaggaggagaaggaggaggaggaggagtggggcaggaagaggcctggccggggcctgccctggaccaagctgggcaggaagctggagagctctgtgtgccctgtgagaagaagccggcggctgaaccctgagctgggcccctggctgacctttgctgatgagcccctggtgcccagcgagccccagggcgccctgcccagcctgtgcctggcccccaaggcctatgatgtggagcgggagctgggcagccccacagatgaggacagcggccaggaccagcagctgctgcggggcccccagatcccagccctggagagcccctgtgagagcggctgtggggacatggatgaggaccccagctgcccccagctgcccccccgggacagcccccgctgcctgatgctggccctgagccagagcgaccccaccttcggcaagaagagctttgagcagaccctgactgtggagctgtgtggcacagctggcctgaccccacccaccaccccaccctacaagcccacagaggaggaccccttcaagccagacatcaagcacagcctgggcaaggagatcgccctgagcctgcccagccctgagggcctgagcctgaaggccacccctggggccgcccacaagctgcccaagaagcaccctgagaggtctgagctgctgagccacctgcggcatgccacagcccagcctgccagccaggccggccagaagaggcccttcagctgcagctttggagaccatgactactgccaggtgctgcggcctgagggcgtgctgcagaggaaggtgctgcgctcctgggagcccagcggcgtgcacctggaggactggccccagcagggcgccccctgggccgaggcccaggcccctggccgggaggaggacaggagctgtgatgctggggccccacccaaggacagcaccctgctgcgggaccacgagatccgggccagcctgaccaagcacttcggcctgctggagacagccctggaggaggaggacctggccagctgcaagagcccagaatatgacacagtgtttgaggacagcagcagcagcagtggagagagcagcttcctgcctgaggaggaggaggaggagggggaggaggaggaggaggatgatgaggaggaggacagcggcgtgagccccacctgcagcgaccactgcccctaccagagcccccccagcaaggccaaccggcagctgtgcagccgcagccgcagcagcagcggcagcagcccctgccacagctggagccctgccaccaggaggaacttccgctgtgagagccggggcccctgcagcgacaggacccccagcatcagacatgccaggaagagaagagagaaggccatcggggagggccgggtggtgtacatccagaacctgagcagtgacatgagcagccgggagctgaagagaagatttgaggtgtttggagaaattgaggagtgtgaggtgctgaccaggaacagaagaggagagaagtatggcttcatcacctaccgctgcagcgagcacgccgccctgagcctgaccaagggggccgccctgaggaagagaaatgagcccagcttccagctgtcctatggaggcctgcggcacttctgctggccccgctacacagattatggcaagcccctgaagcccagccacagcctggtgcggctgaaggcctgggaggccgtgcccagcctgaacaagacccagagctag

SEQ ID NO: 163676 - DNA, 471 bp, Artificial Sequence
  Description of Artificial Sequence: Synthetic coding sequence
atggctgtgggcaagttcctgctgggcagcctgctgctgctgagcctgcagctgggccagggctggggcccagatgcccggggcgtgcctgtggctgatggagagttcagcagcgagcaggtggccaaggccggcggcacctggctgggcacccaccggcccctggcccggctgcggcgggccctgagcggcccctgccagctgtggagcctgaccctgtctgtggccgagctgggcctgggctacgccagcgaggagaaggtgatcttccgctactgtgccggcagctgccccaggggggcccggacccagcacggcctggccctggcccggctgcagggccagggccgggcccatggaggcccctgctgccggcccacccgctacacagatgtggccttcctggatgacagacaccgctggcagaggctgccccagctgtctgctgctgcctgtggctgcggcggctag

SEQ ID NO: 163677 - DNA, 1422 bp, Artificial Sequence
  Description of Artificial Sequence: Synthetic coding sequence
atgggccagagcggccgcagccgccaccagaagagggcccgggcccaggcccagctgaggaacctggaggcctatgctgccaacccccacagctttgtgttcacccggggctgcacaggaagaaacatccggcagctgagcctggatgtgagaagagtgatggagcccctgacagccagccggctgcaggtgaggaagaagaacagcctgaaggactgtgtggccgtggccggccccctgggcgtgacccacttcctgatcctgagcaagacagagaccaacgtgtacttcaagctgatgaggctgcccggcggccccaccctgaccttccaggtgaagaagtacagcctggtgagagatgtggtgagcagcctgcggcggcacaggatgcatgagcagcagtttgcccacccccccctgctggtgctgaacagctttggcccccacggcatgcacgtgaagctgatggccaccatgttccagaacctcttccccagcatcaacgtgcacaaggtgaacctgaacaccatcaagcgctgcctgctgattgactacaacccagacagccaggagctggacttccgccactacagcatcaaggtggtgcctgtgggcgccagccggggcatgaagaagctgctgcaggagaagttccccaacatgagccggctgcaggacatcagcgagctgctggccactggagctggcctgtctgagagcgaggccgagccagatggagaccacaacatcacagagctgccccaggccgtggccggccggggcaacatgagggcccagcagagcgctgtgcggctgacagaaattggccccaggatgaccctgcagctgatcaaggtgcaggagggcgtgggggagggcaaggtgatgttccacagctttgtgtccaagacagaggaggagctgcaggccatcctggaggccaaggagaagaagctgcggctgaaggcccagaggcaggcccagcaggcccagaatgtgcagaggaagcaggagcagcgggaggcccacaggaagaagagcctggagggcatgaagaaggcccgggtgggcggcagtgatgaggaggccagcggcatccccagcaggacagccagcctggagctgggagaagatgatgatgagcaggaggatgatgacatcgagtacttctgccaggccgtgggggaggcccccagcgaggacctcttccctgaggccaagcagaagaggctggccaagagccctggcaggaagaggaagcgctgggagatggaccggggccggggccgcctgtgtgaccagaagttccccaagaccaaggacaagagccagggcgcccaggcccggcggggccccaggggggccagcagagatggcggccggggccggggccggggccggcctgggaagagggtggcctag

SEQ ID NO: 163678 - DNA, 1383 bp, Artificial Sequence
  Description of Artificial Sequence: Synthetic coding sequence
atgggccagagcggccgcagccgccaccagaagagggcccgggcccaggcccagctgaggaacctggaggcctatgctgccaacccccacagctttgtgttcacccggggctgcacaggaagaaacatccggcagctgagcctggatgtgagaagagtgatggagcccctgacagccagccggctgcaggtgaggaagaagaacagcctgaaggactgtgtggccgtggccggccccctgggcgtgacccacttcctgatcctgagcaagacagagaccaacgtgtacttcaagctgatgaggctgcccggcggccccaccctgaccttccaggtgaagaagtacagcctggtgagagatgtggtgagcagcctgcggcggcacaggatgcatgagcagcagtttgcccacccccccctgctggtgctgaacagctttggcccccacggcatgcacgtgaagctgatggccaccatgttccagaacctcttccccagcatcaacgtgcacaaggtgaacctgaacaccatcaagcgctgcctgctgattgactacaacccagacagccaggagctggacttccgccactacagcatcaaggtggtgcctgtgggcgccagccggggcatgaagaagctgctgcaggagaagttccccaacatgagccggctgcaggacatcagcgagctgctggccactggagctggcctgtctgagagcgaggccgagccagatggagaccacaacatcacagagctgccccaggccgtggccggccggggcaacatgagggcccagcagagcgctgtgcggctgacagaaattggccccaggatgaccctgcagctgatcaaggtgcaggagggcgtgggggagggcaaggtgatgttccacagctttgtgtccaagacagaggaggagctgcaggccatcctggaggccaaggagaagaagctgcggctgaaggcccagaggcaggcccagcaggcccagaatgtgcagaggaagcaggagcagcgggaggcccacaggaagaagagcctggagggcatgaagaaggcccgggtgggcggcagtgatgaggaggccagcggcatccccagcaggacagccagcctggagctgggagaagatgatgatgagcaggaggatgatgacatcgagtacttctgccaggccgtgggggaggcccccagcgaggacctcttccctgaggccaagcagaagaggctggccaagagccctggcaggaagaggaagcgctgggagatggaccggggccggggccgcctgtgtgaccagaagttccccaagaccaaggacaagagccaggacggcggccggggccggggccggggccggcctgggaagagggtggcctag

SEQ ID NO: 163679 - DNA, 2385 bp, Artificial Sequence
  Description of Artificial Sequence: Synthetic coding sequence
atgggccagagcggccgcagccgccaccagaagagggcccgggcccaggcccagctgaggaacctggaggcctatgctgccaacccccacagctttgtgttcacccggggctgcacaggaagaaacatccggcagctgagcctggatgtgagaagagtgatggagcccctgacagccagccggctgcaggtgaggaagaagaacagcctgaaggactgtgtggccgtggccggccccctgggcgtgacccacttcctgatcctgagcaagacagagaccaacgtgtacttcaagctgatgaggctgcccggcggccccaccctgaccttccaggtgaagaagtacagcctggtgagagatgtggtgagcagcctgcggcggcacaggatgcatgagcagcagtttgcccacccccccctgctggtgctgaacagctttggcccccacggcatgcacgtgaagctgatggccaccatgttccagaacctcttccccagcatcaacgtgcacaaggtgaacctgaacaccatcaagcgctgcctgctgattgactacaacccagacagccaggagctggacttccgccactacagcatcaaggtggtgcctgtgggcgccagccggggcatgaagaagctgctgcaggagaagttccccaacatgagccggctgcaggacatcagcgagctgctggccactggagctggcctgtctgagagcgaggccgagccagatggagaccacaacatcacagagctgccccaggccgtggccggccggggcaacatgagggcccagcagagcgctgtgcggctgacagaaattggccccaggatgaccctgcagctgatcaaggtgcaggagggcgtgggggagggcaaggtgatgttccacagctttgtgtccaagacagaggaggagctgcaggccatcctggaggccaaggagaagaagctgcggctgaaggcccagaggcaggcccagcaggcccagaatgtgcagaggaagcaggagcagcgggaggcccacaggaagaagagcctggagggcatgaagaaggcccgggtgggcggcagtgatgaggaggccagcggcatccccagcaggacagccagcctggagctgggagaagatgatgatgagcaggaggatgatgacatcgagtacttctgccaggccgtgggggaggcccccagcgaggacctcttccctgaggccaagcagaagaggctggccaagagccctggcaggaagaggaagcgctgggagatggacagaggagccaagagctgcccagccaacttcctggccgctgctgatgacaagctgagcggcttccagggcgacttcctgtggcccatcctggtggtggagttcctggtggccgtggccagcaatggcctggccctgtaccgcttcagcatcaggaagcagaggccctggcaccctgctgtggtgttttctgtgcagctggccgtgtctgacctgctgtgtgccctgaccctgccccccctggccgcctacctgtacccacccaagcactggaggtatggagaggccgcctgccgcctggagcgcttcctgttcacctgcaacctgctgggcagcgtcatcttcatcacctgcatcagcctgaaccgctacctgggcatcgtgcaccccttctttgcccggagccacctgcggcccaagcacgcctgggccgtgtctgctgctggctgggtgctggccgccctgctggccatgcccaccctgtccttcagccacctgaagaggccccagcagggcgccggcaactgcagcgtggcccggcctgaggcctgcatcaagtgcctgggcacagctgaccacggcctggccgcctaccgggcctacagcctggtgctggccggcctgggctgcggcctgcccctgctgctgaccctggccgcctatggagccctgggccgggctgtgctgcggagccctggcatgacagtggccgagaagctgcgggtggccgccctggtggccagcggcgtggccctgtatgccagcagctatgtgccctaccacatcatgagggtgctgaatgtggatgcccggcggcgctggagcacccgctgccccagctttgctgacatcgcccaggccacagctgccctggagctgggcccctacgtgggctaccaggtgatgaggggcctgatgcccctggccttctgtgtgcaccccctgctgtacatggctgctgtgcccagcctgggctgctgctgccgccactgccccggctacagagacagctggaacccagaagatgccaagagcacaggccaggccctgcccctgaatgccacagctgcccccaagcccagcgagccccagagccgggagctgagccagtag

SEQ ID NO: 163680 - DNA, 1374 bp, Artificial Sequence
  Description of Artificial Sequence: Synthetic coding sequence
atggcccagcccccccggctgagccgcagcggggccagcagcctgtgggaccctgccagccctgcccccaccagcggcccccggccccggctgtgggagggccaggatgtgctggcccgctggacagatggcctgctgtacctgggcaccatcaagaaggtggacagcgcccgggaggtgtgcctggtgcagtttgaagatgacagccagttcctggtgctgtggaaggacatcagccctgctgccctgcccggggaggagctgctgtgctgcgtgtgccgctcagaaacagtggtgcccggcaaccggctggtgtcctgtgagaagtgcagacatgcctaccaccaggactgccacgtgccccgggccccagcccctggagagggggagggcacctcctgggtgtgccggcagtgtgtgtttgccatcgccaccaagaggggcggggccctgaagaagggcccctatgcccgggccatgctgggcatgaagctgagcctgccctacggcctgaagggcctggactgggatgctggccacctgagcaaccggcagcagagctactgctactgcggcggccctggagagtggaacctgaagatgctgcagtgccgcagctgcctgcagtggttccacgaggcctgcacccagtgcctgagcaagcccctgctgtatggagaccgcttctatgaatttgagtgctgcgtgtgccggggcggccctgagaaggtgcggcggctgcagctgcgctgggtggatgtggcccacctggtgctgtaccacctgtctgtgtgctgcaagaagaagtactttgattttgaccgggagatcctgcccttcaccagcgagaactgggacagcctgctgctgggggagctgagtgacacccccaagggggagaggagcagccggctgctgagcgccctgaacagccacaaggaccgcttcatcagcggccgggagatcaagaagaggaagtgcctgtttggcctgcacgccaggatgcctcctcctgtggagcccccaactggagatggagccctgaccagggctggcccctggggccggggcctgaccagccctggagaggcccctgaggccggggcccgggcccctgaggaggaggccgagggggagagcggcggggccggggccaccctgagcagcgcccagagcgcccgggcccctggagctgagggcgccggcagcagcgctgagggcacagctgctgcccccagcggctgcctgctgcccagcaccctgctgcctgccccccagggccccctgggcaccgtggacccccagacaggccacccctggaacttcaccctggtgagcccccagaccagcctgaaggtgccccccaccaggtag

SEQ ID NO: 163681 - DNA, 1704 bp, Artificial Sequence
  Description of Artificial Sequence: Synthetic coding sequence
atggcccagcccccccggctgagccgcagcggggccagcagcctgtgggaccctgccagccctgcccccaccagcggcccccggccccggctgtgggagggccaggatgtgctggcccgctggacagatggcctgctgtacctgggcaccatcaagaaggtggacagcgcccgggaggtgtgcctggtgcagtttgaagatgacagccagttcctggtgctgtggaaggacatcagccctgctgccctgcccggggaggagctgctgtgctgcgtgtgccgctcagaaacagtggtgcccggcaaccggctggtgtcctgtgagaagtgcagacatgcctaccaccaggactgccacgtgccccgggccccagcccctggagagggggagggcacctcctgggtgtgccggcagtgtgtgtttgccatcgccaccaagaggggcggggccctgaagaagggcccctatgcccgggccatgctgggcatgaagctgagcctgccctacggcctgaagggcctggactgggatgctggccacctgagcaaccggcagcagagctactgctactgcggcggccctggagagtggaacctgaagatgctgcagtgccgcagctgcctgcagtggttccacgaggcctgcacccagtgcctgagcaagcccctgctgtatggagaccgcttctatgaatttgagtgctgcgtgtgccggggcggccctgagaaggtgcggcggctgcagctgcgctgggtggatgtggcccacctggtgctgtaccacctgtctgtgtgctgcaagaagaagtactttgattttgaccgggagatcctgcccttcaccagcgagaactgggacagcctgctgctgggggagctgagtgacacccccaagggggagaggagcagccggctgctgagcgccctgaacagccacaaggaccgcttcatcagcggccgggagatcaagaagaggaagtgcctgtttggcctgcacgccaggatgcctcctcctgtggagcccccaactggagatggagccctgaccagcttccccagcggccagggccctgggggcggcgtgtcccggcccctgggcaagagaagaagacctgagcctgagcccctgcggcggcggcagaagggcaaggtggaggagctgggccccccatctgctgtgaggaaccagcctgagccccaggagcagcgggagcgggcccacctgcagagggccctgcaggcctctgtgagcccccccagccccagccccaaccagagctaccagggcagcagcggctacaacttccggcccacagatgcccgctgcctgcccagcagccccatccgcatgtttgccagcttccaccccagcgccagcacagctggcaccagcggggacagcggccccccagacaggagccccctggagctgcacatcggcttccccacagacatccccaagagcgccccccacagcatgacagccagcagcagctctgtgagcagccccagccctggcctgcccaggagaagtgccccacccagccccctgtgccgcagcctgagccctggcactggaggcggcgtgcggggcggcgtgggctacctgagcagaggagaccctgtgcgggtgctggccaggagagtgcggccagatggctctgtgcagtacctggtggagtggggcggcggcggcatcttctag

SEQ ID NO: 163682 - DNA, 732 bp, Artificial Sequence
  Description of Artificial Sequence: Synthetic coding sequence
tgaagcctgctgctgacagccaccaggacagtgtccttccagggcgagcggctgcggagaggaaatgtgtgcctggtgtccatgctgggctgcctgcccctgtggagccccctgctggagatggagcacagccctggccagggccctgggggcggcgtgtcccggcccctgggcaagagaagaagacctgagcctgagcccctgcggcggcggcagaagggcaaggtggaggagctgggccccccatctgctgtgaggaaccagcctgagccccaggagcagcgggagcgggcccacctgcagagggccctgcaggcctctgtgagcccccccagccccagccccaaccagagctaccagggcagcagcggctacaacttccggcccacagatgcccgctgcctgcccagccccatccgcatgtttgccagcttccaccccagcgccagcacagctggcaccagcggggacagcggccccccagacaggagccccctggagctgcacatcggcttccccacagacatccccaagagcgccccccacagcatgacagccagcagcagctctgtgagcagccccagccctggcctgccccggcgcagcgccccacccagccccctgtgccgcagcctgagccctggcaccggcggcggcgtgcggggcggcgtgggctacctgagcagaggagaccctgtgcgggtgctggcccggcgggtgcggccagactag

SEQ ID NO: 163683 - DNA, 438 bp, Artificial Sequence
  Description of Artificial Sequence: Synthetic coding sequence
atggcccagcccccccggctgagccgcagcggggccagcagcctgtgggaccctgccagccctgcccccaccagcggcccccggccccggctgtgggagggccaggatgtgctggcccgctggacagatggcctgctgtacctgggcaccatcaagaaggtggacagcgcccgggaggtgtgcctggtgcagtttgaagatgacagccagttcctggtgctgtggaaggacatcagccctgctgccctgcccggggaggagctgctgtgctgcgtgtgccgctcagaaacagtggtgcccggcaaccggctggtgtcctgtgagaagtgcagacatgcctaccaccaggactgccacgtgccccgggccccagcccctggagagggggagggcacctcctgggtgtgccggcagtgtgtgtttgccatcgccacctag

SEQ ID NO: 163684 - DNA, 546 bp, Artificial Sequence
  Description of Artificial Sequence: Synthetic coding sequence
tggggccacccccagcagtgtgccatcagccccagccccaggagccggggcagcggcctcatctgccggggccactgccggccccagtgcctgcaccaccccccagccctgaccagggtgaccagggctgctgctgccaccaccagcggcccccagatgcctgctgcctgccccggccaccccatccgcatgtttgccagcttccaccccagcgccagcacagctggcaccagcggggacagcggccccccagacaggagccccctggagctgcacatcggcttccccacagacatccccaagagcgccccccacagcatgacagccagcagcagctctgtgagcagccccagccctggcctgcccaggagaagtgccccacccagccccctgtgccgcagcctgagccctggcactggaggcggcgtgcggggcggcgtgggctacctgagcagaggagaccctgtgcgggtgctggccaggagagtgcggccagatggctctgtgcagtacctggtggagtggggcggcggcggcatcttctag

SEQ ID NO: 163685 - DNA, 438 bp, Artificial Sequence; identical to SEQ ID NO: 163683
  Description of Artificial Sequence: Synthetic coding sequence

SEQ ID NO: 163686 - DNA, 1704 bp, Artificial Sequence
  Description of Artificial Sequence: Synthetic coding sequence
atggcccagcccccccggctgagccgcagcggggccagcagcctgtgggaccctgccagccctgcccccaccagcggcccccggccccggctgtgggagggccaggatgtgctggcccgctggacagatggcctgctgtacctgggcaccatcaagaaggtggacagcgcccgggaggtgtgcctggtgcagtttgaagatgacagccagttcctggtgctgtggaaggacatcagccctgctgccctgcccggggaggagctgctgtgctgcgtgtgccgctcagaaacagtggtgcccggcaaccggctggtgtcctgtgagaagtgcagacatgcctaccaccaggactgccacgtgccccgggccccagcccctggagagggggagggcacctcctgggtgtgccggcagtgtgtgtttgccatcgccaccaagaggggcggggccctgaagaagggcccctatgcccgggccatgctgggcatgaagctgagcctgccctacggcctgaagggcctggactgggatgctggccacctgagcaaccggcagcagagctactgctactgcggcggccctggagagtggaacctgaagatgctgcagtgccgcagctgcctgcagtggttccacgaggcctgcacccagtgcctgagcaagcccctgctgtatggagaccgcttctatgaatttgagtgctgcgtgtgccggggcggccctgagaaggtgcggcggctgcagctgcgctgggtggatgtggcccacctggtgctgtaccacctgtctgtgtgctgcaagaagaagtactttgattttgaccgggagatcctgcccttcaccagcgagaactgggacagcctgctgctgggggagctgagtgacacccccaagggggagaggagcagcaagctgctgagcgccctgaacagccacaaggaccgcttcatcagcggccgggagatcaagaagaggaagtgcctgtttggcctgcacgccaggatgcctcctcctgtggagcccccaactggagatggagccctgaccagcttccccagcggccagggccctgggggcggcgtgtcccggcccctgggcaagagaagaagacctgagcctgagcccctgcggcggcggcagaagggcaaggtggaggagctgggccccccatctgctgtgaggaaccagcctgagccccaggagcagcgggagcgggcccacctgcagagggccctgcaggcctctgtgagcccccccagccccagccccaaccagagctaccagggcagcagcggctacaacttccggcccacagatgcccgctgcctgcccagcagccccatccgcatgtttgccagcttccaccccagcgccagcacagctggcaccagcggggacagcggccccccagacaggagccccctggagctgcacatcggcttccccacagacatccccaagagcgccccccacagcatgacagccagcagcagctctgtgagcagccccagccctggcctgcccaggagaagtgccccacccagccccctgtgccgcagcctgagccctggcactggaggcggcgtgcggggcggcgtgggctacctgagcagaggagaccctgtgcgggtgctggccaggagagtgcggccagatggctctgtgcagtacctggtggagtggggcggcggcggcatcttctag

SEQ ID NO: 163687 - DNA, 684 bp, Artificial Sequence
  Description of Artificial Sequence: Synthetic coding sequence
atggcccagcccccccggctgagccgcagcggggccagcagcctgtgggaccctgccagccctgcccccaccagcggcccccggccccggctgtgggagggccaggatgtgctggcccgctggacagatggcctgctgtacctgggcaccatcaagaaggtggacagcgcccgggaggtgtgcctggtgcagtttgaagatgacagccagttcctggtgctgtggaaggacatcagccctgctgccctgcccggggaggagctgctgtgctgcgtgtgccgctcagaaacagtggtgcccggcaaccggctggtgtcctgtgagaagtgcagacatgcctaccaccaggactgccacgtgccccgggccccagcccctggagagggggagggcacctcctgggtgtgccggcagtgtgtgtttgccatcgccaccaagaggggcggggccctgaagaagggcccctatgcccgggccatgctgggcatgaagctgagcctgccctacggcctgaagggcctggactgggatgctggccacctgagcaaccggcagcagagctactgctactgcggcggccctggagagtggaacctgaagatgctgcagtgccgcagctgcctgcagtggttccacgaggcctgcacccagtgcctgagcaagcccctgctgtatggagactag

SEQ ID NO: 163688 - DNA, 684 bp, Artificial Sequence; identical to SEQ ID NO: 163687
  Description of Artificial Sequence: Synthetic coding sequence

SEQ ID NO: 163689 - DNA, 1374 bp, Artificial Sequence
  Description of Artificial Sequence: Synthetic coding sequence
atggcccagcccccccggctgagccgcagcggggccagcagcctgtgggaccctgccagccctgcccccaccagcggcccccggccccggctgtgggagggccaggatgtgctggcccgctggacagatggcctgctgtacctgggcaccatcaagaaggtggacagcgcccgggaggtgtgcctggtgcagtttgaagatgacagccagttcctggtgctgtggaaggacatcagccctgctgccctgcccggggaggagctgctgtgctgcgtgtgccgctcagaaacagtggtgcccggcaaccggctggtgtcctgtgagaagtgcagacatgcctaccaccaggactgccacgtgccccgggccccagcccctggagagggggagggcacctcctgggtgtgccggcagtgtgtgtttgccatcgccaccaagaggggcggggccctgaagaagggcccctatgcccgggccatgctgggcatgaagctgagcctgccctacggcctgaagggcctggactgggatgctggccacctgagcaaccggcagcagagctactgctactgcggcggccctggagagtggaacctgaagatgctgcagtgccgcagctgcctgcagtggttccacgaggcctgcacccagtgcctgagcaagcccctgctgtatggagaccgcttctatgaatttgagtgctgcgtgtgccggggcggccctgagaaggtgcggcggctgcagctgcgctgggtggatgtggcccacctggtgctgtaccacctgtctgtgtgctgcaagaagaagtactttgattttgaccgggagatcctgcccttcaccagcgagaactgggacagcctgctgctgggggagctgagtgacacccccaagggggagaggagcagcaagctgctgagcgccctgaacagccacaaggaccgcttcatcagcggccgggagatcaagaagaggaagtgcctgtttggcctgcacgccaggatgcctcctcctgtggagcccccaactggagatggagccctgaccagggctggcccctggggccggggcctgaccagccctggagaggcccctgaggccggggcccgggcccctgaggaggaggccgagggggagagcggcggggccggggccaccctgagcagcgcccagagcgcccgggcccctggagctgagggcgccggcagcagcgctgagggcacagctgctgcccccagcggctgcctgctgcccagcaccctgctgcctgccccccagggccccctgggcaccgtggacccccagacaggccacccctggaacttcaccctggtgagcccccagaccagcctgaaggtgccccccaccaggtag

SEQ ID NO: 163690 - DNA, 1497 bp, Artificial Sequence
  Description of Artificial Sequence: Synthetic coding sequence
atggctgctgctgctggccctggagctgccctgagcccccggccctgtgacagcgaccctgccacccctggggcccagagccccaaggatgacaatgaagacaacagcaatgatggcacccagcccagcaagagaagaaggatgggcagcggggacagcagccgcagctgtgagaccagcagccaggacctgggcttctcctactacccagctgagaacctgattgagtacaagtggcccccagatgagaccggggagtactacatgctgcaggagcaggtgtctgagtacctgggcgtgaccagcttcaagaggaagtacccagacctggagcggcgggacctgagccacaaggagaagctgtacctgcgggagctgaatgtcatcacagagacccagtgcaccctgggcctgacagccctgcggagtgatgaggtgattgacctgatgatcaaggagtacccagccaagcatgctgagtacagcgtcatcctgcaggagaaggagcggcagaggatcacagaccactacaaggagtacagccagatgcagcagcagaacacccagaaggtggaggccagcaaggtgcctgagtacatcaagaaggccgccaagaaggctgctgagttcaacagcaacctgaaccgggagaggatggaggagcggcgggcctactttgacctgcagacccacgtgatccaggtgccccagggcaagtacaaggtgctgcccacagagaggaccaaggtgagcagctaccctgtggccctgatccctggccagttccaggagtactacaagcgctacagcccagatgagctgcgctacctgcccctgaacacagccctgtatgagccccccctggaccctgagctgcctgccctggacagtgatggagacagtgatgatggagaagatggaagaggagatgagaagaggaagaacaagggcaccagtgacagcagcagtggaaatgtgtctgagggggagagccccccagacagccaggaggacagcttccagggccggcagaagagcaaggacaaggccgccacccccaggaaggatggccccaagaggtctgtgctgagcaagtctgtgcccggctacaagcccaaggtgatccccaatgccatctgtggcatctgcctgaagggcaaggagagcaacaagaagggcaaggccgagagcctcatccactgcagccagtgtgaaaattctggccaccccagctgcctggacatgaccatggagctggtgtccatgatcaagacctacccctggcagtgcatggagtgcaagacctgcatcatctgtggccagccccaccacgaggaggagatgatgttctgtgacatgtgtgaccggggctaccacaccttctgtgtgggcctgggcgccatccccagcggccgctggatctgtgactgctgccagagggccccacccacccccaggaaggtgggccggcggggcaagaacagcaaggagggctag

SEQ ID NO: 163691 - DNA, 1491 bp, Artificial Sequence
  Description of Artificial Sequence: Synthetic coding sequence
atggctgctgctgctggccctggagctgccctgagcccccggccctgtgacagcgaccctgccacccctggggcccagagccccaaggatgacaatgaagacaacagcaatgatggcacccagcccagcaagagaagaaggatgggcagcggggacagcagccgcagctgtgagaccagcagccaggacctgggcttctcctactacccagctgagaacctgattgagtacaagtggcccccagatgagaccggggagtactacatgctgcaggagcaggtgtctgagtacctgggcgtgaccagcttcaagaggaagtacccagagcggcgggacctgagccacaaggagaagctgtacctgcgggagctgaatgtcatcacagagacccagtgcaccctgggcctgacagccctgcggagtgatgaggtgattgacctgatgatcaaggagtacccagccaagcatgctgagtacagcgtcatcctgcaggagaaggagcggcagaggatcacagaccactacaaggagtacagccagatgcagcagcagaacacccagaaggtggaggccagcaaggtgcctgagtacatcaagaaggccgccaagaaggctgctgagttcaacagcaacctgaaccgggagaggatggaggagcggcgggcctactttgacctgcagacccacgtgatccaggtgccccagggcaagtacaaggtgctgcccacagagaggaccaaggtgagcagctaccctgtggccctgatccctggccagttccaggagtactacaagcgctacagcccagatgagctgcgctacctgcccctgaacacagccctgtatgagccccccctggaccctgagctgcctgccctggacagtgatggagacagtgatgatggagaagatggaagaggagatgagaagaggaagaacaagggcaccagtgacagcagcagtggaaatgtgtctgagggggagagccccccagacagccaggaggacagcttccagggccggcagaagagcaaggacaaggccgccacccccaggaaggatggccccaagaggtctgtgctgagcaagtctgtgcccggctacaagcccaaggtgatccccaatgccatctgtggcatctgcctgaagggcaaggagagcaacaagaagggcaaggccgagagcctcatccactgcagccagtgtgaaaattctggccaccccagctgcctggacatgaccatggagctggtgtccatgatcaagacctacccctggcagtgcatggagtgcaagacctgcatcatctgtggccagccccaccacgaggaggagatgatgttctgtgacatgtgtgaccggggctaccacaccttctgtgtgggcctgggcgccatccccagcggccgctggatctgtgactgctgccagagggccccacccacccccaggaaggtgggccggcggggcaagaacagcaaggagggctag

SEQ ID NO: 163692 - DNA, 879 bp, Artificial Sequence
  Description of Artificial Sequence: Synthetic coding sequence
atggagaagaggacctgtgccctgtgccccaaggatgtggagtacaacgtgctgtactttgcccagagcgagaacattgctgcccacgagaactgcctgctgtacagcagcggcctggtggagtgtgaggaccaggaccccctgaacccagacaggagctttgatgtggagagcgtgaagaaggagatccagaggggcaggaagctgaagtgcaagttctgccacaagagaggagccaccgtgggctgtgacctgaagaactgcaacaagaactaccacttcttctgtgccaagaaggatgatgctgtgccccagagtgatggagtgcggggcatctacaagctgctgtgccagcagcacgcccagttccccatcatcgcccagagcgccaagttctctggagtgaagaggaagaggggcaggaagaagcccctgagcggcaaccacgtgcagcccccagagaccatgaagtgcaacaccttcatccggcaggtgaaggaggagcacggccgccacacagatgccaccgtgaaggtgcccttcctgaagaagtgcaaggaggccggcctgctgaactacctgctggaggagatcctggacaaggtgcacagcatccctgagaagctgatggatgagaccaccagcgagagtgactatgaggagatcggcagcgccctgtttgactgccgcctgtttgaggacacctttgtgaacttccaggccgccatcgagaagaagatccacgccagccagcagcgctggcagcagctgaaggaggagattgagctgctgcaggacctgaagcagaccctgtgcagcttccaggagaacagagacctgatgagcagcagcaccagcatcagcagcctgagctactag

SEQ ID NO: 163693 - DNA, 996 bp, Artificial Sequence
  Description of Artificial Sequence: Synthetic coding sequence
atggcccaggccagcccccccaggcctgagcgggtgctgggcgccagcagccctgaggcccggcctgcccaggaggccctgctgctgcccactggagtcttccaggtggccgagaagatggagaagaggacctgtgccctgtgccccaaggatgtggagtacaacgtgctgtactttgcccagagtgaaaatattgctgcccacgagaactgcctgctgtacagcagcggcctggtggagtgtgaggaccaggaccccctgaacccagacaggagctttgatgtggagagcgtgaagaaggagatccagaggggcaggaagctgaagtgcaagttctgccacaagagaggagccaccgtgggctgtgacctgaagaactgcaacaagaactaccacttcttctgtgccaagaaggatgatgctgtgccccagagtgatggagtgcggggcatctacaagctgctgtgccagcagcacgcccagttccccatcatcgcccagagcgccaagttcagcggcgtgaagaggaagaggggcaggaagaagcccctgagcggcaaccacgtgcagcccccagagaccatgaagtgcaacaccttcatccggcaggtgaaggaggagcacggccgccacacagatgccaccgtgaaggtgcccttcctgaagaagtgcaaggaggccggcctgctgaactacctgctggaggagatcctggacaaggtgcacagcatccctgagaagctgatggatgagaccaccagcgagagtgactatgaggagatcggcagcgccctgtttgactgccgcctgtttgaggacacctttgtgaacttccaggccgccatcgagaagaagatccacgccagccagcagcgctggcagcagctgaaggaggagattgagctgctgcaggacctgaagcagaccctgtgcagcttccaggagaacagagacctgatgagcagcagcaccagcatcagcagcctgagctactag

SEQ ID NO: 163694 - DNA, 861 bp, Artificial Sequence
  Description of Artificial Sequence: Synthetic coding sequence
tgaagacctggcccccggggctgcagcgccccagctgcccggcggcccggccccaggagaagaagaagcagcttcccccccctgtacagcagcggcctggtggagtgtgaggaccaggaccccctgaacccagacaggagctttgatgtggagagcgtgaagaaggagatccagaggggcaggaagctgaagtgcaagttctgccacaagagaggagccaccgtgggctgtgacctgaagaactgcaacaagaactaccacttcttctgtgccaagaaggatgatgctgtgccccagagtgatggagtgcggggcatctacaagctgctgtgccagcagcacgcccagttccccatcatcgcccagagcgccaagttctctggagtgaagaggaagaggggcaggaagaagcccctgagcggcaaccacgtgcagcccccagagaccatgaagtgcaacaccttcatccggcaggtgaaggaggagcacggccgccacacagatgccaccgtgaaggtgcccttcctgaagaagtgcaaggaggccggcctgctgaactacctgctggaggagatcctggacaaggtgcacagcatccctgagaagctgatggatgagaccaccagcgagagtgactatgaggagatcggcagcgccctgtttgactgccgcctgtttgaggacacctttgtgaacttccaggccgccatcgagaagaagatccacgccagccagcagcgctggcagcagctgaaggaggagattgagctgctgcaggacctgaagcagaccctgtgcagcttccaggagaacagagacctgatgagcagcagcaccagcatcagcagcctgagctactag

SEQ ID NO: 163695 - DNA, 507 bp, Artificial Sequence
  Description of Artificial Sequence: Synthetic coding sequence
atggagaagaggacctgtgccctgtgccccaaggatgtggagtacaacgtgctgtactttgcccagagcgagaacattgctgcccacgagaactgcctgctgtacagcagcggcctggtggagtgtgaggaccaggaccccctgaacccagacaggagctttgatgtggagagcgtgaagaaggagatccagaggggcaggaagctgaagtgcaagttctgccacaagagaggagccaccgtgggctgtgacctgaagaactgcaacaagaactaccacttcttctgtgccaagaaggatgatgctgtgccccagagtgatggagtgcggggcatctacaagctgctgtgccagcagcacgcccagttccccatcatcgcccagagcgccaagttctctggagtgaagaggaagaggggcaggaagaagcccctgagcggcaaccacgtgcagcccccagagaccatgaagtgcaacaccttcatccggcaggtgaaggaggagtag

SEQ ID NO: 163696 - DNA, 297 bp, Artificial Sequence
  Description of Artificial Sequence: Synthetic coding sequence
atggagaagaggacctgtgccctgtgccccaaggatgtggagtacaacgtgctgtactttgcccagagcgagaacattgctgcccacgagaactgcctgctgtacagcagcggcctggtggagtgtgaggaccaggaccccctgaacccagacaggagctttgatgtggagagcgtgaagaaggagatccagaggggcaggaagctgaagtgcaagttctgccacaagagaggagccaccgtgggctgtgacctgaagaactgcaacaagaactaccacttcttctgtgccaagtag

SEQ ID NO: 163697 - DNA, 879 bp, Artificial Sequence; identical to SEQ ID NO: 163692
  Description of Artificial Sequence: Synthetic coding sequence

SEQ ID NO: 163698 - DNA, 624 bp, Artificial Sequence
  Description of Artificial Sequence: Synthetic coding sequence
atggagaacagagccctggaccccggcacccgggacagctatggagccaccagccacctgcccaacaagggggccctggccaaggtgaagaacaacttcaaggacctgatgagcaagctgacagagggccagtatgtgctgtgccgctggacagatggcctgtactacctgggcaagatcaagagggtgagcagcagcaagcagagctgcctggtgacctttgaggacaacagcaagtactgggtgctgtggaaggacatccagcacgccggcgtgcctggagaggagcccaagtgcaacatctgcctgggcaagaccagcggccccctgaatgagatcctgatctgtgggaaatgtggcctgggctaccaccagcagtgccacatccccatcgccggcagcgctgaccagcccctgctgaccccctggttctgccgccgctgcatctttgccctggccgtgcgggtgtccctgcccagcagccctgtgcctgccagccctgccagcagcagtggagctgaccagaggctgcccagccagagcctgagcagcaagcagaagggccacacctgggccctggagacagattctgccagcgccaccgtgctgggccaggacctgtag

SEQ ID NO: 163699 - DNA, 1743 bp, Artificial Sequence
  Description of Artificial Sequence: Synthetic coding sequence
atggagaacagagccctggaccccggcacccgggacagctatggagccaccagccacctgcccaacaagggggccctggccaaggtgaagaacaacttcaaggacctgatgagcaagctgacagagggccagtatgtgctgtgccgctggacagatggcctgtactacctgggcaagatcaagagggtgagcagcagcaagcagagctgcctggtgacctttgaggacaacagcaagtactgggtgctgtggaaggacatccagcacgccggcgtgcctggagaggagcccaagtgcaacatctgcctgggcaagaccagcggccccctgaatgagatcctgatctgtgggaaatgtggcctgggctaccaccagcagtgccacatccccatcgccggcagcgctgaccagcccctgctgaccccctggttctgccgccgctgcatctttgccctggccgtgaggaagggcggggccctgaagaagggggccatcgcccggaccctgcaggccgtgaagatggtgctgagctaccagcctgaggagctggagtgggacagcccccacaggaccaaccagcagcagtgctactgctactgcggcggccctggagagtggtacctgaggatgctgcagtgctaccgctgccggcagtggttccacgaggcctgcacccagtgcctgaatgagcccatgatgtttggagaccgcttctacctgttcttctgcagcgtgtgcaaccagggccctgagtacatcgagcggctgcccctgcgctgggtggatgtggtgcacctggccctgtacaacctgggcgtgcagagcaagaagaagtactttgattttgaggagatcctggcctttgtgaaccaccactgggagctgctgcagctgggcaagctgaccagcacccctgtgacagaccggggcccccacctgctgaatgccctgaacagctacaagagccgcttcctgtgtgggaaggagatcaagaagaagaagtgcatcttccggctgcgcatccgggtgccccccaaccccccaggcaagctgctgcctgacaagggcctgctgcccaatgaaaattctgccagcagcgagctgaggaagaggggcaagagcaagccaggcctgctgccccatgagttccagcagcagaagagaagagtgtacagaaggaagaggagcaagttcctgctggaggatgccatccccagcagtgacttcaccagcgcctggagcaccaaccaccacctggccagcatctttgacttcaccctggatgagatccagagcctgaagagcgccagcagcggccagaccttcttcagtgatgtggacagcacagatgctgccagcaccagcggcagcgccagcaccagcctgtcctatgacagccgctggacagtgggcagcaggaagaggaagctggccgccaaggcctacatgcccctgcgggccaagcgctgggccgctgagctggatggccgctgccccagcgacagcagcgctgagggcgcctctgtgcctgagaggccagatgagggcatcgacagccacacctttgagagcatcagtgaagatgacagcagcctgagccacctgaagagcagcatcaccaactactttggagctgctggccgcctggcctgtggggagaagtaccaggtgctggcccggcgggtgaccccagagggcaaggtgcagtacctggtggagtgggagggcaccaccccctactag

SEQ ID NO: 163700 - DNA, 1116 bp, Artificial Sequence
  Description of Artificial Sequence: Synthetic coding sequence
atgctgcagtgctaccgctgccggcagtggttccacgaggcctgcacccagtgcctgaatgagcccatgatgtttggagaccgcttctacctgttcttctgcagcgtgtgcaaccagggccctgagtacatcgagcggctgcccctgcgctgggtggatgtggtgcacctggccctgtacaacctgggcgtgcagagcaagaagaagtactttgattttgaggagatcctggcctttgtgaaccaccactgggagctgctgcagctgggcaagctgaccagcacccctgtgacagaccggggcccccacctgctgaatgccctgaacagctacaagagccgcttcctgtgtgggaaggagatcaagaagaagaagtgcatcttccggctgcgcatccgggtgccccccaaccccccaggcaagctgctgcctgacaagggcctgctgcccaatgaaaacagcgccagcagcgagctgaggaagaggggcaagagcaagccaggcctgctgccccatgagttccagcagcagaagagaagagtgtacagaaggaagaggagcaagttcctgctggaggatgccatccccagcagtgacttcaccagcgcctggagcaccaaccaccacctggccagcatctttgacttcaccctggatgagatccagagcctgaagagcgccagcagcggccagaccttcttcagtgatgtggacagcacagatgctgccagcaccagcggcagcgccagcaccagcctgtcctatgacagccgctggacagtgggcagcaggaagaggaagctggccgccaaggcctacatgcccctgcgggccaagcgctgggccgctgagctggatggccgctgccccagcgacagcagcgctgagggcgcctctgtgcctgagaggccagatgagggcatcgacagccacacctttgagagcatcagtgaagatgacagcagcctgagccacctgaagagcagcatcaccaactactttggagctgctggccgcctggcctgtggggagaagtaccaggtgctggcccggcgggtgaccccagagggcaaggtgcagtacctggtggagtgggagggcaccaccccctactag

SEQ ID NO: 163701 - DNA, 501 bp, Artificial Sequence
  Description of Artificial Sequence: Synthetic coding sequence
atggagaacagagccctggaccccggcacccgggacagctatggagccaccagccacctgcccaacaagggggccctggccaaggtgaagaacaacttcaaggacctgatgagcaagctgacagagggccagtatgtgctgtgccgctggacagatggcctgtactacctgggcaagatcaagagggtgagcagcagcaagcagagctgcctggtgacctttgaggacaacagcaagtactgggtgctgtggaaggacatccagcacgccggcgtgcctggagaggagcccaagtgcaacatctgcctgggcaagaccagcggccccctgaatgagatcctgatctgtgggaaatgtggcctgggctaccaccagcagtgccacatccccatcgccggcagcgctgaccagcccctgctgaccccctggttctgccgccgctgcatctttgccctggccgtgaggaagggcggggccctgaagaagggggccatcgcctag

SEQ ID NO: 163702 - DNA, 324 bp, Artificial Sequence
  Description of Artificial Sequence: Synthetic coding sequence
atggagaacagagccctggaccccggcacccgggacagctatggagccaccagccacctgcccaacaagggggccctggccaaggtgaagaacaacttcaaggacctgatgagcaagctgacagagggccagtatgtgctgtgccgctggacagatggcctgtactacctgggcaagatcaagagggtgagcagcagcaagcagagctgcctggtgacctttgaggacaacagcaagtactgggtgctgtggaaggacatccagcacgccggcgtgcctggagaggagcccaagtgcaacatctgcctgggcaagaccagctag

SEQ ID NO: 163703 - DNA, 1692 bp, Artificial Sequence
  Description of Artificial Sequence: Synthetic coding sequence
atggagaacagagccctggaccccggcacccgggacagctatggagccaccagccacctgcccaacaagggggccctggccaaggtgaagaacaacttcaaggacctgatgagcaagctgacagagggccagtatgtgctgtgccgctggacagatggcctgtactacctgggcaagatcaagagggtgagcagcagcaagcagagctgcctggtgacctttgaggacaacagcaagtactgggtgctgtggaaggacatccagcacgccggcgtgcctggagaggagcccaagtgcaacatctgcctgggcaagaccagcggccccctgaatgagatcctgatctgtgggaaatgtggcctgggctaccaccagcagtgccacatccccatcgccggcagcgctgaccagcccctgctgaccccctggttctgccgccgctgcatctttgccctggccgtgaggaagggcggggccctgaagaagggggccatcgcccggaccctgcaggccgtgaagatggtgctgagctaccagcctgaggagctggagtgggacagcccccacaggaccaaccagcagcagtgctactgctactgcggcggccctggagagtggtacctgaggatgctgcagtgctaccgctgccggcagtggttccacgaggcctgcacccagtgcctgaatgagcccatgatgtttggagaccgcttctacctgttcttctgcagcgtgtgcaaccagggccctgagtacatcgagcggctgcccctgcgctgggtggatgtggtgcacctggccctgtacaacctgggcgtgcagagcaagaagaagtactttgattttgaggagatcctggcctttgtgaaccaccactgggagctgctgcagctgggcaagctgaccagcacccctgtgacagaccggggcccccacctgctgaatgccctgaacagctacaagagccgcttcctgtgtgggaaggagatcaagaagaagaagtgcatcttccggctgcgcatccgggtgccccccaaccccccaggcaagctgctgcctgacaagggcctgctgcccaatgaaaattctgccagcagcgagctgaggaagaggggcaagagcaagccaggcctgctgccccatgagttccagcagcagaagagaagagtgtacagaaggaagaggagcaagttcctgctggaggatgccatccccagcagtgacttcaccagcgcctggagcaccaaccaccacctggccagcatctttgacttcaccctggatgagatccagagcctgaagagcgccagcagcggccagaccttcttcagtgatgtggacagcacagatgctgccagcaccagcggcagcgccagcaccagcctgtcctatgacagccgctggacagtgggcagcaggaagaggaagctggccgccaaggcctacatgcccctgcgggccaagcgctgggccgctgagctggatggccgctgccccagcgacagcagcgctgagggcgcctctgtgcctgagaggccagatgagggcatcgacagccacacctttgagagcatcagtgaagatgacagcagcctgagccacctgaagagcagcatcaccaactactttggagctgctggccgcctggcctggggcgaggtgcctggggtgggcagcgagggccacacctag

SEQ ID NO: 163704 - DNA, 3291 bp, Artificial Sequence
  Description of Artificial Sequence: Synthetic coding sequence
atggccaccgtgcctgtgtactgtgtgtgccgcctgccctatgatgtgacccgcttcatgattgaatgtgatgcctgcaaggactggttccacggcagctgtgtgggcgtggaggaggaggaggccccagacatcgacatctaccactgccccaactgtgagaagacccacggcaagagcaccctgaagaagaagaggacctggcacaagcacggccctggccaggccccagatgtgaagcctgtgcagaatggcagccagctgttcatcaaggagctgcggagcaggaccttccccagcgcagaagatgtggtggcccgggtgcccggcagccagctgaccctgggctacatggaggagcacggcttcacagagcccatcctggtgcccaagaaggatggcctgggcctggccgtgcctgcccccaccttctacgtgtctgatgtggagaactacgtgggccctgagaggtctgtggatgtgacagatgtgaccaagcagaaggactgcaagatgaagctgaaggagtttgtggactactactacagcaccaacaggaagagggtgctgaatgtgaccaacctggagttcagtgacaccaggatgagcagctttgtggagcccccagacatcgtgaagaagctgtcctgggtggagaactactggccagatgatgccctgctggccaagcccaaggtgaccaagtactgcctgatctgtgtgaaggacagctacacagacttccacatcgacagcggcggggccagcgcctggtaccacgtgctgaagggggagaagaccttctacctgatccggcctgccagcgccaacatcagcctgtatgagcgctggaggtctgccagcaaccacagcgagatgttctttgctgaccaggtggacaagtgctacaagtgcatcgtgaagcagggccagaccctcttcatccccagcggctggatctatgccaccctgacccctgtggactgcctggcctttgctggccacttcctgcacagcctgtctgtggagatgcagatgagggcctatgaggtggagcggcggctgaagctgggcagcctgacccagttccccaactttgaaacagcctgctggtacatgggcaagcacctgctggaggccttcaagggcagccacaagagcggcaagcagctgcccccccacctggtgcagggcgccaagatcctgaatggagccttccgctcctggaccaagaagcaggccctggccgagcatgaagatgagctgcctgagcacttcaagcccagccagctgatcaaggacctggccaaggagatccggctgtctgaaaatgccagcaaggctgtgcggcctgaggtgaacacagtggccagcagtgatgaggtgtgtgatggagaccgggagaaggaggagccccccagccccatcgaggccaccccaccccagagcctgctggagaaggtgtccaagaagaagacccccaagacagtgaagatgcccaagcccagcaagatccccaagccacccaagccacccaagccacccaggcctcccaagaccctgaagctgaaggatggcggcaagaagaagggcaagaagagccgggagagcgccagccccaccatccccaacctggacctgctggaggcccacaccaaggaggccctgaccaagatggagccccccaagaagggcaaggccaccaagtctgtgctgtctgtgcccaacaaggatgtggtgcacatgcagaatgatgtggagcggctggagatccgggagcagaccaagagcaagtctgaggccaagtggaagtacaagaacagcaagccagacagcctgctgaagatggaggaggagcagaagctggagaagagccccctggccggcaacaaggacaacaagttctccttctccttcagcaacaagaagctgctgggcagcaaggccctgcggccccccaccagccctggggtgtttggagccctgcagaacttcaaggaggacaagcccaagcctgtgagagatgaatatgaatatgtgtctgatgatggagagctgaagattgatgagttccccatccggaggaagaagaatgcccccaagagggacctgtccttcctgctggacaagaaggctgtgctgcccacccctgtgaccaagcccaagctggacagcgctgcctacaagagtgatgacagcagtgatgagggcagcctgcacatcgacacagacaccaagccaggaagaaatgcccgggtgaagaaggagagcggcagcagcgctgctggcatcctggacctgctgcaggccagcgaggaggtgggcgccctggagtacaaccccagcagccagcccccagccagccccagcacccaggaggccatccagggcatgctgtccatggccaacctgcaggccagtgacagctgcctgcagaccacctggggcgccggccaggccaagggcagcagcctggccgcccacggggccaggaagaatggaggcggcagcggcaagtctgctgggaagaggctgctgaagagagctgccaagaacagcgtggacctggatgattatgaggaggagcaggaccacctggatgcctgcttcaaggacagcgactatgtgtaccccagcctggagagtgatgaggacaaccccatcttcaagagccgcagcaagaagaggaaaggaagtgatgatgccccctacagccccacagcccgggtgggccccagcgtgccccggcaggacaggcctgtgcgggagggcaccagggtggccagcattgagaccggcctggccgctgctgctgccaagctgagccagcaggaggagcagaagagcaagaagaagaagagcgccaagaggaagctgacccccaacaccaccagccccagcaccagcaccagcatctctgctggcaccaccagcaccagcaccaccccagccagcaccaccccagccagcaccaccccagccagcaccagcacagccagcagccaggccagccaggagggcagcagccctgagcccccacctgagagccacagcagcagcctggccgaccacgagtacacagctgctggcaccttcaccggggcccaggccggccgcaccagccagcccatggcccctggggtcttcctgacccagaggcggcccagcgccagcagccccaacaacaacacagctgccaagggcaagaggaccaagaagggcatggccacagccaagcagaggctgggcaagatcctgaagatccacagaaatggcaagctgctgctgtag

SEQ ID NO: 163705 - DNA, 984 bp, Artificial Sequence
  Description of Artificial Sequence: Synthetic coding sequence
atggccaccgtgcctgtgtactgtgtgtgccgcctgccctatgatgtgacccgcttcatgattgaatgtgatgcctgcaaggactggttccacggcagctgtgtgggcgtggaggaggaggaggccccagacatcgacatctaccactgccccaactgtgagaagacccacggcaagagcaccctgaagaagaagaggacctggcacaagcacggccctggccaggccccagatgtgaagcccaagaacagcgtggacctggatgattatgaggaggagcaggaccacctggatgcctgcttcaaggacagcgactatgtgtaccccagcctggagagtgatgaggacaaccccatcttcaagagccgcagcaagaagaggaagggcagtgatgatgccccctacagccccacagcccgggtgggccccagcgtgccccggcaggacaggcctgtgcgggagggcaccagggtggccagcattgaaacaggcctggccgctgctgctgccaagctgagccagcaggaggagcagaagagcaagaagaagaagagcgccaagaggaagctgacccccaacaccaccagccccagcaccagcaccagcatctctgctggcaccaccagcaccagcaccaccccagccagcaccaccccagccagcaccaccccagccagcaccagcacagccagcagccaggccagccaggagggcagcagccctgagcccccacctgagagccacagcagcagcctggccgaccacgagtacacagctgctggcaccttcaccggggcccaggccggccgcaccagccagcccatggcccctggggtcttcctgacccagaggcggcccagcgccagcagccccaacaacaacacagctgccaagggcaagaggaccaagaagggcatggccacagccaagcagaggctgggcaagatcctgaagatccacagaaatggcaagctgctgctgtag

SEQ ID NO: 163706 - DNA, 2046 bp, Artificial Sequence
  Description of Artificial Sequence: Synthetic coding sequence
atggagctgcagaccctgcaggaggccctgaaggtggagatccaggtgcaccagaagctggtggcccagatgaagcaggacccccagaatgctgacctgaagaagcagctgcacgagctgcaggccaagatcacagccctgtctgagaagcagaagagggtggtggagcagctgaggaagaacctgattgtgaagcaggagcagcctgacaagttccagatccagcccctgccccagagcgagaacaagctgcagacagcccagcagcagcccctgcagcagctgcagcagcagcagcagtaccaccaccaccacgcccagcagagcgctgctgccagccccaacctgacagccagccagaagacagtgaccacagcctccatgatcaccaccaagaccctgcccctggtgctgaaggccgccacagccaccatgcctgcctctgtggtgggccagaggcccaccatcgccatggtgacagccatcaacagccagaaggctgtgctgagcacagatgtgcagaacacccctgtgaacctgcagaccagcagcaaggtgactggacctggagctgaggccgtgcagatcgtggccaagaacacagtgaccctgcaggtgcaggccaccccaccccagcccatcaaggtgccccagttcatccccccaccccggctgaccccccggcccaacttcctgccccaggtgcggcccaagcctgtggcccagaacaacatccccatcgccccagcccccccacccatgctggccgccccccagctgatccagaggcctgtgatgctgaccaagttcacccccaccaccctgcccaccagccagaacagcatccaccctgtgcgggtggtgaatggccagacagccaccatcgccaagaccttccccatggcccagctgaccagcatcgtgattgccaccccaggcacccggctggccggcccccagacagtgcagctgagcaagcccagcctggagaagcagacagtgaagagccacacagaaacagatgagaagcagacagagagcaggaccatcaccccacctgctgcccccaagcccaagcgggaggagaacccccagaagctggccttcatggtgtccctgggcctggtgacccatgaccacctggaggagatccagagcaagaggcaggagaggaagaggaggaccacagccaaccctgtgtacagcggggctgtgtttgagcctgagaggaagaagtctgctgtgacctacctgaacagcaccatgcaccctggcaccaggaagaggggccggccccccaagtacaatgctgtgctgggctttggagccctgacccccaccagcccccagagcagccacccagacagcccagaaaatgagaagacagagaccaccttcaccttccctgcccctgtgcagcctgtgtccctgcccagccccaccagcacagatggagacatccacgaggacttctgcagcgtgtgcaggaagagcggccagctgctgatgtgtgacacctgcagccgggtgtaccacctggactgcctggacccccccctgaagaccatccccaagggcatgtggatctgcccccgctgccaggaccagatgctgaagaaggaggaggccatcccctggccaggcaccctggccatcgtgcacagctacatcgcctacaaggccgccaaggaggaggagaagcagaagctgctgaagtggagcagtgacctgaagcaggagcgggagcagctggagcagaaggtgaagcagctgagcaacagcatcagcaagtgcatggagatgaagaacaccatcctggcccggcagaaggagatgcacagcagcctggagaaggtgaagcagctgatccgcctcatccatggaattgacctgagcaagcctgtggacagcgaggccaccgtgggcgccatcagcaatggaccagactgcaccccaccagccaatgctgccaccagcaccccagcccccagccccagcagccagagctgcacagccaactgcaaccagggcgaggagaccaagtag

SEQ ID NO: 163707 - DNA, 1905 bp, Artificial Sequence
  Description of Artificial Sequence: Synthetic coding sequence
atggagctgcagaccctgcaggaggccctgaaggtggagatccaggtgcaccagaagctggtggcccagatgaagcaggacccccagaatgctgacctgaagaagcagctgcacgagctgcaggccaagatcacagccctgtctgagaagcagaagagggtggtggagcagctgaggaagaacctgattgtgaagcaggagcagcctgacaagttccagatccagcccctgccccagagcgagaacaagctgcagacagcccagcagcagcccctgcagcagctgcagcagcagcagcagtaccaccaccaccacgcccagcagagcgctgctgccagccccaacctgacagccagccagaagacagtgaccacagcctccatgatcaccaccaagaccctgcccctggtgctgaaggccgccacagccaccatgcctgcctctgtggtgggccagaggcccaccatcgccatggtgacagccatcaacagccagaaggctgtgctgagcacagatgtgcagaacacccctgtgaacctgcagaccagcagcaaggtgactggacctggagctgaggccgtgcagatcgtggccaagaacacagtgaccctgcaggtgcaggccaccccaccccagcccatcaaggtgccccagttcatccccccaccccggctgaccccccggcccaacttcctgccccaggtgcggcccaagcctgtggcccagaacaacatccccatcgccccagcccccccacccatgctggccgccccccagctgatccagaggcctgtgatgctgaccaagttcacccccaccaccctgcccaccagccagaacagcatccaccctgtgcgggtggtgaatggccagacagccaccatcgccaagaccttccccatggcccagctgaccagcatcgtgattgccaccccaggcacccggctggccggcccccagacagtgcagctgagcaagcccagcctggagaagcagacagtgaagagccacacagaaacagatgagaagcagacagagagcaggaccatcaccccacctgctgcccccaagcccaagcgggaggagaacccccagaagctggccttcatggtgtccctgggcctggtgacccatgaccacctggaggagatccagagcaagaggcaggagaggaagaggaggaccacagccaaccctgtgtacagcggggctgtgtttgagcctgagaggaagaagtctgctgtgacctacctgaacagcaccatgcaccctggcaccaggaagagggccaatgaggagcactggcccaagggggacatccacgaggacttctgcagcgtgtgcaggaagagcggccagctgctgatgtgtgacacctgcagccgggtgtaccacctggactgcctggacccccccctgaagaccatccccaagggcatgtggatctgcccccgctgccaggaccagatgctgaagaaggaggaggccatcccctggccaggcaccctggccatcgtgcacagctacatcgcctacaaggccgccaaggaggaggagaagcagaagctgctgaagtggagcagtgacctgaagcaggagcgggagcagctggagcagaaggtgaagcagctgagcaacagcatcagcaagtgcatggagatgaagaacaccatcctggcccggcagaaggagatgcacagcagcctggagaaggtgaagcagctgatccgcctcatccacggcatcgacctgagcaagcctgtggacagcgaggccaccgtgggcgccatcagcaatggaccagactgcaccccaccagccaatgctgccaccagcaccccagcccccagccccagcagccagagctgcacagccaactgcaaccagggcgaggagaccaagtag

SEQ ID NO: 163708 - DNA, 2043 bp, Artificial Sequence
  Description of Artificial Sequence: Synthetic coding sequence
atggagctgcagaccctgcaggaggccctgaaggtggagatccaggtgcaccagaagctggtggcccagatgaagcaggacccccagaatgctgacctgaagaagcagctgcacgagctgcaggccaagatcacagccctgtctgagaagcagaagagggtggtggagcagctgaggaagaacctgattgtgaagcaggagcagcctgacaagttccagatccagcccctgccccagagcgagaacaagctgcagacagcccagcagcagcccctgcagcagctgcagcagcagcagcagtaccaccaccaccacgcccagcagagcgctgctgccagccccaacctgacagccagccagaagacagtgaccacagcctccatgatcaccaccaagaccctgcccctggtgctgaaggccgccacagccaccatgcctgcctctgtggtgggccagaggcccaccatcgccatggtgacagccatcaacagccagaaggctgtgctgagcacagatgtgcagaacacccctgtgaacctgcagaccagcagcaaggtgactggacctggagctgaggccgtgcagatcgtggccaagaacacagtgaccctggtgcaggccaccccaccccagcccatcaaggtgccccagttcatccccccaccccggctgaccccccggcccaacttcctgccccaggtgcggcccaagcctgtggcccagaacaacatccccatcgccccagcccccccacccatgctggccgccccccagctgatccagaggcctgtgatgctgaccaagttcacccccaccaccctgcccaccagccagaacagcatccaccctgtgcgggtggtgaatggccagacagccaccatcgccaagaccttccccatggcccagctgaccagcatcgtcatcgccaccccaggcacccggctggccggcccccagacagtgcagctgagcaagcccagcctggagaagcagacagtgaagagccacacagaaacagatgagaagcagacagagagcaggaccatcaccccacctgctgcccccaagcccaagcgggaggagaacccccagaagctggccttcatggtgtccctgggcctggtgacccatgaccacctggaggagatccagagcaagaggcaggagaggaagaggaggaccacagccaaccctgtgtacagcggggctgtgtttgagcctgagaggaagaagtctgctgtgacctacctgaacagcaccatgcaccctggcaccaggaagaggggccggccccccaagtacaatgctgtgctgggctttggagccctgacccccaccagcccccagagcagccacccagacagcccagaaaatgagaagacagagaccaccttcaccttccctgcccctgtgcagcctgtgtccctgcccagccccaccagcacagatggagacatccacgaggacttctgcagcgtgtgcaggaagagcggccagctgctgatgtgtgacacctgcagccgggtgtaccacctggactgcctggacccccccctgaagaccatccccaagggcatgtggatctgcccccgctgccaggaccagatgctgaagaaggaggaggccatcccctggccaggcaccctggccatcgtgcacagctacatcgcctacaaggccgccaaggaggaggagaagcagaagctgctgaagtggagcagtgacctgaagcaggagcgggagcagctggagcagaaggtgaagcagctgagcaacagcatcagcaagtgcatggagatgaagaacaccatcctggcccggcagaaggagatgcacagcagcctggagaaggtgaagcagctgatccgcctcatccacggcatcgacctgagcaagcctgtggacagcgaggccaccgtgggcgccatcagcaatggaccagactgcaccccaccagccaatgctgccaccagcaccccagcccccagccccagcagccagagctgcacagccaactgcaaccagggcgaggagaccaagtag

SEQ ID NO: 163709 - DNA, 81 bp, Artificial Sequence; identical to SEQ ID NO: 92913
  Description of Artificial Sequence: Synthetic coding sequence

SEQ ID NO: 163710 - DNA, 36 bp, Artificial Sequence; identical to SEQ ID NO: 92914
  Description of Artificial Sequence: Synthetic coding sequence

SEQ ID NO: 163711 - DNA, 306 bp, Artificial Sequence
  Description of Artificial Sequence: Synthetic coding sequence
atggagctgcagaccctgcaggaggccctgaaggtggagatccaggtgcaccagaagctggtggcccagatgaagcaggacccccagaatgctgacctgaagaagcagctgcacgagctgcaggccaagatcacagccctgtctgagaagcagaagagggtggtggagcagctgaggaagaacctgattgtgaagcaggagcagcctgacaagttccagatccagcccctgccccagagcgagaacaagctgcagacagcccagcagcagcccctgcagcagctgcagcagcagcagcagtactag

SEQ ID NO: 163712 - DNA, 30 bp, Artificial Sequence; identical to SEQ ID NO: 92916
  Description of Artificial Sequence: Synthetic coding sequence

SEQ ID NO: 163713 - DNA, 156 bp, Artificial Sequence
  Description of Artificial Sequence: Synthetic coding sequence
atggagctgcagaccctgcaggaggccctgaaggtggagatccaggtgcaccagaagctggtggcccagatgaagcaggacccccagaatgctgacctgaagaagcagctgcacgagctgcaggccaagatcacagccctgtctgagaagcagtag

SEQ ID NO: 163714 - DNA, 477 bp, Artificial Sequence
  Description of Artificial Sequence: Synthetic coding sequence
atgctggaggccatggccgagcccagcccagaagatcctccacccaccctgaagccagagacccagcccccagagaagagaagaaggaccatcgaggacttcaacaagttctgcagctttgtgctggcctatgccggctacatcccccccagcaaggaggagagtgactggccagccagcggcagcagcagccccctgcggggggagagcgctgctgacagtgatggctgggacagcgcccccagcgacctgcggaccatccagacctttgtgaagaaggccaagagcagcaagagaagagctgcccaggccggccccacccagcccggccccccaagaagcaccttcagccggctgcaggccccagacagcgccaccctgctggagaagatgaagctgaaggacagcctgtttgacctggatggccccaaggtggccagccccctgagccccccctgtgccgccaacaccccctag

SEQ ID NO: 163715 - DNA, 1212 bp, Artificial Sequence
  Description of Artificial Sequence: Synthetic coding sequence
atgctggaggccatggccgagcccagcccagaagatcctccacccaccctgaagccagagacccagcccccagagaagagaagaaggaccatcgaggacttcaacaagttctgcagctttgtgctggcctatgccggctacatcccccccagcaaggaggagagtgactggccagccagcggcagcagcagccccctgcggggggagagcgctgctgacagtgatggctgggacagcgcccccagcgacctgcggaccatccagacctttgtgaagaaggccaagagcagcaagagaagagctgcccaggccggccccacccagcccggccccccaagaagcaccttcagccggctgcaggccccagacagcgccaccctgctggagaagatgaagctgaaggacagcctgtttgacctggatggccccaaggtggccagccccctgagccccaccagcctgacccacaccagccggcccccagctgccctgacccctgtgcccctgagccagggcgacctgagccacccccccaggaagaaggacaggaagaacaggaagctgggccctggggccggggccggcttcggcgtgctgcggcggccccggcccaccccaggagatggagagaagaggagccgcatcaagaagagcaagaagaggaagctgaagaaggccgagcggggggaccggctgcccccacctggccccccccaggcccccccaagtgacacagattctgaggaggaggaggaggaggaggaggaggaggaggaggaggagatggccaccgtggtgggcggggaggcccctgtgcctgtgctgcccaccccacctgaggccccccggcccccagccaccgtgcaccctgagggcgtgcccccagctgacagcgagagcaaggaggtgggcagcacagagaccagccaggatggagatgccagcagcagcgagggggagatgagggtgatggatgaggacatcatggtggagagcggagatgacagctgggacctgatcacctgctactgcaggaagccctttgctggccggcccatgattgaatgttccctgtgtggcacctggatccacctgagctgtgccaagatcaagaagaccaacgtgcctgacttcttctactgccagaagtgcaaggagctgcggcctgaggcccggcggctgggcggcccccccaagagcggggagccctag

SEQ ID NO: 163716 - DNA, 1200 bp, Artificial Sequence
  Description of Artificial Sequence: Synthetic coding sequence
atgcctggggactgccggcgggaccccccacccaccctgaagccagagacccagcccccagagaagagaagaaggaccatcgaggacttcaacaagttctgcagctttgtgctggcctatgccggctacatcccccccagcaaggaggagagtgactggccagccagcggcagcagcagccccctgcggggggagagcgctgctgacagtgatggctgggacagcgcccccagcgacctgcggaccatccagacctttgtgaagaaggccaagagcagcaagagaagagctgcccaggccggccccacccagcccggccccccaagaagcaccttcagccggctgcaggccccagacagcgccaccctgctggagaagatgaagctgaaggacagcctgtttgacctggatggccccaaggtggccagccccctgagccccaccagcctgacccacaccagccggcccccagctgccctgacccctgtgcccctgagccagggcgacctgagccacccccccaggaagaaggacaggaagaacaggaagctgggccctggggccggggccggcttcggcgtgctgcggcggccccggcccaccccaggagatggagagaagaggagccgcatcaagaagagcaagaagaggaagctgaagaaggccgagcggggggaccggctgcccccacctggccccccccaggcccccccaagtgacacagattctgaggaggaggaggaggaggaggaggaggaggaggaggaggagatggccaccgtggtgggcggggaggcccctgtgcctgtgctgcccaccccacctgaggccccccggcccccagccaccgtgcaccctgagggcgtgcccccagctgacagcgagagcaaggaggtgggcagcacagagaccagccaggatggagatgccagcagcagcgagggggagatgagggtgatggatgaggacatcatggtggagagcggagatgacagctgggacctgatcacctgctactgcaggaagccctttgctggccggcccatgattgaatgttccctgtgtggcacctggatccacctgagctgtgccaagatcaagaagaccaacgtgcctgacttcttctactgccagaagtgcaaggagctgcggcctgaggcccggcggctgggcggcccccccaagagcggggagccctag

SEQ ID NO: 163717 - DNA, 6120 bp, Artificial Sequence
  Description of Artificial Sequence: Synthetic coding sequence
atggacatcgtggacaccttcaaccacctgatccccacagagcacctggatgatgccctcttcctgggcagcaacctggagaatgaggtgtgtgaggacttcagcgccagccagaatgtgctggaggacagcctgaagaacatgctgagtgacaaggaccccatgctgggcagcgccagcaaccagttctgcctgcctgtgctggacagcaatgaccccaacttccagatgccctgcagcacagtggtgggcctggatgacatcatggatgagggcgtggtgaaggagagcggaaatgacaccattgatgaggaggagctgatcctgcccaacagaaacctgcgggacaaggtggaggagaacagcgtgcgcagccccaggaagagcccccggctgatggcccaggagcaggtgcgcagcctgcggcagagcaccatcgccaagaggagcaatgctgcccccctgagcaacaccaagaaggccagcggcaagacagtgtccacagccaaggccggcgtgaagcagcctgagaggagccaggtgaaggaggaggtgtgcatgagcctgaagccagagtaccacaaggagaacagacgctgcagcaggaacagcggccagatcgaggtggtgcctgaggtgtctgtgagcagcagccacagctctgtgagcagctgcctggagatgaaggatgaagatggcctggacagcaagcacaagtgcaacaaccctggagaaattgatgtgcccagccatgagctgaactgcagcctgctgtctgagacctgtgtgaccatcggggagaagaagaatgaggccctgatggagtgcaaggccaagcctgtgggcagccccctcttcaagttcagtgacaaggaggagcacgagcagaatgacagcatcagcggcaagacaggagaaacagtggtggaggagatgattgccaccaggaaggtggagcaggacagcaaggagaccgtgaagctgagccatgaagatgaccacatcctggaggatgctggcagcagtgacatcagcagtgatgctgcctgcaccaaccccaacaagacagagaacagcctggtgggcctgcccagctgtgtggatgaggtgacagagtgcaacctggagctgaaggacaccatgggcattgctgacaagacagagaacaccctggagaggaacaagattgagcccctgggctactgtgaagatgctgagagcaaccggcagctggagagcacagagttcaacaagagcaacctggaggtggtggacaccagcacctttggacctgagagcaacatcctggagaatgccatctgtgatgtgcctgaccagaacagcaagcagctgaatgccatcgagagcaccaagattgagagccatgaaacagccaacctgcaggatgacaggaacagccagagcagctctgtgtcctacctggagagcaagtctgtgaagagcaagcacaccaagcctgtgatccacagcaagcagaacatgaccacagatgcccccaagaagatcgtggccgccaagtatgaggtgatccacagcaagaccaaggtgaatgtgaagtctgtgaagaggaacacagatgtgcctgagagccagcagaacttccacaggcctgtgaaggtgaggaagaagcagattgacaaggagcccaagatccagagctgcaacagcggcgtgaagtctgtgaagaaccaggcccacagcgtgctgaagaagaccctgcaggaccagaccctggtgcagatcttcaagcccctgacccacagcctgagtgacaagagccacgcccaccctggctgcctgaaggagccccaccacccagcccagacaggccacgtgagccacagcagccagaagcagtgccacaagccccagcagcaggccccagccatgaagaccaacagccacgtgaaggaggagctggagcaccctggggtggagcacttcaaggaggaggacaagctgaagctgaagaagccagagaagaacctgcagccccggcagaggaggagcagcaagagcttcagcctggatgagcccccactcttcatcccagacaacatcgccaccatccggcgggagggcagtgaccacagcagcagctttgagagcaagtacatgtggacccccagcaagcagtgtggcttctgcaagaagccccacggcaaccgcttcatggtgggctgcggccgctgtgatgactggttccatggagactgtgtgggcctgagcctgagccaggcccagcagatgggagaggaggacaaggagtatgtgtgtgtgaagtgctgtgccgaggaggacaagaagacagagatcctggaccctgacaccctggagaaccaggccaccgtggagttccacagcggggacaagaccatggagtgtgagaagctgggcctgagcaagcacaccaccaatgacaggaccaagtacattgatgacacagtgaagcacaaggtgaagatcctgaagcgggagagcggggagggcaggaacagcagtgactgccgggacaatgagatcaagaagtggcagctggcccccctgaggaagatgggccagcctgtgctgccccggcgcagcagcgaggagaagtctgagaagatccccaaggagagcaccaccgtgacctgcaccggggagaaggccagcaagccaggcacccatgagaagcaggagatgaagaagaagaaggtggagaagggcgtgctgaatgtgcaccctgctgccagcgccagcaagcccagcgctgaccagatccggcagagcgtgcgccacagcctgaaggacatcctgatgaagaggctgacagacagcaacctgaaggtgcctgaggagaaggccgccaaggtggccaccaagattgagaaggagctgttctccttcttccgggacacagatgccaagtacaagaacaagtaccgcagcctgatgttcaacctgaaggaccccaagaacaacatcctcttcaagaaggtgctgaagggggaggtgaccccagaccacctgatccgcatgagccctgaggagctggccagcaaggagctggccgcctggaggcggcgggagaacagacacaccatcgagatgattgagaaggagcagcgggaggtggagcggcggcccatcaccaagatcacccacaagggggagattgaaattgaaagtgatgcccccatgaaggagcaggaggccgccatggagatccaggagcctgctgccaacaagagcctggagaagccagagggcagcgagaagcagaaggaggaggtggacagcatgagcaaggacaccaccagccagcaccggcagcacctgtttgacctgaactgcaagatctgcatcggccgcatggcccctcctgtggatgacctgagccccaagaaggtgaaggtggtggtgggcgtggccaggaagcacagcgacaatgaggccgagagcattgctgatgccctgagcagcaccagcaacatcctggccagcgagttctttgaggaggagaagcaggagagccccaagagcaccttctccccagcccccaggcctgagatgcctggcaccgtggaggtggagagcaccttcctggcccggctgaacttcatctggaagggcttcatcaacatgcccagcgtggccaagtttgtgaccaaggcctaccctgtgtctggcagccctgagtacctgacagaggacctgcctgacagcatccaggtgggcggccgcatcagcccccagacagtgtgggactatgtggagaagatcaaggccagcggcaccaaggagatctgtgtggtgcgcttcacccctgtgacagaggaggaccagatctcctacaccctgctgtttgcctacttcagcagcaggaagagatatggagtggccgccaacaacatgaagcaggtgaaggacatgtacctgatccccctgggcgccacagacaagatcccccaccccctggtgccctttgatggccctggcctggagctgcaccggcccaacctgctgctgggcctcatcatccggcagaagctgaagaggcagcacagcgcctgtgccagcaccagccacatcgccgagaccccagagagcgccccacccatcgccctgcccccagacaagaagagcaagattgaggtgtccacagaggaggcccctgaggaggagaatgacttcttcaacagcttcaccaccgtgctgcacaagcagaggaacaagccccagcagaacctgcaggaggacctgcccacagctgtggagcccctgatggaggtgaccaagcaggagccccccaagcccctgcgcttcctgcccggggtgctgattggctgggagaaccagcccaccaccctggagctggccaacaagcccctgcctgtggatgacatcctgcagagcctgctgggcaccaccggccaggtgtatgaccaggcccagagcgtgatggagcagaacacagtgaaggagatccccttcctgaatgagcagaccaacagcaagattgagaagacagacaacgtggaggtgacagatggagagaacaaggagatcaaggtgaaggtggacaacatcagcgagagcacagacaagtctgctgagattgagacctctgtggtgggcagcagcagcatctctgctggcagcctgaccagcctgagcctgcggggcaagcccccagatgtgtccacagaggccttcctgaccaacctgagcatccagagcaagcaggaggagaccgtggagagcaaggagaagaccctgaagaggcagctgcaggaggaccaggagaacaacctgcaggacaaccagaccagcaacagcagcccctgccgcagcaatgtgggcaagggcaacattgatggaaatgtgtcctgcagcgagaacctggtggccaacacagcccggagcccccagttcatcaacctgaagagggacccccggcaggccgccggccgcagccagcctgtgaccaccagcgagagcaaggatggagacagctgcagaaatggagagaagcacatgctgcccggcctgagccacaacaaggagcacctgacagagcagatcaacgtggaggagaagctgtgcagcgctgagaagaacagctgtgtgcagcagagcgacaacctgaaggtggcccagaacagccccagcgtggagaacatccagaccagccaggccgagcaggccaagcccctgcaggaggacatcctgatgcagaacatcgagaccgtgcaccccttcagaagaggcagcgctgtggccaccagccactttgaggtgggcaacacctgccccagcgagttccccagcaagagcatcaccttcaccagccgcagcaccagccccaggaccagcaccaacttcagccccatgaggccccagcagcccaacctgcagcacctgaagagcagccccccaggcttccccttccctggcccccccaacttccccccccagagcatgtttggcttccccccccacctgcccccacccctgctgcccccacctggctttggatttgcccagaaccccatggtgccctggccccctgtggtgcacctgcccggccagccccagaggatgatgggccccctgagccaggccagccgctacatcggcccccagaacttctaccaggtgaaggacatcagaagacctgagaggaggcacagcgacccctggggccggcaggaccagcagcagctggaccggcccttcaacagaggaaaaggagaccggcagcgcttctacagcgacagccaccacctgaagcgggagagacatgagaaggagtgggagcaggagagcgagcggcacagaagaagagacaggagccaggacaaggaccgggacaggaagagccgggaggagggccacaaggacaaggagcgggcccggctgagccacggggaccggggcacagatggcaaggccagccgggacagcagaaatgtggacaagaagccagacaagcccaagtctgaggactatgagaaggacaaggagcgggagaagagcaagcaccgggagggggagaaggaccgggaccgctaccacaaggaccgggaccacacagacaggaccaagagcaagaggtag

SEQ ID NO: 163718 - DNA, 6120 bp, Artificial Sequence; identical to SEQ ID NO: 163717
  Description of Artificial Sequence: Synthetic coding sequence

SEQ ID NO: 163719 - DNA, 1098 bp, Artificial Sequence
  Description of Artificial Sequence: Synthetic coding sequence
atgagcagctctgtggagcagaagaagggccccacccggcagaggaaatgtggcttctgcaagagcaacagagacaaggaatgtggccagctgctgatcagcgagaaccagaaggtggccgcccaccacaagtgcatgctgttcagcagcgccctggtgagcagccacagcgacaatgaaagcctgggcggcttcagcattgaagatgtgcagaaggagatcaagaggggcaccaagctgatgtgcagcctgtgccactgccctggggccaccatcggctgtgatgtgaagacctgccacaggacctaccactaccactgtgccctgcatgacaaggcccagatccgggagaagcccagccagggcatctacatggtgtactgcaggaagcacaagaagacagcccacaacagcgaggccgacctggaggagagcttcaatgaacatgagctggagcccagcagccccaagagcaagaagaagagcaggaagggccggcccaggaagaccaacttcaagggcctgtctgaggacaccaggagcaccagcagccatggaacagatgagatggagagcagcagctacagagacaggagcccccacaggagcagccccagcgacacccggcccaagtgtggcttctgccacgtgggggaggaggagaatgaggcccggggcaagctgcacatcttcaatgccaagaaggctgctgcccactacaagtgcatgctgttcagcagcggcaccgtgcagctgaccaccaccagcagagctgagtttggagactttgacatcaagacagtgctgcaggagatcaagaggggcaagaggatgaagtgcaccctgtgcagccagcccggggccaccatcggctgtgagatcaaggcctgtgtgaagacctaccactaccactgcggcgtgcaggacaaggccaagtacatcgagaacatgagccggggcatctacaagctgtactgcaagaaccacagcggaaatgatgaaagagatgaggaggatgaggagcgggagagcaagagccggggcaaggtggagattgaccagcagcagctgacccagcagcagctgaatggaaattag

SEQ ID NO: 163720 - DNA, 975 bp, Artificial Sequence
  Description of Artificial Sequence: Synthetic coding sequence
atgagcagctctgtggagcagaagaagggccccacccggcagaggaaatgtggcttctgcaagagcaacagagacaaggaatgtggccagctgctgatcagcgagaaccagaaggtggccgcccaccacaagtgcatgctgttcagcagcgccctggtgagcagccacagcgacaatgaaagcctgggcggcttcagcattgaagatgtgcagaaggagatcaagaggggcaccaagctgatgtgcagcctgtgccactgccctggggccaccatcggctgtgatgtgaagacctgccacaggacctaccactaccactgtgccctgcatgacaaggcccagatccgggagaagcccagccagggcatctacatggtgtactgcaggaagcacaagaagacagcccacaacagcgaggccgctgacctggaggagagcttcaatgagcacgagctggagcccagcagccccaagagcaagaagaagagcaggaagggccggcccaggaagaccaacttcaagggcctgtctgaggacaccaggagcaccagcagccacggcacagatgagatggagagcagcagctacagagacaggagcccccacaggagcagccccagcgacacccggcccaagtgtggcttctgccacgtgggggaggaggagaatgaggcccggggcaagctgcacatcttcaatgccaagaaggccgccgcccactacaagtgcatgctgttcagcagcggcaccgtgcagctgaccaccaccagcagagctgagtttggagactttgacatcaagacagtgctgcaggagatcaagaggggcaagaggatgaagtgcaccctgtgcagccagcccggggccaccatcggctgtgagatcaaggcctgtgtgaagacctaccactaccactgcggcgtgcaggacaaggccaagtacatcgagaacatgagccggggcatctacaagtag

SEQ ID NO: 163721 - DNA, 939 bp, Artificial Sequence
  Description of Artificial Sequence: Synthetic coding sequence
atgagcagctctgtggagcagaagaagggccccacccggcagaggaaatgtggcttctgcaagagcaacagagacaaggaatgtggccagctgctgatcagcgagaaccagaaggtggccgcccaccacaagtgcatgctgttcagcagcgccctggtgagcagccacagcgacaatgaaagcctgggcggcttcagcattgaagatgtgcagaaggagatcaagaggggcaccaagctgatgtgcagcctgtgccactgccctggggccaccatcggctgtgatgtgaagacctgccacaggacctaccactaccactgtgccctgcatgacaaggcccagatccgggagaagcccagccagggcatctacatggtgtactgcaggaagcacaagaagacagcccacaacagcgaggccgctgacctggaggagagcttcaatgagcacgagctggagcccagcagccccaagagcaagaagaagagcaggaagggccggcccaggaagaccaacttcaagggcctgtctgaggacaccaggagcaccagcagccacggcacagatgagatggagagcagcagctacagagacaggagcccccacaggagcagccccagcgacacccggcccaagtgtggcttctgccacgtgggggaggaggagaatgaggcccggggcaagctgcacatcttcaatgccaagaaggccgccgcccactacaagtgcatgctgttcagcagcggcaccgtgcagctgaccaccaccagcagagctgagtttggagactttgacatcaagacagtgctgcaggagatcaagaggggcaagaggatggtgtgcagcttctacatctgctacgccaccctgcacctgatctgctgcttcaagttccgggtgcaccccaagttcatccagagcagcgagaacctgaagtag

SEQ ID NO: 163722 - DNA, 1098 bp, Artificial Sequence; identical to SEQ ID NO: 163719
  Description of Artificial Sequence: Synthetic coding sequence

SEQ ID NO: 163723 - DNA, 1101 bp, Artificial Sequence
  Description of Artificial Sequence: Synthetic coding sequence
atgagcagctctgtggagcagaagaagggccccacccggcagaggaaatgtggcttctgcaagagcaacagagacaaggaatgtggccagctgctgatcagcgagaaccagaaggtggccgcccaccacaagtgcatgctgttcagcagcgccctggtgagcagccacagcgacaatgaaagcctgggcggcttcagcattgaagatgtgcagaaggagatcaagaggggcaccaagctgatgtgcagcctgtgccactgccctggggccaccatcggctgtgatgtgaagacctgccacaggacctaccactaccactgtgccctgcatgacaaggcccagatccgggagaagcccagccagggcatctacatggtgtactgcaggaagcacaagaagacagcccacaacagcgaggccgctgacctggaggagagcttcaatgagcacgagctggagcccagcagccccaagagcaagaagaagagcaggaagggccggcccaggaagaccaacttcaagggcctgtctgaggacaccaggagcaccagcagccacggcacagatgagatggagagcagcagctacagagacaggagcccccacaggagcagccccagcgacacccggcccaagtgtggcttctgccacgtgggggaggaggagaatgaggcccggggcaagctgcacatcttcaatgccaagaaggccgccgcccactacaagtgcatgctgttcagcagcggcaccgtgcagctgaccaccaccagcagagctgagtttggagactttgacatcaagacagtgctgcaggagatcaagaggggcaagaggatgaagtgcaccctgtgcagccagcccggggccaccatcggctgtgagatcaaggcctgtgtgaagacctaccactaccactgcggcgtgcaggacaaggccaagtacatcgagaacatgagccggggcatctacaagctgtactgcaagaaccacagcggaaatgatgaaagagatgaagaagatgaggagcgggagagcaagagccggggcaaggtggagattgaccagcagcagctgacccagcagcagctgaatggaaattag

SEQ ID NO: 163724 - DNA, 996 bp, Artificial Sequence
  Description of Artificial Sequence: Synthetic coding sequence
atgagcagctctgtggagcagaagaagggccccacccggcagaggaaatgtggcttctgcaagagcaacagagacaaggaatgtggccagctgctgatcagcgagaaccagaaggtggccgcccaccacaagtgcatgatgtgcagcctgtgccactgccctggggccaccatcggctgtgatgtgaagacctgccacaggacctaccactaccactgtgccctgcatgacaaggcccagatccgggagaagcccagccagggcatctacatggtgtactgcaggaagcacaagaagacagcccacaacagcgaggccgacctggaggagagcttcaatgaacatgagctggagcccagcagccccaagagcaagaagaagagcaggaagggccggcccaggaagaccaacttcaagggcctgtctgaggacaccaggagcaccagcagccatggaacagatgagatggagagcagcagctacagagacaggagcccccacaggagcagccccagcgacacccggcccaagtgtggcttctgccacgtgggggaggaggagaatgaggcccggggcaagctgcacatcttcaatgccaagaaggctgctgcccactacaagtgcatgctgttcagcagcggcaccgtgcagctgaccaccaccagcagagctgagtttggagactttgacatcaagacagtgctgcaggagatcaagaggggcaagaggatgaagtgcaccctgtgcagccagcccggggccaccatcggctgtgagatcaaggcctgtgtgaagacctaccactaccactgcggcgtgcaggacaaggccaagtacatcgagaacatgagccggggcatctacaagctgtactgcaagaaccacagcggaaatgatgaaagagatgaggaggatgaggagcgggagagcaagagccggggcaaggtggagattgaccagcagcagctgacccagcagcagctgaatggaaattag

SEQ ID NO: 163725 - DNA, 3075 bp, Artificial Sequence
  Description of Artificial Sequence: Synthetic coding sequence
atggcctctgtgcctgtgtactgcctgtgccgcctgccctatgatgtgacccgcttcatgattgaatgtgacatgtgccaggactggttccacggcagctgtgtgggcgtggaggaggagaaggctgctgacatcgacctgtaccactgccccaactgtgaggtgctgcacggccccagcatcatgaagaagagaagaggcagcagcaagggccatgacacccacaagggcaagcctgtgaagacaggcagccccacctttgtgcgggagctgcggagcaggacctttgacagcagtgatgaggtgatcctgaagcccactggaaaccagctgactgtggagttcctggaggagaacagcttctctgtgcccatcctggtgctgaagaaggatggcctgggcatgaccctgcccagccccagcttcaccgtgagagatgtggagcactacgtgggcagtgacaaggagattgatgtgattgatgtgacccggcaggccgactgcaagatgaagctgggggactttgtgaagtactactacagcggcaagcgggagaaggtgctgaatgtcatcagcctggagttcagtgacacccggctgagcaacctggtggagacccccaagatcgtgaggaagctgtcctgggtggagaacctgtggccagaagaatgtgtgtttgagcggcccaacgtgcagaagtactgcctgatgtctgtgcgggacagctacacagacttccacatcgactttggaggcacctctgtgtggtaccacgtgctgaagggggagaagatcttctacctgatccggcccaccaatgccaacctgaccctgtttgagtgctggagcagcagcagcaaccagaatgagatgttctttggagaccaggtggacaagtgctacaagtgcagcgtgaagcagggccagaccctcttcatccccaccggctggattcatgctgtgctgacccctgtggactgcctggccttcggcggcaacttcctgcacagcctgaacatcgagatgcagctgaaggcctatgaaattgagaagaggctgagcacagctgacctcttccgcttccccaactttgagaccatctgctggtacgtgggcaagcacatcctggacatcttccggggcctgcgggagaacagaagacacccagccagctacctggtgcatggaggcaaggccctgaacctggccttccgggcctggaccaggaaggaggccctgcctgaccatgaagatgagatccctgagaccgtgaggacagtgcagctgatcaaggacctggcccgggagatccggctggtggaggacatcttccagcagaatgtgggcaagaccagcaacatcttcggcctgcagaggatcttccctgctggcagcatccccctgaccaggcctgcccacagcacctctgtgtccatgagccggctgagcctgcccagcaagaatggcagcaagaagaagggcctgaagcccaaggagctgttcaagaaggccgagaggaagggcaaggagagcagcgccctgggccctgctggccagctgagctacaacctgatggacacctacagccaccaggccctgaagacaggcagcttccagaaggccaagttcaacatcaccggggcctgcctgaatgacagtgatgatgacagcccagacctggacctggatggaaatgaaagccccctggccctgctgatgagcaatggcagcaccaagagggtgaagagcctgagcaagagcaggaggaccaagatcgccaagaaggtggacaaggcccggctgatggccgagcaggtgatggaggatgaatttgacctggacagtgatgatgagctgcagattgatgagcggctgggcaaggagaaggccaccctcatcatccggcccaagttccccaggaagctgccccgggccaagccctgcagcgaccccaacagagtgcgggagcctggagaggtggagtttgacatcgaggaggactacaccacagatgaggacatggtggagggcgtggagggcaagctgggcaatggcagcggggccggcggcatcctggacctgctgaaggccagccggcaggtgggcggccctgactatgctgccctgacagaggccccagccagccccagcacccaggaggccatccagggcatgctgtgcatggccaacctgcagagcagcagcagcagccctgccaccagcagcctgcaggcctggtggacaggaggccaggacaggagcagcggcagcagcagcagcggcctgggcaccgtgagcaacagccctgccagccagaggaccccaggcaagaggcccatcaagaggcctgcctactggaggacagagagcgaggaggaggaggagaatgccagcctggatgagcaggacagcctgggcgcctgcttcaaggatgctgagtacatctaccccagcctggagagtgatgatgatgatcctgccctgaagagccggcccaagaagaagaagaacagtgatgatgccccctggagccccaaggcccgggtgacccccaccctgcccaagcaggacaggcctgtgcgggagggcaccagggtggccagcattgaaacaggcctggccgctgctgctgccaagctggcccagcaggagctgcagaaggcccagaagaagaagtacatcaagaagaagcccctgctgaaggaggtggagcagccccggccccaggacagcaacctgagcctgactgtgcctgcccccaccgtggccgccaccccccagctggtgaccagcagcagccccctgcccccacctgagcccaagcaggaggccctgagcggcagcctggccgaccacgagtacacagcccggcccaatgccttcggcatggcccaggccaacagaagcaccacccccatggcccctggggtcttcctgacccagaggcggcccagcgtgggcagccagagcaaccaggccggccagggcaagaggcccaagaagggcctggccacagccaagcagaggctgggccgcatcctgaagatccacagaaatggcaagctgctgctgtag

SEQ ID NO: 163726 - DNA, 2847 bp, Artificial Sequence
  Description of Artificial Sequence: Synthetic coding sequence
atggcctctgtgcctgtgtactgcctgtgccgcctgccctatgatgtgacccgcttcatgattgaatgtgacatgtgccaggactggttccacggcagctgtgtgggcgtggaggaggagaaggctgctgacatcgacctgtaccactgccccaactgtgaggtgctgcacggccccagcatcatgaagaagagaagaggcagcagcaagggccatgacacccacaagggcaagcctgtgaagacaggcagccccacctttgtgcgggagctgcggagcaggacctttgacagcagtgatgaggtgatcctgaagcccactggaaaccagctgactgtggagttcctggaggagaacagcttctctgtgcccatcctggtgctgaagaaggatggcctgggcatgaccctgcccagccccagcttcaccgtgagagatgtggagcactacgtgggcagtgacaaggagattgatgtgattgatgtgacccggcaggccgactgcaagatgaagctgggggactttgtgaagtactactacagcggcaagcgggagaaggtgctgaatgtcatcagcctggagttcagtgacacccggctgagcaacctggtggagacccccaagatcgtgaggaagctgtcctgggtggagaacctgtggccagaagaatgtgtgtttgagcggcccaacgtgcagaagtactgcctgatgtctgtgcgggacagctacacagacttccacatcgactttggaggcacctctgtgtggtaccacgtgctgaagggggagaagatcttctacctgatccggcccaccaatgccaacctgaccctgtttgagtgctggagcagcagcagcaaccagaatgagatgttctttggagaccaggtggacaagtgctacaagtgcagcgtgaagcagggccagaccctcttcatccccaccggctggattcatgctgtgctgacccctgtggactgcctggccttcggcggcaacttcctgcacagcctgaacatcgagatgcagctgaaggcctatgaaattgagaagaggctgagcacagctgacctcttccgcttccccaactttgagaccatctgctggtacgtgggcaagcacatcctggacatcttccggggcctgcgggagaacagaagacacccagccagctacctggtgcatggaggcaaggccctgaacctggccttccgggcctggaccaggaaggaggccctgcctgaccatgaagatgagatccctgagaccgtgaggacagtgcagctgatcaaggacctggcccgggagatccggctggtggagttcaacatcactggagcctgcctgaatgacagtgatgatgacagcccagacctggacctggatggaaatgaaagccccctggccctgctgatgagcaatggcagcaccaagagggtgaagagcctgagcaagagcaggaggaccaagatcgccaagaaggtggacaaggcccggctgatggccgagcaggtgatggaggatgaatttgacctggacagtgatgatgagctgcagattgatgagcggctgggcaaggagaaggccaccctcatcatccggcccaagttccccaggaagctgccccgggccaagccctgcagcgaccccaacagagtgcgggagcccggggaggtggagtttgatattgaggaggactacaccacagatgaggacatggtggagggcgtggagggcaagctgggcaatggaagtggagctgggggcatcctggacctgctgaaggccagccggcaggtgggcggccctgactatgctgccctgacagaggccccagccagccccagcacccaggaggccatccagggcatgctgtgcatggccaacctgcagagcagcagcagcagccctgccaccagcagcctgcaggcctggtggacaggaggccaggacaggagcagcggcagcagcagcagcggcctgggcaccgtgagcaacagccctgccagccagaggacccctgggaagaggcccatcaagaggcctgcctactggaggacagaaagtgaggaggaggaggagaatgccagcctggatgagcaggacagcctgggcgcctgcttcaaggatgctgagtacatctaccccagcctggagagtgatgatgatgatcctgccctgaagagccggcccaagaagaagaagaacagtgatgatgccccctggagccccaaggcccgggtgacccccaccctgcccaagcaggacaggcctgtgcgggagggcaccagggtggccagcattgagaccggcctggccgctgctgctgccaagctggcccagcaggagctgcagaaggcccagaagaagaagtacatcaagaagaagcccctgctgaaggaggtggagcagccccggccccaggacagcaacctgagcctgactgtgcctgcccccaccgtggccgccaccccccagctggtgaccagcagcagccccctgcccccacctgagcccaagcaggaggccctgagcggcagcctggccgaccacgagtacacagcccggcccaatgccttcggcatggcccaggccaacagaagcaccacccccatggcccctggggtcttcctgacccagaggcggcccagcgtgggcagccagagcaaccaggccggccagggcaagaggcccaagaagggcctggccacagccaagcagaggctgggccgcatcctgaagatccacagaaatggcaagctgctgctgcggcaggtgattgtgcaggctgaatgtcggcaggccatccacgagcccaagctgaagagaagagatgcccacccctag

SEQ ID NO: 163727 - DNA, 3183 bp, Artificial Sequence
  Description of Artificial Sequence: Synthetic coding sequence
atgaacagaagccgggccatcgtgcagaggggccgggtgctgcccccaccagcccccctggacaccaccaacctggccggccgccgcaccctgcagggccgggccaagatggcctctgtgcctgtgtactgcctgtgccgcctgccctatgatgtgacccgcttcatgattgaatgtgacatgtgccaggactggttccacggcagctgtgtgggcgtggaggaggagaaggctgctgacatcgacctgtaccactgccccaactgtgaggtgctgcacggccccagcatcatgaagaagagaagaggcagcagcaagggccatgacacccacaagggcaagcctgtgaagacaggcagccccacctttgtgcgggagctgcggagcaggacctttgacagcagtgatgaggtgatcctgaagcccactggaaaccagctgactgtggagttcctggaggagaacagcttctctgtgcccatcctggtgctgaagaaggatggcctgggcatgaccctgcccagccccagcttcaccgtgagagatgtggagcactacgtgggcagtgacaaggagattgatgtgattgatgtgacccggcaggccgactgcaagatgaagctgggggactttgtgaagtactactacagcggcaagcgggagaaggtgctgaatgtcatcagcctggagttcagtgacacccggctgagcaacctggtggagacccccaagatcgtgaggaagctgtcctgggtggagaacctgtggccagaagaatgtgtgtttgagcggcccaacgtgcagaagtactgcctgatgtctgtgcgggacagctacacagacttccacatcgactttggaggcacctctgtgtggtaccacgtgctgaagggggagaagatcttctacctgatccggcccaccaatgccaacctgaccctgtttgagtgctggagcagcagcagcaaccagaatgagatgttctttggagaccaggtggacaagtgctacaagtgcagcgtgaagcagggccagaccctcttcatccccaccggctggattcatgctgtgctgacccctgtggactgcctggccttcggcggcaacttcctgcacagcctgaacatcgagatgcagctgaaggcctatgaaattgagaagaggctgagcacagctgacctcttccgcttccccaactttgagaccatctgctggtacgtgggcaagcacatcctggacatcttccggggcctgcgggagaacagaagacacccagccagctacctggtgcatggaggcaaggccctgaacctggccttccgggcctggaccaggaaggaggccctgcctgaccatgaagatgagatccctgagaccgtgaggacagtgcagctgatcaaggacctggcccgggagatccggctggtggaggacatcttccagcagaatgtgggcaagaccagcaacatcttcggcctgcagaggatcttccctgctggcagcatccccctgaccaggcctgcccacagcacctctgtgtccatgagccggctgagcctgcccagcaagaatggcagcaagaagaagggcctgaagcccaaggagctgttcaagaaggccgagaggaagggcaaggagagcagcgccctgggccctgctggccagctgagctacaacctgatggacacctacagccaccaggccctgaagacaggcagcttccagaaggccaagttcaacatcaccggggcctgcctgaatgacagtgatgatgacagcccagacctggacctggatggaaatgaaagccccctggccctgctgatgagcaatggcagcaccaagagggtgaagagcctgagcaagagcaggaggaccaagatcgccaagaaggtggacaaggcccggctgatggccgagcaggtgatggaggatgaatttgacctggacagtgatgatgagctgcagattgatgagcggctgggcaaggagaaggccaccctcatcatccggcccaagttccccaggaagctgccccgggccaagccctgcagcgaccccaacagagtgcgggagcctggagaggtggagtttgacatcgaggaggactacaccacagatgaggacatggtggagggcgtggagggcaagctgggcaatggcagcggggccggcggcatcctggacctgctgaaggccagccggcaggtgggcggccctgactatgctgccctgacagaggccccagccagccccagcacccaggaggccatccagggcatgctgtgcatggccaacctgcagagcagcagcagcagccctgccaccagcagcctgcaggcctggtggacaggaggccaggacaggagcagcggcagcagcagcagcggcctgggcaccgtgagcaacagccctgccagccagaggaccccaggcaagaggcccatcaagaggcctgcctactggaggacagagagcgaggaggaggaggagaatgccagcctggatgagcaggacagcctgggcgcctgcttcaaggatgctgagtacatctaccccagcctggagagtgatgatgatgatcctgccctgaagagccggcccaagaagaagaagaacagtgatgatgccccctggagccccaaggcccgggtgacccccaccctgcccaagcaggacaggcctgtgcgggagggcaccagggtggccagcattgaaacaggcctggccgctgctgctgccaagctggcccagcaggagctgcagaaggcccagaagaagaagtacatcaagaagaagcccctgctgaaggaggtggagcagccccggccccaggacagcaacctgagcctgactgtgcctgcccccaccgtggccgccaccccccagctggtgaccagcagcagccccctgcccccacctgagcccaagcaggaggccctgagcggcagcctggccgaccacgagtacacagcccggcccaatgccttcggcatggcccaggccaacagaagcaccacccccatggcccctggggtcttcctgacccagaggcggcccagcgtgggcagccagagcaaccaggccggccagggcaagaggcccaagaagggcctggccacagccaagcagaggctgggccgcatcctgaagatccacagaaatggcaagctgctgctgtag

SEQ ID NO: 163728 - DNA, 912 bp, Artificial Sequence
  Description of Artificial Sequence: Synthetic coding sequence
atggacacctacagccaccaggccctgaagacaggcagcttccagaaggccaagttcaacatcaccggggcctgcctgaatgacagtgatgatgacagcccagacctggacctggatggaaatgaaagccccctggccctgctgatgagcaatggcagcaccaagagggtgaagagcctgagcaagagcaggaggaccaagatcgccaagaaggtggacaaggcccggctgatggccgagcaggtgatggaggatgaatttgacctggacagtgatgatgagctgcagattgatgagcggctgggcaaggagaaggccaccctcatcatccggcccaagttccccaggaagctgccccgggccagcctggccctgacccccacagaatttgtgaaccaggagaagctgagcctgaccctgcggaggaccatccagcagatgaggacctggtggaagggcctgaaggccagcctgggcatggtggtggccctggtggccttcctgatctgcagcaggcctgctggccgctggggagacctgaccatgctgcccagcccccggccccagctgctgcctgccctgcggcggcccagccgggcctgctgtgcctggcccacctgcagcccccaccggccccaccggctgcccctggcctgcaggcctgggggcctgggggaccgcatcgaggccgtgggcgccccagctgtgggctgggcccagtgcctgactgtgctgctgcccagcgccccccagggcagcggccccagcagcggccagcacactggagagccccgggccaggagaagaagaaggacccctgtgtggatgaacagaacagcctgggagcgggccagcaggatgcagagcatcagcatcctgcactggagcctgatgatgatgaccctgctgtag

SEQ ID NO: 163729 - DNA, 2862 bp, Artificial Sequence
  Description of Artificial Sequence: Synthetic coding sequence
attgtgcagaggggccgggtgctgcccccaccagcccccctggacaccaccaacctggccggccgccgcaccctgcagggccgggccaagatggcctctgtgcctgtgtactgcctgtgccgcctgccctatgatgtgacccgcttcatgattgaatgtgacatgtgccaggactggttccacggcagctgtgtgggcgtggaggaggagaaggctgctgacatcgacctgtaccactgccccaactgtgaggtgctgcacggccccagcatcatgaagaagagaagaggcagcagcaagggccatgacacccacaagggcaagcctgtgaagacaggcagccccacctttgtgcgggagctgcggagcaggacctttgacagcagtgatgaggtgatcctgaagcccactggaaaccagctgactgtggagttcctggaggagaacagcttctctgtgcccatcctggtgctgaagaaggatggcctgggcatgaccctgcccagccccagcttcaccgtgagagatgtggagcactacgtgggcagtgacaaggagattgatgtgattgatgtgacccggcaggccgactgcaagatgaagctgggggactttgtgaagtactactacagcggcaagcgggagaaggtgctgaatgtcatcagcctggagttcagtgacacccggctgagcaacctggtggagacccccaagatcgtgaggaagctgtcctgggtggagaacctgtggccagaagaatgtgtgtttgagcggcccaacgtgcagaagtactgcctgatgtctgtgcgggacagctacacagacttccacatcgactttggaggcacctctgtgtggtaccacgtgctgaagggggagaagatcttctacctgatccggcccaccaatgccaacctgaccctgtttgagtgctggagcagcagcagcaaccagaatgagatgttctttggagaccaggtggacaagtgctacaagtgcagcgtgaagcagggccagaccctcttcatccccaccggctggattcatgctgtgctgacccctgtggactgcctggccttcggcggcaacttcctgcacagcctgaacatcgagatgcagctgaaggcctatgaaattgagaagaggctgagcacagctgacctcttccgcttccccaactttgagaccatctgctggtacgtgggcaagcacatcctggacatcttccggggcctgcgggagaacagaagacacccagccagctacctggtgcatggaggcaaggccctgaacctggccttccgggcctggaccaggaaggaggccctgcctgaccatgaagatgagatccctgagaccgtgaggacagtgcagctgatcaaggacctggcccgggagatccggctggtggagttcaacatcactggagcctgcctgaatgacagtgatgatgacagcccagacctggacctggatggaaatgaaagccccctggccctgctgatgagcaatggcagcaccaagagggtgaagagcctgagcaagagcaggaggaccaagatcgccaagaaggtggacaaggcccggctgatggccgagcaggtgatggaggatgaatttgacctggacagtgatgatgagctgcagattgatgagcggctgggcaaggagaaggccaccctcatcatccggcccaagttccccaggaagctgccccgggccaagccctgcagcgaccccaacagagtgcgggagcccggggaggtggagtttgatattgaggaggactacaccacagatgaggacatggtggagggcgtggagggcaagctgggcaatggaagtggagctgggggcatcctggacctgctgaaggccagccggcaggtgggcggccctgactatgctgccctgacagaggccccagccagccccagcacccaggaggccatccagggcatgctgtgcatggccaacctgcagagcagcagcagcagccctgccaccagcagcctgcaggcctggtggacaggaggccaggacaggagcagcggcagcagcagcagcggcctgggcaccgtgagcaacagccctgccagccagaggacccctgggaagaggcccatcaagaggcctgcctactggaggacagaaagtgaggaggaggaggagaatgccagcctggatgagcaggacagcctgggcgcctgcttcaaggatgctgagtacatctaccccagcctggagagtgatgatgatgatcctgccctgaagagccggcccaagaagaagaagaacagtgatgatgccccctggagccccaaggcccgggtgacccccaccctgcccaagcaggacaggcctgtgcgggagggcaccagggtggccagcattgagaccggcctggccgctgctgctgccaagctggcccagcaggagctgcagaaggcccagaagaagaagtacatcaagaagaagcccctgctgaaggaggtggagcagccccggccccaggacagcaacctgagcctgactgtgcctgcccccaccgtggccgccaccccccagctggtgaccagcagcagccccctgcccccacctgagcccaagcaggaggccctgagcggcagcctggccgaccacgagtacacagcccggcccaatgccttcggcatggcccaggccaacagaagcaccacccccatggcccctggggtcttcctgacccagaggcggcccagcgtgggcagccagagcaaccaggccggccagggcaagaggcccaagaagggcctggccacagccaagcagaggctgggccgcatcctgaagatccacagaaatggcaagctgctgctgtag

SEQ ID NO: 163730 - DNA, 345 bp, Artificial Sequence
  Description of Artificial Sequence: Synthetic coding sequence
atggcctctgtgcctgtgtactgcctgtgccgcctgccctatgatgtgacccgcttcatgattgaatgtgacatgtgccaggactggttccacggcagctgtgtgggcgtggaggaggagaaggctgctgacatcgacctgtaccactgccccaactgtgaggtgctgcacggccccagcatcatgaagaagagaagaggcagcagcaagggccatgacacccacaagggcaagcctgtgaagacaggcagccccacctttgtgcgggagctgcggagcaggacctttgacagcagtgatgaggtgatcctgaagcccactggaaaccagctgactgtggagtag

SEQ ID NO: 163731 - DNA, 381 bp, Artificial Sequence
  Description of Artificial Sequence: Synthetic coding sequence
atggcctctgtgcctgtgtactgcctgtgccgcctgccctatgatgtgacccgcttcatgattgaatgtgacatgtgccaggactggttccacggcagctgtgtgggcgtggaggaggagaaggctgctgacatcgacctgtaccactgccccaactgtgaggtgctgcacggccccagcatcatgaagaagagaagaggcagcagcaagggccatgacacccacaagggcaagcctgtgaagacaggcagccccacctttgtgcgggagctgcggagcaggacctttgacagcagtgatgaggtgatcctgaagcccactggaaaccagctgactgtggagttcctggaggagaacagcttctctgtgcccatcctgtag

SEQ ID NO: 163732 - DNA, 294 bp, Artificial Sequence
  Description of Artificial Sequence: Synthetic coding sequence
atggcctctgtgcctgtgtactgcctgtgccgcctgccctatgatgtgacccgcttcatgattgaatgtgacatgtgccaggactggttccacggcagctgtgtgggcgtggaggaggagaaggctgctgacatcgacctgtaccactgccccaactgtgaggtgctgcacggccccagcatcatgaagaagagaagaggcagcagcaagggccatgacacccacaagggcaagcctgtgaagacaggcagccccacctttgtgcgggagctgcggagcaggacctttgattag

SEQ ID NO: 163733 - DNA, 348 bp, Artificial Sequence
  Description of Artificial Sequence: Synthetic coding sequence
atggcctctgtgcctgtgtactgcctgtgccgcctgccctatgatgtgacccgcttcatgattgaatgtgacatgtgccaggactggttccacggcagctgtgtgggcgtggaggaggagaaggctgctgacatcgacctgtaccactgccccaactgtgaggtgctgcacggccccagcatcatgaagaagagaagaggcagcagcaagggccatgacacccacaagggcaagcctgtgaagacaggcagccccacctttgtgcgggagctgcggagcaggacctttgacagcagtgatgaggtgatcctgaagcccactggaaaccagctgactgtggagttctag

SEQ ID NO: 163734 - DNA, 294 bp, Artificial Sequence; identical to SEQ ID NO: 163732
  Description of Artificial Sequence: Synthetic coding sequence

SEQ ID NO: 163735 - DNA, 447 bp, Artificial Sequence
  Description of Artificial Sequence: Synthetic coding sequence
atgaacagaagccgggccatcgtgcagaggggccgggtgctgcccccaccagcccccctggacaccaccaacctggccggccgccgcaccctgcagggccgggccaagatggcctctgtgcctgtgtactgcctgtgccgcctgccctatgatgtgacccgcttcatgattgaatgtgacatgtgccaggactggttccacggcagctgtgtgggcgtggaggaggagaaggctgctgacatcgacctgtaccactgccccaactgtgaggtgctgcacggccccagcatcatgaagaagagaagaggcagcagcaagggccatgacacccacaagggcaagcctgtgaagacaggcagccccacctttgtgcgggagctgcggagcaggacctttgacagcagtgatgaggtgatcctgaagcccactggaaaccagctgacctag

SEQ ID NO: 163736 - DNA, 2637 bp, Artificial Sequence
  Description of Artificial Sequence: Synthetic coding sequence
atggcctctgtgcctgtgtactgcctgtgccgcctgccctatgatgtgacccgcttcatgattgaatgtgacatgtgccaggactggttccacggcagctgtgtgggcgtggaggaggagaaggctgctgacatcgacctgtaccactgccccaactgtgaggtgctgcacggccccagcatcatgaagaagagaagaggcagcagcaagggccatgacacccacaagggcaagcctgtgaagacaggcagccccacctttgtgcgggagctgcggagcaggacctttgacagcagtgatgaggtgatcctgaagcccactggaaaccagctgactgtggagttcctggaggagaacagcttctctgtgcccatcctggtgctgaagaaggatggcctgggcatgaccctgcccagccccagcttcaccgtgagagatgtggagcactacgtgggcagtgacaaggagattgatgtgattgatgtgacccggcaggccgactgcaagatgaagctgggggactttgtgaagtactactacagcggcaagcgggagaaggtgctgaatgtcatcagcctggagttcagtgacacccggctgagcaacctggtggagacccccaagatcgtgaggaagctgtcctgggtggagaacctgtggccagaagaatgtgtgtttgagcggcccaacgtgcagaagtactgcctgatgtctgtgcgggacagctacacagacttccacatcgactttggaggcacctctgtgtggtaccacgtgctgaagggggagaagatcttctacctgatccggcccaccaatgccaacctgaccctgtttgagtgctggagcagcagcagcaaccagaatgagatgttctttggagaccaggtggacaagtgctacaagtgcagcgtgaagcagggccagaccctcttcatccccaccggctggattcatgctgtgctgacccctgtggactgcctggccttcggcggcaacttcctgcacagcctgaacatcgagatgcagctgaaggcctatgaaattgagaagaggctgagcacagctgacctcttccgcttccccaactttgagaccatctgctggtacgtgggcaagcacatcctggacatcttccggggcctgcgggagaacagaagacacccagccagctacctggtgcatggaggcaaggccctgaacctggccttccgggcctggaccaggaaggaggccctgcctgaccatgaagatgagatccctgagaccgtgaggacagtgcagctgatcaaggacctggcccgggagatccggctggtggaggacatcttccagcagaatgtgggcaagaccagcaacatcttcggcctgcagaggatcttccctgctggcagcatccccctgaccaggcctgcccacagcacctctgtgtccatgagccggctgagcctgcccagcaagaatggcagcaagaagaagggcctgaagcccaaggagctgttcaagaaggccgagaggaagggcaaggagagcagcgccctgggccctgctggccagctgagctacaacctgatggacacctacagccaccaggccctgaagacaggcagcttccagaaggccaagttcaacatcaccggggcctgcctgaatgacagtgatgatgacagcccagacctggacctggatggaaatgaaagccccctggccctgctgatgagcaatggcagcaccaagagggtgaagagcctgagcaagagcaggaggaccaagatcgccaagaaggtggacaaggcccggctgatggccgagcaggtgatggaggatgaatttgacctggacagtgatgatgagctgcagattgatgagcggctgggcaaggagaaggccaccctcatcatccggcccaagttccccaggaagctgccccgggccaagccctgcagcgaccccaacagagtgcgggagcctggagaggtggagtttgacatcgaggaggactacaccacagatgaggacatggtggagggcgtggagggctaccagacagccaccccagccccagcccagggcgccagcgaggccccagccagccccagcacccaggaggccatccagggcatgctgtgcatggccaacctgcagagcagcagcagcagccctgccaccagcagcctgcaggcctggtggacaggaggccaggacaggagcagcggcagcagcagcagcggcctgggcaccgtgagcaacagccctgccagccagaggacccctgggaagaggcccatcaagaggcctgcctactggaggacagaaagtgaggaggaggaggagaatgccagcctggatgagcaggacagcctgggcgcctgcttcaaggatgctgagtacatctaccccagcctggagagtgatgatgatgatcctgccctgaagagccggcccaagaagaagaagaacagtgatgatgccccctggagccccaaggcccgggtgacccccaccctgcccaagcaggacaggcctgtgcgggagggcaccagggtggccagcattgagaccggcctggccgctgctgctgccaagctggcccagcaggtgaagaagatgaagctgagcctgacagattctggatag

SEQ ID NO: 163737 - DNA, 417 bp, Artificial Sequence
  Description of Artificial Sequence: Synthetic coding sequence
atgaagctgcccatcttcatcgcagatgccttcaccgcccgggccttccggggcaacccagctgctgtgtgcctgctggagaatgagctggatgaggacatgcaccagaagatcgcccgggagatgaacctgtctgaaacagccttcatcaggaagctgcaccccacagacaactttgcccagaagaacatgaacagcaccctgacctttgtgaccctgagcggggagctgcgggcccggcgggcagaagatggcatcgtgctggacctgcccctgtacccagcccacccccaggacttccacgaggtggaggacctgatcaagacagccatcggcaacaccctggtgcaggacatctgctacagcccagacacccagaagctgctggtgcggctgagtgatgtgtacaacagatag

SEQ ID NO: 163738 - DNA, 867 bp, Artificial Sequence
  Description of Artificial Sequence: Synthetic coding sequence
atgaagctgcccatcttcatcgcagatgccttcaccgcccgggccttccggggcaacccagctgctgtgtgcctgctggagaatgagctggatgaggacatgcaccagaagatcgcccgggagatgaacctgtctgaaacagccttcatcaggaagctgcaccccacagacaactttgcccagagcagctgcttcggcctgcgctggttcaccccagccagcgaggtgcccctgtgtggccacgccaccctggccagcgctgctgtgctcttccacaagatcaagaacatgaacagcaccctgacctttgtgaccctgtctggagagctgcgggccaggagagcagaagatggcatcgtgctggacctgcccctgtacccagcccacccccaggacttccacgaggtggaggacctgatcaagacagccatcggcaacaccctggtgcaggacatctgctacagcccagacacccagaagctgctggtgcggctgagtgatgtgtacaacagaagcttcctggagaacctgaaggtgaacacagagaacctgctgcaggtggagaacacaggcaaggtgaagggcctcatcctgaccctgaagggggagcccggcggccagacccaggcctttgacttctacagccgctactttgccccctgggtgggcgtggccgaggaccctgtgacaggcagcgcccatgctgtgctgagcagctactggagccagcacctgggcaagaaggagatgcacgccttccagtgcagccacagaggaggagagctgggcatcagcctgcggccagatggccgggtggacatccggggcggcgctgctgtggtgctggagggcaccctgacagcctag

SEQ ID NO: 163739 - DNA, 768 bp, Artificial Sequence
  Description of Artificial Sequence: Synthetic coding sequence
atgcaccagaagatcgcccgggagatgaacctgtctgaaacagccttcatcaggaagctgcaccccacagacaactttgcccagagcagctgcttcggcctgcgctggttcaccccagccagcgaggtgcccctgtgtggccacgccaccctggccagcgctgctgtgctcttccacaagatcaagaacatgaacagcaccctgacctttgtgaccctgagcggggagctgcgggcccggcgggcagaagatggcatcgtgctggacctgcccctgtacccagcccacccccaggacttccacgaggtggaggacctgatcaagacagccatcggcaacaccctggtgcaggacatctgctacagcccagacacccagaagctgctggtgcggctgagtgatgtgtacaacagaagcttcctggagaacctgaaggtgaacacagagaacctgctgcaggtggagaacacaggcaaggtgaagggcctcatcctgaccctgaagggggagcccggcggccagacccaggcctttgacttctacagccgctactttgccccctgggtgggcgtggctgaagatcctgtgactggaagtgcccatgctgtgctgagcagctactggagccagcacctgggcaagaaggagatgcacgccttccagtgcagccaccggggcggggagctgggcatcagcctgcggccagatggccgggtggacatccggggcggcgctgctgtggtgctggagggcaccctgacagcctag

SEQ ID NO: 163740 - DNA, 867 bp, Artificial Sequence; identical to SEQ ID NO: 163738
  Description of Artificial Sequence: Synthetic coding sequence

SEQ ID NO: 163741 - DNA, 843 bp, Artificial Sequence
  Description of Artificial Sequence: Synthetic coding sequence
atgaagctgcccatcttcatcgcagatgccttcaccgcccgggccttccggggcaacccagctgctgtgtgcctgctggagaatgagctggatgaggacatgcaccagaagatcgcccgggagatgaacctgtctgaaacagccttcatcaggaagctgcaccccacagacaactttgcccagagcagctgcttcggcctgcgctggttcaccccagccagcgaggtgcccctgtgtggccacgccaccctggccagcgctgctgtgctcttccacaagatcaagaacatgaacagcaccctgacctttgtgaccctgtctggagagctgcgggccaggagagcagaagatggcatcgtgctggacctgcccctgtacccagcccacccccaggacttccacgaggtggaggacctgatcaagacagccatcggcaacaccctggtgcaggacatctgctacagcccagacacccagaagctgctggtgcggctgagtgatgtgtacaacagaagcttcctggagaacctgaaggtgaacacagagaacctgctgcaggtggagaacacaggcaaggtgaagggcctcatcctgaccctgaagggggagcccggcggccagacccaggcctttgacttctacagccgctactttgccccctgggtgggcgtggccgaggaccctgtgacaggcagcgcccatgctgtgctgagcagctactggagccagcacctgggcaagaaggagatgcacggccgcacagccctgtaccagttcctgttctacctgcccaacagcaagctggtgttcctgctgatctgcaccatccccctgaagatgtag

SEQ ID NO: 163742 - DNA, 1356 bp, Artificial Sequence
  Description of Artificial Sequence: Synthetic coding sequence
atggtgggcagcgccctgcggcggggggcccacgcctacgtgtacctggtgtccaaggccagccacatcagccggggccaccagcaccaggcctggggcagccggcccccagctgctgaatgtgccacccagagggcccctggctctgtggtggagctgctgggcaagagctacccccaggatgaccacagcaacctgaccaggaaggtgctgaccagggtgggcaggaacctgcacaaccagcagcaccaccccctgtggctgatcaaggagcgggtgaaggagcacttctacaagcagtatgtgggccgcttcggcacccccctcttctctgtgtatgacaacctgagccctgtggtgaccacctggcagaactttgacagcctgctgatcccagctgaccaccccagcaggaagaagggggacaactactacctgaacagaacccacatgctgcgggcccacaccagcgcccaccagtgggacctgctgcacgccggcctggatgccttcctggtggtgggagatgtgtacagaagagaccagattgacagccagcactaccccatcttccaccagctggaggccgtgcggctcttcagcaagcatgagctgtttgctggcatcaaggatggagagagcctgcagctgtttgagcagagcagccgcagcgcccacaagcaggagacccacaccatggaggccgtgaagctggtggagtttgacctgaagcagaccctgacccggctgatggcccacctgtttggagatgagctggagatccgctgggtggactgctacttccccttcacccaccccagctttgagatggagatcaacttccacggggagtggctggaggtgctgggctgcggcgtgatggagcagcagctggtgaacagcgctggggcccaggaccgcatcggctgggccttcggcctgggcctggagcggctggccatgatcctgtatgacatcccagacatccgcctcttctggtgtgaagatgagcgcttcctgaagcagttctgtgtgagcaacatcaaccagaaggtgaagttccagcccctgagcaagtacccagctgtgatcaatgacatctccttctggctgcccagcgagaactatgcagaaaatgacttctatgacctggtgaggaccatcggcggggacctggtggagaaggtggacctgattgacaagtttgtgcaccccaagacccacaagaccagccactgctaccgcatcacctaccgccacatggagaggaccctgagccagcgggaggtgcgccacatccaccaggccctgcaggaggccgctgtgcagctgctgggcgtggagggccgcttctag

SEQ ID NO: 163743 - DNA, 1356 bp, Artificial Sequence; identical to SEQ ID NO: 163742
  Description of Artificial Sequence: Synthetic coding sequence

SEQ ID NO: 163744 - DNA, 468 bp, Artificial Sequence
  Description of Artificial Sequence: Synthetic coding sequence
atgctgcgggcccacaccagcgcccaccagtgggacctgctgcacgccggcctggatgccttcctggtggtgggagatgtgtacagaagagaccagattgacagccagcactaccccatcttccaccagctggaggccgtgcggctcttcagcaagcatgagctgtttgctggcatcaaggatggagagagcctgcagctgtttgagcagagcagccgcagcgcccacaagcaggagacccacaccatggaggccgtgaagctggtggagtttgacctgaagcagaccctgacccggctgatggcccacctgtttggagatgagctggagatccgctgggtggactgctacttccccttcacccaccccagctttgagatggagatcaacttccacggggagtggctggaggtgctgggctgcggcgtgatggagcagcagctggtgaacagcggcggggccacctag

SEQ ID NO: 163745 - DNA, 306 bp, Artificial Sequence
  Description of Artificial Sequence: Synthetic coding sequence
ctctttgctggcatcaaggatggagagagcctgcagctgtttgagcagagcagccgcagcgcccacaagcaggagacccacaccatggaggccgtgaagctggtggagtttgacctgaagcagaccctgacccggctgatggcccacctgtttggagatgagctggagatccgctgggtggactgctacttccccttcacccaccccagctttgagatggagatcaacttccacggggagtggctggaggtgctgggctgcggcgtgatggagcagcagctggtgaacagcggcggggccacctag

SEQ ID NO: 163746 - DNA, 849 bp, Artificial Sequence
  Description of Artificial Sequence: Synthetic coding sequence
atgtctggagctgacaggagccccaatgctggggccgccccagacagcgcccctggccaggccgctgtggccagcgcctaccagagatttgagccccgggcctacctgaggaacaactatgccccacccaggggggacctgtgcaaccccaatggagtgggcccctggaagctgcgctgcctggcccagacctttgccactggagaggtgtctggccgcaccctgattgacatcggcagcggccccaccgtgtaccagctgctgagcgcctgcagccactttgaggacatcaccatgacagacttcctggaggtgaaccggcaggagctgggccgctggctgcaggaggagcccggggccttcaactggagcatgtacagccagcacgcctgcctgattgagggcaagggggagtgctggcaggacaaggagcggcagctgcgggcccgggtgaagagggtgctgcccattgatgtgcaccagccccagcccctgggcgccggcagccctgcccccctgcctgcagatgccctggtgtctgccttctgcctggaggccgtgtccccagacctggccagcttccagagggccctggaccacatcaccaccctgctgcggcctgggggccacctgctgctgattggagccctggaggagagctggtacctggccggggaggcccggctgactgtggtgcctgtgtctgaggaggaggtgcgggaggccctggtgcgcagcggctacaaggtgcgggacctgcggacctacatcatgcctgcccacctgcagacaggagtggatgatgtgaagggcgtcttctttgcctgggcccagaaggtgggcctgtag

SEQ ID NO: 163747 - DNA, 555 bp, Artificial Sequence
  Description of Artificial Sequence: Synthetic coding sequence
atgacagacttcctggaggtgaaccggcaggagctgggccgctggctgcaggaggagcccggggccttcaactggagcatgtacagccagcacgcctgcctgattgagggcaagggggagtgctggcaggacaaggagcggcagctgcgggcccgggtgaagagggtgctgcccattgatgtgcaccagccccagcccctgggcgccggcagccctgcccccctgcctgcagatgccctggtgtctgccttctgcctggaggccgtgtccccagacctggccagcttccagagggccctggaccacatcaccaccctgctgcggcctgggggccacctgctgctgattggagccctggaggagagctggtacctggccggggaggcccggctgactgtggtgcctgtgtctgaggaggaggtgcgggaggccctggtgcgcagcggctacaaggtgcgggacctgcggacctacatcatgcctgcccacctgcagacaggagtggatgatgtgaagggcgtcttctttgcctgggcccagaaggtgggcctgtag

SEQ ID NO: 163748 - DNA, 741 bp, Artificial Sequence
  Description of Artificial Sequence: Synthetic coding sequence
atggaggaggccaagagccagagcctggaggaggactttgagggccaggccacccacacaggccccaagggcgtcatcaatgactggaggaagttcaagctggagagccaggacagcgacagcatcccccccagcaagaaggagatcctgcggcagatgagcagcccccagagcagaaatggcaaggacagcaaggagcgggtgtccaggaagatgagcatccaggagtatgagctgatccacaaggagaaggaggatgagaactgcctgaggaagtaccgccggcagtgcatgcaggacatgcaccagaagctgagctttggccccaggtatggctttgtgtatgagctggagaccgggaagcagttcctggagaccatcgagaaggagctgaagatcaccaccatcgtggtgcacatctatgaagatggcatcaagggctgtgatgccctgaacagcagcctgacctgcctggccgctgagtaccccatcgtgaagttctgcaagatcaaggccagcaacacaggagctggggaccgcttcagcctggatgtgctgcccaccctgctgatctacaagggcggggagctgatcagcaacttcatctctgtggccgagcagtttgctgaggagttctttgctggagatgtggagagcttcctgaatgaatatggcctgctgcctgagcgggaggtgcacgtgctggagcacaccaagattgaggaggaggatgtggagtag

SEQ ID NO: 163749 - DNA, 741 bp, Artificial Sequence; identical to SEQ ID NO: 163748
  Description of Artificial Sequence: Synthetic coding sequence

SEQ ID NO: 163750 - DNA, 585 bp, Artificial Sequence
  Description of Artificial Sequence: Synthetic coding sequence
atgagcagcccccagagcagaaatggcaaggacagcaaggagcgggtgtccaggaagatgagcatccaggagtatgagctgatccacaaggagaaggaggatgagaactgcctgaggaagtaccgccggcagtgcatgcaggacatgcaccagaagctgagctttggccccaggtatggctttgtgtatgagctggagaccgggaagcagttcctggagaccatcgagaaggagctgaagatcaccaccatcgtggtgcacatctatgaagatggcatcaagggctgtgatgccctgaacagcagcctgacctgcctggccgctgagtaccccatcgtgaagttctgcaagatcaaggccagcaacacaggagctggggaccgcttcagcctggatgtgctgcccaccctgctgatctacaagggcggggagctgatcagcaacttcatctctgtggccgagcagtttgctgaggagttctttgctggagatgtggagagcttcctgaatgaatatggcctgctgcctgagcgggaggtgcacgtgctggagcacaccaagattgaggaggaggatgtggagtag

SEQ ID NO: 163751 - DNA, 585 bp, Artificial Sequence; identical to SEQ ID NO: 163750
  Description of Artificial Sequence: Synthetic coding sequence

SEQ ID NO: 163752 - DNA, 906 bp, Artificial Sequence
  Description of Artificial Sequence: Synthetic coding sequence
atgaccaccctggatgacaagctgctgggggagaagctgcagtactactacagcagcagtgaagatgaagattctgaccacgaggacaaggaccggggccgctgtgccccagccagcagctctgtgcctgctgaggccgagctggccggggagggcatctctgtgaacacaggccccaagggcgtcatcaatgactggaggcgcttcaagcagctggagacagagcagcgggaggagcagtgccgggagatggagcggctcatcaagaagctgtccatgacctgccgcagccacctggatgaggaggaggagcagcagaagcagaaggacctgcaggagaagatcagcggcaagatgaccctgaaggagtttgccatcatgaatgaagaccaggatgatgaggagttcctgcagcagtacaggaagcagaggatggaggagatgaggcagcagctgcacaagggcccccagttcaagcaggtgtttgagatcagcagcggggagggcttcctggacatgattgacaaggagcagaagagcatcgtcatcatggtgcacatctatgaagatggcatccctggaacagaggccatgaatggctgcatgatctgcctggccgctgagtacccagctgtgaagttctgcaaggtgaagagcagcgtcatcggggccagcagccagttcaccagaaatgccctgcctgccctgctgatctacaagggcggggagctgattggcaactttgtgcgggtgacagaccagctgggagatgacttctttgctgtggacctggaggccttcctgcaggagtttggcctgctgcctgagaaggaggtgctggtgctgacctctgtgaggaacagcgccacctgccacagcgaggacagcgacctggagattgattag

SEQ ID NO: 163753 - DNA, 330 bp, Artificial Sequence
  Description of Artificial Sequence: Synthetic coding sequence
tgactgcagtactactacagcagcagtgaagatgaggacagcgaccacgaggacaaggaccggggccgctgtgccccagccagcagctctgtgcctgctgaggccgagctggccggggagggcatctctgtgaacacaggccccaagggcgtcatcaatgactggaggcgcttcaagcagctggagacagagcagcgggaggagcagtgccgggagatggagcggctcatcaagaagctgtccatgacctgccgcagccacctggatgaggaggaggagcagcagaagcagaaggacctgcaggagaagatcagcggcaaggagaggtag

SEQ ID NO: 163754 - DNA, 276 bp, Artificial Sequence
  Description of Artificial Sequence: Synthetic coding sequence
tgatgtgccccagccagcagctctgtgcctgctgaggccgagctggccggggagggcatctctgtgaacacaggccccaagggcgtcatcaatgactggaggcgcttcaagcagctggagacagagcagcgggaggagcagtgccgggagatggagcggctcatcaagaagctgtccatgacctgccgcagccacctggatgaggaggaggagcagcagaagcagaaggacctgcaggagaagatcagcggcaagaagtcctgggccatcctgtag

SEQ ID NO: 163755 - DNA, 726 bp, Artificial Sequence
  Description of Artificial Sequence: Synthetic coding sequence
atgcaggaccccaatgaagacacagagtggaatgacatcctgcgggactttggcatcctgccccccaaggaggagagcaaggatgaaattgaggagatggtgctgcggctgcagaaggaggccatggtgaagccctttgagaagatgaccctggcccagctgaaggaggccgaggatgaatttgatgaggaggacatgcaggccgtggagacctacaggaagaagaggctgcaggagtggaaggccctgaagaagaagcagaagtttggagagctgcgggagatcagcggcaaccagtatgtgaatgaggtgaccaatgcagaagaagatgtgtgggtgatcatccacctgtaccgcagcagcatccccatgtgcctgctggtgaaccagcacctgagcctgctggccaggaagtttcctgagaccaagtttgtgaaggccatcgtgaacagctgcatccagcactaccatgacaactgcctgcccaccatctttgtgtacaagaatggccagatcgaggccaagttcatcggcatcattgaatgtggcggcatcaacctgaagctggaggagctggagtggaagctggccgaggtgggcgccatccagacagacctggaggagaaccccaggaaggacatggtggacatgatggtgagcagcatccggaacaccagcatccatgatgacagcgacagcagcaacagcgacaatgacaccaagtag

SEQ ID NO: 163756 - DNA, 720 bp, Artificial Sequence
  Description of Artificial Sequence: Synthetic coding sequence
atgcaggaccccaatgctgacacagagtggaatgacatcctgaggaagaagggcatcctgccccccaaggagagcctgaaggagctggaggaggaggccgaggaggagcagaggatcctgcagcagagcgtggtgaagacctatgaggacatgaccctggaggagctggaggaccatgaagatgagttcaatgaggaggatgagcgggccatcgagatgtacagaagaagaaggctggccgagtggaaggccaccaagctgaagaacaagtttggagaggtgctggagatcagcggcaaggactatgtgcaggaggtgaccaaggccggggagggcctgtgggtgatcctgcacctgtacaagcagggcatccccctgtgtgccctgatcaaccagcacctgagcggcctggccaggaagttcccagatgtgaagttcatcaaggccatcagcaccacctgcatccccaactacccagacaggaacctgcccaccatctttgtgtacctggagggggacatcaaggcccagttcatcggccccctggtgtttggaggcatgaacctgaccagagatgagctggagtggaagctgtctgagagcggggccatcatgacagacctggaggagaaccccaagaagcccattgaagatgtgctgctgagctctgtgagaagatctgtgctgatgaagagggacagcgacagcgagggggactag

SEQ ID NO: 163757 - DNA, 1104 bp, Artificial Sequence
  Description of Artificial Sequence: Synthetic coding sequence
atggatgcccagtgcagcgccaaggtgaatgccaggaagaggaggaaggaggcccctggccccaacggggccacagaagaagatggagtgcccagcaaggtgcagagatgtgctgtgggcctgcggcagcctgcccccttcagtgatgaaattgaggtggacttcagcaagccctacgtgcgggtgaccatggaggaggccagccggggcaccccctgtgagaggcctgtgcgggtgtatgcagatggcatctttgacctcttccacagcggccacgcccgggccctgatgcaggccaagaacctcttccccaacacctacctgattgtgggcgtgtgcagtgatgagctgacccacaacttcaagggcttcaccgtgatgaatgaaaatgaaagatatgatgctgtgcagcactgccgctacgtggatgaggtggtgagaaatgccccctggaccctgaccccagagttcctggccgagcacagaattgactttgtggcccatgatgacatcccctacagcagcgctggcagtgatgatgtgtacaagcacatcaaggaggccggcatgtttgcccccacccagaggacagagggcatcagcaccagtgacatcatcaccagaattgtgcgggactatgatgtgtatgcccggaggaacctgcagaggggctacacagccaaggagctgaatgtgtccttcatcaatgagaagaagtaccacctgcaggagcgggtggacaaggtgaagaagaaggtgaaggatgtggaggagaagagcaaggagtttgtgcagaaggtggaggagaagagcattgacctgatccagaagtgggaggagaagagccgggagttcatcggcagcttcctggagatgtttggacctgagggcgccctgaagcacatgctgaaggagggcaaaggaaggatgctgcaggccatcagccccaagcagagccccagcagcagccccacccgggagaggagccccagccccagcttccgctggcccttcagcggcaagaccagccccccctgcagccctgccaacctgagccgccacaaggctgctgcctatgacatcagtgaagatgaggaggactag

SEQ ID NO: 163758 - DNA, 882 bp, Artificial Sequence
  Description of Artificial Sequence: Synthetic coding sequence
atggatgcccagtgcagcgccaaggtgaatgccaggaagaggaggaaggaggcccctggccccaacggggccacagaagaagatggagtgcccagcaaggtgcagagatgtgctgtgggcctgcggcagcctgcccccttcagtgatgaaattgaggtggacttcagcaagccctacgtgcgggtgaccatggaggaggccagccggggcaccccctgtgagaggcctgtgcgggtgtatgcagatggcatctttgacctcttccacagcggccacgcccgggccctgatgcaggccaagaacctcttccccaacacctacctgattgtgggcgtgtgcagtgatgagctgacccacaacttcaagggcttcaccgtgatgaatgaaaatgaaagatatgatgctgtgcagcactgccgctacgtggatgaggtggtgagaaatgccccctggaccctgaccccagagttcctggccgagcacagaattgactttgtggcccatgatgacatcccctacagcagcgctggcagtgatgatgtgtacaagcacatcaaggaggccggcatgtttgcccccacccagaggacagagggcatcagcaccagtgacatcatcaccagaattgtgcgggactatgatgtgtatgcccggaggaacctgcagaggggctacacagccaaggagctgaatgtgtccttcatcaatgagaagaagtaccacctgcaggagcgggtggacaaggtgaagaagaaggtgaaggatgtggaggagaagagcaaggagtttgtgcagaaggtggaggagaagagcattgacctgatccagaagtgggaggagaagagccgggagttcatcggcagcttcctggagatgttttag

SEQ ID NO: 163759 - DNA, 402 bp, Artificial Sequence
  Description of Artificial Sequence: Synthetic coding sequence
atggatgcccagtgcagcgccaaggtgaatgccaggaagaggaggaaggaggcccctggccccaacggggccacagaagaagatggagtgcccagcaaggtgcagagatgtgctgtgggcctgcggcagcctgcccccttcagtgatgaaattgaggtggacttcagcaagccctacgtgcgggtgaccatggaggaggccagccggggcaccccctgtgagaggcctgtgcgggtgtatgcagatggcatctttgacctcttccacagcggccacgcccgggccctgatgcaggccaagaacctcttccccaacacctacctgattgtgggcgtgtgcagtgatgagctgacccacaacttcaagggcttcaccgtgatgaatgaaaatgaaagatactag

SEQ ID NO: 163760 - DNA, 987 bp, Artificial Sequence
  Description of Artificial Sequence: Synthetic coding sequence
atggatgcccagtgcagcgccaaggtgaatgccaggaagaggaggaaggaggcccctggccccaacggggccacagaggaggccagccggggcaccccctgtgagaggcctgtgcgggtgtatgcagatggcatctttgacctcttccacagcggccacgcccgggccctgatgcaggccaagaacctcttccccaacacctacctgattgtgggcgtgtgcagtgatgagctgacccacaacttcaagggcttcaccgtgatgaatgaaaatgaaagatatgatgctgtgcagcactgccgctacgtggatgaggtggtgagaaatgccccctggaccctgaccccagagttcctggccgagcacagaattgactttgtggcccatgatgacatcccctacagcagcgctggcagtgatgatgtgtacaagcacatcaaggaggccggcatgtttgcccccacccagaggacagagggcatcagcaccagtgacatcatcacccgcatcgtgcgggactatgatgtgtatgcccggaggaacctgcagaggggctacacagccaaggagctgaatgtgtccttcatcaatgagaagaagtaccacctgcaggagcgggtggacaaggtgaagaagaaggtgaaggatgtggaggagaagagcaaggagtttgtgcagaaggtggaggagaagagcattgacctgatccagaagtgggaggagaagagccgggagttcatcggcagcttcctggagatgtttggacctgagggcgccctgaagcacatgctgaaggagggcaagggccgcatgctgcaggccatcagccccaagcagagccccagcagcagccccacccgggagaggagccccagccccagcttccgctggcccttcagcggcaagaccagccccccctgcagccctgccaacctgagccgccacaaggccgccgcctatgacatcagtgaagatgaagaagattag

SEQ ID NO: 163761 - DNA, 1104 bp, Artificial Sequence; identical to SEQ ID NO: 163757
  Description of Artificial Sequence: Synthetic coding sequence

SEQ ID NO: 163762 - DNA, 348 bp, Artificial Sequence
  Description of Artificial Sequence: Synthetic coding sequence
atggatgcccagtgcagcgccaaggtgaatgccaggaagaggaggaaggaggcccctggccccaacggggccacagaagaagatggagtgcccagcaaggtgcagagatgtgctgtgggcctgcggcagcctgcccccttcagtgatgaaattgaggtggacttcagcaagccctacgtgcgggtgaccatggaggaggccagccggggcaccccctgtgagaggcctgtgcgggtgtatgcagatggcatctttgacctcttccacagcggccacgcccgggccctgatgcaggccaagaacctcttccccaacacctacctgattgtgggcgtgtgcagcgactag

SEQ ID NO: 163763 - DNA, 2250 bp, Artificial Sequence
  Description of Artificial Sequence: Synthetic coding sequence
atggaggccgagaccggcagctctgtggagaccgggaagaaggccaacagaggcaccagaattgccctggtggtgtttgtgggcggcaccctggtgctgggcaccatcctcttcctggtgtcccagggcctgctgagcctgcaggccaagcaggagtactgcctgaagccagagtgcatcgaggccgccgccgccatcctgagcaaggtgaacctgtctgtggacccctgtgacaacttcttccgctttgcctgtgatggctggatcagcaacaaccccatccctgaggacatgcccagctatggagtgtacccctggctgcggcacaacgtggacctgaagctgaaggagctgctggagaagagcatcagcagaagaagagacacagaggccatccagaaggccaagatcctgtacagcagctgcatgaatgagaaggccatcgagaaggcagatgccaagcccctgctgcacatcctgcggcacagccccttccgctggcctgtgctggagagcaacatcggccctgagggcgtgtggagcgagaggaagttcagcctgctgcagaccctggccaccttccggggccagtacagcaacagcgtcttcatccggctgtatgtgtccccagatgacaaggccagcaatgagcacatcctgaagctggaccaggccaccctgagcctggccgtgcgggaggactacctggacaacagcacagaggccaagagctacagagatgccctgtacaagttcatggtggacacagctgtgctgctgggcgccaacagcagcagagctgagcatgacatgaagtctgtgctgcggctggagatcaagattgctgagatcatgatcccccatgaaaatagaacatctgaggccatgtacaacaagatgaacatcagcgagctgagcgccatgatcccccagtttgactggctgggctacatcaagaaggtgattgacacccggctgtacccccacctgaaggacatcagccccagtgaaaatgtggtggtgcgggtgccccagtacttcaaggacctcttccgcatcctgggcagcgagaggaagaagaccatcgccaactacctggtgtggaggatggtgtacagccgcatccccaacctgagccgccgcttccagtaccgctggctggagttcagcagggtcatccagggcaccaccaccctgctgccccagtgggacaagtgtgtgaacttcatcgagagcgccctgccctacgtggtgggcaagatgtttgtggatgtgtacttccaggaggacaagaaggagatgatggaggagctggtggagggcgtgcgctgggccttcatcgacatgctggagaaggaaaatgagtggatggatgctggcaccaagaggaaggccaaggagaaggcccgggctgtgctggccaaggtgggctacccagagttcatcatgaatgacacccacgtgaatgaagacctgaaggccatcaagttcagcgaggccgactactttggaaatgtgctgcagaccaggaagtacctggcccagagcgacttcttctggctgaggaaggctgtgcccaagacagagtggttcaccaaccccaccaccgtgaatgccttctacagcgccagcaccaaccagatccgcttccctgctggggagctgcagaagcccttcttctggggcacagagtaccccaggagcctgtcctatggagccatcggcgtgattgtgggccacgagttcacccacggctttgacaacaatggaagaaaatatgacaagaatggaaacctggacccctggtggagcacagaaagtgaggagaagttcaaggagaagaccaagtgcatgatcaaccagtacagcaactactactggaagaaggccggcctgaatgtgaagggcaagaggaccctgggggagaacattgctgacaatggaggcctgcgggaggccttccgggcctacaggaagtggatcaatgaccggcggcagggcctggaggagcccctgctgcccggcatcaccttcaccaacaaccagctgttcttcctgtcctatgcccacgtgcgctgcaacagctacagacctgaggccgcccgggagcaggtgcagattggagcccacagccccccccagttccgggtgaatggagccatcagcaactttgaggagttccagaaggccttcaactgcccccccaacagcaccatgaacagaggcatggacagctgccgcctgtggtag

SEQ ID NO: 163764 - DNA, 1359 bp, Artificial Sequence
  Description of Artificial Sequence: Synthetic coding sequence
atgatccacctgcccaggcctcccaaggtgctgggcctgcagtttgactggctgggctacatcaagaaggtgattgacacccggctgtacccccacctgaaggacatcagccccagtgaaaatgtggtggtgcgggtgccccagtacttcaaggacctcttccgcatcctgggcagcgagaggaagaagaccatcgccaactacctggtgtggaggatggtgtacagccgcatccccaacctgagccgccgcttccagtaccgctggctggagttcagcagggtcatccagggcaccaccaccctgctgccccagtgggacaagtgtgtgaacttcattgaaagtgccctgccctacgtggtgggcaagatgtttgtggatgtgtacttccaggaggacaagaaggagatgatggaggagctggtggagggcgtgcgctgggccttcatcgacatgctggagaaggaaaatgagtggatggatgctggcaccaagaggaaggccaaggagaaggcccgggctgtgctggccaaggtgggctacccagagttcatcatgaatgacacccacgtgaatgaagacctgaaggccatcaagttcagcgaggccgactactttggaaatgtgctgcagaccaggaagtacctggcccagagcgacttcttctggctgaggaaggctgtgcccaagacagagtggttcaccaaccccaccaccgtgaatgccttctacagcgccagcaccaaccagatccgcttccctgctggggagctgcagaagcccttcttctggggcacagagtaccccaggagcctgtcctatggagccatcggggtcatcgtgggccacgagttcacccacggctttgacaacaacggcaggaaatatgacaagaatggaaacctggacccctggtggagcacagagagcgaggagaagttcaaggagaagaccaagtgcatgatcaaccagtacagcaactactactggaagaaggccggcctgaatgtgaagggcaagaggaccctgggagaaaatattgctgacaatggaggcctgcgggaggccttccgggcctacaggaagtggatcaatgaccggcggcagggcctggaggagcccctgctgcccggcatcaccttcaccaacaaccagctgttcttcctgtcctatgcccacgtgcgctgcaacagctacagacctgaggccgcccgggagcaggtgcagatcggggcccacagccccccccagttccgggtgaatggagccatcagcaactttgaggagttccagaaggccttcaactgcccccccaacagcaccatgaacagaggcatggacagctgccgcctgtggtag

SEQ ID NO: 163765 - DNA, 1959 bp, Artificial Sequence
  Description of Artificial Sequence: Synthetic coding sequence
atgcccagctatggagtgtacccctggctgcggcacaacgtggacctgaagctgaaggagctgctggagaagagcatcagcagaagaagagacacagaggccatccagaaggccaagatcctgtacagcagctgcatgaatgagaaggccatcgagaaggcagatgccaagcccctgctgcacatcctgcggcacagccccttccgctggcctgtgctggagagcaacatcggccctgagggcgtgtggagcgagaggaagttcagcctgctgcagaccctggccaccttccggggccagtacagcaacagcgtcttcatccggctgtatgtgtccccagatgacaaggccagcaatgagcacatcctgaagctggaccaggccaccctgagcctggccgtgcgggaggactacctggacaacagcacagaggccaagagctacagagatgccctgtacaagttcatggtggacacagctgtgctgctgggcgccaacagcagcagagctgagcatgacatgaagtctgtgctgcggctggagatcaagattgctgagatcatgatcccccatgagaacagaaccagcgaggccatgtacaacaagatgaacatcagcgagctgagcgccatgatcccccagtttgactggctgggctacatcaagaaggtgattgacacccggctgtacccccacctgaaggacatcagccccagtgaaaatgtggtggtgcgggtgccccagtacttcaaggacctcttccgcatcctgggcagcgagaggaagaagaccatcgccaactacctggtgtggaggatggtgtacagccgcatccccaacctgagccgccgcttccagtaccgctggctggagttcagcagggtcatccagggcaccaccaccctgctgccccagtgggacaagtgtgtgaacttcattgaaagtgccctgccctacgtggtgggcaagatgtttgtggatgtgtacttccaggaggacaagaaggagatgatggaggagctggtggagggcgtgcgctgggccttcatcgacatgctggagaaggaaaatgagtggatggatgctggcaccaagaggaaggccaaggagaaggcccgggctgtgctggccaaggtgggctacccagagttcatcatgaatgacacccacgtgaatgaagacctgaaggccatcaagttcagcgaggccgactactttggaaatgtgctgcagaccaggaagtacctggcccagagcgacttcttctggctgaggaaggctgtgcccaagacagagtggttcaccaaccccaccaccgtgaatgccttctacagcgccagcaccaaccagatccgcttccctgctggggagctgcagaagcccttcttctggggcacagagtaccccaggagcctgtcctatggagccatcggggtcatcgtgggccacgagttcacccacggctttgacaacaacggcaggaaatatgacaagaatggaaacctggacccctggtggagcacagagagcgaggagaagttcaaggagaagaccaagtgcatgatcaaccagtacagcaactactactggaagaaggccggcctgaatgtgaagggcaagaggaccctgggagaaaatattgctgacaatggaggcctgcgggaggccttccgggcctacaggaagtggatcaatgaccggcggcagggcctggaggagcccctgctgcccggcatcaccttcaccaacaaccagctgttcttcctgtcctatgcccacgtgcgctgcaacagctacagacctgaggccgcccgggagcaggtgcagatcggggcccacagccccccccagttccgggtgaatggagccatcagcaactttgaggagttccagaaggccttcaactgcccccccaacagcaccatgaacagaggcatggacagctgccgcctgtggtag

SEQ ID NO: 163766 - DNA, 2088 bp, Artificial Sequence
  Description of Artificial Sequence: Synthetic coding sequence
atggaggccgagaccggcagctctgtggagaccgggaagaaggccaacagaggcaccagaattgccctggtggtgtttgtgggcggcaccctggtgctgggcaccatcctcttcctggtgtcccagggcctgctgagcctgcaggccaagcaggagtactgcctgaagccagagtgcatcgaggccgccgccgccatcctgagcaaggtgaacctgtctgtggacccctgtgacaacttcttccgctttgcctgtgatggctggatcagcaacaaccccatccctgaggacatgcccagctatggagtgtacccctggctgcggcacaacgtggacctgaagctgaaggagctgctggagaagagcatcagcagaagaagagacacagaggccatccagaaggccaagatcctgtacagcagctgcatgaatgagaaggccatcgagaaggcagatgccaagcccctgctgcacatcctgcggcacagccccttccgctggcctgtgctggagagcaacatcggccctgagggcgtgtggagcgagaggaagttcagcctgctgcagaccctggccaccttccggggccagtacagcaacagcgtcttcatccggctgtatgtgtccccagatgacaaggccagcaatgagcacatcctgaagctggaccaggccaccctgagcctggccgtgcgggaggactacctggacaacagcacagaggccaagagctacagagatgccctgtacaagttcatggtggacacagctgtgctgctgggcgccaacagcagcagagctgagcatgacatgaagtctgtgctgcggctggagatcaagattgctgagatcatgatcccccatgaaaatagaacatctgaggccatgtacaacaagatgaacatcagcgagctgagcgccatgatcccccagtttgactggctgggctacatcaagaaggtgattgacacccggctgtacccccacctgaaggacatcagccccagtgaaaatgtggtggtgcgggtgccccagtacttcaaggacctcttccgcatcctgggcagcgagaggaagaagaccatcgccaactacctggtgtggaggatggtgtacagccgcatccccaacctgagccgccgcttccagtaccgctggctggagttcagcagggtcatccagggcaccaccaccctgctgccccagtgggacaagtgtgtgaacttcatcgagagcgccctgccctacgtggtgggcaagatgtttgtggatgtgtacttccaggaggacaagaaggagatgatggaggagctggtggagggcgtgcgctgggccttcatcgacatgctggagaaggaaaatgagtggatggatgctggcaccaagaggaaggccaaggagaaggcccgggctgtgctggccaaggtgggctacccagagttcatcatgaatgacacccacgtgaatgaagacctgaaggccatcaagttcagcgaggccgactactttggaaatgtgctgcagaccaggaagtacctggcccagagcgacttcttctggctgaggaaggctgtgcccaagacagagtggttcaccaaccccaccaccgtgaatgccttctacagcgccagcaccaaccagatccgcttccctgctggggagctgcagaagcccttcttctggggcacagagtaccccaggagcctgtcctatggagccatcggcgtgattgtgggccacgagttcacccacggctttgacaacaatggaagaaaatatgacaagaatggaaacctggacccctggtggagcacagaaagtgaggagaagttcaaggagaagaccaagtgcatgatcaaccagtacagcaactactactggaagaaggccggcctgaatgtgaagggcaagaggaccctgggggagaacattgctgacaatggaggcctgcgggaggccttccgggcctacaggaagtggatcaatgaccggcggcagggcctggaggagcccctgctgcccggcatcaccttcaccaacaaccagctgttcttcctgtcctatgcccacggccagtggtgcaactag

SEQ ID NO: 163767 - DNA, 888 bp, Artificial Sequence
  Description of Artificial Sequence: Synthetic coding sequence
atgcccagccccaggaggtccatggagggccggcccctgggcgtgtctgccagcagcagcagcagcagccctggcagccctgcccatggaggcggcggcggcggcagcagatttgagttccagagcctgctgagcagccgggccacagctgtggaccccacctgtgcccggctgcgggccagcgagagccctgtgcacagaagaggcagcttccccctggccgccgccggccccagccagagccctgccccacccctgcctgaggaggacaggatggacctgaaccccagcttcctgggcatcgccctgcggagcctgctggccatcgacctgtggctgagcaagaagctgggcgtgtgtgccggggagagcagctcctggggctctgtgcggcccctgatgaagctgctggagatcagcggccacggcatcccctggctgctgggcaccctgtactgcctgtgccgcagtgacagctgggccggccgggaggtgctgatgaacctgctgtttgccctgctgctggacctgctgctggtggccctgatcaagggcctggtgagaagaagaagacctgcccacaaccagatggacatgtttgtgaccctgtctgtggacaagtacagcttccccagcggccacgccacccgggccgccctgatgagccgcttcatcctgaaccacctggtgctggccatccccctgcgggtgctggtggtgctgtgggcctttgtgctgggcctgagccgggtgatgctgggccgccacaacgtgacagatgtggccttcggcttcttcctgggctacatgcagtacagcatcgtggactactgctggctgagcccccacaatgcccctgtgctcttcctgctgtggagccagaggtag

SEQ ID NO: 163768 - DNA, 615 bp, Artificial Sequence
  Description of Artificial Sequence: Synthetic coding sequence
atggacctgaaccccagcttcctgggcatcgccctgcggagcctgctggccatcgacctgtggctgagcaagaagctgggcgtgtgtgccggggagagcagctcctggggctctgtgcggcccctgatgaagctgctggagatcagcggccacggcatcccctggctgctgggcaccctgtactgcctgtgccgcagtgacagctgggccggccgggaggtgctgatgaacctgctgtttgccctgctgctggacctgctgctggtggccctgatcaagggcctggtgagaagaagaagacctgcccacaaccagatggacatgtttgtgaccctgtctgtggacaagtacagcttccccagcggccacgccaccagggctgccctgatgagccgcttcatcctgaaccacctggtgctggccatccccctgcgggtgctggtggtgctgtgggcctttgtgctgggcctgagccgggtgatgctgggccgccacaacgtgacagatgtggccttcggcttcttcctgggctacatgcagtacagcatcgtggactactgctggctgagcccccacaatgcccctgtgctcttcctgctgtggagccagaggtag

SEQ ID NO: 163769 - DNA, 645 bp, Artificial Sequence
  Description of Artificial Sequence: Synthetic coding sequence
atggagctggccgccggcagcttcagcgaggagcagttctgggaggcctgtgccgagctgcagcagcctgccctggccggggctgactggcagctgctggtggagaccagcggcatcagcatctaccgcctgctggacaagaagacaggcctgtatgagtacaaggtgtttggagtgctggaggactgcagccccaccctgctggccgacatctacatggacagcgactacaggaagcagtgggaccagtatgtgaaggagctgtatgagcaggagtgcaatggagaaacagtggtgtactgggaggtgaagtaccccttccccatgagcaacagagattatgtgtacctgcggcagaggcgggacctggacatggagggcaggaagatccacgtgatcctggcccggagcacctccatgccccagctgggggagaggtctggagtcatccgggtgaagcagtacaagcagagcctggccattgaaagtgatggcaagaagggcagcaaggtgttcatgtactactttgacaaccctgggggccagatccccagctggctgatcaactgggccgccaagaatggagtgcccaacttcctgaaggacatggcccgggcctgccagaactacctgaagaagacctag

SEQ ID NO: 163770 - DNA, 582 bp, Artificial Sequence
  Description of Artificial Sequence: Synthetic coding sequence
ctggcccagggccgctgcctgcaggtgacagctgtgcagatccagggctcctggaaggtgactggagtgcagccccagaagacaggcctgtatgagtacaaggtgtttggagtgctggaggactgcagccccaccctgctggccgacatctacatggacagcgactacaggaagcagtgggaccagtatgtgaaggagctgtatgagcaggagtgcaatggagagaccgtggtgtactgggaggtgaagtaccccttccccatgagcaacagagattatgtgtacctgcggcagaggcgggacctggacatggagggcaggaagatccacgtgatcctggcccggagcacctccatgccccagctgggggagaggtctggagtcatccgggtgaagcagtacaagcagagcctggccatcgagagtgatggcaagaagggcagcaaggtgttcatgtactactttgacaaccctgggggccagatccccagctggctgatcaactgggccgccaagaatggagtgcccaacttcctgaaggacatggcccgggcctgccagaactacctgaagaagacctag

SEQ ID NO: 163771 - DNA, 429 bp, Artificial Sequence
  Description of Artificial Sequence: Synthetic coding sequence
atggacagcgactacaggaagcagtgggaccagtatgtgaaggagctgtatgagcaggagtgcaatggagaaacagtggtgtactgggaggtgaagtaccccttccccatgagcaacagagattatgtgtacctgcggcagaggcgggacctggacatggagggcaggaagatccacgtgatcctggcccggagcacctccatgccccagctgggggagaggtctggagtcatccgggtgaagcagtacaagcagagcctggccattgaaagtgatggcaagaagggcagcaaggtgttcatgtactactttgacaaccctgggggccagatccccagctggctgatcaactgggccgccaagaatggagtgcccaacttcctgaaggacatggcccgggcctgccagaactacctgaagaagacctag

SEQ ID NO: 163772 - DNA, 564 bp, Artificial Sequence
  Description of Artificial Sequence: Synthetic coding sequence
atgcctgtggacctgagcaagtggagcggccccctgagcctgcaggaggtggatgagcagccccagcaccccctgcacgtgacctacgccggggctgctgtggatgagctgggcaaggtgctgacccccacccaggtgaagaaccggcccaccagcatctcctgggatggcctggacagcggcaagctgtacaccctggtgctgacagatcctgatgcccccagcaggaaggaccccaagtaccgggagtggcaccacttcctggtggtgaacatgaagggaaatgacatcagcagcggcaccgtgctgagtgactatgtgggcagcggcccccccaagggcaccggcctgcaccgctacgtgtggctggtgtatgagcaggaccggcccctgaagtgtgatgagcccatcctgagcaacagaagtggggaccaccggggcaagttcaaggtggccagcttcaggaagaagtatgagctgcgggcccctgtggccggcacctgctaccaggccgagtgggatgattatgtgcccaagctgtatgagcagctgagcggcaagtag

SEQ ID NO: 163773 - DNA, 468 bp, Artificial Sequence
  Description of Artificial Sequence: Synthetic coding sequence
atgcctgtggacctgagcaagtggagcggccccctgagcctgcaggaggtggatgagcagccccagcaccccctgcacgtgacctacgccggggctgctgtggatgagctgggcaaggtgctgacccccacccaggtgaagaaccggcccaccagcatctcctgggatggcctggacagcggcaagctgtacaccctggtgctgacagatcctgatgcccccagcaggaaggaccccaagtaccgggagtggcaccacttcctggtggtgaacatgaagggaaatgacatcagcagcggcaccgtgctgagtgactatgtgggcagcggcccccccaagggcaccggcctgcaccgctacgtgtggctggtgtatgagcaggaccggcccctgaagtgtgacttcagctgctgcctggccttcatcatcctgctgacccacagcgacctgtgctttgaccagatctag

SEQ ID NO: 163774 - DNA, 6135 bp, Artificial Sequence
  Description of Artificial Sequence: Synthetic coding sequence
atgtgccctgtggacttccacggcatcttccagctggatgaaagaagaagagatgctgtgattgccctgggcatcttcctgattgaaagtgacctgcagcacaaggactgtgtggtgccctacctgctgcggctgctgaagggcctgcccaaggtgtactgggtggaggagagcacagccaggaagggccgcggggccctgcctgtggccgagagcttctccttctgcctggtgaccctgctgagtgatgtggcctacagagaccccagcctgagagatgagatcctggaggtgctgctgcaggtgctgcacgtgctgctgggcatgtgccaggccctggagatccaggacaaggagtacctgtgcaagtatgccatcccctgcctgattggcatcagccgggccttcggccgctacagcaacatggaggagagcctgctgagcaagctgttccccaagatccccccccacagcctgcgggtgctggaggagctggagggcgtgagaagaagaagcttcaatgacttccgcagcatcctgcccagcaacctgctgactgtgtgccaggagggcaccctgaagaggaagaccagctctgtgagcagcatcagccaggtgtccccagagcggggcatgcccccacccagcagccctgggggcagcgccttccactactttgaggccagctgcctgcctgatggaacagccctggagcctgagtactacttcagcaccatcagcagcagcttctctgtgagccccctcttcaatggagtgacctacaaggagttcaacatccccctggagatgctgcgggagctgctgaacctggtgaagaagatcgtggaggaggccgtgctgaagagcctggatgccatcgtggcctctgtgatggaggccaaccccagcgctgacctgtactacaccagcttcagtgaccccctgtacctgaccatgttcaagatgctgcgggacaccctgtactacatgaaggacctgcccaccagctttgtgaaggagatccatgactttgtgctggagcagttcaacaccagccagggcgagctgcagaagatcctgcatgatgctgaccgcatccacaatgagctgagccccctgaagctgcgctgccaggccaatgctgcctgtgtggacctgatggtgtgggccgtgaaggatgagcagggcgctgagaacctgtgcatcaagctgtctgagaagctgcagagcaagaccagcagcaaggtgatcatcgcccacctgcccctgctgatctgctgcctgcagggcctgggccgcctgtgtgagcgcttccctgtggtggtgcacagcgtgacccccagcctgcgggacttcctggtgatccccagccctgtgctggtgaagctgtacaagtaccacagccagtaccacacagtggccggaaatgacatcaagatctctgtgaccaatgagcacagcgagagcaccctgaatgtgatgtctgggaagaagagccagcccagcatgtatgagcagctgcgggacatcgccatcgacaacatctgccgctgcctgaaggccggcctgactgtggaccctgtgattgtggaggccttcctggccagcctgagcaacagactctacatcagccaggagagtgacaaggatgcccacctgatcccagaccacaccatccgggccctgggccacatcgctgtggccctgcgggacacccccaaggtgatggagcccatcctgcagatcctgcagcagaagttctgccagccccccagccccctggatgtgctgatcatcgaccagctgggctgcctggtgatcaccggcaaccagtacatctaccaggaggtgtggaacctcttccagcagatctctgtgaaggccagctctgtggtgtacagcgccaccaaggactacaaggaccacggctaccgccactgcagcctggccgtcatcaatgccctggccaacattgctgccaacatccaggatgagcacctggtggatgagctgctgatgaacctgctggagctgtttgtgcagctgggcctggagggcaagagggccagcgagcgggccagcgagaagggccctgccctgaaggccagcagcagcgctggcaacctgggcgtgctgatccctgtgattgctgtgctgacccggcggctgccccccatcaaggaggccaagccccggctgcagaagctgttccgggacttctggctgtacagcgtgctgatgggctttgctgtggagggcagcggcctgtggccagaggagtggtatgagggcgtgtgtgagatcgccaccaagagccccctgctgaccttccccagcaaggagcccctgcggtctgtgctgcagtacaacagcgccatgaagaatgacacagtgaccccagctgagctgtctgagctgcggagcaccatcatcaacctgctggaccccccacctgaggtgtctgccctgatcaacaagctggactttgccatgagcacctacctgctgtctgtgtaccgcctggagtacatgagggtgctgcggagcacagatcctgaccgcttccaggtgatgttctgctactttgaggacaaggccatccagaaggacaagagcggcatgatgcagtgtgtgattgctgtggccgacaaggtgtttgatgccttcctgaacatgatggctgacaaggccaagaccaaggaaaatgaggaggagctggagagacatgcccagttcctgctggtgaacttcaaccacatccacaagaggatcagaagagtggccgacaagtacctgagcggcctggtggacaagttcccccacctgctgtggagcggcaccgtgctgaagaccatgctggacatcctgcagaccctgagcctgagcctgtctgctgacatccacaaggaccagccctactatgacatcccagatgccccctaccgcatcaccgtgcctgacacctatgaggcccgggagagcatcgtgaaggactttgctgcccgctgtggcatgatcctgcaggaggccatgaagtgggcccccaccgtgaccaagagccacctgcaggagtacctgaacaagcaccagaactgggtgtctggcctgagccagcacacaggcctggccatggccacagagagcatcctgcactttgctggctacaacaagcagaacaccaccctgggcgccacccagctgtctgagaggcctgcctgtgtgaagaaggactacagcaacttcatggccagcctgaacctgaggaacagatatgctggggaggtgtatggcatgatccgcttcagcggcaccaccggccagatgtctgacctgaacaagatgatggtgcaggacctgcacagcgccctggacaggagccacccccagcactacacccaggccatgttcaagctgacagccatgctgatcagcagcaaggactgtgacccccagctgctgcaccacctgtgctggggccccctgaggatgtttaatgaacatggcatggagacagccctggcctgctgggagtggctgctggccggcaaggatggagtggaggtgcccttcatgagggagatggccggggcctggcacatgacagtggagcagaagtttggcctcttctctgctgagatcaaggaggccgaccccctggccgccagcgaggccagccagcccaagccctgccccccagaggtgaccccccactacatctggattgacttcctggtgcagagatttgagatcgccaagtactgcagcagtgaccaggtggagatcttcagcagcctgctgcagaggtccatgagcctgaacatcggcggggccaagggctccatgaacagacatgtggccgccatcggcccccgcttcaagctgctgaccctgggcctgagcctgctgcacgcagatgtggtgcccaatgccaccatcagaaatgtgctgcgggagaagatctacagcacagcctttgactacttcagctgcccccccaagttccccacccagggcgagaagaggctgcgggaggacatcagcatcatgatcaagttctggacagccatgttcagtgacaagaagtacctgacagccagccagctggtgcccccagacaaccaggacaccaggagcaacctggacatcaccgtgggcagccggcagcaggccacccagggctggatcaacacctaccccctgagcagcggcatgagcaccatcagcaagaagagcggcatgagcaagaagaccaacagaggcagccagctgcacaagtactacatgaagaggaggaccctgctgctgagcctgctggccacagaaattgaaagactcatcacctggtacaaccccctgagcgcccctgagctggagctggaccaggccggggagaacagcgtggccaactggaggagcaagtacatcagcctgtctgagaagcagtggaaggacaacgtgaacctggcctggagcatcagcccctacctggccgtgcagctgcctgcccgcttcaagaacacagaggccatcggaaatgaggtgacccggctggtgcggctggaccccggggctgtgtctgatgtgcctgaggccatcaagttcctggtgacctggcacaccattgatgctgatgcccctgagctgagccacgtgctgtgctgggcccccacagatcctcccaccggcctgagctacttcagctccatgtacccaccccaccccctgacagcccagtatggagtgaaggtgctgcggagcttccccccagatgccatcctcttctacatcccccagatcgtgcaggccctgcgctatgacaagatgggctacgtgcgggagtacatcctgtgggccgccagcaagagccagctgctggcccaccagttcatctggaacatgaagaccaacatctacctggatgaggagggccaccagaaggaccctgacatcggggacctgctggaccagctggtggaggagatcaccggcagcctgagcggccctgccaaggacttctaccagcgggagtttgacttcttcaacaagatcaccaacgtgtctgccatcatcaagccctaccccaagggagatgagaggaagaaggcctgcctgagcgccctgtctgaggtgaaggtgcagcccggctgctacctgcccagcaaccctgaggccatcgtgctggacatcgactacaagagcggcacccccatgcagagcgctgccaaggccccctacctggccaagttcaaggtgaagagatgtggggtgtctgagctggagaaggagggcctgcgctgccgcagtgacagtgaagatgaatgttccacccaggaggctgatggccagaagatctcctggcaggccgccatcttcaaggtgggagatgactgccggcaggacatgctggccctgcagatcatcgacctcttcaagaacatcttccagctggtgggcctggacctgtttgtgttcccctacagagtggtggccacagcccctggctgtggggtgattgagtgcatcccagactgcaccagccgggaccagctgggccggcagacagactttggcatgtatgactacttcacccggcagtatggagatgagagcaccctggccttccagcaggcccgctacaacttcatccgctccatggccgcctacagcctgctgctcttcctgctgcagatcaaggacagacacaacggcaacatcatgctggacaagaagggccacatcatccacatcgactttggcttcatgtttgagagcagccctgggggcaacctgggctgggagccagacatcaagctgacagatgagatggtgatgatcatgggcggcaagatggaggccacccccttcaagtggttcatggagatgtgtgtgcggggctacctggccgtgcggccctacatggatgctgtggtgtccctggtgaccctgatgctggacaccggcctgccctgcttccggggccagaccatcaagctgctgaagcaccgcttcagccccaacatgacagagcgggaggccgccaacttcatcatgaaggtgatccagagctgcttcctgagcaacagaagcaggacctatgacatgatccagtactaccagaatgacatcccctactag

SEQ ID NO: 163775 - DNA, 1440 bp, Artificial Sequence
  Description of Artificial Sequence: Synthetic coding sequence
atggatgagaccagccccctggtgtccccagagcgggcccagcccccagactacaccttccccagcggcagcggggcccacttcccccaggtgcctgggggcgctgtgcgggtggccgctgctgctggcagcggccccagccccccaggcagccctggccatgaccgggagcggcagcccctgctggaccgggcccggggagctgctgcccagggccagacccagacagtggccgcccaggcccaggccctggccgcccaggccgctgctgctgcccacgccgcccaggcccaccgggagagaaatgagttccctgaggaccctgagtttgaggccgtggtgcggcaggccgagctggccatcgagcgctgcatcttccctgagcgcatctaccagggcagcagcggcagctactttgtgaaggacccccagggccgcatcatcgctgtgttcaagcccaagaatgaggagccctacggccacctgaaccccaagtggaccaagtggctgcagaagctgtgctgcccctgctgcttcggccgggactgcctggtgctgaaccagggctacctgtctgaggccggggccagcctggtggaccagaagctggagctgaacatcgtgcccaggaccaaggtggtgtacctggccagcgagaccttcaactacagcgccatcgacagagtgaagagccggggcaagaggctggccctggagaaggtgcccaaggtgggccagcgcttcaacagaattggcctgccccccaaggtgggcagcttccagctgtttgtggagggctacaaggatgctgactactggctgcggagatttgaagctgagcccctgcctgagaacaccaaccggcagctgctgctgcagtttgagcggctggtggtgctggactacatcatccggaacacagacagaggaaatgacaactggctgatcaagtatgactgccccatggacagcagcagcagccgggacacagactgggtggtggtgaaggagcccgtcatcaaggtggccgccatcgacaatggcctggccttccccctgaagcacccagacagctggagggcctaccccttctactgggcctggctgccccaggccaaggtgcccttcagccaggagatcaaggacctgatcctgcccaagatcagtgaccccaactttgtgaaggacctggaggaggacctgtatgagctgttcaagaaggaccccggctttgaccggggccagttccacaagcagattgctgtgatgaggggccagatcctgaacctgacccaggccctgaaggacaacaagagccccctgcacctggtgcagatgcctcctgtgattgtggagacagcccggagccaccagaggagcagcagcgagagctacacccagagcttccagagcaggaagcccttcttctcctggtggtag

SEQ ID NO: 163776 - DNA, 1350 bp, Artificial Sequence
  Description of Artificial Sequence: Synthetic coding sequence
atgctgggcccccaggtgtggagctctgtgcggcagggcctgagccgcagcctgagcagaaatgtgggcgtgtgggccagcggggagggcaagaaggtggacattgctggcatctacccacctgtgaccacccccttcaccgccacagctgaggtggactatggcaagctggaggagaacctgcacaagctgggcaccttccccttcagaggagctgtgggcggcgtgtgtgccctggccaacgtgctgggcgcccaggtgtgccagctggagcggctgtgctgcaccggccagtgggaggatgcccagaagctgcagcacaggctcatcgagcccaatgctgcccgcatcatcgctgtgttcaagcccaagaatgaggagccctacggccacctgaaccccaagtggaccaagtggctgcagaagctgtgctgcccctgctgcttcggccgggactgcctggtgctgaaccagggctacctgtctgaggccggggccagcctggtggaccagaagctggagctgaacatcgtgcccaggaccaaggtggtgtacctggccagcgagaccttcaactacagcgccatcgacagagtgaagagccggggcaagaggctggccctggagaaggtgcccaaggtgggccagcgcttcaacagaattggcctgccccccaaggtgggcagcttccagctgtttgtggagggctacaaggatgctgactactggctgcggagatttgaagctgagcccctgcctgagaacaccaaccggcagctgctgctgcagtttgagcggctggtggtgctggactacatcatccggaacacagacagaggaaatgacaactggctgatcaagtatgactgccccatggacagcagcagcagccgggacacagactgggtggtggtgaaggagcccgtcatcaaggtggccgccatcgacaatggcctggccttccccctgaagcacccagacagctggagggcctaccccttctactgggcctggctgccccaggccaaggtgcccttcagccaggagatcaaggacctgatcctgcccaagatcagtgaccccaactttgtgaaggacctggaggaggacctgtatgagctgttcaagaaggaccccggctttgaccggggccagttccacaagcagattgctgtgatgaggggccagatcctgaacctgacccaggccctgaaggacaacaagagccccctgcacctggtgcagatgcctcctgtgattgtggagacagcccggagccaccagaggagcagcagcgagagctacacccagagcttccagagcaggaagcccttcttctcctggtggtag

SEQ ID NO: 163777 - DNA, 1446 bp, Artificial Sequence
  Description of Artificial Sequence: Synthetic coding sequence
atggaggaccccagcgagccagaccggctggccagcgcagatggcggcagccctgaggaggaggaggatggagagcgggagcccctgctgcccagaattgcctgggcccaccccaggagaggagcccctggcagcgctgtgcggctgctggatgctgctggggaggagggggaggccggagatgaggagctgcccctgcccccaggagatgtgggcgtgagccgcagcagcagcgctgagctggacaggagcaggcctgctgtgtctgtgaccatcggcaccagcgagatgaatgccttcctggatgatcctgagtttgctgacatcatgctgcgggcagagcaggccatcgaggtgggcatcttccctgagcgcatcagccagggcagcagcggcagctactttgtgaaggaccccaagaggaagatcatcggggtcttcaagcccaagtctgaggagccctacggccagctgaaccccaagtggaccaagtatgtgcacaaggtgtgctgcccctgctgcttcggccggggctgcctgatccccaaccagggctacctgtctgaggccggggcctacctggtggacaacaagctgcacctgagcatcgtgcccaagaccaaggtggtgtggctggtgtctgagaccttcaactacaatgccatcgaccgggccaagagccggggcaagaagtatgccctggagaaggtgcccaaggtgggcaggaagttccacagaattggcctgccccccaagattggcagcttccagctgtttgtggagggctacaaggaggccgagtactggctgaggaagtttgaagctgaccccctgcctgagaacatcaggaagcagttccagagccagtttgagcggctggtgatcctggactacatcatccggaacacagacagaggaaatgacaactggctggtgcgctatgagaagcagaagtgtgagaaggagattgaccacaaggagagcaagtggattgatgatgaggagttcctgatcaagattgctgccatcgacaatggcctggccttccccttcaagcacccagatgagtggagggcctaccccttccactgggcctggctgccccaggccaaggtgcccttcagcgaggagatccggaacctgatcctgccctacatcagtgacatgaactttgtgcaggacctgtgtgaggacctgtatgagctgttcaagacagacaagggctttgacaaggccacctttgagagccagatgtctgtgatgaggggccagatcctgaacctgacccaggccctgagagatggcaagagccccttccagctggtgcagatcccctgcgtcatcgtggagaggagccagggcggcagccagggccgcatcgtgcacctgagcaacagcttcacccagacagtgaactgcaggaagcccttcttcagctcctggtag

SEQ ID NO: 163778 - DNA, 1353 bp, Artificial Sequence
  Description of Artificial Sequence: Synthetic coding sequence
atggaggaccccagcgagccagaccggctggccagcgcagatggcggcagccctgaggaggaggaggatggagagcgggagcccctgctgcccagaattgcctgggcccaccccaggagaggagcccctggcagcgctgtgcggctgctggacaggagcaggcctgctgtgtctgtgaccatcggcaccagcgagatgaatgccttcctggatgatcctgagtttgctgacatcatgctgcgggcagagcaggccatcgaggtgggcatcttccctgagcgcatcagccagggcagcagcggcagctactttgtgaaggaccccaagaggaagatcattggagtcttcaagcccaagtctgaggagccctacggccagctgaaccccaagtggaccaagtatgtgcacaaggtgtgctgcccctgctgcttcggccggggctgcctgatccccaaccagggctacctgtctgaggccggggcctacctggtggacaacaagctgcacctgagcatcgtgcccaagaccaaggtggtgtggctggtgtctgagaccttcaactacaatgccatcgaccgggccaagagccggggcaagaagtatgccctggagaaggtgcccaaggtgggcaggaagttccaccgcatcggcctgccccccaagattggcagcttccagctgtttgtggagggctacaaggaggccgagtactggctgaggaagtttgaggccgaccccctgcctgagaacatcaggaagcagttccagagccagtttgagcggctggtgatcctggactacatcatccggaacacagacagaggaaatgacaactggctggtgcgctatgagaagcagaagtgtgagaaggagattgaccacaaggagagcaagtggattgatgatgaggagttcctgatcaagattgctgccatcgacaatggcctggccttccccttcaagcacccagatgagtggagggcctaccccttccactgggcctggctgccccaggccaaggtgcccttcagcgaggagatccggaacctgatcctgccctacatcagtgacatgaactttgtgcaggacctgtgtgaggacctgtatgagctgttcaagacagacaagggctttgacaaggccacctttgagagccagatgtctgtgatgaggggccagatcctgaacctgacccaggccctgagagatggcaagagccccttccagctggtgcagatcccctgtgtgattgtggagaggagccagggcggcagccagggcagaattgtgcacctgagcaacagcttcacccagacagtgaactgcaggaagcccttcttcagctcctggtag

SEQ ID NO: 163779 - DNA, 6135 bp, Artificial Sequence; identical to SEQ ID NO: 163774
  Description of Artificial Sequence: Synthetic coding sequence

SEQ ID NO: 163780 - DNA, 2565 bp, Artificial Sequence
  Description of Artificial Sequence: Synthetic coding sequence
atgagggagatggccggggcctggcacatgacagtggagcagaagtttggcctcttctctgctgagatcaaggaggccgaccccctggccgccagcgaggccagccagcccaagccctgccccccagaggtgaccccccactacatctggattgacttcctggtgcagagatttgagatcgccaagtactgcagcagtgaccaggtggagatcttcagcagcctgctgcagaggtccatgagcctgaacatcggcggggccaagggctccatgaacagacatgtggccgccatcggcccccgcttcaagctgctgaccctgggcctgagcctgctgcacgcagatgtggtgcccaatgccaccatcagaaatgtgctgcgggagaagatctacagcacagcctttgactacttcagctgcccccccaagttccccacccagggcgagaagaggctgcgggaggacatcagcatcatgatcaagttctggacagccatgttcagtgacaagaagtacctgacagccagccagctggtgcccccagacaaccaggacaccaggagcaacctggacatcaccgtgggcagccggcagcaggccacccagggctggatcaacacctaccccctgagcagcggcatgagcaccatcagcaagaagagcggcatgagcaagaagaccaacagaggcagccagctgcacaagtactacatgaagaggaggaccctgctgctgagcctgctggccacagaaattgaaagactcatcacctggtacaaccccctgagcgcccctgagctggagctggaccaggccggggagaacagcgtggccaactggaggagcaagtacatcagcctgtctgagaagcagtggaaggacaacgtgaacctggcctggagcatcagcccctacctggccgtgcagctgcctgcccgcttcaagaacacagaggccatcggaaatgaggtgacccggctggtgcggctggaccccggggctgtgtctgatgtgcctgaggccatcaagttcctggtgacctggcacaccattgatgctgatgcccctgagctgagccacgtgctgtgctgggcccccacagatcctcccaccggcctgagctacttcagctccatgtacccaccccaccccctgacagcccagtatggagtgaaggtgctgcggagcttccccccagatgccatcctcttctacatcccccagatcgtgcaggccctgcgctatgacaagatgggctacgtgcgggagtacatcctgtgggccgccagcaagagccagctgctggcccaccagttcatctggaacatgaagaccaacatctacctggatgaggagggccaccagaaggaccctgacatcggggacctgctggaccagctggtggaggagatcaccggcagcctgagcggccctgccaaggacttctaccagcgggagtttgacttcttcaacaagatcaccaacgtgtctgccatcatcaagccctaccccaagggagatgagaggaagaaggcctgcctgagcgccctgtctgaggtgaaggtgcagcccggctgctacctgcccagcaaccctgaggccatcgtgctggacatcgactacaagagcggcacccccatgcagagcgctgccaaggccccctacctggccaagttcaaggtgaagagatgtggggtgtctgagctggagaaggagggcctgcgctgccgcagtgacagtgaagatgaatgttccacccaggaggctgatggccagaagatctcctggcaggccgccatcttcaaggtgggagatgactgccggcaggacatgctggccctgcagatcatcgacctcttcaagaacatcttccagctggtgggcctggacctgtttgtgttcccctacagagtggtggccacagcccctggctgtggggtgattgagtgcatcccagactgcaccagccgggaccagctgggccggcagacagactttggcatgtatgactacttcacccggcagtatggagatgagagcaccctggccttccagcaggcccgctacaacttcatccgctccatggccgcctacagcctgctgctcttcctgctgcagatcaaggacagacacaacggcaacatcatgctggacaagaagggccacatcatccacatcgactttggcttcatgtttgagagcagccctgggggcaacctgggctgggagccagacatcaagctgacagatgagatggtgatgatcatgggcggcaagatggaggccacccccttcaagtggttcatggagatgtgtgtgcggggctacctggccgtgcggccctacatggatgctgtggtgtccctggtgaccctgatgctggacaccggcctgccctgcttccggggccagaccatcaagctgctgaagcaccgcttcagccccaacatgacagagcgggaggccgccaacttcatcatgaaggtgatccagagctgcttcctgagcaacagaagcaggacctatgacatgatccagtactaccagaatgacatcccctactag

SEQ ID NO: 163781 - DNA, 264 bp, Artificial Sequence
  Description of Artificial Sequence: Synthetic coding sequence
atgtgccctgtggacttccacggcatcttccagctggatgaaagaagaagagatgctgtgattgccctgggcatcttcctgattgaaagtgacctgcagcacaaggactgtgtggtgccctacctgctgcggctgctgaagggcctgcccaaggtgtactgggtggaggagagcacagccaggaagggccgcggggccctgcctgtggccgagagcttctccttctgcctggtgaccctgctgagtgatgtggcctacagatag

SEQ ID NO: 163782 - DNA, 1959 bp, Artificial Sequence
  Description of Artificial Sequence: Synthetic coding sequence
atgagcggccagagcctgacagaccgcatcacagctgcccagcacagcgtgacaggcagcgctgtgtccaagacagtgtgcaaggccaccacccatgagatcatgggccccaagaagaagcacctggactacctgatccagtgcaccaatgagatgaatgtgaacatcccccagctggccgacagcctgtttgagaggaccaccaacagctcctgggtggtggtgttcaagagcctcatcaccacccaccacctgatggtgtatggaaatgaacgcttcatccagtacctggccagcaggaacaccctcttcaacctgagcaacttcctggacaagagcggcctgcagggctatgacatgagcaccttcatccgccgctacagccgctacctgaatgagaaggctgtgtcctaccggcaggtggcctttgacttcaccaaggtgaagagaggagcagatggagtgatgaggaccatgaacacagagaagctgctgaagacagtgcccatcatccagaaccagatggatgccctgctggacttcaacgtgaacagcaatgagctgaccaacggggtcatcaatgctgccttcatgctgctcttcaaggatgccatccggctgtttgctgcctacaatgaaggcatcatcaacctgctggagaagtactttgacatgaagaagaaccagtgcaaggagggcctggacatctacaagaagttcctgaccaggatgacccgcatcagcgagttcctgaaggtggccgagcaggtgggcatcgacagaggagacatcccagacctgagccaggcccccagcagcctgctggatgccctggagcagcacctggccagcctggagggcaagaagatcaaggacagcacagctgccagccgggccaccaccctgagcaatgctgtgagcagcctggccagcacaggcctgagcctgaccaaggtggatgagcgggagaagcaggccgccctggaggaggagcaggcccggctgaaggccctgaaggagcagaggctgaaggagctggccaagaagccccacaccagcctgaccacagctgccagccctgtgtccaccagcgctgggggcatcatgacagccccagccatcgacatcttcagcacccccagcagcagcaacagcaccagcaagctgcccaatgacctgctggacctgcagcagcccaccttccaccccagcgtgcaccccatgagcacagccagccaggtggccagcacctggggagaccccttcagcgccaccgtggatgctgtggatgatgccatccccagcctgaaccccttcctgaccaagagcagtggagatgtgcacctgagcatcagcagtgatgtgtccaccttcaccaccaggacccccacccatgagatgtttgtgggcttcacccccagccctgtggcccagccccaccccagcgctggcctgaatgtggactttgaatctgtgtttggaaacaagagcaccaacgtgattgtggacagcggcggctttgatgagctgggcggcctgctgaagcccaccgtggccagccagaaccagaacctgcctgtggccaagctgccccccagcaagctggtgtctgatgacctggacagcagcctggccaacctggtgggcaacctgggcattggaaatggcaccaccaagaatgatgtgaactggagccagcctggagagaagaagctgactggaggcagcaactggcagcccaaggtggcccccaccacagcctggaatgctgccaccatggcccctcctgtgatggcctacccagccaccacccccaccggcatgattggctacggcatccccccccagatgggctctgtgcctgtgatgacccagcccaccctcatctacagccagcctgtgatgaggcctcccaacccctttggacctgtgtctggggcccagatccagttcatgtag

SEQ ID NO: 163783 - DNA, 1959 bp, Artificial Sequence; identical to SEQ ID NO: 163782
  Description of Artificial Sequence: Synthetic coding sequence

SEQ ID NO: 163784 - DNA, 1938 bp, Artificial Sequence
  Description of Artificial Sequence: Synthetic coding sequence
atgagcggccagagcctgacagaccgcatcacagctgcccagcacagcgtgacaggcagcgctgtgtccaagacagtgtgcaaggccaccacccatgagatcatgggccccaagaagaagcacctggactacctgatccagtgcaccaatgagatgaatgtgaacatcccccagctggccgacagcctgtttgagaggaccaccaacagctcctgggtggtggtgttcaagagcctcatcaccacccaccacctgatggtgtatggaaatgaacgcttcatccagtacctggccagcaggaacaccctcttcaacctgagcaacttcctggacaagagcggcctgcagggctatgacatgagcaccttcatccgccgctacagccgctacctgaatgagaaggctgtgtcctaccggcaggtggcctttgacttcaccaaggtgaagagaggagcagatggagtgatgaggaccatgaacacagagaagctgctgaagacagtgcccatcatccagaaccagatggatgccctgctggacttcaacgtgaacagcaatgagctgaccaacggggtcatcaatgctgccttcatgctgctcttcaaggatgccatccggctgtttgctgcctacaatgaaggcatcatcaacctgctggagaagtactttgacatgaagaagaaccagtgcaaggagggcctggacatctacaagaagttcctgaccaggatgacccgcatcagcgagttcctgaaggtggccgagcaggtgggcatcgacagaggagacatcccagacctgagccaggcccccagcagcctgctggatgccctggagcagcacctggccagcctggagggcaagaagatcaaggacagcacagctgccagccgggccaccaccctgagcaatgctgtgagcagcctggccagcacaggcctgagcctgaccaaggtggatgagcgggagaagcaggccgccctggaggaggagcaggcccggctgaaggccctgaaggagcagaggctgaaggagctggccaagaagccccacaccagcctgaccacagctgccagccctgtgtccaccagcgctgggggcatcatgacagccccagccatcgacatcttcagcacccccagcagcagcaacagcaccagcaagctgcccaatgacctgctggacctgcagcagcccaccttccaccccagcgtgcaccccatgagcacagccagccaggtggccagcacctggggagatgctgtggatgatgccatccccagcctgaaccccttcctgaccaagagcagtggagatgtgcacctgagcatcagcagtgatgtgtccaccttcaccaccaggacccccacccatgagatgtttgtgggcttcacccccagccctgtggcccagccccaccccagcgctggcctgaatgtggactttgagagcgtgtttggaaacaagagcaccaacgtcatcgtggacagcggcggctttgatgagctgggcggcctgctgaagcccaccgtggccagccagaaccagaacctgcctgtggccaagctgccccccagcaagctggtgtctgatgacctggacagcagcctggccaacctggtgggcaacctgggcattggaaatggcaccaccaagaatgatgtgaactggagccagcccggggagaagaagctgaccggcggcagcaactggcagcccaaggtggcccccaccacagcctggaatgctgccaccatggcccctcctgtgatggcctacccagccaccacccccaccggcatgattggctacggcatccccccccagatgggctctgtgcctgtgatgacccagcccaccctcatctacagccagcctgtgatgaggcctcccaaccccttcggccctgtgtctggggcccagatccagttcatgtag

SEQ ID NO: 163785 - DNA, 1833 bp, Artificial Sequence
  Description of Artificial Sequence: Synthetic coding sequence
atgagcggccagagcctgacagaccgcatcacagctgcccagcacagcgtgacaggcagcgctgtgtccaagacagtgtgcaaggccaccacccatgagatcatgggccccaagaagaagcacctggactacctgatccagtgcaccaatgagatgaatgtgaacatcccccagctggccgacagcctgtttgagaggaccaccaacagctcctgggtggtggtgttcaagagcctcatcaccacccaccacctgatggtgtatggaaatgaacgcttcatccagtacctggccagcaggaacaccctcttcaacctgagcaacttcctggacaagagcggcctgcagggctatgacatgagcaccttcatccgccgctacagccgctacctgaatgagaaggctgtgtcctaccggcaggtggcctttgacttcaccaaggtgaagagaggagcagatggagtgatgaggaccatgaacacagagaagctgctgaagacagtgcccatcatccagaaccagatggatgccctgctggacttcaacgtgaacagcaatgagctgaccaacggggtcatcaatgctgccttcatgctgctcttcaaggatgccatccggctgtttgctgcctacaatgaaggcatcatcaacctgctggagaagtactttgacatgaagaagaaccagtgcaaggagggcctggacatctacaagaagttcctgaccaggatgacccgcatcagcgagttcctgaaggtggccgagcaggtgggcatcgacagaggagacatcccagacctgagccaggcccccagcagcctgctggatgccctggagcagcacctggccagcctggagggcaagaagatcaaggacagcacagctgccagccgggccaccaccctgagcaatgctgtgagcagcctggccagcacaggcctgagcctgaccaaggtggatgagcgggagaagcaggccgccctggaggaggagcaggcccggctgaaggccctgaaggagcagaggctgaaggagctggccaagaagccccacaccagcctgaccacagctgccagccctgtgtccaccagcgctgggggcatcatgacagccccagccatcgacatcttcagcacccccagcagcagcaacagcaccagcaagctgcccaatgacctgctggacctgcagcagcccaccttccaccccagcgtgcaccccatgagcacagccagccaggtggccagcacctggggcggcttcacccccagccctgtggcccagccccaccccagcgctggcctgaatgtggactttgaatctgtgtttggaaacaagagcaccaacgtgattgtggacagcggcggctttgatgagctgggcggcctgctgaagcccaccgtggccagccagaaccagaacctgcctgtggccaagctgccccccagcaagctggtgtctgatgacctggacagcagcctggccaacctggtgggcaacctgggcattggaaatggcaccaccaagaatgatgtgaactggagccagcctggagagaagaagctgactggaggcagcaactggcagcccaaggtggcccccaccacagcctggaatgctgccaccatgaatggcatgcacttcccccagtatgcccctcctgtgatggcctacccagccaccacccccaccggcatgattggctacggcatccccccccagatgggctctgtgcctgtgatgacccagcccaccctcatctacagccagcctgtgatgaggcctcccaacccctttggacctgtgtctggggcccagatccagttcatgtag

SEQ ID NO: 163786 - DNA, 1656 bp, Artificial Sequence
  Description of Artificial Sequence: Synthetic coding sequence
atgaatgtgaacatcccccagctggccgacagcctgtttgagaggaccaccaacagctcctgggtggtggtgttcaagagcctcatcaccacccaccacctgatggtgtatggaaatgaacgcttcatccagtacctggccagcaggaacaccctcttcaacctgagcaacttcctggacaagagcggcctgcagggctatgacatgagcaccttcatccgccgctacagccgctacctgaatgagaaggctgtgtcctaccggcaggtggcctttgacttcaccaaggtgaagagaggagcagatggagtgatgaggaccatgaacacagagaagctgctgaagacagtgcccatcatccagaaccagatggatgccctgctggacttcaacgtgaacagcaatgagctgaccaatggagtcatcaatgctgccttcatgctgctcttcaaggatgccatccggctgtttgctgcctacaatgaaggcatcatcaacctgctggagaagtactttgacatgaagaagaaccagtgcaaggagggcctggacatctacaagaagttcctgaccaggatgacccgcatcagcgagttcctgaaggtggccgagcaggtgggcatcgacagaggagacatcccagacctgagccaggcccccagcagcctgctggatgccctggagcagcacctggccagcctggagggcaagaagatcaaggacagcacagctgccagccgggccaccaccctgagcaatgctgtgagcagcctggccagcacaggcctgagcctgaccaaggtggatgagcgggagaagcaggccgccctggaggaggagcaggcccggctgaaggccctgaaggagcagaggctgaaggagctggccaagaagccccacaccagcctgaccacagctgccagccctgtgtccaccagcgctgggggcatcatgacagccccagccatcgacatcttcagcacccccagcagcagcaacagcaccagcaagctgcccaatgacctgctggacctgcagcagcccaccttccaccccagcgtgcaccccatgagcacagccagccaggtggccagcacctggggcggcttcacccccagccctgtggcccagccccaccccagcgctggcctgaatgtggactttgagagcgtgtttggaaacaagagcaccaacgtcatcgtggacagcggcggctttgatgagctgggcggcctgctgaagcccaccgtggccagccagaaccagaacctgcctgtggccaagctgccccccagcaagctggtgtctgatgacctggacagcagcctggccaacctggtgggcaacctgggcattggaaatggcaccaccaagaatgatgtgaactggagccagcccggggagaagaagctgaccggcggcagcaactggcagcccaaggtggcccccaccacagcctggaatgctgccaccatggcccctcctgtgatggcctacccagccaccacccccaccggcatgattggctacggcatccccccccagatgggctctgtgcctgtgatgacccagcccaccctcatctacagccagcctgtgatgaggcctcccaaccccttcggccctgtgtctggggcccagatccagttcatgtag

SEQ ID NO: 163787 - DNA, 1455 bp, Artificial Sequence
  Description of Artificial Sequence: Synthetic coding sequence
atggcctgccggggcggcgctggaaatggccaccgggccagcgccaccctgagccgggtgtccccaggcagcctgtacacctgcaggaccaggacccacaacatctgcatggtgtctgacttcttctaccccaacatgggcggcgtggagagccacatctaccagctgagccagtgcctgattgagcggggccacaaggtgatcatcgtgacccacgcctacggcaacaggaagggcatccgctacctgaccagcggcctgaaggtgtactacctgcccctgaaggtgatgtacaaccagagcacagccaccaccctcttccacagcctgcccctgctgcgctacatctttgtgcgggagcgggtgaccatcatccacagccacagcagcttcagcgccatggcccatgatgccctcttccacgccaagaccatgggcctgcagacagtgttcacagaccacagcctgtttggatttgctgatgtgtcctctgtgctgaccaacaagctgctgactgtgtccctgtgtgacaccaaccacatcatctgtgtgtcctacaccagcaaggagaacacagtgctgcgggccgccctgaaccctgagatcgtgtctgtcatccccaatgctgtggaccccacagacttcaccccagaccccttcagaagacatgacagcatcaccatcgtggtggtgtcccggctggtgtacaggaagggcatcgacctgctgagcggcatcatccctgagctgtgccagaagtacccagacctgaacttcatcattggaggagagggccccaagaggatcatcctggaggaggtgcgggagcgctaccagctgcatgacagagtgcggctgctgggcgccctggagcacaaggatgtgagaaatgtgctggtgcagggccacatcttcctgaacaccagcctgacagaggccttctgcatggccatcgtggaggccgccagctgtggcctgcaggtggtgtccaccagggtgggcggcatccctgaggtgctgcctgagaacctgatcatcctgtgtgagcccagcgtgaagagcctgtgtgagggcctggagaaggccatcttccagctgaagagcggcaccctgcctgcccctgagaacatccacaacatcgtgaagaccttctacacctggagaaatgtggccgagaggacagagaaggtgtatgacagagtgtctgtggaggccgtgctgcccatggacaagaggctggacaggctcatcagccactgcggccctgtgacaggctacatctttgccctgctggccgtgttcaacttcctgttcctgatcttcctgcgctggatgaccccagacagcatcattgatgtggccattgatgccaccggccccaggggggcctggaccaacaactacagccacagcaagaggggcggggagaacaatgagatcagcgagaccaggtag

SEQ ID NO: 163788 - DNA, 510 bp, Artificial Sequence
  Description of Artificial Sequence: Synthetic coding sequence
atggccatcgtggaggccgccagctgtggcctgcaggtggtgtccaccagggtgggcggcatccctgaggtgctgcctgaaaatctcatcatcctgtgtgagcccagcgtgaagagcctgtgtgagggcctggagaaggccatcttccagctgaagagcggcaccctgcctgcccctgagaacatccacaacatcgtgaagaccttctacacctggagaaatgtggccgagaggacagagaaggtgtatgacagagtgtctgtggaggccgtgctgcccatggacaagaggctggacaggctcatcagccactgcggccctgtgacaggctacatctttgccctgctggccgtgttcaacttcctgttcctgatcttcctgcgctggatgaccccagacagcatcattgatgtggccattgatgccaccggccccaggggggcctggaccaacaactacagccacagcaagagaggaggagaaaataatgagatcagcgagaccaggtag

SEQ ID NO: 163789 - DNA, 753 bp, Artificial Sequence
  Description of Artificial Sequence: Synthetic coding sequence
atggagctgaccggcatcgacctgctgagcggcatcatccctgagctgtgccagaagtacccagacctgaacttcatcattggaggagagggccccaagaggatcatcctggaggaggtgcgggagcgctaccagctgcatgacagagtgcggctgctgggcgccctggagcacaaggatgtgagaaatgtgctggtgcagggccacatcttcctgaacaccagcctgacagaggccttctgcatggccatcgtggaggccgccagctgtggcctgcaggtggtgtccaccagggtgggcggcatccctgaggtgctgcctgagaacctgatcatcctgtgtgagcccagcgtgaagagcctgtgtgagggcctggagaaggccatcttccagctgaagagcggcaccctgcctgcccctgagaacatccacaacatcgtgaagaccttctacacctggagaaatgtggccgagaggacagagaaggtgtatgacagagtgtctgtggaggccgtgctgcccatggacaagaggctggacaggctcatcagccactgcggccctgtgacaggctacatctttgccctgctggccgtgttcaacttcctgttcctgatcttcctgcgctggatgaccccagacagcatcattgatgtggccattgatgccaccggccccaggggggcctggaccaacaactacagccacagcaagaggggcggggagaacaatgagatcagcgagaccaggtag

SEQ ID NO: 163790 - DNA, 1665 bp, Artificial Sequence
  Description of Artificial Sequence: Synthetic coding sequence
atgaggcggcccctgagcaaatgtggcatggagcccggcggcggagatgccagcctgaccctgcacggcctgcagaacagaagccacggcaagatcaagctgaggaagaggaagagcaccctgtacttcaacacccaggagaagagcgcccggcggcggggggacctgctgggggagaacatctacctgctgctcttcaccatcgccctgcgcatcctgaactgcttcctggtgcagaccagctttgtgcctgatgagtactggcagagcctggaggtgagccaccacatggtgttcaactacggctacctgacctgggagtggacagagcggctgcggagctacacctaccccctcatctttgccagcatctacaagatcctgcacctgctgggcaaggacagcgtgcagctgctgatctggatcccccggctggcccaggccctgctgtctgctgtggctgatgtgcggctgtacagcctgatgaagcagctggagaaccaggaggtggcccgctgggtgttcttctgccagctgtgctcctggttcacctggtactgctgcaccaggaccctgaccaacaccatggagaccgtgctgaccatcatcgccctcttctactaccccctggagggcagcaagtccatgaacagcgtgaagtacagcagcctggtggccctggccttcatcatccggcccacagctgtgatcctgtggacccccctgctcttccgccacttctgccaggagcccaggaagctggacctgatcctgcaccacttcctgcctgtgggctttgtgaccctgagcctgagcctgatgattgaccgcatcttcttcggccagtggaccctggtgcagttcaacttcctgaagttcaacgtgctgcagaactggggcaccttctacggcagccacccctggcactggtacttcagccagggcttccctgtgatcctgggcacccacctgcccttcttcatccacggctgctacctggcccccaagcgctaccgcatcctgctggtgacagtgctgtggaccctgctggtgtacagcatgctgagccacaaggagttccgcttcatctaccctgtgctgcccttctgcatggtgttctgtggctacagcctgacccacctgaagacctggaagaagccagccctgtccttcctgttcctgagcaacctcttcctggccctgtacacaggcctggtgcaccagaggggcaccctggatgtgatgagccacatccagaaggtgtgctacaacaaccccaacaagagcagcgccagcatcttcatcatgatgccctgccacagcaccccctactacagccacgtgcactgccccctgcccatgaggttcctgcagtgccccccagacctgaccgggaagagccactacctggatgaagcagatgtgttctacctgaaccccctgaactggctgcaccgggagttccatgatgatgccagcctgcccacccacctgatcaccttcagcatcctggaggaggagatcagcgccttcctgatcagcagcaactacaagaggacagctgtgttcttccacacccacctgcctgagggcagaattggcagccacatctacgtgtatgaaaggaagctgaagggcaagttcaacatgaagatgaagttctag

SEQ ID NO: 163791 - DNA, 1080 bp, Artificial Sequence
  Description of Artificial Sequence: Synthetic coding sequence
atggagaccgtgctgaccatcatcgccctcttctactaccccctggagggcagcaagtccatgaacagcgtgaagtacagcagcctggtggccctggccttcatcatccggcccacagctgtgatcctgtggacccccctgctcttccgccacttctgccaggagcccaggaagctggacctgatcctgcaccacttcctgcctgtgggctttgtgaccctgagcctgagcctgatgattgaccgcatcttcttcggccagtggaccctggtgcagttcaacttcctgaagttcaacgtgctgcagaactggggcaccttctacggcagccacccctggcactggtacttcagccagggcttccctgtgatcctgggcacccacctgcccttcttcatccacggctgctacctggcccccaagcgctaccgcatcctgctggtgacagtgctgtggaccctgctggtgtacagcatgctgagccacaaggagttccgcttcatctaccctgtgctgcccttctgcatggtgttctgtggctacagcctgacccacctgaagacctggaagaagccagccctgtccttcctgttcctgagcaacctcttcctggccctgtacacaggcctggtgcaccagaggggcaccctggatgtgatgagccacatccagaaggtgtgctacaacaaccccaacaagagcagcgccagcatcttcatcatgatgccctgccacagcaccccctactacagccacgtgcactgccccctgcccatgaggttcctgcagtgccccccagacctgaccgggaagagccactacctggatgaagcagatgtgttctacctgaaccccctgaactggctgcaccgggagttccatgatgatgccagcctgcccacccacctgatcaccttcagcatcctggaggaggagatcagcgccttcctgatcagcagcaactacaagaggacagctgtgttcttccacacccacctgcctgagggccgcatcggcagccacatctacgtgtatgaaaggaagctgaagggcaagttcaacatgaagatgaagttctag

SEQ ID NO: 163792 - DNA, 894 bp, Artificial Sequence
  Description of Artificial Sequence: Synthetic coding sequence
atgtatgcccagcctgtgaccaacaccaaggaggtgaagtggcagaaggtgctgtatgagcggcagcccttcccagacaactacgtggaccggcgcttcctggaggagctgaggaagaacatccacgccaggaagtaccagtactgggccgtggtgtttgagagctctgtggtgatccagcagctgtgcagcgtgtgtgtgtttgtggtgatctggtggtacatggatgagggcctgctggccccccactggctgctgggcaccggcctggccagcagcctgattggctacgtgctgtttgacctgattgatggaggagagggcaggaagaagagcggccagacccgctgggccgacctgaagagcgccctggtgttcatcaccttcacctacggcttcagccctgtgctgaagaccctgacagaatctgtgtccacagacaccatctatgccatgtctgtgttcatgctgctgggccacctgatcttctttgattatggagccaatgctgccatcgtgagcagcaccctgagcctgaacatggccatctttgcctctgtgtgcctggccagccggctgcccaggagcctgcacgccttcatcatggtgacctttgccatccagatctttgccctgtggcccatgctgcagaagaagctgaaggcctgcacccccaggagctatgtgggcgtgaccctgctgtttgccttctctgctgtgggcggcctgctgagcatctctgctgtgggcgctgtgctgtttgccctgctgctgatgagcatcagctgcctgtgccccttctacctgatccggctgcagctgttcaaggagaacatccacggcccctgggatgaggccgagatcaaggaggacctgagccgcttcctgtcctag

SEQ ID NO: 163793 - DNA, 894 bp, Artificial Sequence; identical to SEQ ID NO: 163792
  Description of Artificial Sequence: Synthetic coding sequence

SEQ ID NO: 163794 - DNA, 894 bp, Artificial Sequence; identical to SEQ ID NO: 163792
  Description of Artificial Sequence: Synthetic coding sequence

SEQ ID NO: 163795 - DNA, 660 bp, Artificial Sequence
  Description of Artificial Sequence: Synthetic coding sequence
atgaaggacaatgacatcaagaggctgctgtacacccacctgctgtgcatcttcagcatcatcctgtctgtgttcatccccagcctcttcctggagaacttcagcatcctggagacccacctgacctggctgtgcatctgcagcggctttgtgacagctgtgaacctggtgctgtacctggtggtgaagcccaacaccagcagcaagaggagcagcctgagccacaaggtgacaggcttcctgaagtgctgcatctacttcctgatgagctgcttctccttccacgtgatctttgtgctgtatggagcccccctcatcgagctggccctggagaccttcctgtttgctgtgatcctgagcaccttcaccaccgtgccctgcctgtgcctgctgggccccaacctgaaggcctggctgcgggtcttcagcagaaatggagtgaccagcatctgggagaacagcctgcagatcaccaccatcagcagctttgtgggcgcctggctgggcgccctgcccatccccctggactgggagcggccctggcaggtgtggcccatcagctgcaccctgggcgccaccttcggctacgtggccggcctggtgatcagccccctgtggatctactggaacaggaagcagctgacctacaagaacaactag

SEQ ID NO: 163796 - DNA, 621 bp, Artificial Sequence
  Description of Artificial Sequence: Synthetic coding sequence
atgaaggacaatgacatcaagaggctgctgtacacccacctgctgtgcatcttcagcatcatcctgtctgtgttcatccccagcctcttcctggagaacttcagcatcctggagacccacctgacctggctgtgcatctgcagcggctttgtgacagctgtgaacctggtgctgtacctggtggtgaagcccaacaccagcagcaagaggagcagcctgagccacaaggtgacaggcttcctgaagtgctgcatctacttcctgatgagctgcttctccttccacgtgatctttgtgctgtatggagcccccctcatcgagctggccctggagaccttcctgtttgctgtgatcctgagcaccttcaccaccgtgccctgcctgtgcctgctgggccccaacctgaaggcctggctgcgggtcttcagcagaaatggagtgaccagcatctgggagaacagcctgcagatcaccaccatcagcagctttgtgggcgcctggctgggcgccctgcccatccccctggactgggagcggccctggcagatgacagtggagaggaagaggagcacctaccgcagcctgcacgtgccctgccggggcctgggcaccgtgaagtag

SEQ ID NO: 163797 - DNA, 150 bp, Artificial Sequence
  Description of Artificial Sequence: Synthetic coding sequence
atgaaggacaatgacatcaagaggctgctgtacacccacctgctgtgcatcttcagcatcatcctgtctgtgttcatccccagcctcttcctggagaacttcagcatcctggagacccacctgacctggctgtgcatctgcagcggctag

SEQ ID NO: 163798 - DNA, 999 bp, Artificial Sequence
  Description of Artificial Sequence: Synthetic coding sequence
atggctgtgacagacagcctgagccgggccgccaccgtgctggccaccgtgctgctgctgagctttggatctgtggccgccagccacatcgaggaccaggccgagcagttcttccgcagcggccacaccaacaactgggccgtgctggtgtgcaccagccgcttctggttcaactacagacatgtggccaacaccctgtctgtgtacagatctgtgaagaggctgggcatcccagacagccacatcgtgctgatgctggctgatgacatggcctgcaaccccaggaaccccaagccagccaccgtcttcagccacaagaacatggagctgaatgtgtatggagatgatgtggaggtggactaccgctcctatgaggtgacagtggagaacttcctgcgggtgctgaccggccgcatcccccccagcacccccaggagcaagaggctgctgagtgatgacaggagcaacatcctgatctacatgacaggccacggcggcaatggcttcctgaagttccaggacagcgaggagatcaccaacatcgagctggctgatgcctttgagcagatgtggcagaagaggcgctacaatgagctgctcttcatcatcgacacctgccagggcgcctccatgtatgagcgcttctacagccccaacatcatggccctggccagcagccaggtgggggaggacagcctgagccaccagcctgaccctgccatcggcgtgcacctgatggaccgctacaccttctacgtgctggagttcctggaggagatcaacccagccagccagaccaacatgaatgacctcttccaggtgtgccccaagagcctgtgtgtgtccaccccaggccacaggacagacctcttccagagggaccccaagaatgtgctgatcacagacttcttcggctctgtgaggaaggtggagatcaccacagagaccatcaagctgcagcaggacagcgagatcatggagagccgctacagcagctag

SEQ ID NO: 163799 - DNA, 1188 bp, Artificial Sequence
  Description of Artificial Sequence: Synthetic coding sequence
atggctgtgacagacagcctgagccgggccgccaccgtgctggccaccgtgctgctgctgagctttggatctgtggccgccagccacatcgaggaccaggccgagcagttcttccgcagcggccacaccaacaactgggccgtgctggtgtgcaccagccgcttctggttcaactacagacatgtggccaacaccctgtctgtgtacagatctgtgaagaggctgggcatcccagacagccacatcgtgctgatgctggctgatgacatggcctgcaaccccaggaaccccaagccagccaccgtcttcagccacaagaacatggagctgaatgtgtatggagatgatgtggaggtggactaccgctcctatgaggtgacagtggagaacttcctgcgggtgctgaccggccgcatcccccccagcacccccaggagcaagaggctgctgagtgatgacaggagcaacatcctgatctacatgacaggccacggcggcaatggcttcctgaagttccaggacagcgaggagatcaccaacatcgagctggctgatgcctttgagcagatgtggcagaagaggcgctacaatgagctgctcttcatcatcgacacctgccagggcgcctccatgtatgagcgcttctacagccccaacatcatggccctggccagcagccaggtgggggaggacagcctgagccaccagcctgaccctgccatcggcgtgcacctgatggaccgctacaccttctacgtgctggagttcctggaggagatcaacccagccagccagaccaacatgaatgacctcttccaggtgtgccccaagagcctgtgtgtgtccaccccaggccacaggacagacctcttccagagggaccccaagaatgtgctgatcacagacttcttcggctctgtgaggaaggtggagatcaccacagagaccatcaagctgcagcaggacagcgagatcatggagagcagctacaaggaggaccagatggatgagaagctgatggagcccctgaagtatgcagagcagctgcctgtggcccagatcatccaccagaagcccaagctgaaggactggcaccccccaggcggcttcatcctgggcctgtgggccctgatcatcatggtgttcttcaagacctacggcatcaagcacatgaagttcatcttctag

SEQ ID NO: 163800 - DNA, 960 bp, Artificial Sequence
  Description of Artificial Sequence: Synthetic coding sequence
atggctgtgacagacagcctgagccgggccgccaccgtgctggccaccgtgctgctgctgagctttggatctgtggccgccagccacatcgaggaccaggccgagcagttcttccgcagcggccacaccaacaactgggccgtgctggtgacagtggagaacttcctgcgggtgctgaccggccgcatcccccccagcacccccaggagcaagaggctgctgagtgatgacaggagcaacatcctgatctacatgacaggccacggcggcaatggcttcctgaagttccaggacagcgaggagatcaccaacatcgagctggctgatgcctttgagcagatgtggcagaagaggcgctacaatgagctgctcttcatcatcgacacctgccagggcgcctccatgtatgagcgcttctacagccccaacatcatggccctggccagcagccaggtgggggaggacagcctgagccaccagcctgaccctgccatcggcgtgcacctgatggaccgctacaccttctacgtgctggagttcctggaggagatcaacccagccagccagaccaacatgaatgacctcttccaggtgtgccccaagagcctgtgtgtgtccaccccaggccacaggacagacctcttccagagggaccccaagaatgtgctgatcacagacttcttcggctctgtgaggaaggtggagatcaccacagagaccatcaagctgcagcaggacagcgagatcatggagagcagctacaaggaggaccagatggatgagaagctgatggagcccctgaagtatgcagagcagctgcctgtggcccagatcatccaccagaagcccaagctgaaggactggcaccccccaggcggcttcatcctgggcctgtgggccctgatcatcatggtgttcttcaagacctacggcatcaagcacatgaagttcatcttctag

SEQ ID NO: 163801 - DNA, 906 bp, Artificial Sequence
  Description of Artificial Sequence: Synthetic coding sequence
atggctgtgacagacagcctgagccgggccgccaccgtgctggccaccgtgctgctgctgagctttggatctgtggccgccagccacatcgaggtgacagtggagaacttcctgcgggtgctgaccggccgcatcccccccagcacccccaggagcaagaggctgctgagtgatgacaggagcaacatcctgatctacatgacaggccacggcggcaatggcttcctgaagttccaggacagcgaggagatcaccaacatcgagctggctgatgcctttgagcagatgtggcagaagaggcgctacaatgagctgctcttcatcatcgacacctgccagggcgcctccatgtatgagcgcttctacagccccaacatcatggccctggccagcagccaggtgggggaggacagcctgagccaccagcctgaccctgccatcggcgtgcacctgatggaccgctacaccttctacgtgctggagttcctggaggagatcaacccagccagccagaccaacatgaatgacctcttccaggtgtgccccaagagcctgtgtgtgtccaccccaggccacaggacagacctcttccagagggaccccaagaatgtgctgatcacagacttcttcggctctgtgaggaaggtggagatcaccacagagaccatcaagctgcagcaggacagcgagatcatggagagcagctacaaggaggaccagatggatgagaagctgatggagcccctgaagtatgcagagcagctgcctgtggcccagatcatccaccagaagcccaagctgaaggactggcaccccccaggcggcttcatcctgggcctgtgggccctgatcatcatggtgttcttcaagacctacggcatcaagcacatgaagttcatcttctag

SEQ ID NO: 163802 - DNA, 558 bp, Artificial Sequence
  Description of Artificial Sequence: Synthetic coding sequence
atgggcaagaagcagaacaagaagaaggtggaggaggtgctggaggaggaggaggaggagtatgtggtggagaaggtgctggacagaagagtggtgaagggcaaggtggagtacctgctgaagtggaagggcttcagtgatgaggacaacacctgggagcctgaggagaacctggactgcccagacctgattgctgagttcctgcagagccagaagacagcccatgaaacagacaagtctgagggcggcaagaggaaggctgacagcgacagcgaggacaagggggaggagagcaagcccaagaagaagaaggaggagagcgagaagccccggggctttgcccggggcctggagcctgagcgcatcattggagccacagacagcagtggagagctgatgttcctgatgaagtggaagaacagtgatgaggccgacctggtgcctgccaaggaggccaacgtgaagtgcccccaggtggtgatctccttctatgaggagcggctgacctggcacagctaccccagtgaagatgatgacaagaaggatgacaagaactag

SEQ ID NO: 163803 - DNA, 735 bp, Artificial Sequence
  Description of Artificial Sequence: Synthetic coding sequence
atggaggccatgtggctgctgtgtgtggccctggccgtgctggcctggggcttcctgtgggtgtgggacagcagcgagaggatgaagagccgggagcagggcggccgcctgggcgctgagagcaggaccctgctggtgattgcccacccagatgatgaggccatgttctttgcccccaccgtgctgggcctggcccggctgcggcactgggtgtacctgctgtgcttctctgctggcaactactacaaccagggcgagaccaggaagaaggagctgctgcagagctgtgatgtgctgggcatccccctgagctctgtgatgatcatcgacaacagagacttcccagatgaccccggcatgcagtgggacacagagcacgtggcccgggtgctgctgcagcacatcgaggtgaatggcatcaacctggtggtgacctttgatgctgggggcgtgtctggccacagcaaccacatcgccctgtatgctgctgtgcgggtgctgtgtgcccacgcctctgtgtgtgaatgtgccgcccaggtgcacctgcccagcggcagcgccctggtgtctgccagctatgccggctgccccctgcgggcccagcagcagaggtctggaacaggccaggagagccacgtgctgcccccccagcctgcccccctggtgcccccacccctgcactacctgctgcctgtgcatgagaaccagctgacagagctgcccctgaagccctag

SEQ ID NO: 163804 - DNA, 1272 bp, Artificial Sequence
  Description of Artificial Sequence: Synthetic coding sequence
atgggcagcaccaagcactggggcgagtggctgctgaacctgaaggtggccccagctggggtgtttggagtggccttcctggcccgggtggccctggtgttctatggagtcttccaggacaggaccctgcacgtgcgctacacagacatcgactaccaggtgttcacagatgctgccaggtttgtgacagagggccgcagcccctacctgcgggccacctaccgctacacccccctgctgggctggctgctgacccccaacatctacctgtctgagctgtttgggaagttcctgttcatcagctgtgacctgctgacagccttcctgctgtaccgcctgctgctgctgaagggcctgggccggcggcaggcctgtggctactgtgtgttctggctgctgaaccccctgcccatggctgtgagcagcagaggaaatgctgacagcatcgtggccagcctggtgctgatggtgctgtacctgatcaagaagaggctggtggcctgtgccgctgtgttctacggctttgctgtgcacatgaagatctaccctgtgacctacatcctgcccatcaccctgcacctgctgcctgaccgggacaatgacaagagcctgcggcagttccgctacaccttccaggcctgcctgtatgagctgctgaagaggctgtgcaacagagctgtgctgctgtttgtggccgtggccggcctgaccttctttgccctgagctttggcttctactatgaatatggctgggagttcctggagcacacctacttctaccacctgacccggcgggacatccgccacaacttcagcccctacttctacatgctgtacctgacagctgagagcaagtggagcttcagcctgggcattgctgccttcctgccccagctgatcctgctgtctgctgtgtcctttgcctactacagagacctggtgttctgctgcttcctgcacaccagcatctttgtgaccttcaacaaggtgtgcaccagccagtacttcctgtggtacctgtgcctgctgcccctggtgatgcccctggtgaggatgccctggaagagagctgtggtgctgctgatgctgtggttcatcggccaggccatgtggctggccccagcctacgtgctggagttccagggcaagaacaccttcctgttcatctggctggccggcctcttcttcctgctgatcaactgcagcatcctgatccagatcatcagccactacaaggaggagcccctgacagagcgcatcaagtatgactag

SEQ ID NO: 163805 - DNA, 2796 bp, Artificial Sequence
  Description of Artificial Sequence: Synthetic coding sequence
atgctgctcttcttcaccctgggcctgctgatccactttgtgttctttgccagcatctttgacatctacttcaccagccccctggtgcacggcatgaccccccagttcacccccctgcccccaccagcccggcggctggtgctgtttgtggctgatggcctgcgggcagatgccctgtatgagctggatgaaaatggaaacagccgggcccccttcatccggaacatcatcatgcatgagggctcctggggcatcagccacaccagggtgcccacagagagccggcccggccacgtggccctgattgctggcttctatgaagatgtgtctgctgtggccaagggctggaaggagaaccctgtggagtttgacagcctcttcaatgaaagcaagtacacctggagctggggcagcccagacatcctgcccatgtttgccaagggggccagcggggaccacgtgtacacctacagctatgatgccaagcgggaggactttggagcccaggatgccaccaagctggacacctgggtgtttgacaacgtgaaggacttcttccaccacgccaggaacaaccagagcctcttcagcaagatcaatgaggagaagatcgtgttcttcctgcacctgctgggcatcgacaccaacggccacgcccaccggcccagcagccgggactacaagcacaacatcaagaaggtggatgatggagtgaaggagatcgtgtccatgttcaaccacttctatggaaatgatggcaagaccaccttcatcttcaccagtgaccacggcatgacagactggggcagccatggagctggccaccccagcgagaccctgacccccctggtgacctggggcgccggcatcaagtacccccagagggtgtctgcccagcagtttgatgatgccttcctgaaggagtggaggctggagaactggaagaggctggatgtgaaccaggccgacatcgcccccctgatgaccagcctcatcggcgtgcccttccccctgaacagcgtgggcatcctgcctgtggactacctgaacaacacagacctcttcaaggccgagagcatgttcaccaatgctgtgcagatcctggagcagttcaaggtgaagatgacccagaagaaggaggtgaccctgcccttcctgttcacccccttcaagctgctgagtgacagcaagcagttcaacatcctgaggaaggcccggagctacatcaagcacaggaagtttgatgaggtggtgtccctgtgcaaggagctgatccacctggccctgaagggcctgagctactaccacacctatgaccgcttcttcctgggcgtgaatgtggtgattggatttgtgggctggatctcctatgccagcctgctgatcatcaagagccacagcaacctgatcaagggcgtgtccaaggaggtgaagaagcccagccacctgctgccctgcagctttgtggccatcggcatcctggtggccttcttcctgctgatccaggcctgcccctggacctactacgtgtatggcctgctgcccctgcccatctggtatgctgtgctgcgggagttccaggtgatccaggacctggtggtgtctgtgctgacctaccccctgagccactttgtgggctacctgctggccttcaccctgggcatcgaggtgctggtgctgtccttcttctaccgctacatgctgacagctggcctgacagcctttgctgcctggcccttcctgacccggctgtggacccgggccaagatgaccagcctgtcctggaccttcttcagcctgctgctggccgtgttccccctgatgcctgtggtgggcaggaagccagacatcagcctggtgatgggcgccggcctgctggtgctgctgctgagcctgtgtgtggtgaccagcctgatgaagaggaaggacagcttcatcaaggaggagctgctggtgcacctgctgcaggtgctgagcacagtgctgtccatgtatgtggtgtacagcacccagagcagcctgctgaggaagcagggcctgcccctgatgaaccagatcatctcctgggccaccctggccagcagcctggtggtgcccctgctgagcagccctgtgctcttccagaggctcttcagcatcctgctgagcctgatgagcacctacctgctgctgagcacaggctatgaggccctcttccccctggtgctgagctgcctgatgtttgtgtggatcaacatcgagcaggagaccctgcagcagagcggcgtgtgctgcaagcagaagctgaccagcatccagttctcctacaacacagacatcacccagttccggcagctgtacctggatgacatcagaagagccttcttcctggtgttcttcctggtgacagccttctttggaactggaaacatcgccagcatcaacagctttgacctggcctctgtgtactgcttcctgaccgtcttcagccccttcatgatgggcgccctgatgatgtggaagatcctgatcccctttgtgctggtgatgtgtgcctttgaggccgtgcagctgaccacccagctgagcagcaagagcctcttcctgattgtgctggtgatcagtgacatcatggccctgcacttcttcttcctggtgaaggactatggctcctggctggacatcggcaccagcatcagccactacgtgattgtgatgtccatgaccatcttcctggtgttcctgaatggcctggcccagctgctgaccaccaagaagctgcggctgtgtgggaagcccaagagccacttcatgtag

SEQ ID NO: 163806 - DNA, 2796 bp, Artificial Sequence; identical to SEQ ID NO: 163805
  Description of Artificial Sequence: Synthetic coding sequence

SEQ ID NO: 163807 - DNA, 405 bp, Artificial Sequence
  Description of Artificial Sequence: Synthetic coding sequence
atggtggagaacagccccagccccctgcctgagcgggccatctacggctttgtgctcttcctgagcagccagtttggcttcatcctgtacctggtgtgggccttcatccctgagagctggctgaacagcctgggcctgacctactggccccagaagtactgggccgtggccctgcctgtgtacctgctgattgccatcgtcatcggctacgtgctgctgtttggcatcaacatgatgagcaccagccccctggacagcatccacaccatcacagacaactatgccaagaaccagcagcagaagaagtaccaggaggaggccatcccagccctgcgggacatcagcatcagcgaggtgaaccagatgttcttcctggccgccaaggagctgtacaccaagaactag

SEQ ID NO: 163808 - DNA, 327 bp, Artificial Sequence
  Description of Artificial Sequence: Synthetic coding sequence
atggtgctgtacctggtgtgggccttcatccctgagagctggctgaacagcctgggcctgacctactggccccagaagtactgggccgtggccctgcctgtgtacctgctgattgccatcgtcatcggctacgtgctgctgtttggcatcaacatgatgagcaccagccccctggacagcatccacaccatcacagacaactatgccaagaaccagcagcagaagaagtaccaggaggaggccatcccagccctgcgggacatcagcatcagcgaggtgaaccagatgttcttcctggccgccaaggagctgtacaccaagaactag

SEQ ID NO: 163809 - DNA, 405 bp, Artificial Sequence; identical to SEQ ID NO: 163807
  Description of Artificial Sequence: Synthetic coding sequence

SEQ ID NO: 163810 - DNA, 405 bp, Artificial Sequence; identical to SEQ ID NO: 163807
  Description of Artificial Sequence: Synthetic coding sequence

SEQ ID NO: 163811 - DNA, 78 bp, Artificial Sequence
  Description of Artificial Sequence: Synthetic coding sequence
atggtgctgtacctggtgtgggccttcatccctgagagctggctgaacagcctgggcctgacctactggccccagtag

SEQ ID NO: 163812 - DNA, 477 bp, Artificial Sequence
  Description of Artificial Sequence: Synthetic coding sequence
atggtgcccaggagcaccagcctggccctgattgtgttcctgttccaccggctgagcaaggcccctgggaagatggtggagaacagccccagccccctgcctgagcgggccatctacggctttgtgctcttcctgagcagccagtttggcttcatcctgtacctggtgtgggccttcatccctgagagctggctgaacagcctgggcctgacctactggccccagaagtactgggccgtggccctgcctgtgtacctgctgattgccatcgtcatcggctacgtgctgctgtttggcatcaacatgatgagcaccagccccctggacagcatccacaccatcacagacaactatgccaagaaccagcagcagaagaagtaccaggaggaggccatcccagccctgcgggacatcagcatcagcgaggtgaaccagatgttcttcctggccgccaaggagctgtacaccaagaactag

SEQ ID NO: 163813 - DNA, 1848 bp, Artificial Sequence
  Description of Artificial Sequence: Synthetic coding sequence
atggcccgggcctgcctgatccagaggctgcccatcaagagggactgcacccctgtgtttgtgcggggcctgagcagccccagcgctgccatggccctgctgtctgagggcctggatgaggtgcctgctgcctgcctgagcccctgtggcccccccaaccccacagagctgttcagcgagagccggcggctggccctggaggagctggtggccggcggccctgaggcctttgctgccttcctgcggcgggagcggctggcccgcttcctgaacccagatgaggtgcacgccatcctgcgggctgctgagaggcctggagaggagggcgctgctgctgctgctgctgctgaagattcttttggcagcagccatgactgcagcagcggcacctacttccctgagcagagcgacctggagccccccctgctggagctgggctggccagccttctaccagggcgcctacagaggagccaccagggtggagacccacttccagcccaggggggccggggagggcggcccctacggctgcaaggatgccctgcggcagcagctgcggagcgcccgggaggtgattgctgtggtgatggatgtgttcacagacatcgacatcttccgggacctgcaggagatctgcaggaagcagggcgtggccgtgtacatcctgctggaccaggccctgctgagccagttcctggacatgtgcatggacctgaaggtgcaccctgagcaggagaagctgatgacagtgaggaccatcactggaaacatctactatgcccggagcggcaccaagatcatcggcaaggtgcatgagaagttcaccctgattgatggcatccgggtggccaccggcagctacagcttcacctggacagatggcaagctgaacagcagcaacctggtgatcctgagcggccaggtggtggagcactttgacctggagttccgcatcctgtatgcccagagcaagcccatcagccccaagctgctgagccacttccagagcagcaacaagtttgaccacctgaccaacaggaagccccagagcaaggagctgaccctgggcaacctgctgaggatgaggctggcccggctgagcagcacccccaggaaggctgacctggaccctgagatgcctgctgagggcaaggccgagaggaagccccatgactgtgagagcagcacagtgtctgaggaggactacttcagcagccacagagatgagctgcagagcaggaaggccattgatgctgccacccagacagagcctggagaggagatgcctggcctgtctgtgtctgaggtgggcacccagaccagcatcaccacagcctgtgccggcacccagacagctgtgatcacccgcatcgccagcagccagaccaccatctggagccgcagcaccaccacccagacagacatggatgagaacatcctcttcccccggggcacccagagcacagagggcagccctgtgtccaagatgtctgtgagccgcagcagcagcctgaagagcagcagctctgtgagcagccagggctctgtggccagcagcacaggcagccctgccagcatccgcaccacagacttccacaaccctggctaccccaagtacctgggcaccccccacctggagctgtacctgagtgacagcctgaggaacctgaacaaggagcggcagttccactttgctggcatccgcagccggctgaaccacatgctggccatgctgagcaggaggaccctcttcacagagaaccacctgggcctgcacagcggcaacttcagccgggtgaacctgctggccgtgagagatgtggccctgtaccccagctaccagtag

SEQ ID NO: 163814 - DNA, 1248 bp, Artificial Sequence
  Description of Artificial Sequence: Synthetic coding sequence
atggccgcccccctggtgctggtgctggtggtggccgtgacagtgcgggccgccctcttccgcagcagcctggccgagttcatcagcgagcgggtggaggtggtgagccccctgagctcctggaagagggtggtggagggcctgagcctgctggacctgggcgtgagcccctacagcggggctgtgttccacgagatcacagatgccctgacagccatcgccctgtactttgccatccaggacttcaacaaggtggtgttcaagaagcagaagctgctgctggagctggaccagtatgccccagatgtggccgagctgatccgcacccccatggagatgagatacatccccctgaaggtggccctcttctacctgctgaacccctacaccatcctgagctgtgtggccaagagcacctgtgccatcaacaacaccctgattgccttcttcatcctgaccaccatcaagggcagcgccttcctgagcgccatcttcctggccctggccacctaccagagcctgtaccccctgaccctgtttgtgcccggcctgctgtacctgctgcagaggcagtacatccctgtgaagatgaagagcaaggccttctggatcttctcctgggagtatgccatgatgtatgtgggcagcctggtggtgatcatctgcctgtccttcttcctgctgagctcctgggacttcatcccagctgtgtatggcttcatcctgtctgtgcctgacctgacccccaacatcggcctcttctggtacttctttgctgagatgtttgagcacttcagcctcttctttgtgtgtgtgttccagatcaacgtgttcttctacaccatccccctggccatcaagctgaaggagcaccccatcttcttcatgttcatccagattgctgtgattgccatcttcaagagctaccccaccgtgggagatgtggccctgtacatggccttcttccctgtgtggaaccacctgtaccgcttcctgaggaacatctttgtgctgacctgcatcatcatcgtgtgcagcctgctcttccctgtgctgtggcacctgtggatctatgccggcagcgccaacagcaacttcttctacgccatcaccctgaccttcaacgtgggccagatcctgctgatcagtgactacttctacgccttcctgcggcgggagtactacctgacccacggcctgtacctgacagccaaggatggaacagaggccatgctggtgctgaagtag

SEQ ID NO: 163815 - DNA, 513 bp, Artificial Sequence
  Description of Artificial Sequence: Synthetic coding sequence
gtgtctgtgcccacccacctggtgtgccccaggacccccctgagccccccagctgctgtgcacacctgtgaaaatgaggagcagagcctgctggacctcttcctgggcgtgtgccacgacatcaacgtgttcttctacaccatccccctggccatcaagctgaaggagcaccccatcttcttcatgttcatccagattgctgtgattgccatcttcaagagctaccccaccgtgggagatgtggccctgtacatggccttcttccctgtgtggaaccacctgtaccgcttcctgaggaacatctttgtgctgacctgcatcatcatcgtgtgcagcctgctcttccctgtgctgtggcacctgtggatctatgccggcagcgccaacagcaacttcttctacgccatcaccctgaccttcaacgtgggccagatcctgctgatcagtgactacttctacgccttcctgcggcgggagtactacctgacccacggcctgtacctgacagcctag

SEQ ID NO: 163816 - DNA, 1272 bp, Artificial Sequence
  Description of Artificial Sequence: Synthetic coding sequence
atggccgcccccctggtgctggtgctggtggtggccgtgacagtgcgggccgccctcttccgcagcagcctggccgagttcatcagcgagcgggtggaggtggtgagccccctgagctcctggaagagggtggtggagggcctgagcctgctggacctgggcgtgagcccctacagcggggctgtgttccacgagacccccctcatcatctacctgttccacttcctgattgattatgcagagctggtgttcatgatcacagatgccctgacagccatcgccctgtactttgccatccaggacttcaacaaggtggtgttcaagaagcagaagctgctgctggagctggaccagtatgccccagatgtggccgagctgatccgcacccccatggagatgagatacatccccctgaaggtggccctcttctacctgctgaacccctacaccatcctgagctgtgtggccaagagcacctgtgccatcaacaacaccctgattgccttcttcatcctgaccaccatcaagggcagcgccttcctgagcgccatcttcctggccctggccacctaccagagcctgtaccccctgaccctgtttgtgcccggcctgctgtacctgctgcagaggcagtacatccctgtgaagatgaagagcaaggccttctggatcttctcctgggagtatgccatgatgtatgtgggcagcctggtggtgatcatctgcctgtccttcttcctgctgagctcctgggacttcatcccagctgtgtatggcttcatcctgtctgtgcctgacctgacccccaacatcggcctcttctggtacttctttgctgagatgtttgagcacttcagcctcttctttgtgtgtgtgttccagatcaacgtgttcttctacaccatccccctggccatcaagctgaaggagcaccccatcttcttcatgttcatccagattgctgtgattgccatcttcaagagctaccccaccgtgggagatgtggccctgtacatggccttcttccctgtgtggaaccacctgtaccgcttcctgaggaacatctttgtgctgacctgcatcatcatcgtgtgcagcctgctcttccctgtgctgtggcacctgtggatctatgccggcagcgccaacagcaacttcttctacgccatcaccctgaccttcaacgtgggccagatgggcttctgtggggacaggatggccggcacctgcccagaggccatccgggctgctggggacaggacccccagctag

SEQ ID NO: 163817 - DNA, 1482 bp, Artificial Sequence
  Description of Artificial Sequence: Synthetic coding sequence
atgtggccccaggaccccagcaggaaggaggtgctgcgctttgctgtgtcctgccgcatcctgaccctgatgctgcaggccctcttcaatgccatcatcccagaccaccacgccgaggccttcagccccccccggctggcccccagcggctttgtggaccagctggtggagggcctgctgggcggcctgagccactgggatgctgagcacttcctgttcatcgccgagcacggctacctgtatgagcacaactttgccttcttccctggcttccccctggccctgctggtgggcacagagctgctgcggcccctgcggggcctgctgagcctgcggagctgcctgctgatctctgtggccagcctgaacttcctgttcttcatgctggccgctgtggccctgcatgacctgggctgcctggtgctgcactgcccccaccagagcttctatgctgccctgctcttctgcctgagccctgccaacgtgttcctggccgccggctacagcgaggccctgtttgccctgctgaccttcagcgccatgggccagctggagcggggccgggtgtggacctctgtgctgctgtttgcctttgccaccggggtgcgcagcaatggcctggtgtctgtgggcttcctgatgcacagccagtgccagggcttcttcagcagcctgaccatgctgaaccccctgcggcagctgttcaagctgatggccagcctcttcctgagcgtcttcaccctgggcctgccctttgccctcttccagtactatgcctacacccagttctgcctgcccggcagcgcccggcccatccctgagcccctggtgcagctggccgtggacaagggctacagaattgctgagggcaatgaaccaccctggtgcttctgggatgtgcccctcatctacagctacatccaggatgtgtactggaatgtgggcttcctgaagtactatgagctgaagcaggtgcccaacttcctgctggccgcccctgtggccatcctggtggcctgggccacctggacctacgtgaccacccacccctggctgtgcctgaccctgggcctgcagaggagcaagaacaacaagaccctggagaagccagacctgggcttcctgagcccccaggtgtttgtgtatgtggtgcacgccgctgtgctgctgctgtttggaggcctgtgcatgcacgtgcaggtgctgacccgcttcctgggcagcagcacccccatcatgtactggttccctgcccacctgctgcaggaccaggagcccctgctgcggagcctgaagacagtgccctggaagcccctggccgaggacagccccccaggccagaaggtgcccaggaaccccatcatgggcctgctgtaccactggaagacctgcagccctgtgacccgctacatcctgggctacttcctgacctactggctgctgggcctgctgctgcactgcaacttcctgccctggacctag

SEQ ID NO: 163818 - DNA, 1482 bp, Artificial Sequence; identical to SEQ ID NO: 163817
  Description of Artificial Sequence: Synthetic coding sequence

SEQ ID NO: 163819 - DNA, 219 bp, Artificial Sequence
  Description of Artificial Sequence: Synthetic coding sequence
atgtggccccaggaccccagcaggaaggaggtgctgcgctttgctgtgtcctgccgcatcctgaccctgatgctgcaggccctcttcaatgccatcatcccagaccaccacgccgaggccttcagccccccccggctggcccccagcggctttgtggaccagctggtggagggcctgctgggcggcctgagccactgggatgctgagcacttcctgtag

SEQ ID NO: 163820 - DNA, 366 bp, Artificial Sequence
  Description of Artificial Sequence: Synthetic coding sequence
atgtggccccaggaccccagcaggaaggaggtgctgcgctttgctgtgtcctgccgcatcctgaccctgatgctgcaggccctcttcaatgccatcatcccagaccaccacgccgaggccttcagccccccccggctggcccccagcggctttgtggaccagctggtggagggcctgctgggcggcctgagccactgggatgctgagcacttcctgttcatcgccgagcacggctacctgtatgagcacaactttgccttcttccctggcttccccctggccctgctggtgggcacagagctgctgcggcccctgcggggcctgctgagcctgcggagctgcctgctgatctctgtggccagctag

SEQ ID NO: 163821 - DNA, 798 bp, Artificial Sequence
  Description of Artificial Sequence: Synthetic coding sequence
atgcccagcagccagatcaccatgcagaagcccagcctgctgctggcctggccaccccaggccctgtggaccaacagctggaagtactatgcctacacccagttctgcctgcccggcagcgcccggcccatccctgagcccctggtgcagctggccgtggacaagggctacagaattgctgagggcaatgaaccaccctggtgcttctgggatgtgcccctcatctacagctacatccaggatgtgtactggaatgtgggcttcctgaagtactatgagctgaagcaggtgcccaacttcctgctggccgcccctgtggccatcctggtggcctgggccacctggacctacgtgaccacccacccctggctgtgcctgaccctgggcctgcagaggagcaagaacaacaagaccctggagaagccagacctgggcttcctgagcccccaggtgtttgtgtatgtggtgcacgccgctgtgctgctgctgtttggaggcctgtgcatgcacgtgcaggtgctgacccgcttcctgggcagcagcacccccatcatgtactggttccctgcccacctgctgcaggaccaggagcccctgctgcggagcctgaagacagtgccctggaagcccctggccgaggacagccccccaggccagaaggtgcccaggaaccccatcatgggcctgctgtaccactggaagacctgcagccctgtgacccgctacatcctgggctacttcctgacctactggctgctgggcctgctgctgcactgcaacttcctgccctggacctag

SEQ ID NO: 163822 - DNA, 549 bp, Artificial Sequence
  Description of Artificial Sequence: Synthetic coding sequence
atgtggccccaggaccccagcaggaaggaggtgctgcgctttgctgtgtcctgccgcatcctgaccctgatgctgcaggccctcttcaatgccatcatcccagaccaccacgccgaggccttcagccccccccggctggcccccagcggctttgtggaccagctggtggagggcctgctgggcggcctgagccactgggatgctgagcacttcctgttcatcgccgagcacggctacctgtatgagcacaactttgccttcttccctggcttccccctggccctgctggtgggcacagagctgctgcggcccctgcggggcctgctgagcctgcggagctgcctgctgatctctgtggccagcctgaacttcctgttcttcatgctggccgctgtggccctgcatgacctgggctgcctggtgctgcactgcccccaccagagcttctatgctgccctgctcttctgcctgagccctgccaacgtgttcctggccgccggctacagcgaggccctgtttgccctgctgaccttcagcgccatgggctag

SEQ ID NO: 163823 - DNA, 1515 bp, Artificial Sequence
  Description of Artificial Sequence: Synthetic coding sequence
atgtctgagaagcagatgaaggaggcctttgtgagcaacctgaatggcaccaccgtgctggagatcacccagggcctgtgcttccctgccttctgcatcctgtgccggggcttcctgatcatcttcagccagtacctgtgcagcttcagccccacctggaagacccgcttcctgacagactttgtggtgctgattgtgcccatggtggccaccctgaccatctgggccagcttcatcctgctggagctgctgggcgtcatcatctttggagctggcctgctgtaccagatctacagaagaaggacctgctacgcccggctgcccttcctgaagatcctggagaagttcctgaacatcagcctggagagcgagtacaacccagccatcagctgcttccgggtcatcaccagcgccttcaccgccatcgccatcctggccgtggacttccccctcttccccaggagatttgccaagacagagctgtatggcaccggggccatggactttggagtgggcggctttgtgtttggcagcgccatggtgtgcctggaggtgagaagaaggaagtacatggagggcagcaagctgcactacttcaccaacagcctgtacagcgtgtggcccctggtgttcctgggcatcggccgcctggccatcatcaagagcatcggctaccaggagcacctgacagaatatggagtgcactggaacttcttcttcaccatcatcgtggtgaagctgatcacccccctgctgctgatcatcttccccctgaacaagtcctggatcatcgccctgggcatcaccgtgctgtaccagctggccctggacttcaccagcctgaagaggctcatcctgtatggaacagatggcagcggcaccagggtgggcctgctgaatgccaaccgggagggcatcatcagcaccctgggctacgtggccatccacatggccggcgtgcagacaggcctgtacatgcacaagaacagaagccacatcaaggacctgatcaaggtggcctgcttcctgctgctggccgccatcagcctcttcatcagcctgtatgtggtgcaggtgaatgtggaggccgtgtccaggaggatggccaacctggccttctgcatctggatcgtggccagcagcctcatcctgctgagcagcctgctgctgggggacatcatcctgagctttgccaagttcctgatcaagggggccctggtgccctgctcctggaagctgatccagagccctgtgaccaacaagaagcacagcgagagcctggtgcctgaggccgagaggatggagcccagcctgtgcctgatcacagccctgaacaggaagcagctgatcttcttcctgctgagcaacatcaccaccggcctcatcaacctgatggtggacaccctgcacagcagcaccctgtgggccctgtttgtggtgaacctgtacatgttcagcaactgcctgattgtgtatgtgctgtacctgcaggacaagacagtgcagttctggtag

SEQ ID NO: 163824 - DNA, 318 bp, Artificial Sequence
  Description of Artificial Sequence: Synthetic coding sequence
atgtctgagaagcagatgaaggaggcctttgtgagcaacctgaatggcaccaccgtgctggagatcacccagggcctgtgcttccctgccttctgcatcctgtgccggggcttcctgatcatcttcagccagtacctgtgcagcttcagccccacctggaagacccgcttcctgacagactttgtggtgctgattgtgcccatggtggccaccctgaccatctgggccagcttcatcctgctggagctgctgggcgtcatcatctttggagctggcctgctgtaccagatctacagaagaaggacctgctacgcctag

SEQ ID NO: 163825 - DNA, 831 bp, Artificial Sequence
  Description of Artificial Sequence: Synthetic coding sequence
ctggccgcccgggtggccgctgtgcgggctgctgcctggctgctgctgggcgccgccaccggcctgacccggggccctgctgctgccttcaccgctgcccggagtgatgctggcatccgggccatgtgcagcgagatcatcctgcggcaggaggtgctgaaggatggcttccaccgggacctgctgatcaaggtgaagtttggagagagcattgaggacctgcacacctgccgcctgctgatcaagcaggacatcccagctggcctgtatgtggacccctatgagctggccagcctgcgggagaggaacatcacagaagctgtgatggtgtctgagaactttgacatcgaggcccccaactacctgagcaaggagagcgaggtgctgatctatgcccggcgggacagccagtgcatcgactgcttccaggccttcctgcctgtgcactgccgctaccaccggccccacagtgaagatggagaggccagcatcgtggtgaacaacccagacctgctgatgttctgtgaccaggccggcagcaggaggatgatccgcttccgctttgacagctttgacaagaccatcgagttccccatcctgaagtgctgggcccacagcgaggtggccgccccctgtgccctggagaatgaagacatctgccagtggaacaagatgaagtacaagtctgtgtacaagaatgtcatcctgcaggtgcctgtgggcctgactgtgcacaccagcctggtgtgcagcgtgaccctgctgatcaccatcctgtgcagcaccctcatcctggtggccgtgttcaagtatggccacttcagcctgtag

SEQ ID NO: 163826 - DNA, 654 bp, Artificial Sequence
  Description of Artificial Sequence: Synthetic coding sequence
atgtgcagcgagatcatcctgcggcaggaggtgctgaaggatggcttccaccgggacctgctgatcaaggtgaagtttggagagagcattgaggacctgcacacctgccgcctgctgatcaagcaggacatcccagctggcctgtatgtggacccctatgagctggccagcctgcgggagaggaacatcacagaggccgtgatggtgtctgaaaattttgatattgaggcccccaactacctgagcaaggagagcgaggtgctgatctatgcccggcgggacagccagtgcatcgactgcttccaggccttcctgcctgtgcactgccgctaccaccggccccacagtgaagatggagaggccagcatcgtggtgaacaacccagacctgctgatgttctgtgaccaggagttccccatcctgaagtgctgggcccacagcgaggtggccgccccctgtgccctggagaatgaagacatctgccagtggaacaagatgaagtacaagtctgtgtacaagaatgtcatcctgcaggtgcctgtgggcctgactgtgcacaccagcctggtgtgcagcgtgaccctgctgatcaccatcctgtgcagcaccctcatcctggtggccgtgttcaagtatggccacttcagcctgtag

SEQ ID NO: 163827 - DNA, 777 bp, Artificial Sequence
  Description of Artificial Sequence: Synthetic coding sequence
ctggccgcccgggtggccgctgtgcgggctgctgcctggctgctgctgggcgccgccaccggcctgacccggggccctgctgctgccttcaccgctgcccggagtgatgctggcatccgggccatgtgcagcgagatcatcctgcggcaggaggtgctgaaggatggcttccaccgggacctgctgatcaaggtgaagtttggagagagcattgaggacctgcacacctgccgcctgctgatcaagcaggacatcccagctggcctgtatgtggacccctatgagctggccagcctgcgggagaggaacatcacagaagctgtgatggtgtctgagaactttgacatcgaggcccccaactacctgagcaaggagagcgaggtgctgatctatgcccggcgggacagccagtgcatcgactgcttccaggccttcctgcctgtgcactgccgctaccaccggccccacagtgaagatggagaggccagcatcgtggtgaacaacccagacctgctgatgttctgtgaccaggagttccccatcctgaagtgctgggcccacagcgaggtggccgccccctgtgccctggagaatgaagacatctgccagtggaacaagatgaagtacaagtctgtgtacaagaatgtcatcctgcaggtgcctgtgggcctgactgtgcacaccagcctggtgtgcagcgtgaccctgctgatcaccatcctgtgcagcaccctcatcctggtggccgtgttcaagtatggccacttcagcctgtag

SEQ ID NO: 163828 - DNA, 507 bp, Artificial Sequence
  Description of Artificial Sequence: Synthetic coding sequence
atggtgtctgagaactttgacatcgaggcccccaactacctgagcaaggagagcgaggtgctgatctatgcccggcgggacagccagtgcatcgactgcttccaggccttcctgcctgtgcactgccgctaccaccggccccacagtgaagatggagaggccagcatcgtggtgaacaacccagacctgctgatgttctgtgaccaggccggcagcaggaggatgatccgcttccgctttgacagctttgacaagaccatcgagttccccatcctgaagtgctgggcccacagcgaggtggccgccccctgtgccctggagaatgaagacatctgccagtggaacaagatgaagtacaagtctgtgtacaagaatgtcatcctgcaggtgcctgtgggcctgactgtgcacaccagcctggtgtgcagcgtgaccctgctgatcaccatcctgtgcagcaccctcatcctggtggccgtgttcaagtatggccacttcagcctgtag

SEQ ID NO: 163829 - DNA, 1740 bp, Artificial Sequence
  Description of Artificial Sequence: Synthetic coding sequence
atgcagatctgtggcagctctgtggcctctgtggccgccggcaccagcttccaggtgctgggccctgtgtgctggcagcagctggacctgaagatggctgtgcgggtgctgtggggcggcctgagcctgctgcgggtgctgtggtgcctgctgccccagacaggctacgtgcacccagatgagttcttccagagccctgaggtgatggccgaggacatcctgggcgtgcaggccgcccggccctgggagttctaccccagcagcagctgccgctctgtgctcttccccctgctgatcagcggcagcaccttctggctgctgcggctgtgggaggagctgggcccctggccaggcctggtgtctggctacgccctgctggtgggcccccggctgctgctgacagccctgagctttgccctggatggagctgtgtaccacctggccccacccatgggcgctgaccgctggaatgccctggccctgctgagcggcagctatgtgaccctggtgttctacaccaggaccttcagcaacaccatcgagggcctgctcttcacctggctgctggtgctggtgagcagccacgtgacctggggccccaccaggaaggagcccgcccctggcccccgctggaggtcctggctgctgggcggcatcgtggccgccggcttcttcaaccggcccaccttcctggcctttgctgtggtgcccctgtacctgtggggcaccaggggggccaccaaccctggcctgaagagcctgacccgggaggccctggtgctgctgcctggagctgccctgacagctgctgtgtttgtggccacagacagctggtacttcagcagccctgccaccagcaggaacctggtgctgacccctgtgaacttcctgcactacaacctgaacccccagaacctggcccggcacggcacccacgcccggctgacccacctggccgtgaatggcttcctgctgtttggagtgctgcacgcccaggccctgcaggccgcctggcagaggctgcaggtgggcctgcaggccagcgcccagatgggcctgctgcgggccctgggcgcccggagcctgctgagcagccccaggagctacctgctgctgctgtacttcatgcccctggccctgctgagcgccttcagccaccaggaggcccgcttcctgatccccctgctggtgcccctggtgctgctgtgcagcccccagacccagcctgtgccctggaagggcaccgtggtgctcttcaatgccctgggcgccctgctgtttggctgcctgcaccagggcggcctggtgcccggcctggagtacctggagcaggtggtgcacgcccctgtgctgcccagcacccccacccactacaccctgctcttcacccacacctacatgccacccaggcacctgctgcacctgcccggcctgggcgcccctgtggaggtggtggacatgggcggcacagaggactgggccctgtgccagaccctgaagagcttcacccggcagcctgcctgccaggtggccggcggcccctggctgtgccgcctgtttgtggtgaccccaggcaccacccggcgggctgtggagaagtgcagcttccccttcaagaatgagaccctgctcttcccccacctgaccctggaggaccccccagccctgagcagcctgctgagcggggcctggagggaccacctgagcctgcacatcgtggagctgggggaggagacctag

SEQ ID NO: 163830 - DNA, 813 bp, Artificial Sequence
  Description of Artificial Sequence: Synthetic coding sequence
atggtgctgctgaaggagtacagagtcatcctgcctgtgtctgtggatgagtaccaggtgggccagctgtacagcgtggccgaggccagcaagaatgagaccggcggcggggagggcgtggaggtgctggtgaatgagccctatgagaaggatggagagaagggccagtacacccacaagatctaccacctgcagagcaaggtgcccacctttgtgaggatgctggcccctgagggcgccctgaacatccacgagaaggcctggaatgcctacccctactgcaggacagtcatcaccaatgagtacatgaaggaggacttcctgatcaagattgagacctggcacaagccagacctgggcacccaggagaatgtgcacaagctggagcctgaggcctggaagcacgtggaggccgtgtacattgatattgctgacaggagccaggtgctgagcaaggactacaaggccgaggaggaccctgccaagttcaagagcatcaagacaggccggggccccctgggccccaactggaagcaggagctggtgaaccagaaggactgcccctacatgtgtgcctacaagctggtgacagtgaagttcaagtggtggggcctgcagaacaaggtggagaacttcatccacaagcaggagcggcggctcttcaccaacttccaccggcagctgttctgctggctggacaagtgggtggacctgaccatggatgacatccggaggatggaggaggagaccaagaggcagctggatgagatgaggcagaaggaccctgtgaagggcatgacagcagatgactag

SEQ ID NO: 163831 - DNA, 813 bp, Artificial Sequence
  Description of Artificial Sequence: Synthetic coding sequence
atggtgctgctgaaggagtacagagtcatcctgcctgtgtctgtggatgagtaccaggtgggccagctgtacagcgtggccgaggccagcaagaatgagaccggcggcggggagggcgtggaggtgctggtgaatgagccctatgagaaggatggagagaagggccagtacacccacaagatctaccacctgcagagcaaggtgcccacctttgtgaggatgctggcccctgagggcgccctgaacatccacgagaaggcctggaatgcctacccctactgcaggacagtgctgcccaatgagtacatgaaggaggacttcctgatcaagattgagacctggcacaagccagacctgggcacccaggagaatgtgcacaagctggagcctgaggcctggaagcacgtggaggccgtgtacattgatattgctgacaggagccaggtgctgagcaaggactacaaggccgaggaggaccctgccaagttcaagagcatcaagacaggccggggccccctgggccccaactggaagcaggagctggtgaaccagaaggactgcccctacatgtgtgcctacaagctggtgacagtgaagttcaagtggtggggcctgcagaacaaggtggagaacttcatccacaagcaggagcggcggctcttcaccaacttccaccggcagctgttctgctggctggacaagtgggtggacctgaccatggatgacatccggaggatggaggaggagaccaagaggcagctggatgagatgaggcagaaggaccctgtgaagggcatgacagcagatgactag

SEQ ID NO: 163832 - DNA, 594 bp, Artificial Sequence
  Description of Artificial Sequence: Synthetic coding sequence
atgctggcccctgagggcgccctgaacatccacgagaaggcctggaatgcctacccctactgcaggacagtgctgcccaatgagtacatgaaggaggacttcctgatcaagattgagacctggcacaagccagacctgggcacccaggagaatgtgcacaagctggagcctgaggcctggaagcacgtggaggccgtgtacatcgacattgctgacaggagccaggtgctgagcaaggactacaaggccgaggaggaccctgccaagttcaagagcatcaagacaggccggggccccctgggccccaactggaagcaggagctggtgaaccagaaggactgcccctacatgtgtgcctacaagctggtgacagtgaagttcaagtggtggggcctgcagaacaaggtggagaacttcatccacaagcaggagaggaggctcttcaccaacttccaccggcagctgttctgctggctggacaagtgggtggacctgaccatggatgacatccggaggatggaggaggagaccaagaggcagctggatgagatgaggcagaaggaccctgtgaagggcatgacagcagatgactag

SEQ ID NO: 163833 - DNA, 819 bp, Artificial Sequence
  Description of Artificial Sequence: Synthetic coding sequence
atggtgctgatcaaggagttccgggtggtgctgccctgcagcgtgcaggagtaccaggtgggccagctgtacagcgtggccgaggccagcaagaatgagaccggcggcggggagggcatcgaggtgctgaagaatgagccctatgagaaggatggagagaagggccagtacacccacaagatctaccacctgaagagcaaggtgcctgcctttgtgaggatgattgcccctgagggcagcctggtgttccacgagaaggcctggaatgcctacccctactgcaggaccatcgtgaccaatgagtacatgaaggatgacttcttcatcaagattgagacctggcacaagccagacctgggcaccctggagaatgtgcacggcctggaccccaacacctggaagacagtggagatcgtgcacattgatattgctgacaggagccaggtggagcctgctgactacaaggcagatgaggaccctgccctcttccagagcgtgaagaccaagaggggccccctgggccccaactggaagaaggagctggccaacagcccagactgcccccagatgtgtgcctacaagctggtgaccatcaagttcaagtggtggggcctgcagagcaaggtggagaacttcatccagaagcaggagaagaggatcttcaccaacttccaccggcagctgttctgctggattgacaagtggattgacctgaccatggaggacatccggaggatggaggatgagacccagaaggagctggagaccctgaggaaccagggccaggtgcggggcaccagcgctgccagtgatgaatag

SEQ ID NO: 163834 - DNA, 816 bp, Artificial Sequence
  Description of Artificial Sequence: Synthetic coding sequence
atggtgctgatcaaggagttccgggtggtgctgccctgcagcgtgcaggagtaccaggtgggccagctgtacagcgtggccgaggccagcaagaatgagaccggcggcggggagggcatcgaggtgctgaagaatgagccctatgagaaggatggagagaagggccagtacacccacaagatctaccacctgaagagcaaggtgcctgcctttgtgaggatgattgcccctgagggcagcctggtgttccacgagaaggcctggaatgcctacccctactgcaggaccatcgtgaccaatgagtacatgaaggatgacttcttcatcaagattgagacctggcacaagccagacctgggcaccctggagaatgtgcacggcctggaccccaacacctggaagacagtggagatcgtgcacattgatattgctgacaggagccaggtggagcctgctgactacaaggcagatgaggaccctgccctcttccagagcgtgaagaccaagaggggccccctgggccccaactggaagaaggagctggccaacagcccagactgcccccagatgtgtgcctacaagctggtgaccatcaagttcaagtggtggggcctgcagagcaaggtggagaacttcatccagaagcaggagaagaggatcttcaccaacttccaccggcagctgttctgctggattgacaagtggattgacctgaccatggaggacatccggaggatggaggatgagacccagaaggagctggagaccatgaggaagaggggctctgtgcggggcaccagcgctgctgatgtgtag

SEQ ID NO: 163835 - DNA, 363 bp, Artificial Sequence
  Description of Artificial Sequence: Synthetic coding sequence
atgattgcccctgagggcagcctggtgttccacgagaaggcctggaatgcctacccctactgcaggaccatcgtgaccaatgagtacatgaaggatgacttcttcatcaagattgagacctggcacaagccagacctgggcaccctggagaatgtgcacggcctggaccccaacacctggaagacagtggagatcgtgcacatcgacattgctgacaggagccaggtggagcctgctgactacaaggcagatgaagatcctgccctcttccagagcgtgaagaccaagaggggccccctgggccccaactggaagaaggagctggccaacagcccagactgcccccagatgtgtgcctactag

SEQ ID NO: 163836 - DNA, 507 bp, Artificial Sequence
  Description of Artificial Sequence: Synthetic coding sequence
atgggagacctgctgatggagaagtgccgggtggtgctgccctgcagcgtgcaggagtaccaggtgggccagctgtacagcgtggccgaggccagcaagaatgagaccggcggcggggagggcatcgaggtgctgaagaatgagccctatgagaaggatggagagaagggccagtacacccacaagatctaccacctgaagagcaaggtgcctgcctttgtgaggatgattgcccctgagggcagcctggtgttccacgagaaggcctggaatgcctacccctactgcaggaccatcgtgaccaatgagtacatgaaggatgacttcttcatcaagattgagacctggcacaagccagacctgggcaccctggagaatgtgcacggcctggaccccaacacctggaagacagtggagatcgtgcacattgatattgctgacaggagccaggtggagcctgctgactacaaggcagatgaggaccctgccctcttccagagcgtgtag

SEQ ID NO: 163837 - DNA, 822 bp, Artificial Sequence
  Description of Artificial Sequence: Synthetic coding sequence
atgggagacctgctgatggagaagtgccgggtggtgctgccctgcagcgtgcaggagtaccaggtgggccagctgtacagcgtggccgaggccagcaagaatgagaccggcggcggggagggcatcgaggtgctgaagaatgagccctatgagaaggatggagagaagggccagtacacccacaagatctaccacctgaagagcaaggtgcctgcctttgtgaggatgattgcccctgagggcagcctggtgttccacgagaaggcctggaatgcctacccctactgcaggaccatcgtgaccaatgagtacatgaaggatgacttcttcatcaagattgagacctggcacaagccagacctgggcaccctggagaatgtgcacggcctggaccccaacacctggaagacagtggagatcgtgcacattgatattgctgacaggagccaggtggagcctgctgactacaaggcagatgaggaccctgccctcttccagagcgtgaagaccaagaggggccccctgggccccaactggaagaaggagctggccaacagcccagactgcccccagatgtgtgcctacaagctggtgaccatcaagttcaagtggtggggcctgcagagcaaggtggagaacttcatccagaagcaggagaagaggatcttcaccaacttccaccggcagctgttctgctggattgacaagtggattgacctgaccatggaggacatccggaggatggaggatgagacccagaaggagctggagaccatgaggaagaggggctctgtgcggggcaccagcgctgctgatgtgtag

SEQ ID NO: 163838 - DNA, 4980 bp, Artificial Sequence
  Description of Artificial Sequence: Synthetic coding sequence
atggaggcccccagcggcagcgagcctggaggagatggagctggggactgtgcccacccagacccccgggcccctggagctgctgcccccagcagcggccctggcccctgtgccgccgcccgggagagcgagcggcagctgcggctgcggctgtgtgtgctgaatgagatcctgggcacagagcgggactatgtgggcaccctgcgcttcctgcagagcgccttcctgcaccgcatccggcagaatgtggccgacagcgtggagaagggcctgacagaggagaatgtgaaggtgctcttcagcaacatcgaggacatcctggaggtgcacaaggacttcctggccgccctggagtactgcctgcaccctgagccccagagccagcacgagctgggcaatgtgttcctgaagttcaaggacaagttctgtgtgtatgaggagtactgcagcaaccacgagaaggccctgcggctgctggtggagctgaacaagatccccaccgtgcgggccttcctgctgagctgcatgctgctgggcggcaggaagaccacagacatccccctggagggctacctgctgagccccatccagaggatctgcaagtaccccctgctgctgaaggagctggccaagaggacccctgggaagcacccagaccaccctgctgtgcagagcgccctgcaggccatgaagacagtgtgcagcaacatcaatgagaccaagaggcagatggagaagctggaggccctggagcagctgcagagccacatcgagggctgggagggcagcaacctgacagacatctgcacccagctgctgctgcagggcaccctgctgaagatctctgctggcaacatccaggagcgggccttcttcctgtttgacaacctgctggtgtactgcaagaggaagagccgggtgacaggcagcaagaagagcaccaagaggaccaagagcatcaatggcagcctgtacatcttccggggccgcatcaacacagaggtgatggaggtggagaatgtggaggatggaacagctgactaccacagcaatggctacacagtgaccaacggctggaagatccacaacacagccaagaacaagtggtttgtgtgcatggccaagacagctgaggagaagcagaagtggctggatgccatcatccgggagcgggagcagcgggagagcctgaagctgggcatggagagagatgcctacgtgatgattgctgagaagggggagaagctgtaccacatgatgatgaacaagaaggtgaacctgatcaaggacagaagaaggaagctgagcacagtgcccaagtgcttcctgggcaatgaatttgtggcctggctgctggagatcggggagatcagcaagacagaggagggcgtgaacctgggccaggccctgctggagaatggcatcatccaccacgtgtctgacaagcaccagttcaagaatgagcaggtgatgtaccgcttccgctatgatgatggcacctacaaggcccggtctgagctggaggacatcatgagcaaaggagtgcggctgtactgccgcctgcacagcctgtacacccctgtgatcaaggaccgggactaccacctgaagacctacaagtctgtgctgcccggcagcaagctggtggactggctgctggcccagggcgactgccagacccgggaggaggccgtggccctgggcgtgggcctgtgcaacaacggcttcatgcaccacgtgctggagaagtctgagttcagagatgagagccagtacttccgcttccacgcagatgaggagatggagggcaccagcagcaagaacaagcagctgagaaatgacttcaagctggtggagaacatcctggccaagaggctgctgatcctgccccaggaggaggactatggctttgatattgaggagaagaacaaggctgtggtggtgaagtctgtgcagaggggcagcctggccgaggtggccggcctgcaggtgggcaggaagatctacagcatcaatgaagacctggtgttcctgcggcccttcagcgaggtggagagcatcctgaaccagagcttctgcagcagaagacccctgcggctgctggtggccaccaaggccaaggagatcatcaagatcccagaccagcctgacaccctgtgcttccagatccggggggccgccccaccctacgtgtatgctgtgggccggggcagcgaggccatggctgctggcctgtgtgccggccagtgcatcctgaaggtgaatggcagcaatgtgatgaatgatggagcccctgaggtgctggagcacttccaggccttccgcagcagaagagaggaggccctgggcctgtaccagtggatctaccacacccatgaagatgcccaggaggcccgggccagccaggaggccagcacagaggaccccagcggggagcaggcccaggaggaggaccaggccgacagcgccttccccctgctgagcctgggcccccggctgagcctgtgtgaggacagccccatggtgaccctgactgtggacaacgtgcacctggagcacggcgtggtgtatgaatatgtgtccacagctggggtgcgctgccacgtgctggagaagatcgtggagccccggggctgcttcggcctgacagccaagatcctggaggcctttgctgccaatgattctgtgtttgtggagaactgccggcggctgatggccctgagcagcgccatcgtgaccatgccccactttgagttcaggaacatctgtgacaccaagctggagagcatcggccagagaattgcctgctaccaggagtttgctgcccagctgaagagccgggtgagcccccccttcaagcaggcccccctggagccccaccccctgtgtggcctggacttctgccccaccaactgccacatcaacctgatggaggtgtcctaccccaagaccaccccatctgtgggccgctccttcagcatccgcttcggcaggaagcccagcctgattggcctggaccctgagcagggccacctgaaccccatgagctacacccagcactgcatcaccaccatggccgcccccagctggaagtgcctgcctgctgctgagggggacccccagggccagggcctgcatgatggcagctttggacctgccagcggcaccctgggccaggaggaccggggcctgtccttcctgctgaagcaggaggaccgggagatccaggatgcctacctgcagctgttcaccaagctggatgtggccctgaaggagatgaagcagtatgtgacccagatcaaccggctgctgagcaccatcacagagcccaccagcggcggcagctgtgatgccagcctggccgaggaggccagcagcctgcccctggtgtctgaggagagcgagatggacagaagtgaccatggaggcatcaagaaggtgtgcttcaaggtggccgaggaggaccaggaggacagcggccatgacaccatgagctacagagacagctacagcgagtgcaacagcaacagagattctgtgctgagctacacctctgtgcgcagcaacagcagctacctgggcagtgatgagatgggcagcggagatgagctgccctgtgacatgaggatccccagcgacaagcaggacaagctgcacggctgcctggagcacctgttcaaccaggtggacagcatcaatgccctgctgaagggccctgtgatgagccgggcctttgaggagaccaagcacttccccatgaaccacagcctgcaggagttcaagcagaaggaggagtgcaccatccggggccgcagcctcatccagatcagcatccaggaggacccctggaacctgcccaacagcatcaagaccctggtggacaacatccagagatatgtggaggatggcaagaaccagctgctgctggccctgctgaagtgcacagacacagagctgcagctgcggagagatgccatcttctgccaggccctggtggccgctgtgtgcaccttcagcaagcagctgctggccgccctgggctaccgctacaacaacaatggagaatatgaggagagcagcagagatgccagcaggaagtggctggagcaggtggccgccaccggggtgctgctgcactgccagagcctgctgagccctgccaccgtgaaggaggagaggaccatgctggaggacatctgggtgaccctgtctgagctggacaacgtgaccttctccttcaagcagctggatgagaactacgtggccaacaccaacgtgttctaccacatcgagggcagccggcaggccctgaaggtgatcttctacctggacagctaccacttcagcaagctgcccagccggctggagggcggggccagcctgcggctgcacacagccctcttcaccaaggtgctggagaatgtggagggcctgcccagccctggcagccaggccgctgaggacctgcagcaggacatcaatgcccagagcctggagaaggtgcagcagtactacaggaagctgcgggccttctacctggagaggagcaacctgcccacagatgccagcaccacagctgtgaagattgaccagctgatccggcccatcaatgccctggatgagctgtgccgcctgatgaagagctttgtgcaccccaagccaggagctgctggctctgtgggcgccggcctcatccccatcagcagcgagctgtgctaccgcctgggcgcctgccagatggtgatgtgtggcaccggcatgcagaggagcaccctgtctgtgtccctggagcaggccgccatcctggcccggagccacggcctgctgcccaagtgcatcatgcaggccacagacatcatgaggaagcagggcccccgggtggagatcctggccaagaacctgcgggtgaaggaccagatgccccagggcgccccccggctgtaccgcctgtgccagccccctgtggatggagacctgtag

SEQ ID NO: 163839 - DNA, 4686 bp, Artificial Sequence
  Description of Artificial Sequence: Synthetic coding sequence
atggaggcccccagcggcagcgagcctggaggagatggagctggggactgtgcccacccagacccccgggcccctggagctgctgcccccagcagcggccctggcccctgtgccgccgcccgggagagcgagcggcagctgcggctgcggctgtgtgtgctgaatgagatcctgggcacagagcgggactatgtgggcaccctgcgcttcctgcagagcgccttcctgcaccgcatccggcagaatgtggccgacagcgtggagaagggcctgacagaggagaatgtgaaggtgctcttcagcaacatcgaggacatcctggaggtgcacaaggacttcctggccgccctggagtactgcctgcaccctgagccccagagccagcacgagctgggcaatgtgttcctgaagttcaaggacaagttctgtgtgtatgaggagtactgcagcaaccacgagaaggccctgcggctgctggtggagctgaacaagatccccaccgtgcgggccttcctgctgagctgcatgctgctgggcggcaggaagaccacagacatccccctggagggctacctgctgagccccatccagaggatctgcaagtaccccctgctgctgaaggagctggccaagaggacccctgggaagcacccagaccaccctgctgtgcagagcgccctgcaggccatgaagacagtgtgcagcaacatcaatgagaccaagaggcagatggagaagctggaggccctggagcagctgcagagccacatcgagggctgggagggcagcaacctgacagacatctgcacccagctgctgctgcagggcaccctgctgaagatctctgctggcaacatccaggagcgggccttcttcctgtttgacaacctgctggtgtactgcaagaggaagagccgggtgacaggcagcaagaagagcaccaagaggaccaagagcatcaatggcagcctgtacatcttccggggccgcatcaacacagaggtgatggaggtggagaatgtggaggatggaacagctgactaccacagcaatggctacacagtgaccaacggctggaagatccacaacacagccaagaacaagtggtttgtgtgcatggccaagacagctgaggagaagcagaagtggctggatgccatcatccgggagcgggagcagcgggagagcctgaagctgggcatggagagagatgcctacgtgatgattgctgagaagggggagaagctgtaccacatgatgatgaacaagaaggtgaacctgatcaaggacagaagaaggaagctgagcacagtgcccaagtgcttcctgggcaatgaatttgtggcctggctgctggagatcggggagatcagcaagacagaggagggcgtgaacctgggccaggccctgctggagaatggcatcatccaccacgtgtctgacaagcaccagttcaagaatgagcaggtgatgtaccgcttccgctatgatgatggcacctacaaggcccggtctgagctggaggacatcatgagcaaaggagtgcggctgtactgccgcctgcacagcctgtacacccctgtgatcaaggaccgggactaccacctgaagacctacaagtctgtgctgcccggcagcaagctggtggactggctgctggcccagggcgactgccagacccgggaggaggccgtggccctgggcgtgggcctgtgcaacaacggcttcatgcaccacgtgctggagaagtctgagttcagagatgagagccagtacttccgcttccacgcagatgaggagatggagggcaccagcagcaagaacaagcagctgagaaatgacttcaagctggtggagaacatcctggccaagaggctgctgatcctgccccaggaggaggactatggctttgatattgaggagaagaacaaggctgtggtggtgaagtctgtgcagaggggcagcctggccgaggtggccggcctgcaggtgggcaggaagatctacagcatcaatgaagacctggtgttcctgcggcccttcagcgaggtggagagcatcctgaaccagagcttctgcagcagaagacccctgcggctgctggtggccaccaaggccaaggagatcatcaagatcccagaccagcctgacaccctgtgcttccagatccggggggccgccccaccctacgtgtatgctgtgggccggggcagcgaggccatggctgctggcctgtgtgccggccagtgcatcctgaaggtgaatggcagcaatgtgatgaatgatggagcccctgaggtgctggagcacttccaggccttccgcagcagaagagaggaggccctgggcctgtaccagtggatctaccacacccatgaagatgcccaggaggcccgggccagccaggaggccagcacagaggaccccagcggggagcaggcccaggaggaggaccaggccgacagcgccttccccctgctgagcctgggcccccggctgagcctgtgtgaggacagccccatggtgaccctgactgtggacaacgtgcacctggagcacggcgtggtgtatgaatatgtgtccacagctggggtgcgctgccacgtgctggagaagatcgtggagccccggggctgcttcggcctgacagccaagatcctggaggcctttgctgccaatgattctgtgtttgtggagaactgccggcggctgatggccctgagcagcgccatcgtgaccatgccccactttgagttcaggaacatctgtgacaccaagctggagagcatcggccagagaattgcctgctaccaggagtttgctgcccagctgaagagccgggtgagcccccccttcaagcaggcccccctggagccccaccccctgtgtggcctggacttctgccccaccaactgccacatcaacctgatggaggtgtcctaccccaagaccaccccatctgtgggccgctccttcagcatccgcttcggcaggaagcccagcctgattggcctggaccctgagcagggccacctgaaccccatgagctacacccagcactgcatcaccaccatggccgcccccagctggaagtgcctgcctgctgctgagggggacccccagggccagggcctgcatgatggcagctttggacctgccagcggcaccctgggccaggaggaccggggcctgtccttcctgctgaagcaggaggaccgggagatccaggatgcctacctgcagctgttcaccaagctggatgtggccctgaaggagatgaagcagtatgtgacccagatcaaccggctgctgagcaccatcacagagcccaccagcggcggcagctgtgatgccagcctggccgaggaggccagcagcctgcccctggtgtctgaggagagcgagatggacagaagtgaccatggaggcatcaagaaggtgtgcttcaaggtggccgaggaggaccaggaggacagcggccatgacaccatgagctacagagacagctacagcgagtgcaacagcaacagagattctgtgctgagctacacctctgtgcgcagcaacagcagctacctgggcagtgatgagatgggcagcggagatgagctgccctgtgacatgaggatccccagcgacaagcaggacaagctgcacggctgcctggagcacctgttcaaccaggtggacagcatcaatgccctgctgaagggccctgtgatgagccgggcctttgaggagaccaagcacttccccatgaaccacagcctgcaggagttcaagcagaaggaggagtgcaccatccggggccgcagcctcatccagatcagcatccaggaggacccctggaacctgcccaacagcatcaagaccctggtggacaacatccagagatatgtggaggatggcaagaaccagctgctgctggccctgctgaagtgcacagacacagagctgcagctgcggagagatgccatcttctgccaggccctggtggccgctgtgtgcaccttcagcaagcagctgctggccgccctgggctaccgctacaacaacaatggagaatatgaggagagcagcagagatgccagcaggaagtggctggagcaggtggccgccaccggggtgctgctgcactgccagagcctgctgagccctgccaccgtgaaggaggagaggaccatgctggaggacatctgggtgaccctgtctgagctggacaacgtgaccttctccttcaagcagctggatgagaactacgtggccaacaccaacgtgttctaccacatcgagggcagccggcaggccctgaaggtgatcttctacctggacagctaccacttcagcaagctgcccagccggctggagggcggggccagcctgcggctgcacacagccctcttcaccaagggggagctgcaggcctggggcagagaagatcatggaggccgggccaaggccaccaagcacacaggcagccagcccccagcccggcccaggcacctgcccagccagtgctggaggacctggaggggctgcctgctgcaggccgcccggccccggcgcatctgcagcaggaccagcaccaggagcccctggaggaagttcagcagcatcacagccaacagcggccacttcacctggagcggcctgacctgccccaggatgcctgcccccaggaggtag

SEQ ID NO: 163840 - DNA, 4821 bp, Artificial Sequence
  Description of Artificial Sequence: Synthetic coding sequence
atgtctgaggacagcagaggagacagcagagctgagagcgccaaggacctggagaagcagctgcggctgcgggtgtgtgtgctgtctgagctgcagaagacagagcgggactatgtgggcaccctggagttcctggtgtctgccttcctgcacaggatgaaccagtgtgccgccagcaaggtggacaagaatgtgacagaggagaccgtgaagatgctgttcagcaacatcgaggacatcctggccgtgcacaaggagttcctgaaggtggtggaggagtgcctgcaccctgagcccaatgcccagcaggaggtgggcacctgcttcctgcacttcaaggacaagttccgcatctatgatgagtactgcagcaaccacgagaaggcccagaagctgctgctggagctgaacaagatccgcaccatccgcaccttcctgctgaactgcatgctgctgggcggcaggaagaacacagatgtgcccctggagggctacctggtgacccccatccagaggatctgcaagtaccccctcatcctgaaggagctgctgaagaggacccccaggaagcacagcgactatgctgctgtgatggaggccctgcaggccatgaaggctgtgtgcagcaacatcaatgaggccaagaggcagatggagaagctggaggtgctggaggagtggcagagccacatcgagggctgggagggcagcaacatcacagacacctgcacagagatgctgatgtgtggggtgctgctgaagatcagcagcggcaacatccaggagagggtcttcttcctgtttgacaacctgctggtgtactgcaagaggaagcaccggcggctgaagaacagcaaggccagcacagatggccaccgctacctgttccggggccgcatcaacacagaggtgatggaggtggagaatgtggatgatggaacagctgacttccacagcagcggccacatcgtggtgaatggctggaagatccacaacacagccaagaacaagtggtttgtgtgcatggccaagaccccagaggagaagcatgagtggtttgaggccatcctgaaggagcgggagaggaggaagggcctgaagctgggcatggagcaggacacctgggtgatgatcagcgagcagggcgagaagctgtacaagatgatgtgccggcagggcaacctgatcaaggacaggaagaggaagctgaccaccttccccaagtgcttcctgggcagcgagtttgtgtcctggctgctggagatcggggagatccacaggcctgaggagggcgtgcacctgggccaggccctgctggagaatggcatcatccaccacgtgacagacaagcaccagttcaagccagagcagatgctgtaccgcttccgctatgatgatggcaccttctaccccagaaatgagatgcaggatgtgatcagcaaaggagtgcggctgtactgccgcctgcacagcctcttcacccctgtgatccgggacaaggactaccacctgcggacctacaagtctgtggtgatggccaacaagctgattgactggctgattgcccagggcgactgcaggacccgggaggaggccatgatctttggagtgggcctgtgtgacaatggcttcatgcaccacgtgctggagaagtctgagttcaaggatgagcccctgctcttccgcttcttcagtgatgaggagatggagggcagcaacatgaagcaccggctgatgaagcatgacctgaaggtggtggagaatgtcatcgccaagagcctgctgatcaagagcaatgaaggcagctatggcttcggcctggaggacaagaacaaggtgcccatcatcaagctggtggagaagggcagcaatgctgagatggccggcatggaggtgggcaagaagatctttgccatcaacggggacctggtgttcatgaggcccttcaatgaggtggactgcttcctgaagagctgcctgaacagcaggaagcccctgcgggtgctggtgtccaccaagccccgggagaccgtgaagatcccagattctgcagatggcctgggcttccagatccggggcttcggccccagcgtggtgcatgctgtgggccggggcaccgtggccgctgctgctggcctgcaccctggccagtgcatcatcaaggtgaatggcatcaacgtgtccaaggagacccacgccagcgtcatcgcccacgtgacagcctgcaggaagtaccgccggcccaccaagcaggacagcatccagtgggtgtacaacagcattgaaagtgcccaggaggacctgcagaagagccacagcaagcccccaggagatgaggccggagatgcctttgactgcaaggtggaggaggtgattgacaagttcaacaccatggccatcattgatggcaagaaggagcacgtgtccctgactgtggacaacgtgcacctggagtatggagtggtgtatgaatatgacagcacagctggcatcaagtgcaatgtggtggagaagatgattgagcccaagggcttcttcagcctgacagccaagatcctggaggccctggccaagagtgatgagcactttgtgcagaactgcaccagcctgaacagcctgaatgaggtgatccccacagacctgcagagcaagttcagcgccctgtgcagcgagagaattgagcacctgtgccagaggatcagcagctacaagaagttcagccgggtgctgaagaacagagcctggcccaccttcaagcaggccaagagcaagatcagccccctgcacagcagtgacttctgccccaccaactgccacgtgaatgtgatggaggtgtcctaccccaagaccagcaccagcctgggcagcgccttcggcgtgcagctggacagcaggaagcacaacagccatgacaaggagaacaagagcagcgagcagggcaagctgagccccatggtgtacatccagcacaccatcaccaccatggccgcccccagcggcctgagcctgggccagcaggacggccacggcctgcgctacctgctgaaggaggaggacctggagacccaggacatctaccagaagctgctgggcaagctgcagacagccctgaaggaggtggagatgtgtgtgtgccagattgatgacctgctgagcagcatcacctacagccccaagctggagaggaagaccagcgagggcatcatccccacagacagcgacaatgaaaaaggagagaggaacagcaagagggtgtgcttcaacgtggccggagatgagcaggaggacagcggccatgacaccatcagcaacagagacagctacagcgactgcaacagcaacagaaattccatcgccagcttcaccagcatctgcagcagccagtgcagcagctacttccacagtgatgagatggacagcggagatgagctgcccctgtctgtgcgcatcagccatgacaagcaggacaagatccacagctgcctggagcacctgttcagccaggtggacagcatcaccaacctgctgaagggccaggccgtggtgcgggcctttgaccagaccaagtacctgaccccaggccggggcctgcaggagttccagcaggagatggagcccaagctgagctgccccaagaggctgcggctgcacatcaagcaggacccctggaacctgcccagctctgtgaggaccctggcccagaacatcaggaagtttgtggaggaggtgaagtgccgcctgctgctggccctgctggagtacagcgacagcgagacccagctgcggcgggacatggtgttctgccagaccctggtggccaccgtgtgtgccttcagcgagcagctgatggccgccctgaaccagatgtttgacaacagcaaagaaaatgagatggagacctgggaggccagccgccgctggctggaccagatcgccaatgctggggtgctcttccacttccagagcctgctgagccccaacctgacagatgagcaggccatgctggaggacaccctggtggccctgtttgacctggagaaggtgtccttctacttcaagcccagcgaggaggagcccctggtggccaacgtgcccctgacctaccaggccgagggcagccggcaggccctgaaggtgtacttctacatcgacagctaccactttgagcagctgccccagaggctgaagaatggaggcggcttcaagatccaccctgtgctgtttgcccaggccctggagagcatggagggctactactacagagacaacgtgtctgtggaggagttccaggcccagatcaatgctgccagcctggagaaggtgaagcagtacaaccagaagctgcgggccttctacctggacaagagcaacagcccccccaacagcaccagcaaggccgcctacgtggacaagctgatgaggcccctgaatgccctggatgagctgtaccgcctggtggccagcttcatccgcagcaagaggacagctgcctgtgccaacacagcctgcagcgccagcggcgtgggcctgctgtctgtgtcctctgagctgtgcaaccggctgggcgcctgccacatcatcatgtgcagcagtggagtgcaccgctgcaccctgtctgtgaccctggagcaggccatcatcctggcccggagccacggcctgcccccacgctacatcatgcaggccacagatgtgatgaggaagcagggcgcccgggtgcagaacacagccaagaacctgggcgtgcgggacaggaccccccagagcgccccccggctgtacaagctgtgtgagcccccacctcctgctggggaggagtag

SEQ ID NO: 163841 - DNA, 3525 bp, Artificial Sequence
  Description of Artificial Sequence: Synthetic coding sequence
atgtctgaggacagcagaggagacagcagagctgagagcgccaaggacctggagaagcagctgcggctgcgggtgtgtgtgctgtctgagctgcagaagacagagcgggactatgtgggcaccctggagttcctggtgtctgccttcctgcacaggatgaaccagtgtgccgccagcaaggtggacaagaatgtgacagaggagaccgtgaagatgctgttcagcaacatcgaggacatcctggccgtgcacaaggagttcctgaaggtggtggaggagtgcctgcaccctgagcccaatgcccagcaggaggtgggcacctgcttcctgcacttcaaggacaagttccgcatctatgatgagtactgcagcaaccacgagaaggcccagaagctgctgctggagctgaacaagatccgcaccatccgcaccttcctgctgaactgcatgctgctgggcggcaggaagaacacagatgtgcccctggagggctacctggtgacccccatccagaggatctgcaagtaccccctcatcctgaaggagctgctgaagaggacccccaggaagcacagcgactatgctgctgtgatggaggccctgcaggccatgaaggctgtgtgcagcaacatcaatgaggccaagaggcagatggagaagctggaggtgctggaggagtggcagagccacatcgagggctgggagggcagcaacatcacagacacctgcacagagatgctgatgtgtggggtgctgctgaagatcagcagcggcaacatccaggagagggtcttcttcctgtttgacaacctgctggtgtactgcaagaggaagcaccggcggctgaagaacagcaaggccagcacagatggccaccgctacctgttccggggccgcatcaacacagaggtgatggaggtggagaatgtggatgatggaacagctgacttccacagcagcggccacatcgtggtgaatggctggaagatccacaacacagccaagaacaagtggtttgtgtgcatggccaagaccccagaggagaagcatgagtggtttgaggccatcctgaaggagcgggagaggaggaagggcctgaagctgggcatggagcaggacacctgggtgatgatcagcgagcagggcgagaagctgtacaagatgatgtgccggcagggcaacctgatcaaggacaggaagaggaagctgaccaccttccccaagtgcttcctgggcagcgagtttgtgtcctggctgctggagatcggggagatccacaggcctgaggagggcgtgcacctgggccaggccctgctggagaatggcatcatccaccacgtgacagacaagcaccagttcaagccagagcagatgctgtaccgcttccgctatgatgatggcaccttctaccccagaaatgagatgcaggatgtgatcagcaaaggagtgcggctgtactgccgcctgcacagcctcttcacccctgtgatccgggacaaggactaccacctgcggacctacaagtctgtggtgatggccaacaagctgattgactggctgattgcccagggcgactgcaggacccgggaggaggccatgatctttggagtgggcctgtgtgacaatggcttcatgcaccacgtgctggagaagtctgagttcaaggatgagcccctgctcttccgcttcttcagtgatgaggagatggagggcagcaacatgaagcaccggctgatgaagcatgacctgaaggtggtggagaatgtcatcgccaagagcctgctgatcaagagcaatgaaggcagctatggcttcggcctggaggacaagaacaaggtgcccatcatcaagctggtggagaagggcagcaatgctgagatggccggcatggaggtgggcaagaagatctttgccatcaacggggacctggtgttcatgaggcccttcaatgaggtggactgcttcctgaagagctgcctgaacagcaggaagcccctgcgggtgctggtgtccaccaagccccgggagaccgtgaagatcccagattctgcagatggcctgggcttccagatccggggcttcggccccagcgtggtgcatgctgtgggccggggcaccgtggccgctgctgctggcctgcaccctggccagtgcatcatcaaggtgaatggcatcaacgtgtccaaggagacccacgccagcgtcatcgcccacgtgacagcctgcaggaagtaccgccggcccaccaagcaggacagcatccagtgggtgtacaacagcattgaaagtgcccaggaggacctgcagaagagccacagcaagcccccaggagatgaggccggagatgcctttgactgcaaggtggaggaggtgattgacaagttcaacaccatggccatcattgatggcaagaaggagcacgtgtccctgactgtggacaacgtgcacctggagtatggagtggtgtatgaatatgacagcacagctggcatcaagtgcaatgtggtggagaagatgattgagcccaagggcttcttcagcctgacagccaagatcctggaggccctggccaagagtgatgagcactttgtgcagaactgcaccagcctgaacagcctgaatgaggtgatccccacagacctgcagagcaagttcagcgccctgtgcagcgagagaattgagcacctgtgccagaggatcagcagctacaagaaggtgtctgtgctgctgatcctgtacaccatcatcgtggagatgtaccacttcacagagatgatcaccctgtacaacatcctggagctggtgcggccccccaacagcgagttcttcttctccttcctgcccaccaagaggatgaagaccctgaaccagaagaaggtgacccacatgaagaagaccaacatccagctgcagttcagccgggtgctgaagaacagagcctggcccaccttcaagcaggccaagagcaagatcagccccctgcacagcagtgacttctgccccaccaactgccacgtgaatgtgatggaggtgtcctaccccaagaccagcaccagcctgggcagcgccttcggcgtgcagtggaagctgagccccatggtgtacatccagcacaccatcaccaccatggccgcccccagcggcctgagcctgggccagcaggacggccacggcctgcgctacctgctggagaggaagaccagcgagggcatcatccccacagacagcgacaatgagaagggggagaggaacagcaagagggtgtgcttcaacgtggccggagatgagcaggaggacagcggccatgacaccatcagcaacagagacagctacagcttcagtgactgcaacagcaacagaaacagcatcgccagcttcaccagcatctgcagcagccagtgcagcagctacttccacagtgatgagatggattctggcagtgatgagctgcccctgtctgtgcgcatcagccatgacaagcaggacaagatccacagctgcctggagcacctgttcagccagtag

SEQ ID NO: 163842 - DNA, 1650 bp, Artificial Sequence
  Description of Artificial Sequence: Synthetic coding sequence
atggccagcgccagcagcggccccagcagctctgtgggcttcagcagctttgatcctgctgtgcccagctgcaccctgagcagcgccagcggcatcaagaggcccatggccagcgaggtgccctatgccagcggcatgcccatcaagaagattggccacaggtctgtggacagcagtggagagaccacctacaagaagaccaccagcagcgccctgaagggggccatccagctgggcatcacccacacagtgggcagcctgagcaccaagccagagagagatgtgctgatgcaggacttctacgtggtggagagcatcttcttccccagcgagggcagcaacctgaccccagcccaccactacaatgacttccgcttcaagacctacgcccctgtggccttccgctacttccgggagctgtttggcatccggccagatgactacctgtacagcctgtgcagcgagcccctcatcgagctgtgcagcagcggggccagcggcagcctcttctacgtgtccagtgatgatgagttcatcatcaagacagtgcagcacaaggaggccgagttcctgcagaagctgctgcccggctactacatgaacctgaaccagaaccccaggaccctgctgcccaagttctacggcctgtactgtgtgcaggccggcggcaagaacatccgcatcgtggtgatgaacaacctgctgcccaggtctgtgaagatgcacatcaagtatgacctgaagggcagcacctacaagaggcgggccagccagaaggagcgggagaagcccctgcccaccttcaaggacctggacttcctgcaggacatcccagatggcctcttcctggatgctgacatgtacaatgccctgtgcaagaccctgcagagggactgcctggtgctgcagagcttcaagatcatggactacagcctgctgatgagcatccacaacatcgaccacgcccagcgggagcccctgagcagcgagacccagtacagcgtggacacccggcggcctgccccccagaaggccctgtacagcacagccatggagagcatccagggcgaggccaggagaggaggcaccatggagacagatgaccacatgggcggcatcccagccaggaacagcaaaggagagcggctgctgctgtacatcggcatcatcgacatcctgcagagctacagatttgtgaagaagctggagcacagctggaaggccctggtgcatgatggagacacagtgtctgtgcacaggcctggcttctatgcagagcgcttccagcgcttcatgtgcaacacagtgttcaagaagatccccctgaagcccagccccagcaagaagttccgcagcggcagcagcttcagccggcgggccggcagcagcggcaacagctgcatcacctaccagcccagcgtgtctggagagcacaaggcccaggtgaccaccaaggccgaggtggagcccggggtgcacctgggccgcccagatgtgctgccccagaccccacccctggaggagatcagcgagggcagccccatcccagaccccagcttcagccccctggtgggggagaccctgcagatgctgaccaccagcaccaccctggagaagctggaggtggccgagagcgagttcacccactag

SEQ ID NO: 163843 - DNA, 1689 bp, Artificial Sequence
  Description of Artificial Sequence: Synthetic coding sequence
atggccagcgccagcagcggccccagcagctctgtgggcttcagcagctttgatcctgctgtgcccagctgcaccctgagcagcgctgccagcggcatcaagaggcccatggccagcgaggtgctggaggcccggcaggacagctacatcagcctggtgccctatgccagcggcatgcccatcaagaagattggccacaggtctgtggacagcagcggggagaccacctacaagaagaccaccagcagcgccctgaagggggccatccagctgggcatcacccacacagtgggcagcctgagcaccaagccagagagagatgtgctgatgcaggacttctacgtggtggagagcatcttcttccccagcgagggcagcaacctgaccccagcccaccactacaatgacttccgcttcaagacctacgcccctgtggccttccgctacttccgggagctgtttggcatccggccagatgactacctgtacagcctgtgcagcgagcccctgattgagctgtgcagcagcggggccagcggcagcctcttctacgtgtccagtgatgatgagttcatcatcaagacagtgcagcacaaggaggccgagttcctgcagaagctgctgcccggctactacatgaacctgaaccagaaccccaggaccctgctgcccaagttctacggcctgtactgtgtgcaggccggcggcaagaacatcagaattgtggtgatgaacaacctgctgcccaggtctgtgaagatgcacatcaagtatgacctgaagggcagcacctacaagagaagagccagccagaaggagcgggagaagcccctgcccaccttcaaggacctggacttcctgcaggacatcccagatggcctcttcctggatgctgacatgtacaatgccctgtgcaagaccctgcagagggactgcctggtgctgcagagcttcaagatcatggactacagcctgctgatgagcatccacaacatcgaccacgcccagcgggagcccctgagcagcgagacccagtacagcgtggacaccaggaggcctgccccccagaaggccctgtacagcacagccatggagagcatccagggcgaggcccggcggggcggcaccatggagacagatgaccacatgggcggcatcccagccaggaacagcaagggggagcggctgctgctgtacatcggcatcatcgacatcctgcagagctacagatttgtgaagaagctggagcacagctggaaggccctggtgcatgatggagacacagtgtctgtgcaccggcccggcttctacgccgagcgcttccagcgcttcatgtgcaacacagtgttcaagaagatccccctgaagcccagccccagcaagaagttccgcagcggcagcagcttcagcagaagagctggcagcagcggcaacagctgcatcacctaccagcccagcgtgtctggagagcacaaggcccaggtgaccaccaaggccgaggtggagcccggggtgcacctgggccgcccagatgtgctgccccagaccccacccctggaggagatcagcgagggcagccccatcccagaccccagcttcagccccctggtgggggagaccctgcagatgctgaccaccagcaccaccctggagaagctggaggtggccgagagcgagttcacccactag

SEQ ID NO: 163844 - DNA, 1503 bp, Artificial Sequence
  Description of Artificial Sequence: Synthetic coding sequence
atggccagcgccagcagcggccccagcagctctgtgggcttcagcagctttgatcctgctgtgcccagctgcaccctgagcagcgccagcggcatcaagaggcccatggccagcgaggtgccctatgccagcggcatgcccatcaagaagattggccacaggtctgtggacagcagtggagagaccacctacaagaagaccaccagcagcgccctgaagggggccatccagctgggcatcacccacacagtgggcagcctgagcaccaagccagagagagatgtgctgatgcaggacttctacgtggtggagagcatcttcttccccagcgagggcagcaacctgaccccagcccaccactacaatgacttccgcttcaagacctacgcccctgtggccttccgctacttccgggagctgtttggcatccggccagatgactacctgtacagcctgtgcagcgagcccctcatcgagctgtgcagcagcggggccagcggcagcctcttctacgtgtccagtgatgatgagttcatcatcaagacagtgcagcacaaggaggccgagttcctgcagaagctgctgcccggctactacatgaacctgaaccagaaccccaggaccctgctgcccaagttctacggcctgtactgtgtgcaggccggcggcaagaacatccgcatcgtggtgatgaacaacctgctgcccaggtctgtgaagatgcacatcaagtatgacctgaagggcagcacctacaagaggcgggccagccagaaggagcgggagaagcccctgcccaccttcaaggacctggacttcctgcaggacatcccagatggcctcttcctggatgctgacatgtacaatgccctgtgcaagaccctgcagagggactgcctggtgctgcagagcttcaagatcatggactacagcctgctgatgagcatccacaacatcgaccacgcccagcgggagcccctgagcagcgagacccagtacagcgtggacacccggcggcctgccccccagaaggccctgtacagcacagccatggagagcatccagggcgaggccaggagaggaggcaccatggagacagatgaccacatgggcggcatcccagccaggaacagcaaaggagagcggctgctgctgtacatcggcatcatcgacatcctgcagagctacagatttgtgaagaagctggagcacagctggaaggccctggtgcatgatggagacacagtgtctgtgcacaggcctggcttctatgcagagcgcttccagcgcttcatgtgcaacacagtgttcaagaagatcccctgtgtgcacctgggccgcccagatgtgctgccccagaccccacccctggaggagatcagcgagggcagccccatcccagaccccagcttcagccccctggtgggggagaccctgcagatgctgaccaccagcaccaccctggagaagctggaggtggccgagagcgagttcacccactag

SEQ ID NO: 163845 - DNA, 1653 bp, Artificial Sequence
  Description of Artificial Sequence: Synthetic coding sequence
atggccagcgccagcagcggccccagcagctctgtgggcttcagcagctttgatcctgctgtgcccagctgcaccctgagcagcgctgccagcggcatcaagaggcccatggccagcgaggtgccctatgccagcggcatgcccatcaagaagattggccacaggtctgtggacagcagcggggagaccacctacaagaagaccaccagcagcgccctgaagggggccatccagctgggcatcacccacacagtgggcagcctgagcaccaagccagagagagatgtgctgatgcaggacttctacgtggtggagagcatcttcttccccagcgagggcagcaacctgaccccagcccaccactacaatgacttccgcttcaagacctacgcccctgtggccttccgctacttccgggagctgtttggcatccggccagatgactacctgtacagcctgtgcagcgagcccctgattgagctgtgcagcagcggggccagcggcagcctcttctacgtgtccagtgatgatgagttcatcatcaagacagtgcagcacaaggaggccgagttcctgcagaagctgctgcccggctactacatgaacctgaaccagaaccccaggaccctgctgcccaagttctacggcctgtactgtgtgcaggccggcggcaagaacatcagaattgtggtgatgaacaacctgctgcccaggtctgtgaagatgcacatcaagtatgacctgaagggcagcacctacaagagaagagccagccagaaggagcgggagaagcccctgcccaccttcaaggacctggacttcctgcaggacatcccagatggcctcttcctggatgctgacatgtacaatgccctgtgcaagaccctgcagagggactgcctggtgctgcagagcttcaagatcatggactacagcctgctgatgagcatccacaacatcgaccacgcccagcgggagcccctgagcagcgagacccagtacagcgtggacaccaggaggcctgccccccagaaggccctgtacagcacagccatggagagcatccagggcgaggcccggcggggcggcaccatggagacagatgaccacatgggcggcatcccagccaggaacagcaagggggagcggctgctgctgtacatcggcatcatcgacatcctgcagagctacagatttgtgaagaagctggagcacagctggaaggccctggtgcatgatggagacacagtgtctgtgcaccggcccggcttctacgccgagcgcttccagcgcttcatgtgcaacacagtgttcaagaagatccccctgaagcccagccccagcaagaagttccgcagcggcagcagcttcagcagaagagctggcagcagcggcaacagctgcatcacctaccagcccagcgtgtctggagagcacaaggcccaggtgaccaccaaggccgaggtggagcccggggtgcacctgggccgcccagatgtgctgccccagaccccacccctggaggagatcagcgagggcagccccatcccagaccccagcttcagccccctggtgggggagaccctgcagatgctgaccaccagcaccaccctggagaagctggaggtggccgagagcgagttcacccactag

SEQ ID NO: 163846 - DNA, 597 bp, Artificial Sequence
  Description of Artificial Sequence: Synthetic coding sequence
atgtacaatgccctgtgcaagaccctgcagagggactgcctggtgctgcagagcttcaagatcatggactacagcctgctgatgagcatccacaacatcgaccacgcccagcgggagcccctgagcagcgagacccagtacagcgtggacacccggcggcctgccccccagaaggccctgtacagcacagccatggagagcatccagggcgaggccaggagaggaggcaccatggagacagatgaccacatgggcggcatcccagccaggaacagcaaaggagagcggctgctgctgtacatcggcatcatcgacatcctgcagagctacagatttgtgaagaagctggagcacagctggaaggccctggtgcatgatggagacacagtgtctgtgcacaggcctggcttctatgcagagcgcttccagcgcttcatgtgcaacacagtgttcaagaagatccccctgcagccctggaagagcctgaagctgcagagccagagcagccccatcaagaggaaggccagcgaggacctggagcaggacagcgccatcagcgtcatcccccgctgccagcccctgccccagcagtgctag

SEQ ID NO: 163847 - DNA, 261 bp, Artificial Sequence
  Description of Artificial Sequence: Synthetic coding sequence
atggccagcgaggtgctggaggcccggcaggacagctacatcagcctggtgccctatgccagcggcatgcccatcaagaagattggccacaggtctgtggacagcagcggggagaccacctacaagaagaccaccagcagcgccctgaagggggccatccagctgggcatcacccacacagtgggcagcctgagcaccaagccagagagagatgtgctgatgcaggacttctacgtggtggagagcatcttcttcccctag

SEQ ID NO: 163848 - DNA, 1569 bp, Artificial Sequence
  Description of Artificial Sequence: Synthetic coding sequence
atggccagcgccagcagcggccccagcagctctgtgggcttcagcagctttgatcctgctgtgcccagctgcaccctgagcagcgctgccagcggcatcaagaggcccatggccagcgaggtgccctatgccagcggcatgcccatcaagaagattggccacaggtctgtggacagcagcggggagaccacctacaagaagaccaccagcagcgccctgaagggggccatccagctgggcatcacccacacagtgggcagcctgagcaccaagccagagagagatgtgctgatgcaggacttctacgtggtggagagcatcttcttccccagcgagggcagcaacctgaccccagcccaccactacaatgacttccgcttcaagacctacgcccctgtggccttccgctacttccgggagctgtttggcatccggccagatgactacctgtacagcctgtgcagcgagcccctgattgagctgtgcagcagcggggccagcggcagcctcttctacgtgtccagtgatgatgagttcatcatcaagacagtgcagcacaaggaggccgagttcctgcagaagctgctgcccggctactacatgaacctgaaccagaaccccaggaccctgctgcccaagttctacggcctgtactgtgtgcaggccggcggcaagaacatcagaattgtggtgatgaacaacctgctgcccaggtctgtgaagatgcacatcaagtatgacctgaagggcagcacctacaagagaagagccagccagaaggagcgggagaagcccctgcccaccttcaaggacctggacttcctgcaggacatcccagatggcctcttcctggatgctgacatgtacaatgccctgtgcaagaccctgcagagggactgcctggtgctgcagagcttcaagatcatggactacagcctgctgatgagcatccacaacatcgaccacgcccagcgggagcccctgagcagcgagacccagtacagcgtggacaccaggaggcctgccccccagaaggccctgtacagcacagccatggagagcatccagggcgaggcccggcggggcggcaccatggagacagatgaccagtttgtgaagaagctggagcacagctggaaggccctggtgcatgatggagacacagtgtctgtgcaccggcccggcttctacgccgagcgcttccagcgcttcatgtgcaacacagtgttcaagaagatccccctgaagcccagccccagcaagaagttccgcagcggcagcagcttcagcagaagagctggcagcagcggcaacagctgcatcacctaccagcccagcgtgtctggagagcacaaggcccaggtgaccaccaaggccgaggtggagcccggggtgcacctgggccgcccagatgtgctgccccagaccccacccctggaggagatcagcgagggcagccccatcccagaccccagcttcagccccctggtgggggagaccctgcagatgctgaccaccagcaccaccctggagaagctggaggtggccgagagcgagttcacccactag

SEQ ID NO: 163849 - DNA, 1623 bp, Artificial Sequence
  Description of Artificial Sequence: Synthetic coding sequence
atgagcagcgctgctgaaaatggagaggccgcccctgggaagcagaatgaggagaagacctacaagaagacagccagcagcgccatcaagggggccatccagctgggcatcggctacacagtgggcaacctgaccagcaagccagagagagatgtgctgatgcaggacttctacgtggtggagagcgtcttcctgcccagcgagggcagcaacctgaccccagcccaccactacccagacttccgcttcaagacctacgcccccctggccttccgctacttccgggagctgtttggcatcaagccagatgactacctgtacagcatctgcagcgagcccctgattgagctgagcaaccctggggccagcggcagcctcttctttgtgaccagtgatgatgagttcatcatcaagacagtgcagcacaaggaggccgagttcctgcagaagctgctgcccggctactacatgaacctgaaccagaaccccaggaccctgctgcccaagttctacggcctgtactgcatgcagagcggcggcatcaacatcagaattgtggtgatgaacaacgtgctgcccaggtccatgaggatgcacttcacctatgacctgaagggcagcacctacaagagaagagccagcaggaaggagcgggagaagagcaaccccaccttcaaggacctggacttcctgcaggacatgcatgagggcctgtactttgacacagagacctacaatgccctgatgaagaccctgcagagggactgccgggtgctggagagcttcaagatcatggactacagcctgctgctgggcatccacttcctggaccacagcctgaaggagaaggaggaggagaccccccagaatgtgcctgatgccaagaggacaggcatgcagaaggtgctgtacagcacagccatggagagcatccagggccctgggaagtctggagatggcatcatcacagagaacccagacaccatgggcggcatcccagccaagagccacagaggagagaagctgctgctcttcatgggcatcatcgacatcctgcagagctaccgcctgatgaagaagctggagcacagctggaaggccctggtgtatgatggagacacagtgtctgtgcaccggcccagcttctacgccgaccgcttcctgaagttcatgaacagcagggtcttcaagaagatccaggccctgaaggccagccccagcaagaagcgctgcaacagcattgctgccctgaaggccaccagccaggagatcgtgagcagcatcagccaggagtggaaggatgagaagagggacctgctgacagagggccagagcttcagcagcctggatgaggaggccctgggcagccgccacaggccagacctggtgcccagcacccccagcctgtttgaggccgccagcctggccaccaccatcagcagcagcagcctgtatgtgaatgagcactacccccatgaccggcccaccctgtacagcaacagcaagggcctgcccagcagcagcaccttcaccctggaggagggcaccatctacctgacagctgagcccaacaccctggaggtgcaggatgacaatgcctctgtgctggatgtgtacctgtag

SEQ ID NO: 163850 - DNA, 312 bp, Artificial Sequence
  Description of Artificial Sequence: Synthetic coding sequence
atgagcagcgctgctgaaaatggagaggccgcccctgggaagcagaatgaggagaagacctacaagaagacagccagcagcgccatcaagggggccatccagctgggcatcggctacacagtgggcaacctgaccagcaagccagagagagatgtgctgatgcaggacttctacgtggtggagagcgtcttcctgcccagcgagggcagcaacctgaccccagcccaccactacccagacttccgcttcaagacctacgcccccctggccttccgctacttccgggagctgtttggcatcaagccagactag

SEQ ID NO: 163851 - DNA, 1623 bp, Artificial Sequence; identical to SEQ ID NO: 163849
  Description of Artificial Sequence: Synthetic coding sequence

SEQ ID NO: 163852 - DNA, 1350 bp, Artificial Sequence
  Description of Artificial Sequence: Synthetic coding sequence
atgcaggacttctacgtggtggagagcgtcttcctgcccagcgagggcagcaacctgaccccagcccaccactacccagacttccgcttcaagacctacgcccccctggccttccgctacttccgggagctgtttggcatcaagccagatgactacctgtacagcatctgcagcgagcccctcatcgagctgagcaaccctggggccagcggcagcctcttctttgtgaccagtgatgatgagttcatcatcaagacagtgcagcacaaggaggccgagttcctgcagaagctgctgcccggctactacatgaacctgaaccagaaccccaggaccctgctgcccaagttctacggcctgtactgcatgcagagcggcggcatcaacatccgcatcgtggtgatgaacaacgtgctgcccaggtccatgaggatgcacttcacctatgacctgaagggcagcacctacaagaggcgggccagcaggaaggagcgggagaagagcaaccccaccttcaaggacctggacttcctgcaggacatgcatgagggcctgtactttgacacagagacctacaatgccctgatgaagaccctgcagagggactgccgggtgctggagagcttcaagatcatggactacagcctgctgctgggcatccacttcctggaccacagcctgaaggagaaggaggaggagaccccccagaatgtgcctgatgccaagaggacaggcatgcagaaggtgctgtacagcacagccatggagagcatccagggccctgggaagtctggagatggcatcatcacagaaaatccagacaccatgggcggcatcccagccaagagccacagaggagagaagctgctgctcttcatgggcatcatcgacatcctgcagagctaccgcctgatgaagaagctggagcacagctggaaggccctggtgtatgatggagacacagtgtctgtgcaccggcccagcttctatgctgaccgcttcctgaagttcatgaacagcagggtcttcaagaagatccaggccctgaaggccagccccagcaagaagcgctgcaacagcattgctgccctgaaggccaccagccaggagatcgtgagcagcatcagccaggagtggaaggatgagaagagggacctgctgacagagggccagagcttcagcagcctggatgaggaggccctgggcagccgccacaggccagacctggtgcccagcacccccagcctgtttgaagctgccagcctggccaccaccatcagcagcagcagcctgtatgtgaatgagcactacccccatgaccggcccaccctgtacagcaacagcaagtag

SEQ ID NO: 163853 - DNA, 489 bp, Artificial Sequence
  Description of Artificial Sequence: Synthetic coding sequence
atgagcagcgctgctgaaaatggagaggccgcccctgggaagcagaatgaggagaagacctacaagaagacagccagcagcgccatcaagggggccatccagctgggcatcggctacacagtgggcaacctgaccagcaagccagagagagatgtgctgatgcaggacttctacgtggtggagagcgtcttcctgcccagcgagggcagcaacctgaccccagcccaccactacccagacttccgcttcaagacctacgcccccctggccttccgctacttccgggagctgtttggcatcaagccagatgactacctgtacagcatctgcagcgagcccctgattgagctgagcaaccctggggccagcggcagcctcttctttgtgaccagtgatgatgagttcatcatcaagacagtgcagcacaaggaggccgagttcctgcagaagctgctgcccggctactacatgaacctgaaccagaactag

SEQ ID NO: 163854 - DNA, 474 bp, Artificial Sequence
  Description of Artificial Sequence: Synthetic coding sequence
atgagcagcgctgctgaaaatggagaggccgcccctgggaagcagaatgaggagaagacctacaagaagacagccagcagcgccatcaagggggccatccagctgggcatcggctacacagtgggcaacctgaccagcaagccagagagagatgtgctgatgcaggacttctacgtggtggagagcgtcttcctgcccagcgagggcagcaacctgaccccagcccaccactacccagacttccgcttcaagacctacgcccccctggccttccgctacttccgggagctgtttggcatcaagccagatgactacctgtacagcatctgcagcgagcccctgattgagctgagcaaccctggggccagcggcagcctcttctttgtgaccagtgatgatgagttcatcatcaagacagtgcagcacaaggaggccgagttcctgcagaagctgctgcccggctactacatgtag

SEQ ID NO: 163855 - DNA, 1509 bp, Artificial Sequence
  Description of Artificial Sequence: Synthetic coding sequence
atgagcagcgctgctgaaaatggagaggccgcccctgggaagcagaatgaggagaagacctacaagaagacagccagcagcgccatcaagggggccatccagctgggcatcggctacacagtgggcaacctgaccagcaagccagagagagatgtgctgatgcaggacttctacgtggtggagagcgtcttcctgcccagcgagggcagcaacctgaccccagcccaccactacccagacttccgcttcaagacctacgcccccctggccttccgctacttccgggagctgtttggcatcaagccagatgactacctgtacagcatctgcagcgagcccctgattgagctgagcaaccctggggccagcggcagcctcttctttgtgaccagtgatgatgagttcatcatcaagacagtgcagcacaaggaggccgagttcctgcagaagctgctgcccggctactacatgaacctgaaccagaaccccaggaccctgctgcccaagttctacggcctgtactgcatgcagagcggcggcatcaacatcagaattgtggtgatgaacaacgtgctgcccaggtccatgaggatgcacttcacctatgacctgaagggcagcacctacaagagaagagccagcaggaaggagcgggagaagagcaaccccaccttcaaggacctggacttcctgcaggacatgcatgagggcctgtactttgacacagagacctacaatgccctgatgaagaccctgcagagggactgccgggtgctggagagcttcaagatcatggactacagcctgctgctgggcatccacttcctggaccacagcctgaaggagaaggaggaggagaccccccagaatgtgcctgatgccaagaggacaggcatgcagaaggtgctgtacagcacagccatggagagcatccagggccctgggaagtctggagatggcatcatcacagagaacccagacaccatgggcggcatcccagccaagagccacagaggagagaagctgctgctcttcatgggcatcatcgacatcctgcagagctaccgcctgatgaagaagctggagcacagctggaaggccctggtgtatgatggagacacagtgtctgtgcaccggcccagcttctacgccgaccgcttcctgaagttcatgaacagcagggtcttcaagaagatccaggccctgaaggccagccccagcaagaagcgctgcaacagcattgctgccctgaaggccaccagccaggagatcgtgagcagcatcagccaggagtggaaggatgagaagagggacctgctgacagagggccagagcttcagcagcctggatgaggaggccctgggcagccgccacaggccagacctggtgcccagcacccccagcctgtttgaggccgccagcctggccaccaccatcagcagcagcagcctgtatgtgaatgagcactacccccatgaccggcccaccctgtacagcaacagcaagtag

SEQ ID NO: 163856 - DNA, 2007 bp, Artificial Sequence
  Description of Artificial Sequence: Synthetic coding sequence
atggagctggaggtgcctgatgaagctgagagcgctgaggccggggctgtgcccagcgaggccgcctgggccgctgagagcggggctgctgctggcctggcccagaagaaggccgcccccacagaggtgctgtccatgacagcccagcccggccctggccacggcaagaagctgggccaccggggcgtggatgccagcggggagaccacctacaagaagaccaccagcagcaccctgaagggggccatccagctgggcatcggctacacagtgggccacctgagcagcaagccagagagagatgtgctgatgcaggacttctacgtggtggagagcatcttcttccccagcgagggcagcaacctgaccccagcccaccacttccaggacttccgcttcaagacctacgcccctgtggccttccgctacttccgggagctgtttggcatccggccagatgactacctgtacagcctgtgcaatgagcccctgattgagctgagcaaccctggggccagcggcagcctcttctacgtgaccagtgatgatgagttcatcatcaagacagtgatgcacaaggaggccgagttcctgcagaagctgctgcccggctactacatgaacctgaaccagaaccccaggaccctgctgcccaagttctacggcctgtactgtgtgcagagcggcggcaagaacatccgggtggtggtgatgaacaacatcctgccccgggtggtgaagatgcacctgaagtttgacctgaagggcagcacctacaagagaagagccagcaagaaggagaaggagaagagcttccccacctacaaggacctggacttcatgcaggacatgcctgagggcctgctgctggatgctgacaccttcagcgccctggtgaagaccctgcagagggactgcctggtgctggagagcttcaagatcatggactacagcctgctgctgggcgtgcacaacatcgaccagcacgagcgggagcggcaggcccagggcgcccagagcaccagtgatgagaagaggcctgtgggccagaaggccctgtacagcacagccatggagagcatccagggcggggccgcccggggggaggccattgaaagtgatgacaccatgggcggcatcccagctgtgaatggccgcggggagcggctgctgctgcacatcggcatcatcgacatcctgcagagctaccgcttcatcaagaagctggagcacacctggaaggccctggtgcatgatggagacacagtgtctgtgcaccggcccagcttctacgccgagcgcttcttcaagttcatgagcaacacagtgttcaggaagaacagcagcctgaagagcagccccagcaagaagggccggggcggggccctgctggccgtgaagcccctgggccccacagctgccttcagcgccagccagatccccagcgagcgggaggaggcccagtatgacctgcggggggcccggagctaccccaccctggaggatgagggccgcccagacctgctgccctgcaccccacccagctttgaggaggccaccacagccagcatcgccaccaccctgagcagcaccagcctgagcatccctgagaggagccccagcgagaccagcgagcagccccgctacagaagaaggacccagagcagcggccaggacggccggccccaggaggagcccccagctgaggaggacctgcagcagatcaccgtgcaggtggagcccgcctgcagcgtggagatcgtggtgcccaaggaggaggatgctggggtggaggccagccctgctggggccagcgctgctgtggaggtggagacagccagccaggccagtgatgaggagggcgccccagccagccaggccagtgatgaagaagatgccccagccacagacatctacttccccacagatgagaggtcctgggtgtacagccccctgcactacagcgcccaggcccccccagccagtgatggagagagtgacacctag

SEQ ID NO: 163857 - DNA, 2103 bp, Artificial Sequence
  Description of Artificial Sequence: Synthetic coding sequence
atggagctggaggtgcctgatgaagctgagagcgctgaggccggggctgtgcccagcgaggccgcctgggccgctgagagcggggctgctgctggcctggcccagaagaaggccgcccccacagaggtgctgtccatgacagcccagcccggccctggccacggcaagaagctgggccaccggggcgtggatgccagcggggagaccacctacaagaagaccaccagcagcaccctgaagggggccatccagctgggcatcggctacacagtgggccacctgagcagcaagccagagagagatgtgctgatgcaggacttctacgtggtggagagcatcttcttccccagcgagggcagcaacctgaccccagcccaccacttccaggacttccgcttcaagacctacgcccctgtggccttccgctacttccgggagctgtttggcatccggccagatgactacctgtacagcctgtgcaatgagcccctgattgagctgagcaaccctggggccagcggcagcctcttctacgtgaccagtgatgatgagttcatcatcaagacagtgatgcacaaggaggccgagttcctgcagaagctgctgcccggctactacatgaacctgaaccagaaccccaggaccctgctgcccaagttctacggcctgtactgtgtgcagagcggcggcaagaacatccgggtggtggtgatgaacaacatcctgccccgggtggtgaagatgcacctgaagtttgacctgaagggcagcacctacaagagaagagccagcaagaaggagaaggagaagagcttccccacctacaaggacctggacttcatgcaggacatgcctgagggcctgctgctggatgctgacaccttcagcgccctggtgaagaccctgcagagggactgcctggtgctggagagcttcaagatcatggactacagcctgctgctgggcgtgcacaacatcgaccagcacgagcgggagcggcaggcccagggcgcccagagcaccagtgatgagaagaggcctgtgggccagaaggccctgtacagcacagccatggagagcatccagggcggggccgcccggggggaggccattgaaagtgatgacaccatgggcggcatcccagctgtgaatggccgcggggagcggctgctgctgcacatcggcatcatcgacatcctgcagagctaccgcttcatcaagaagctggagcacacctggaaggccctggtgcatgatggagacacagtgtctgtgcaccggcccagcttctacgccgagcgcttcttcaagttcatgagcaacacagtgttcaggaagaacagcagcctgaagagcagccccagcaagaagggccggggcggggccctgctggccgtgaagcccctgggccccacagctgccttcagcgccagccagatccccagcgagcgggaggaggcccagtatgacctgcggggggcccggagctaccccaccctggaggatgagggccgcccagacctgctgccctgcaccccacccagctttgaggaggccaccacagccagcatcgccaccaccctgagcagcaccagcctgagcatccctgagaggagccccagcgagaccagcgagcagccccgctacagaagaaggacccagagcagcggccaggacggccggccccaggaggagcccccagctgaggaggacctgcagcagatcaccgtgcaggtggagcccgcctgcagcgtggagatcgtggtgcccaaggaggaggatgctggggtggaggccagccctgctggggccagcgctgctgtggaggtggagacagccagccaggccagtgatgaggagggcgccccagccagccaggccagtgatgaagaagatgccccagccacagacatctacttctggaggctgtggggcccccacgcccccacctggccctggaggcgggagggccgggccgcctgcctgtgcccctacccaccccacgtggtgacccccttccctggcaccggcctgtgtgcctcctggagcccagatggcactggaggcctgggcgccatgagctgctgcgtgtctgtgtcctag

SEQ ID NO: 163858 - DNA, 1923 bp, Artificial Sequence
  Description of Artificial Sequence: Synthetic coding sequence
atggagctggaggtgcctgatgaagctgagagcgctgaggccggggctgtgcccagcgaggccgcctgggccgctgagagcggggctgctgctggcctggcccagaagaaggccgcccccacagaggtgctgtccatgacagcccagcccggccctggccacggcaagaagctgggccaccggggcgtggatgccagcggggagaccacctacaagaagaccaccagcagcaccctgaagggggccatccagctgggcatcggctacacagtgggccacctgagcagcaagccagagagagatgtgctgatgcaggacttctacgtggtggagagcatcttcttccccagcgagggcagcaacctgaccccagcccaccacttccaggacttccgcttcaagacctacgcccctgtggccttccgctacttccgggagctgtttggcatccggccagatgactacctgtacagcctgtgcaatgagcccctgattgagctgagcaaccctggggccagcggcagcctcttctacgtgaccagtgatgatgagttcatcatcaagacagtgatgcacaaggaggccgagttcctgcagaagctgctgcccggctactacatgaacctgaaccagaaccccaggaccctgctgcccaagttctacggcctgtactgtgtgcagagcggcggcaagaacatccgggtggtggtgatgaacaacatcctgccccgggtggtgaagatgcacctgaagtttgacctgaagggcagcacctacaagagaagagccagcaagaaggagaaggagaagagcttccccacctacaaggacctggacttcatgcaggacatgcctgagggcctgctgctggatgctgacaccttcagcgccctggtgaagaccctgcagagggactgcctggtgctggagagcttcaagatcatggactacagcctgctgctgggcgtgcacaacatcgaccagcacgagcgggagcggcaggcccagggcgcccagagcaccagtgatgagaagaggcctgtgggccagaaggccctgtacagcacagccatggagagcatccagggcggggccgcccggggggaggccattgaaagtgatgacaccatgggcggcatcccagctgtgaatggccgcggggagcggctgctgctgcacatcggcatcatcgacatcctgcagagctaccgcttcatcaagaagctggagcacacctggaaggccctggtgcatgatggagacacagtgtctgtgcaccggcccagcttctacgccgagcgcttcttcaagttcatgagcaacacagtgttcaggaagaacagcagcctgaagagcagccccagcaagaagggccggggcggggccctgctggccgtgaagcccctgggccccacagctgccttcagcgccagccagatccccagcgagcgggaggaggcccagtatgacctgcggggggcccggagctaccccaccctggaggatgagggccgcccagacctgctgccctgcaccccacccagctttgaggaggccaccacagccagcatcgccaccaccctgagcagcaccagcctgagcatccctgagaggagccccagcgagaccagcgagcagccccgctacagaagaaggacccagagcagcggccaggacggccggccccaggaggagcccccagctgaggaggacctgcagcagatcaccgtgcaggtggagcccgcctgcagcgtggagatcgtggtgcccaaggaggaggatgctggggtggaggccagccctgctggggccagcgctgctgtggaggtggagacagccagccaggccagtgatgaggagggcgccccagccagccaggccagtgatgaagaagatgccccagccacagacatctacttctag

SEQ ID NO: 163859 - DNA, 576 bp, Artificial Sequence
  Description of Artificial Sequence: Synthetic coding sequence
atgcagagcgtcttctacccagctggccgcatcagcgagagatatgacatcaagggctgtgaggtgagccgctgggtggaccctgcccctgagggcagccccctggtgctggtgctgaaggacctgaacttccagggcaagaccatcaacctgggcccccagaggtcctggttcctgcggcagatggagctggacaccaccttcctgcgggagctgaatgtgctggactacagcctgctgattgccttccagaggctgcatgaagatgagcggggccctggcagcagcctcatcttcagaacagcccggtctgtgcagggcgcccagagccctgaggagagccgggcccagaacagaaggctgctgcctgatgccccaaatgccctgcacatcctggatggccctgagcagcgctacttcctgggcgtggtggacctggccaccgtgtatggcctgaggaagaggctggagcacctgtggaagaccctgcgctacccaggccgcaccttcagcacagtgtccccagcccgctatgcccggcggctgtgccagtgggtggaggcccacacagaatag

SEQ ID NO: 163860 - DNA, 1185 bp, Artificial Sequence
  Description of Artificial Sequence: Synthetic coding sequence
atggccgcccccagccctggcccccgggaggtgctggcccccagccctgaggccggctgcagagctgtgaccagcagcagaagaggcctgctgtggaggctgcgggacaagcagagccggctgggcctgtttgagatcagccctggccacgagctgcacggcatgacctgcatgatgcaggccggcctgtgggccgccacccaggtgtccatggaccacccccccaccggcccccccagcagagatgacttcagcgaggtgctgacccaggtgcatgagggctttgagctgggcaccctggccggccctgcctttgcctggctgcggcgcagcctgggcctggccgaggaggactaccaggccgccctgggccctgggggcccctacctgcagttcctgagcaccagcaagagcaaggccagcttcttcctgagccatgaccagcgcttcttcctgaagacccagggcagaagagaggtgcaggccctgctggcccacctgccccgctacgtgcagcacctgcagaggcacccccacagcctgctggcccggctgctgggcgtgcacagcctgcgggtggaccggggcaagaagacctacttcatcgtgatgcagagcgtcttctacccagctggccgcatcagcgagagatatgacatcaagggctgtgaggtgagccgctgggtggaccctgcccctgagggcagccccctggtgctggtgctgaaggacctgaacttccagggcaagaccatcaacctgggcccccagaggtcctggttcctgcggcagatggagctggacaccaccttcctgcgggagctgaatgtgctggactacagcctgctgattgccttccagaggctgcatgaagatgagcggggccctggcagcagcctcatcttcagaacagcccggtctgtgcagggcgcccagagccctgaggagagccgggcccagaacagaaggctgctgcctgatgccccaaatgccctgcacatcctggatggccctgagcagcgctacttcctgggcgtggtggacctggccaccgtgtatggcctgaggaagaggctggagcacctgtggaagaccctgcgctacccaggccgcaccttcagcacagtgtccccagcccgctatgcccggcggctgtgccagtgggtggaggcccacacagaatag

SEQ ID NO: 163861 - DNA, 1128 bp, Artificial Sequence
  Description of Artificial Sequence: Synthetic coding sequence
atgatgtgccagagcgaggcccggcagggccctgagctgcgggccgccaagtggctgcacttcccccagctggccctgcggcggcggctgggccagctgagctgcatgagcaggcctgccctgaagctgcgctcctggcccctgactgtgctgtactacctgctgccctttggagccctgcggcccctgagccgggtgggctggaggcctgtgtcccgggtggccctgtacaagtctgtgcccacccggctgctgagccgggcctggggccgcctgaaccaggtggagctgccccactggctgcggcggcctgtgtacagcctgtacatctggacctttggagtgaacatgaaggaggccgctgtggaggacctgcaccactacagaaacctgtctgagttcttccggaggaagctgaagccccaggcccggcctgtgtgtggcctgcacagcgtcatcagccccagtgatggccgcatcctgaactttggccaggtgaagaactgtgaggtggagcaggtgaagggcgtgacctacagcctggagagcttcctgggccccaggatgtgcacagaggacctgcccttccccccagctgccagctgtgacagcttcaagaaccagctggtgacccgggagggcaatgagctgtaccactgcgtcatctacctggcccctggggactaccactgcttccacagccccacagactggacagtgagccacagaagacacttccctggcagcctgatgtctgtgaaccctggcatggcccgctggatcaaggagctgttctgccacaatgaaagagtggtgctgaccggggactggaagcacggcttcttcagcctgacagctgtgggcgccaccaacgtgggcagcatccgcatctactttgaccgggacctgcacaccaacagccccaggcacagcaagggcagctacaatgacttctcctttgtgacccacaccaaccgggagggcgtgcccatgaggaaaggagagcacctgggggagttcaacctgggcagcaccatcgtgctgatctttgaggcccccaaggacttcaacttccagctgaagacaggccagaagatccgctttggagaggccctgggcagcctgtag

SEQ ID NO: 163862 - DNA, 1227 bp, Artificial Sequence
  Description of Artificial Sequence: Synthetic coding sequence
atggccacctctgtgggccaccgctgcctgggcctgctgcacggcgtggccccctggaggagcagcctgcacccctgtgagatcacagccctgagccagagcctgcagcccctgaggaagctgcccttccgggccttcagaacagatgccaggaagatccacacagccccagcccggaccatgttcctgctgcggcccctgcccatcctgctggtgactggaggcggctacgccggctaccggcagtatgagaagtaccgggagcgggagctggagaagctgggcctggagatcccccccaagctggccggccactgggaggtggccctgtacaagtctgtgcccacccggctgctgagccgggcctggggccgcctgaaccaggtggagctgccccactggctgcggcggcctgtgtacagcctgtacatctggacctttggagtgaacatgaaggaggccgctgtggaggacctgcaccactacagaaacctgtctgagttcttccggaggaagctgaagccccaggcccggcctgtgtgtggcctgcacagcatcagccccagtgatggccgcatcctgaactttggccaggtgaagaactgtgaggtggagcaggtgaagggcgtgacctacagcctggagagcttcctgggccccaggatgtgcacagaggacctgcccttccccccagctgccagctgtgacagcttcaagaaccagctggtgacccgggagggcaatgagctgtaccactgtgtgatctacctggcccctggggactaccactgcttccacagccccacagactggacagtgagccaccggcggcacttccctggcagcctgatgtctgtgaaccctggcatggcccgctggatcaaggagctgttctgccacaatgaaagagtggtgctgactggagactggaagcacggcttcttcagcctgacagctgtgggcgccaccaacgtgggcagcatccgcatctactttgaccgggacctgcacaccaacagccccaggcacagcaagggcagctacaatgacttctcctttgtgacccacaccaaccgggagggcgtgcccatgaggaagggggagcacctgggggagttcaacctgggcagcaccatcgtgctgatctttgaggcccccaaggacttcaacttccagctgaagacaggccagaagatccgctttggagaggccctgggcagcctgtag

SEQ ID NO: 163863 - DNA, 1128 bp, Artificial Sequence; identical to SEQ ID NO: 163861
  Description of Artificial Sequence: Synthetic coding sequence

SEQ ID NO: 163864 - DNA, 789 bp, Artificial Sequence
  Description of Artificial Sequence: Synthetic coding sequence
atgatgtgccagagcgaggcccggcagggccctgagctgcgggccgccaagtggctgcacttcccccagctggccctgcggcggcggctgggccagctgagctgcatgagcaggcctgccctgaagctgcgctcctggcccctgactgtgctgtactacctgctgccctttggagccctgcggcccctgagccgggtgggctggaggcctgtgtcccgggtggccctgtacaagtctgtgcccacccggctgctgagccgggcctggggccgcctgaaccaggtggagctgccccactggctgcggcggcctgtgtacagcctgtacatctggacctttggagtgaacatgaaggaggccgctgtggaggacctgcaccactacagaaacctgtctgagttcttccggaggaagctgaagccccaggcccggcctgtgtgtggcctgcacagcgtcatcagccccagtgatggccgcatcctgaactttggccaggtgaagaactgtgaggtggagcaggtgaagggcgtgacctacagcctggagagcttcctgggccccaggatgtgcacagaggacctgcccttccccccagctgccagctgtgacagcttcaagaaccagctggtgacccgggagggcaatgagctgtaccactgcgtcatctacctggcccctggggactaccactgcttccacagccccacagactggacagtgagccacagaagacacttccctggccctgcccacaagcagcccaaggcccagcagggcctgctgcagtag

SEQ ID NO: 163865 - DNA, 687 bp, Artificial Sequence
  Description of Artificial Sequence: Synthetic coding sequence
atgatgtgccagagcgaggcccggcagggccctgagctgcgggccgccaagtggctgcacttcccccagctggccctgcggcggcggctgggccagctgagctgcatgagcaggcctgccctgaagctgcgctcctggcccctgactgtgctgtactacctgctgccctttggagccctgcggcccctgagccgggtgggctggaggcctgtgtcccgggtggccctgtacaagtctgtgcccacccggctgctgagccgggcctggggccgcctgaaccaggtggagctgccccactggctgcggcggcctgtgtacagcctgtacatctggacctttggagtgaacatgaaggaggccgctgtggaggacctgcaccactacagaaacctgtctgagttcttccggaggaagctgaagccccaggcccggcctgtgtgtggcctgcacagcgtcatcagccccagtgatggccgcatcctgaactttggccaggtgaagaactgtgaggtggagcaggtgaagggcgtgacctacagcctggagagcttcctgggccccaggatgtgcacagaggacctgcccttccccccagctgccagctgtgacagcttcaagaaccagctggtgacccgggagggcaatgagctgtaccactgcgtcatctacctggcccctggggactag

SEQ ID NO: 163866 - DNA, 222 bp, Artificial Sequence
  Description of Artificial Sequence: Synthetic coding sequence
atgatgtgccagagcgaggcccggcagggccctgagctgcgggccgccaagtggctgcacttcccccagctggccctgcggcggcggctgggccagctgagctgcatgagcaggcctgccctgaagctgcgctcctggcccctgactgtgctgtactacctgctgccctttggagccctgcggcccctgagccgggtgggctggaggcctgtgtccaggtag

SEQ ID NO: 163867 - DNA, 222 bp, Artificial Sequence; identical to SEQ ID NO: 163866
  Description of Artificial Sequence: Synthetic coding sequence

SEQ ID NO: 163868 - DNA, 1230 bp, Artificial Sequence
  Description of Artificial Sequence: Synthetic coding sequence
atggccacctctgtgggccaccgctgcctgggcctgctgcacggcgtggccccctggaggagcagcctgcacccctgtgagatcacagccctgagccagagcctgcagcccctgaggaagctgcccttccgggccttcagaacagatgccaggaagatccacacagccccagcccggaccatgttcctgctgcggcccctgcccatcctgctggtgactggaggcggctacgccggctaccggcagtatgagaagtaccgggagcgggagctggagaagctgggcctggagatcccccccaagctggccggccactgggaggtggccctgtacaagtctgtgcccacccggctgctgagccgggcctggggccgcctgaaccaggtggagctgccccactggctgcggcggcctgtgtacagcctgtacatctggacctttggagtgaacatgaaggaggccgctgtggaggacctgcaccactacagaaacctgtctgagttcttccggaggaagctgaagccccaggcccggcctgtgtgtggcctgcacagcgtcatcagccccagtgatggccgcatcctgaactttggccaggtgaagaactgtgaggtggagcaggtgaagggcgtgacctacagcctggagagcttcctgggccccaggatgtgcacagaggacctgcccttccccccagctgccagctgtgacagcttcaagaaccagctggtgacccgggagggcaatgagctgtaccactgcgtcatctacctggcccctggggactaccactgcttccacagccccacagactggacagtgagccacagaagacacttccctggcagcctgatgtctgtgaaccctggcatggcccgctggatcaaggagctgttctgccacaatgaaagagtggtgctgaccggggactggaagcacggcttcttcagcctgacagctgtgggcgccaccaacgtgggcagcatccgcatctactttgaccgggacctgcacaccaacagccccaggcacagcaagggcagctacaatgacttctcctttgtgacccacaccaaccgggagggcgtgcccatgaggaaaggagagcacctgggggagttcaacctgggcagcaccatcgtgctgatctttgaggcccccaaggacttcaacttccagctgaagacaggccagaagatccgctttggagaggccctgggcagcctgtag

SEQ ID NO: 163869 - DNA, 246 bp, Artificial Sequence
  Description of Artificial Sequence: Synthetic coding sequence
atgatgtgccagagcgaggcccggcagggccctgagctgcgggccgccaagtggctgcacttcccccagctggccctgcggcggcggctgggccagctgagctgcatgagcaggcctgccctgaagctgcgctcctggcccctgactgtgctgtactacctgctgccctttggagccctgcggcccctgagccgggtgggctggaggcctgtgtcccgggtggccctgtacaagtctgtgccctag

SEQ ID NO: 163870 - DNA, 981 bp, Artificial Sequence
  Description of Artificial Sequence: Synthetic coding sequence
atgatgtgccagagcgaggcccggcagggccctgagctgcgggccgccaagtggctgcacttcccccagctggccctgcggcggcggctgggccagctgagctgcatgagcaggcctgccctgaagctgcgctcctggcccctgactgtgctgtactacctgctgccctttggagccctgcggcccctgagccgggtgggctggaggcctgtgtcccgggtggccctgtacaagtctgtgcccacccggctgctgagccgggcctggggccgcctgaaccaggtggagctgccccactggctgcggcggcctgtgtacagcctgtacatctggacctttggagtgaacatgaaggaggccgctgtggaggacctgcaccactacagaaacctgtctgagttcttccggaggaagctgaagccccaggcccggcctgtgtgtggcctgcacagcgtcatcagccccagtgatggccgcatcctgaactttggccaggtgaagaactgtgaggtggagcaggtgaagggcgtgacctacagcctggagagcttcctgggccccaggatgtgcacagaggacctgcccttccccccagctgccagctgtgacagcttcaagaaccagctggtgacccgggagggcaatgagctgtaccactgcgtcatctacctggcccctggggactaccactgcttccacagccccacagactggacagtgagccacagaagacacttccctggcagcctgatgtctgtgaaccctggcatggcccgctggatcaaggagctgttctgccacaatgaaagagtggtgctgaccggggactggaagcacggcttcttcagcctgacagctgtgggcgccaccaacgtgggcagcatccgcatctactttgaccgggacctgcacaccaacagccccaggcacagcaagggcagctacaatgacttctctgtggtgggcagcctgaccaggtag

SEQ ID NO: 163871 - DNA, 984 bp, Artificial Sequence
  Description of Artificial Sequence: Synthetic coding sequence
atggagtatgctgtgaactgccacgtgatcacctgggagcgcatcatcagccactttgacatctttgccttcggccacttctggggctgggccatgaaggccctgctgatccgctcctatggcctgtgctggaccatcagcatcacctgggagctgacagagctgttcttcatgcacctgctgcccaactttgctgagtgctggtgggaccaggtgatcctggacatcctgctgtgcaatggaggcggcatctggctgggcatggtggtgtgccgcttcctggagatgaggacctaccactgggccagcttcaaggacatccacaccaccaccgggaagatcaagagagctgtgctgcagttcaccccagcctcctggacctacgtgcgctggtttgaccccaagagcagcttccagagggtggccggcgtgtacctgttcatgatcatctggcagctgacagagctgaacaccttcttcctgaagcacatctttgtgttccaggccagccaccccctgtcctggggccgcatcctcttcatcggcggcatcacagcccccaccgtgcggcagtactatgcctacctgacagacacccagtgcaagagggtgggcacccagtgctgggtgtttggagtcatcggcttcctggaggccatcgtgtgcatcaagtttggccaggacctcttcagcaagacccagatcctgtatgtggtgctgtggctgctgtgtgtggccttcaccaccttcctgtgcctgtatggcatgatctggtacgccgagcactacggccaccgggagaagacctacagtgaatgtgaagatggcacctacagccctgagatctcctggcaccacaggaagggcaccaagggcagcgaggacagcccccccaagcatgctggcaacaatgaaagccacagcagcagaagaagaaacagacacagcaagagcaaggtgaccaacggggtgggcaagaagtag

SEQ ID NO: 163872 - DNA, 1422 bp, Artificial Sequence
  Description of Artificial Sequence: Synthetic coding sequence
atggccagctgtgtgggcagcaggaccctgagcaaggatgatgtgaactacaagatgcacttcaggatgatcaatgagcagcaggtggaggacatcaccatcgacttcttctaccggccccacaccatcaccctgctgtccttcaccatcgtgtccctgatgtactttgccttcaccagagatgattctgtgcctgaggacaacatctggaggggcatcctgagcgtcatcttcttcttcctgatcatctctgtgctggccttccccaacggccccttcacccggccccacccagccctgtggaggatggtgtttggcctgtctgtgctgtacttcctgttcctggtgttcctgctcttcctgaactttgagcaggtgaagagcctgatgtactggctggaccccaacctgcgctatgccacccgggaggctgatgtgatggagtatgctgtgaactgccacgtgatcacctgggagcgcatcatcagccactttgacatctttgccttcggccacttctggggctgggccatgaaggccctgctgatccgctcctatggcctgtgctggaccatcagcatcacctgggagctgacagagctgttcttcatgcacctgctgcccaactttgctgagtgctggtgggaccaggtgatcctggacatcctgctgtgcaatggaggcggcatctggctgggcatggtggtgtgccgcttcctggagatgaggacctaccactgggccagcttcaaggacatccacaccaccaccgggaagatcaagagagctgtgctgcagttcaccccagcctcctggacctacgtgcgctggtttgaccccaagagcagcttccagagggtggccggcgtgtacctgttcatgatcatctggcagctgacagagctgaacaccttcttcctgaagcacatctttgtgttccaggccagccaccccctgtcctggggccgcatcctcttcatcggcggcatcacagcccccaccgtgcggcagtactatgcctacctgacagacacccagtgcaagagggtgggcacccagtgctgggtgtttggagtcatcggcttcctggaggccatcgtgtgcatcaagtttggccaggacctcttcagcaagacccagatcctgtatgtggtgctgtggctgctgtgtgtggccttcaccaccttcctgtgcctgtatggcatgatctggtacgccgagcactacggccaccgggagaagacctacagtgaatgtgaagatggcacctacagccctgagatctcctggcaccacaggaagggcaccaagggcagcgaggacagcccccccaagcatgctggcaacaatgaaagccacagcagcagaagaagaaacagacacagcaagagcaaggtgaccaacggggtgggcaagaagtag

SEQ ID NO: 163873 - DNA, 1464 bp, Artificial Sequence
  Description of Artificial Sequence: Synthetic coding sequence
atgagaagaggagagaggagagatgctgggggccccaggcctgagagccctgtgcctgctggccgggccagcctggaggagcccccagatggccccagcgctggccaggccaccggccctggagagggccgccgcagcacagaaagtgaggtgtatgatgatggcaccaacaccttcttctggagggcccacaccctgactgtgctcttcatcctgacctgcaccctgggctacgtgaccctgctggaggagaccccccaggacacagcctacaacaccaagaggggcatcgtggccagcatcctggtgttcctgtgctttggagtgacccaggccaaggatggccccttcagccggccccacccagcctactggaggttctggctgtgtgtgtctgtggtgtatgagctgttcctgatcttcatcctcttccagacagtgcaggacggccggcagttcctgaagtatgtggaccccaagctgggcgtgcccctgcctgagcgggactatggaggcaactgcctgatctatgaccctgacaatgaaacagaccccttccacaacatctgggacaagctggatggctttgtgcctgcccacttcctgggctggtacctgaagaccctgatgatccgggactggtggatgtgcatgatcatctctgtgatgtttgagttcctggagtacagcctggagcaccagctgcccaacttcagcgagtgctggtgggaccactggatcatggatgtgctggtgtgcaatggcctgggcatctactgcggcatgaagaccctggagtggctgagcctgaagacctacaagtggcagggcctgtggaacatccccacctacaagggcaagatgaagagaattgccttccagttcaccccctacagctgggtgcgctttgagtggaagccagccagcagcctgcggcgctggctggccgtgtgtggcatcatcctggtgttcctgctggccgagctgaacaccttctacctgaagtttgtgctgtggatgcctcctgagcactacctggtgctgctgcggctggtgttctttgtgaatgtgggcggcgtggccatgagggagatctatgacttcatggatgaccccaagccccacaagaagctgggcccccaggcctggctggtggccgccatcacagccacagagctgctgattgtggtgaagtatgacccccacaccctgaccctgagcctgcccttctacatcagccagtgctggaccctgggctctgtgctggccctgacctggacagtgtggaggttcttcctgcgggacatcaccctgcgctacaaggagacccgctggcagaagtggcagaacaaggatgaccagggcagcacagtgggcaatggagaccagcaccccctgggcctggatgaggacctgctgggccctggggtggccgagggggagggcgcccccacccccaactag

SEQ ID NO: 163874 - DNA, 2802 bp, Artificial Sequence
  Description of Artificial Sequence: Synthetic coding sequence
atggccgccagccggctggactttggagaggtggagaccttcctggacagacaccctgagctgtttgaggactacctgatgaggaagggcaagcaggagatggtggagaagtggctgcagaggcacagccagggccagggcgccctgggcccccggcccagcctggccggcaccagcagcctggcccacagcacctgccggggcggcagctctgtgggcggcggcaccggccccaatggaagtgcccacagccagcccctgcccggcggcggggactgtggcggcgtgcccctgagccccagctgggccggcggcagcagaggagatggcaacctgcagaggcgggccagccagaaggagctgaggaagagctttgcccggagcaaggccatccacgtgaacagaacctatgatgagcaggtgaccagccgggcccaggagcccctgagctctgtgagaagaagagccctgctgaggaaggccagcagcctgccccccaccacagcccacatcctgagcgccctgctggagagccgggtgaacctgccccgctacccacccacagccatcgactacaagtgccacctgaagaagcacaatgaaaggcagttcttcctggagctggtgaaggacatcagcaatgacctggacctgaccagcctgagctacaagatcctgatctttgtgtgcctgatggtggatgctgaccgctgcagcctcttcctggtggagggcgctgctgctgggaagaagaccctggtgtccaagttctttgatgtgcacgccggcacccccctgctgccctgcagcagcacagagaacagcaatgaggtgcaggtgccctggggcaagggcatcatcggctacgtgggggagcacggggagaccgtgaacatcccagatgcctaccaggaccggcgcttcaatgatgaaattgacaagctgaccggctacaagaccaagagcctgctgtgcatgcccatccgcagcagtgatggagagatcatcggcgtggcccaggccatcaacaagatccctgagggcgcccccttcacagaagatgatgagaaggtgatgcagatgtacctgcccttctgtggcatcgccatcagcaatgcccagctgtttgctgccagcaggaaggagtatgaaagaagccgggccctgctggaggtggtgaatgacctgtttgaggagcagacagacctggagaagatcgtgaagaagatcatgcaccgggcccagaccctgctgaagtgtgagcgctgcagcgtgctgctgctggaggacatcgagagccctgtggtgaagttcaccaagagctttgagctgatgagccccaagtgcagcgcagatgctgagaacagcttcaaggagagcatggagaagagcagctacagcgactggctgatcaacaacagcattgctgagctggtggccagcacaggcctgcctgtgaacatcagtgatgcctaccaggaccccaggtttgatgctgaggccgaccagatcagcggcttccacatccgctctgtgctgtgtgtgcccatctggaacagcaaccaccagatcattggagtggcccaggtgctgaaccggctggatggcaagccctttgatgatgctgaccagaggctgtttgaggccttcgtcatcttctgtggcctgggcatcaacaacaccatcatgtatgaccaggtgaagaagtcctgggccaagcagagcgtggccctggatgtgctgagctaccacgccacctgcagcaaggccgaggtggacaagttcaaggccgccaacatccccctggtgtctgagctggccattgatgacatccactttgatgacttcagcctggatgtggatgccatgatcacagctgccctgaggatgttcatggagctgggcatggtgcagaagttcaagattgattatgagaccctgtgccgctggctgctgactgtgaggaagaactacaggatggtgctgtaccacaactggaggcatgccttcaacgtgtgccagctgatgtttgccatgctgaccacagctggcttccaggacatcctgacagaggtggagatcctggccgtcatcgtgggctgcctgtgccacgacctggaccaccggggcaccaacaatgccttccaggccaagagcggcagcgccctggcccagctgtatggcaccagcgccaccctggagcaccaccacttcaaccacgctgtgatgatcctgcagagcgagggccacaacatctttgccaacctgagcagcaaggagtacagcgacctgatgcagctgctgaagcagagcatcctggccacagacctgaccctgtactttgaaagaagaacagagttctttgagctggtgtccaaaggagaatatgactggaacatcaagaaccaccgggacatcttccgctccatgctgatgacagcctgtgacctgggcgctgtgaccaagccctgggagatcagccggcaggtggccgagctggtgaccagcgagttctttgagcagggcgaccgggagcggctggagctgaagctgacccccagcgccatctttgacaggaacaggaaggatgagctgccccggctgcagctggagtggattgacagcatctgcatgcccctgtaccaggccctggtgaaggtgaatgtgaagctgaagcccatgctggacagcgtggccaccaacagaagcaagtgggaggagctgcaccagaagaggctgctggccagcacagccagcagcagccctgcctctgtgatggtggccaaggaggacaggaactag

SEQ ID NO: 163875 - DNA, 2052 bp, Artificial Sequence
  Description of Artificial Sequence: Synthetic coding sequence
atgctgaagcaggcccggcggcccctcttcagaaatgtgctgagcgccacccagtggaagaaggtgaagatcacccggctggtgcagatcagcggggccagcctggccgagaagcaggagaagcaccaggacttcctgatccagaggcagaccaagaccaaggaccggcgcttcaatgatgaaattgacaagctgaccggctacaagaccaagagcctgctgtgcatgcccatccgcagcagtgatggagagatcatcggcgtggcccaggccatcaacaagatccctgagggcgcccccttcacagaagatgatgagaaggtgatgcagatgtacctgcccttctgtggcatcgccatcagcaatgcccagctgtttgctgccagcaggaaggagtatgaaagaagccgggccctgctggaggtggtgaatgacctgtttgaggagcagacagacctggagaagatcgtgaagaagatcatgcaccgggcccagaccctgctgaagtgtgagcgctgcagcgtgctgctgctggaggacatcgagagccctgtggtgaagttcaccaagagctttgagctgatgagccccaagtgcagcgcagatgctgagaacagcttcaaggagagcatggagaagagcagctacagcgactggctgatcaacaacagcattgctgagctggtggccagcacaggcctgcctgtgaacatcagtgatgcctaccaggaccccaggtttgatgctgaggccgaccagatcagcggcttccacatccgctctgtgctgtgtgtgcccatctggaacagcaaccaccagatcattggagtggcccaggtgctgaaccggctggatggcaagccctttgatgatgctgaccagaggctgtttgaggccttcgtcatcttctgtggcctgggcatcaacaacaccatcatgtatgaccaggtgaagaagtcctgggccaagcagagcgtggccctggatgtgctgagctaccacgccacctgcagcaaggccgaggtggacaagttcaaggccgccaacatccccctggtgtctgagctggccattgatgacatccactttgatgacttcagcctggatgtggatgccatgatcacagctgccctgaggatgttcatggagctgggcatggtgcagaagttcaagattgattatgagaccctgtgccgctggctgctgactgtgaggaagaactacaggatggtgctgtaccacaactggaggcatgccttcaacgtgtgccagctgatgtttgccatgctgaccacagctggcttccaggacatcctgacagaggtggagatcctggccgtcatcgtgggctgcctgtgccacgacctggaccaccggggcaccaacaatgccttccaggccaagagcggcagcgccctggcccagctgtatggcaccagcgccaccctggagcaccaccacttcaaccacgctgtgatgatcctgcagagcgagggccacaacatctttgccaacctgagcagcaaggagtacagcgacctgatgcagctgctgaagcagagcatcctggccacagacctgaccctgtactttgaaagaagaacagagttctttgagctggtgtccaaaggagaatatgactggaacatcaagaaccaccgggacatcttccgctccatgctgatgacagcctgtgacctgggcgctgtgaccaagccctgggagatcagccggcaggtggccgagctggtgaccagcgagttctttgagcagggcgaccgggagcggctggagctgaagctgacccccagcgccatctttgacaggaacaggaaggatgagctgccccggctgcagctggagtggattgacagcatctgcatgcccctgtaccaggccctggtgaaggtgaatgtgaagctgaagcccatgctggacagcgtggccaccaacagaagcaagtgggaggagctgcaccagaagaggctgctggccagcacagccagcagcagccctgcctctgtgatggtggccaaggaggacaggaactag

SEQ ID NO: 163876 - DNA, 1470 bp, Artificial Sequence
  Description of Artificial Sequence: Synthetic coding sequence
atgagccccaagtgcagcgcagatgctgagaacagcttcaaggagagcatggagaagagcagctacagcgactggctgatcaacaacagcattgctgagctggtggccagcacaggcctgcctgtgaacatcagtgatgcctaccaggaccccaggtttgatgctgaggccgaccagatcagcggcttccacatccgctctgtgctgtgtgtgcccatctggaacagcaaccaccagatcattggagtggcccaggtgctgaaccggctggatggcaagccctttgatgatgctgaccagaggctgtttgaggccttcgtcatcttctgtggcctgggcatcaacaacaccatcatgtatgaccaggtgaagaagtcctgggccaagcagagcgtggccctggatgtgctgagctaccacgccacctgcagcaaggccgaggtggacaagttcaaggccgccaacatccccctggtgtctgagctggccattgatgacatccactttgatgacttcagcctggatgtggatgccatgatcacagctgccctgaggatgttcatggagctgggcatggtgcagaagttcaagattgattatgagaccctgtgccgctggctgctgactgtgaggaagaactacaggatggtgctgtaccacaactggaggcatgccttcaacgtgtgccagctgatgtttgccatgctgaccacagctggcttccaggacatcctgacagaggtggagatcctggccgtcatcgtgggctgcctgtgccacgacctggaccaccggggcaccaacaatgccttccaggccaagagcggcagcgccctggcccagctgtatggcaccagcgccaccctggagcaccaccacttcaaccacgctgtgatgatcctgcagagcgagggccacaacatctttgccaacctgagcagcaaggagtacagcgacctgatgcagctgctgaagcagagcatcctggccacagacctgaccctgtactttgaaagaagaacagagttctttgagctggtgtccaaaggagaatatgactggaacatcaagaaccaccgggacatcttccgctccatgctgatgacagcctgtgacctgggcgctgtgaccaagccctgggagatcagccggcaggtggccgagctggtgaccagcgagttctttgagcagggcgaccgggagcggctggagctgaagctgacccccagcgccatctttgacaggaacaggaaggatgagctgccccggctgcagctggagtggattgacagcatctgcatgcccctgtaccaggccctggtgaaggtgaatgtgaagctgaagcccatgctggacagcgtggccaccaacagaagcaagtgggaggagctgcaccagaagaggctgctggccagcacagccagcagcagccctgcctctgtgatggtggccaaggaggacaggaactag

SEQ ID NO: 163877 - DNA, 1728 bp, Artificial Sequence
  Description of Artificial Sequence: Synthetic coding sequence
atgcagatgtacctgcccttctgtggcatcgccatcagcaatgcccagctgtttgctgccagcaggaaggagtatgaaagaagccgggccctgctggaggtggtgaatgacctgtttgaggagcagacagacctggagaagatcgtgaagaagatcatgcaccgggcccagaccctgctgaagtgtgagcgctgcagcgtgctgctgctggaggacatcgagagccctgtggtgaagttcaccaagagctttgagctgatgagccccaagtgcagcgcagatgctgagaacagcttcaaggagagcatggagaagagcagctacagcgactggctgatcaacaacagcattgctgagctggtggccagcacaggcctgcctgtgaacatcagtgatgcctaccaggaccccaggtttgatgctgaggccgaccagatcagcggcttccacatccgctctgtgctgtgtgtgcccatctggaacagcaaccaccagatcattggagtggcccaggtgctgaaccggctggatggcaagccctttgatgatgctgaccagaggctgtttgaggccttcgtcatcttctgtggcctgggcatcaacaacaccatcatgtatgaccaggtgaagaagtcctgggccaagcagagcgtggccctggatgtgctgagctaccacgccacctgcagcaaggccgaggtggacaagttcaaggccgccaacatccccctggtgtctgagctggccattgatgacatccactttgatgacttcagcctggatgtggatgccatgatcacagctgccctgaggatgttcatggagctgggcatggtgcagaagttcaagattgattatgagaccctgtgccgctggctgctgactgtgaggaagaactacaggatggtgctgtaccacaactggaggcatgccttcaacgtgtgccagctgatgtttgccatgctgaccacagctggcttccaggacatcctgacagaggtggagatcctggccgtcatcgtgggctgcctgtgccacgacctggaccaccggggcaccaacaatgccttccaggccaagagcggcagcgccctggcccagctgtatggcaccagcgccaccctggagcaccaccacttcaaccacgctgtgatgatcctgcagagcgagggccacaacatctttgccaacctgagcagcaaggagtacagcgacctgatgcagctgctgaagcagagcatcctggccacagacctgaccctgtactttgaaagaagaacagagttctttgagctggtgtccaaaggagaatatgactggaacatcaagaaccaccgggacatcttccgctccatgctgatgacagcctgtgacctgggcgctgtgaccaagccctgggagatcagccggcaggtggccgagctggtgaccagcgagttctttgagcagggcgaccgggagcggctggagctgaagctgacccccagcgccatctttgacaggaacaggaaggatgagctgccccggctgcagctggagtggattgacagcatctgcatgcccctgtaccaggccctggtgaaggtgaatgtgaagctgaagcccatgctggacagcgtggccaccaacagaagcaagtgggaggagctgcaccagaagaggctgctggccagcacagccagcagcagccctgcctctgtgatggtggccaaggaggacaggaactag

SEQ ID NO: 163878 - DNA, 393 bp, Artificial Sequence
  Description of Artificial Sequence: Synthetic coding sequence
atgcccatccgcagcagtgatggagagatcattggagtggcccaggccatcaacaagatccctgagggcgcccccttcacagaagatgatgagaaggtgatgcagatgtacctgcccttctgtggcatcgccatcagcaatgcccagctgtttgctgccagcaggaaggagtatgaaagaagccgggccctgctggaggtggtgaatgacctgtttgaggagcagacagacctggagaagatcgtgaagaagatcatgcaccgggcccagaccctgctgaagtgtgagcgctgcagcgtgctgctgctggaggacatcgagagccctgtggtgaagttcaccaagagctttgagctgatgagccccaagtgcagcgcagatgctgaaaattag

SEQ ID NO: 163879 - DNA, 1728 bp, Artificial Sequence; identical to SEQ ID NO: 163877
  Description of Artificial Sequence: Synthetic coding sequence

SEQ ID NO: 163880 - DNA, 375 bp, Artificial Sequence
  Description of Artificial Sequence: Synthetic coding sequence
atgctgatgacagcctgtgacctgggcgctgtgaccaagccctgggagatcagccggcaggtggccgagctggtgaccagcgagttctttgagcagggcgaccgggagcggctggagctgaagctgaccccatctgccatctttgacaggaacaggaaggatgagctgccccggctgcagctggagtggattgacagcatctgcatgcccctgtaccaggccctggtgaaggtgaatgtgaagctgaagcccatgctggacagcgtggccaccaacagaagcaagtgggaggagctgcaccagaagaggctgctggccagcacagccagcagcagccctgcctctgtgatggtggccaaggaggacagaaattag

SEQ ID NO: 163881 - DNA, 1638 bp, Artificial Sequence
  Description of Artificial Sequence: Synthetic coding sequence
atgggcagcagcgccacagaaattgaggagctggagaacaccaccttcaagtacctgaccggggagcagacagagaagatgtggcagaggctgaagggcatcctgcgctgcctggtgaagcagctggagagaggagatgtgaatgtggtggacctgaagaagaacatcgagtatgctgcctctgtgctggaggccgtgtacattgatgagacccggcggctgctggacacagaagatgagctgagtgacatccagacagacagcgtgcccagcgaggtgcgggactggctggccagcaccttcaccaggaagatgggcatgaccaagaagaagccagaggagaagcccaagttccgcagcatcgtgcatgctgtgcaggccggcatctttgtggagaggatgtacaggaagacctaccacatggtgggcctggcctacccagctgctgtgattgtgaccctgaaggatgtggacaagtggagctttgatgtgtttgccctgaatgaggccagcggggagcacagcctgaagttcatgatctatgagctgttcaccaggtatgacctgatcaaccgcttcaagatccctgtgtcctgcctgatcacctttgctgaggccctggaggtgggctacagcaagtacaagaacccctaccacaacctgattcatgctgctgatgtgacccagacagtgcactacatcatgctgcacacaggcatcatgcactggctgacagagctggagatcctggccatggtgtttgctgctgccatccatgactatgagcacacaggcaccaccaacaacttccacatccagaccaggagtgatgtggccatcctgtacaatgacagatctgtgctggagaaccaccacgtgtctgctgcctaccgcctgatgcaggaggaggagatgaacatcctgatcaacctgagcaaggatgactggagggacctgaggaacctggtgattgagatggtgctgagcacagacatgagcggccacttccagcagatcaagaacatccggaacagcctgcagcagcctgagggcatcgaccgggccaagaccatgagcctcatcctgcacgccgctgacatcagccacccagccaagtcctggaagctgcactaccgctggaccatggccctgatggaggagttcttcctgcagggcgacaaggaggccgagctgggcctgcccttcagccccctgtgtgacaggaagagcaccatggtggcccagagccagatcggcttcatcgacttcatcgtggagcccaccttcagcctgctgacagacagcacagagaagatcgtcatccccctcatcgaggaggccagcaaggccgagaccagcagctatgtggccagcagcagcaccaccatcgtgggcctgcacatcgcagatgccctgcggcgcagcaacaccaagggctccatgtctgatggcagctacagcccagactacagcctggccgctgtggacctgaagagcttcaagaacaacctggtggacatcatccagcagaacaaggagcgctggaaggagctggccgcccagggcgagagtgacctgcacaagaacagcgaggacctggtgaatgctgaggagaagcatgatgagacccacagctag

SEQ ID NO: 163882 - DNA, 1536 bp, Artificial Sequence
  Description of Artificial Sequence: Synthetic coding sequence
atgggcaagaagatcaacaagctgttctgcttcaacttcctggtgcagtgcttccggggcaagagcaagcccagcaagtgccagatcaggaagaaggtgaagaaccacatcgagcggctgctggacacagaagatgagctgagtgacatccagacagacagcgtgcccagcgaggtgcgggactggctggccagcaccttcaccaggaagatgggcatgaccaagaagaagccagaggagaagcccaagttccgcagcatcgtgcatgctgtgcaggccggcatctttgtggagaggatgtacaggaagacctaccacatggtgggcctggcctacccagctgctgtgattgtgaccctgaaggatgtggacaagtggagctttgatgtgtttgccctgaatgaggccagcggggagcacagcctgaagttcatgatctatgagctgttcaccaggtatgacctgatcaaccgcttcaagatccctgtgtcctgcctgatcacctttgctgaggccctggaggtgggctacagcaagtacaagaacccctaccacaacctgattcatgctgctgatgtgacccagacagtgcactacatcatgctgcacacaggcatcatgcactggctgacagagctggagatcctggccatggtgtttgctgctgccatccatgactatgagcacacaggcaccaccaacaacttccacatccagaccaggagtgatgtggccatcctgtacaatgacagatctgtgctggagaaccaccacgtgtctgctgcctaccgcctgatgcaggaggaggagatgaacatcctgatcaacctgagcaaggatgactggagggacctgaggaacctggtgattgagatggtgctgagcacagacatgagcggccacttccagcagatcaagaacatccggaacagcctgcagcagcctgagggcatcgaccgggccaagaccatgagcctcatcctgcacgccgctgacatcagccacccagccaagtcctggaagctgcactaccgctggaccatggccctgatggaggagttcttcctgcagggcgacaaggaggccgagctgggcctgcccttcagccccctgtgtgacaggaagagcaccatggtggcccagagccagatcggcttcatcgacttcatcgtggagcccaccttcagcctgctgacagacagcacagagaagatcgtcatccccctcatcgaggaggccagcaaggccgagaccagcagctatgtggccagcagcagcaccaccatcgtgggcctgcacatcgcagatgccctgcggcgcagcaacaccaagggctccatgtctgatggcagctacagcccagactacagcctggccgctgtggacctgaagagcttcaagaacaacctggtggacatcatccagcagaacaaggagcgctggaaggagctggccgcccagggcgagagtgacctgcacaagaacagcgaggacctggtgaatgctgaggagaagcatgatgagacccacagctag

SEQ ID NO: 163883 - DNA, 1560 bp, Artificial Sequence
  Description of Artificial Sequence: Synthetic coding sequence
atggatgaccacgtgaccatcaggaagaagcacctgcagaggcccatcttccggctgcgctgcctggtgaagcagctggagagaggagatgtgaatgtggtggacctgaagaagaacatcgagtatgctgcctctgtgctggaggccgtgtacattgatgagacccggcggctgctggacacagaagatgagctgagtgacatccagacagacagcgtgcccagcgaggtgcgggactggctggccagcaccttcaccaggaagatgggcatgaccaagaagaagccagaggagaagcccaagttccgcagcatcgtgcatgctgtgcaggccggcatctttgtggagaggatgtacaggaagacctaccacatggtgggcctggcctacccagctgctgtgattgtgaccctgaaggatgtggacaagtggagctttgatgtgtttgccctgaatgaggccagcggggagcacagcctgaagttcatgatctatgagctgttcaccaggtatgacctgatcaaccgcttcaagatccctgtgtcctgcctgatcacctttgctgaggccctggaggtgggctacagcaagtacaagaacccctaccacaacctgattcatgctgctgatgtgacccagacagtgcactacatcatgctgcacacaggcatcatgcactggctgacagagctggagatcctggccatggtgtttgctgctgccatccatgactatgagcacacaggcaccaccaacaacttccacatccagaccaggagtgatgtggccatcctgtacaatgacagatctgtgctggagaaccaccacgtgtctgctgcctaccgcctgatgcaggaggaggagatgaacatcctgatcaacctgagcaaggatgactggagggacctgaggaacctggtgattgagatggtgctgagcacagacatgagcggccacttccagcagatcaagaacatccggaacagcctgcagcagcctgagggcatcgaccgggccaagaccatgagcctcatcctgcacgccgctgacatcagccacccagccaagtcctggaagctgcactaccgctggaccatggccctgatggaggagttcttcctgcagggcgacaaggaggccgagctgggcctgcccttcagccccctgtgtgacaggaagagcaccatggtggcccagagccagatcggcttcatcgacttcatcgtggagcccaccttcagcctgctgacagacagcacagagaagatcgtcatccccctcatcgaggaggccagcaaggccgagaccagcagctatgtggccagcagcagcaccaccatcgtgggcctgcacatcgcagatgccctgcggcgcagcaacaccaagggctccatgtctgatggcagctacagcccagactacagcctggccgctgtggacctgaagagcttcaagaacaacctggtggacatcatccagcagaacaaggagcgctggaaggagctggccgcccaggaggcccggaccagcagccagaagtgtgagttcatccaccagtag

SEQ ID NO: 163884 - DNA, 1608 bp, Artificial Sequence
  Description of Artificial Sequence: Synthetic coding sequence
atgggcagcagcgccacagaaattgaggagctggagaacaccaccttcaagtacctgaccggggagcagacagagaagatgtggcagaggctgaagggcatcctgcgctgcctggtgaagcagctggagagaggagatgtgaatgtggtggacctgaagaagaacatcgagtatgctgcctctgtgctggaggccgtgtacattgatgagacccggcggctgctggacacagaagatgagctgagtgacatccagacagacagcgtgcccagcgaggtgcgggactggctggccagcaccttcaccaggaagatgggcatgaccaagaagaagccagaggagaagcccaagttccgcagcatcgtgcatgctgtgcaggccggcatctttgtggagaggatgtacaggaagacctaccacatggtgggcctggcctacccagctgctgtgattgtgaccctgaaggatgtggacaagtggagctttgatgtgtttgccctgaatgaggccagcggggagcacagcctgaagttcatgatctatgagctgttcaccaggtatgacctgatcaaccgcttcaagatccctgtgtcctgcctgatcacctttgctgaggccctggaggtgggctacagcaagtacaagaacccctaccacaacctgattcatgctgctgatgtgacccagacagtgcactacatcatgctgcacacaggcatcatgcactggctgacagagctggagatcctggccatggtgtttgctgctgccatccatgactatgagcacacaggcaccaccaacaacttccacatccagaccaggagtgatgtggccatcctgtacaatgacagatctgtgctggagaaccaccacgtgtctgctgcctaccgcctgatgcaggaggaggagatgaacatcctgatcaacctgagcaaggatgactggagggacctgaggaacctggtgattgagatggtgctgagcacagacatgagcggccacttccagcagatcaagaacatccggaacagcctgcagcagcctgagggcatcgaccgggccaagaccatgagcctcatcctgcacgccgctgacatcagccacccagccaagtcctggaagctgcactaccgctggaccatggccctgatggaggagttcttcctgcagggcgacaaggaggccgagctgggcctgcccttcagccccctgtgtgacaggaagagcaccatggtggcccagagccagatcggcttcatcgacttcatcgtggagcccaccttcagcctgctgacagacagcacagagaagatcgtcatccccctcatcgaggaggccagcaaggccgagaccagcagctatgtggccagcagcagcaccaccatcgtgggcctgcacatcgcagatgccctgcggcgcagcaacaccaagggctccatgtctgatggcagctacagcccagactacagcctggccgctgtggacctgaagagcttcaagaacaacctggtggacatcatccagcagaacaaggagcgctggaaggagctggccgcccaggaggcccggaccagcagccagaagtgtgagttcatccaccagtag

SEQ ID NO: 163885 - DNA, 1590 bp, Artificial Sequence
  Description of Artificial Sequence: Synthetic coding sequence
atggatgaccacgtgaccatcaggaagaagcacctgcagaggcccatcttccggctgcgctgcctggtgaagcagctggagagaggagatgtgaatgtggtggacctgaagaagaacatcgagtatgctgcctctgtgctggaggccgtgtacattgatgagacccggcggctgctggacacagaagatgagctgagtgacatccagacagacagcgtgcccagcgaggtgcgggactggctggccagcaccttcaccaggaagatgggcatgaccaagaagaagccagaggagaagcccaagttccgcagcatcgtgcatgctgtgcaggccggcatctttgtggagaggatgtacaggaagacctaccacatggtgggcctggcctacccagctgctgtgattgtgaccctgaaggatgtggacaagtggagctttgatgtgtttgccctgaatgaggccagcggggagcacagcctgaagttcatgatctatgagctgttcaccaggtatgacctgatcaaccgcttcaagatccctgtgtcctgcctgatcacctttgctgaggccctggaggtgggctacagcaagtacaagaacccctaccacaacctgattcatgctgctgatgtgacccagacagtgcactacatcatgctgcacacaggcatcatgcactggctgacagagctggagatcctggccatggtgtttgctgctgccatccatgactatgagcacacaggcaccaccaacaacttccacatccagaccaggagtgatgtggccatcctgtacaatgacagatctgtgctggagaaccaccacgtgtctgctgcctaccgcctgatgcaggaggaggagatgaacatcctgatcaacctgagcaaggatgactggagggacctgaggaacctggtgattgagatggtgctgagcacagacatgagcggccacttccagcagatcaagaacatccggaacagcctgcagcagcctgagggcatcgaccgggccaagaccatgagcctcatcctgcacgccgctgacatcagccacccagccaagtcctggaagctgcactaccgctggaccatggccctgatggaggagttcttcctgcagggcgacaaggaggccgagctgggcctgcccttcagccccctgtgtgacaggaagagcaccatggtggcccagagccagatcggcttcatcgacttcatcgtggagcccaccttcagcctgctgacagacagcacagagaagatcgtcatccccctcatcgaggaggccagcaaggccgagaccagcagctatgtggccagcagcagcaccaccatcgtgggcctgcacatcgcagatgccctgcggcgcagcaacaccaagggctccatgtctgatggcagctacagcccagactacagcctggccgctgtggacctgaagagcttcaagaacaacctggtggacatcatccagcagaacaaggagcgctggaaggagctggccgcccagggcgagagtgacctgcacaagaacagcgaggacctggtgaatgctgaggagaagcatgatgagacccacagctag

SEQ ID NO: 163886 - DNA, 1608 bp, Artificial Sequence; identical to SEQ ID NO: 163884
  Description of Artificial Sequence: Synthetic coding sequence

SEQ ID NO: 163887 - DNA, 1638 bp, Artificial Sequence; identical to SEQ ID NO: 163881
  Description of Artificial Sequence: Synthetic coding sequence

SEQ ID NO: 163888 - DNA, 1659 bp, Artificial Sequence
  Description of Artificial Sequence: Synthetic coding sequence
atgggcagcagcgccacagaaattgaggagctggagaacaccaccttcaagtacctgaccggggagcagacagagaagatgtggcagaggctgaagggcatcctgcgctgcctggtgaagcagctggagagaggagatgtgaatgtggtggacctgaagaagaacatcgagtatgctgcctctgtgctggaggccgtgtacattgatgagacccggcggctgctggacacagaagatgagctgagtgacatccagacagacagcgtgcccagcgaggtgcgggactggctggccagcaccttcaccaggaagatgggcatgaccaagaagaagccagaggagaagcccaagttccgcagcatcgtgcatgctgtgcaggccggcatctttgtggagaggatgtacaggaagacctaccacatggtgggcctggcctacccagctgctgtgattgtgaccctgaaggatgtggacaagtggagctttgatgtgtttgccctgaatgaggccagcggggagcacagcctgaagttcatgatctatgagctgttcaccaggtatgacctgatcaaccgcttcaagatccctgtgtcctgcctgatcacctttgctgaggccctggaggtgggctacagcaagtacaagaacccctaccacaacctgattcatgctgctgatgtgacccagacagtgcactacatcatgctgcacacaggcatcatgcactggctgacagagctggagatcctggccatggtgtttgctgctgccatccatgactatgagcacacaggcaccaccaacaacttccacatccagaccaggagtgatgtggccatcctgtacaatgacagatctgtgctggagaaccaccacgtgtctgctgcctaccgcctgatgcaggaggaggagatgaacatcctgatcaacctgagcaaggatgactggagggacctgaggaacctggtgattgagatggtgctgagcacagacatgagcggccacttccagcagatcaagaacatccggaacagcctgcagcagcctgagggcatcgaccgggccaagaccatgagcctcatcctgcacgccgctgacatcagccacccagccaagtcctggaagctgcactaccgctggaccatggccctgatggaggagttcttcctgcagggcgacaaggaggccgagctgggcctgcccttcagccccctgtgtgacaggaagagcaccatggtggcccagagccagatcggcttcatcgacttcatcgtggagcccaccttcagcctgctgacagacagcacagagaagatcgtcatccccctcatcgaggaggccagcaaggccgagaccagcagctatgtggccagcagcagcaccaccatcgtgggcctgcacatcgcagatgccctgcggcgcagcaacaccaagggctccatgtctgatggcagctacagcccagactacagcctggccgctgtggacctgaagagcttcaagaacaacctggtggacatcatccagcagaacaaggagcgctggaaggagctggccgcccagggctctgtggtgtatgaggccctgctgcccagcctgagcgtcttcaccagccccctgcgggtgtggatcaccagcagccgcttcctgctgctgtag

SEQ ID NO: 163889 - DNA, 1326 bp, Artificial Sequence
  Description of Artificial Sequence: Synthetic coding sequence
atgggcatgaccaagaagaagccagaggagaagcccaagttccgcagcatcgtgcatgctgtgcaggccggcatctttgtggagaggatgtacaggaagacctaccacatggtgggcctggcctacccagctgctgtgattgtgaccctgaaggatgtggacaagtggagctttgatgtgtttgccctgaatgaggccagcggggagcacagcctgaagttcatgatctatgagctgttcaccaggtatgacctgatcaaccgcttcaagatccctgtgtcctgcctgatcacctttgctgaggccctggaggtgggctacagcaagtacaagaacccctaccacaacctgattcatgctgctgatgtgacccagacagtgcactacatcatgctgcacacaggcatcatgcactggctgacagagctggagatcctggccatggtgtttgctgctgccatccatgactatgagcacacaggcaccaccaacaacttccacatccagaccaggagtgatgtggccatcctgtacaatgacagatctgtgctggagaaccaccacgtgtctgctgcctaccgcctgatgcaggaggaggagatgaacatcctgatcaacctgagcaaggatgactggagggacctgaggaacctggtgattgagatggtgctgagcacagacatgagcggccacttccagcagatcaagaacatccggaacagcctgcagcagcctgagggcatcgaccgggccaagaccatgagcctcatcctgcacgccgctgacatcagccacccagccaagtcctggaagctgcactaccgctggaccatggccctgatggaggagttcttcctgcagggcgacaaggaggccgagctgggcctgcccttcagccccctgtgtgacaggaagagcaccatggtggcccagagccagatcggcttcatcgacttcatcgtggagcccaccttcagcctgctgacagacagcacagagaagatcgtcatccccctcatcgaggaggccagcaaggccgagaccagcagctatgtggccagcagcagcaccaccatcgtgggcctgcacatcgcagatgccctgcggcgcagcaacaccaagggctccatgtctgatggcagctacagcccagactacagcctggccgctgtggacctgaagagcttcaagaacaacctggtggacatcatccagcagaacaaggagcgctggaaggagctggccgcccagggcgagagtgacctgcacaagaacagcgaggacctggtgaatgctgaggagaagcatgatgagacccacagctag

SEQ ID NO: 163890 - DNA, 1611 bp, Artificial Sequence
  Description of Artificial Sequence: Synthetic coding sequence
atggagctgagccccaggagccccccagagatgctggaggagagtgactgccccagccccctggagctgaagagcgcccccagcaagaagatgtggatcaagctgcggagcctgctgcgctacatggtgaagcagctggagaatggagagatcaacatcgaggagctgaagaagaacctggagtacacagccagcctgctggaggccgtgtacattgatgagacccggcagatcctggacacagaagatgagctgcaggagctgcggagtgatgctgtgcccagcgaggtgcgggactggctggccagcaccttcacccagcaggcccgggccaagggccggcgggcagaggagaagcccaagttccgcagcatcgtgcatgctgtgcaggccggcatctttgtggagaggatgttccggaggacctacacctctgtgggccccacctacagcacagctgtgctgaactgcctgaagaacctggacctgtggtgctttgatgtgttcagcctgaaccaggccgcagatgaccacgccctgcggaccatcgtgtttgagctgctgaccaggcacaacctgatcagccgcttcaagatccccaccgtcttcctgatgtccttcctggatgccctggagaccggctacggcaagtacaagaacccctaccacaaccagatccacgccgcagatgtgacccagacagtgcactgcttcctgctgaggacaggcatggtgcactgcctgtctgaaattgagctgctggccatcatctttgctgctgccatccatgactatgagcacacaggcaccaccaacagcttccacatccagaccaagtcagaatgtgccatcgtgtacaatgacagatctgtgctggagaaccaccacatcagctctgtgttccggctgatgcaggatgatgagatgaacatcttcatcaacctgaccaaggatgaatttgtggagctgcgggccctggtgattgagatggtgctggccacagacatgagctgccacttccagcaggtgaagaccatgaagacagccctgcagcagctggagagaattgacaagcccaaggccctgagcctgctgctgcacgccgctgacatcagccaccccaccaagcagtggctggtgcacagccgctggaccaaggccctgatggaggagttcttccggcagggcgacaaggaggccgagctgggcctgcccttcagccccctgtgtgacaggaccagcaccctggtggcccagagccagatcggcttcatcgacttcatcgtggagcccaccttctctgtgctgacagatgtggccgagaagtctgtgcagcccctggctgatgaggacagcaagagcaagaaccagcccagcttccagtggaggcagcccagcctggatgtggaggtgggggaccccaacccagatgtggtgtccttccgcagcacctgggtgaagaggatccaggagaacaagcagaagtggaaggagcgggccgccagcggcatcaccaaccagatgagcattgatgagctgagcccctgtgaggaggaggccccacccagccctgcagaagatgagcacaaccagaatggaaacctggactag

SEQ ID NO: 163891 - DNA, 1488 bp, Artificial Sequence
  Description of Artificial Sequence: Synthetic coding sequence
atggtgaagcagctggagaatggagagatcaacatcgaggagctgaagaagaacctggagtacacagccagcctgctggaggccgtgtacattgatgagacccggcagatcctggacacagaagatgagctgcaggagctgcggagtgatgctgtgcccagcgaggtgcgggactggctggccagcaccttcacccagcaggcccgggccaagggcagaagagctgaggagaagcccaagttccgcagcatcgtgcatgctgtgcaggccggcatctttgtggagaggatgttccggaggacctacacctctgtgggccccacctacagcacagctgtgctgaactgcctgaagaacctggacctgtggtgctttgatgtgttcagcctgaaccaggccgcagatgaccacgccctgcggaccatcgtgtttgagctgctgaccaggcacaacctgatcagccgcttcaagatccccaccgtcttcctgatgtccttcctggatgccctggagaccggctacggcaagtacaagaacccctaccacaaccagatccatgctgctgatgtgacccagacagtgcactgcttcctgctgaggacaggcatggtgcactgcctgtctgaaattgagctgctggccatcatctttgctgctgccatccatgactatgagcacacaggcaccaccaacagcttccacatccagaccaagtcagaatgtgccatcgtgtacaatgacagatctgtgctggagaaccaccacatcagcagcgtcttccggctgatgcaggatgatgagatgaacatcttcatcaacctgaccaaggatgaatttgtggagctgcgggccctggtgattgagatggtgctggccacagacatgagctgccacttccagcaggtgaagaccatgaagacagccctgcagcagctggagagaattgacaagcccaaggccctgagcctgctgctgcatgctgctgacatcagccaccccaccaagcagtggctggtgcacagccgctggaccaaggccctgatggaggagttcttccggcagggcgacaaggaggccgagctgggcctgcccttcagccccctgtgtgacaggaccagcaccctggtggcccagagccagatcggcttcatcgacttcatcgtggagcccaccttctctgtgctgacagatgtggccgagaagtctgtgcagcccctggctgatgaggacagcaagagcaagaaccagcccagcttccagtggaggcagcccagcctggatgtggaggtgggggaccccaacccagatgtggtgtccttccgcagcacctgggtgaagaggatccaggagaacaagcagaagtggaaggagagagctgccagcggcatcaccaaccagatgagcattgatgagctgagcccctgtgaggaggaggccccacccagccctgcagaagatgagcacaaccagaatggaaacctggactag

SEQ ID NO: 163892 - DNA, 1551 bp, Artificial Sequence
  Description of Artificial Sequence: Synthetic coding sequence
atggccaaccctgtgcctgtgcagaggagccacctgcagggccccatcctgcggctgcgctacatggtgaagcagctggagaatggagagatcaacatcgaggagctgaagaagaacctggagtacacagccagcctgctggaggccgtgtacattgatgagacccggcagatcctggacacagaagatgagctgcaggagctgcggagtgatgctgtgcccagcgaggtgcgggactggctggccagcaccttcacccagcaggcccgggccaagggccggcgggcagaggagaagcccaagttccgcagcatcgtgcatgctgtgcaggccggcatctttgtggagaggatgttccggaggacctacacctctgtgggccccacctacagcacagctgtgctgaactgcctgaagaacctggacctgtggtgctttgatgtgttcagcctgaaccaggccgcagatgaccacgccctgcggaccatcgtgtttgagctgctgaccaggcacaacctgatcagccgcttcaagatccccaccgtcttcctgatgtccttcctggatgccctggagaccggctacggcaagtacaagaacccctaccacaaccagatccacgccgcagatgtgacccagacagtgcactgcttcctgctgaggacaggcatggtgcactgcctgtctgaaattgagctgctggccatcatctttgctgctgccatccatgactatgagcacacaggcaccaccaacagcttccacatccagaccaagtcagaatgtgccatcgtgtacaatgacagatctgtgctggagaaccaccacatcagctctgtgttccggctgatgcaggatgatgagatgaacatcttcatcaacctgaccaaggatgaatttgtggagctgcgggccctggtgattgagatggtgctggccacagacatgagctgccacttccagcaggtgaagaccatgaagacagccctgcagcagctggagagaattgacaagcccaaggccctgagcctgctgctgcacgccgctgacatcagccaccccaccaagcagtggctggtgcacagccgctggaccaaggccctgatggaggagttcttccggcagggcgacaaggaggccgagctgggcctgcccttcagccccctgtgtgacaggaccagcaccctggtggcccagagccagatcggcttcatcgacttcatcgtggagcccaccttctctgtgctgacagatgtggccgagaagtctgtgcagcccctggctgatgaggacagcaagagcaagaaccagcccagcttccagtggaggcagcccagcctggatgtggaggtgggggaccccaacccagatgtggtgtccttccgcagcacctgggtgaagaggatccaggagaacaagcagaagtggaaggagcgggccgccagcggcatcaccaaccagatgagcattgatgagctgagcccctgtgaggaggaggccccacccagccctgcagaagatgagcacaaccagaatggaaacctggactag

SEQ ID NO: 163893 - DNA, 2310 bp, Artificial Sequence
  Description of Artificial Sequence: Synthetic coding sequence
atgacagatgctggcaacaggaaggagggcttcaagaagtgccgcagcgccaccttcagcattgatggctacagcttcaccatcgtggccaatgaagctggggacaagaatgcccggcccctggcccgcttcagccgcagcaagagccagaactgcctgtggaacagcctgattgatggcctgactggaaatgtgaaggagaagccccggcccaccatcgtgcatgaccccaggcctcctgaggagatcctggctgatgagctgccccagctggacagcagcgaggtgctggtgaagaccagcttccggctgcggagcctggtgaagcagctggagcggggggaggcctctgtggtggacctgaagaagaacctggagtatgctgccaccgtgctggagagcgtgtacattgatgagacccggcggctgctggacacagaagatgagctgagtgacatccagagtgatgctgtgcccagcgaggtgcgggactggctggccagcaccttcacccggcagatgggcatgatgctgcggcggagtgatgagaagccccgcttcaagagcatcgtgcatgctgtgcaggccggcatctttgtggagaggatgtacagaaggaccagcaacatggtgggcctgagctaccccccagctgtgattgaggccctgaaggatgtggacaagtggagctttgatgtgttcagcctgaatgaggccagcggggaccacgccctgaagttcatcttctatgagctgctgaccaggtatgacctgatcagccgcttcaagatccccatcagcgccctggtgtcctttgtggaggccctggaggtgggctacagcaagcacaagaacccctaccacaacctgatgcatgctgctgatgtgacccagacagtgcactacctgctgtacaagacaggagtggccaactggctgacagagctggagatctttgccatcatcttctctgctgccatccatgactatgagcacacaggcaccaccaacaacttccacatccagaccaggagtgaccctgccatcctgtacaatgacagatctgtgctggagaaccaccacctgtctgctgcctaccgcctgctgcaggatgatgaggagatgaacatcctgatcaacctgagcaaggatgactggagggagttccgcaccctggtgattgagatggtgatggccacagacatgagctgccacttccagcagatcaaggccatgaagacagccctgcagcagcctgaggccatcgagaagcccaaggccctgagcctgatgctgcacacagctgacatcagccacccagccaaggcctgggacctgcaccaccgctggaccatgagcctgctggaggagttcttccggcagggcgaccgggaggccgagctgggcctgcccttcagccccctgtgtgacaggaagagcaccatggtggcccagagccaggtgggcttcatcgacttcatcgtggagcccaccttcaccgtgctgacagacatgacagagaagatcgtgagccccctgattgatgagaccagccagacaggaggcaccggccagaggaggagcagcctgaacagcatcagcagcagtgatgccaagaggtctggagtgaagaccagcggcagcgagggcagcgcccccatcaacaacagcgtcatctctgtggactacaagagcttcaaggccacctggacagaggtggtgcacatcaaccgggagcgctggagggccaaggtgcccaaggaggagaaggccaagaaggaggccgaggagaaggcccggctggccgctgaggagcagcagaaggagatggaggccaagagccaggccgaggagggcgccagcggcaaggccgagaagaagaccagcggggagaccaagaaccaggtgaatggcacccgggccaacaagagtgacaacccccggggcaagaacagcaaggccgagaagagcagcggggagcagcagcagaatggagacttcaaggatggcaagaacaagacagacaagaaggaccacagcaacattggaaatgacagcaagaagacagatggcaccaagcagaggagccacggcagccctgcccccagcaccagcagcacctgccgcctgaccctgcctgtgatcaagccacccctgcggcacttcaagaggcctgcctatgccagcagcagctatgcccccagcgtgtccaagaagacagatgagcacccagcccgctacaagatgctggaccagaggatcaagatgaagaagatccagaacatcagccacaactggaacaggaagtag

SEQ ID NO: 163894 - DNA, 2130 bp, Artificial Sequence
  Description of Artificial Sequence: Synthetic coding sequence
atggagagccccaccaaggagattgaggagtttgagagcaacagcctgaagtacctgcagcctgagcagatcgagaagatctggctgcggctgcggggcctgaggaagtacaagaagaccagccagaggctgcggagcctggtgaagcagctggagcggggggaggcctctgtggtggacctgaagaagaacctggagtatgctgccaccgtgctggagagcgtgtacattgatgagacccggcggctgctggacacagaagatgagctgagtgacatccagagtgatgctgtgcccagcgaggtgcgggactggctggccagcaccttcacccggcagatgggcatgatgctgcggcggagtgatgagaagccccgcttcaagagcatcgtgcatgctgtgcaggccggcatctttgtggagaggatgtacagaaggaccagcaacatggtgggcctgagctaccccccagctgtgattgaggccctgaaggatgtggacaagtggagctttgatgtgttcagcctgaatgaggccagcggggaccacgccctgaagttcatcttctatgagctgctgaccaggtatgacctgatcagccgcttcaagatccccatcagcgccctggtgtcctttgtggaggccctggaggtgggctacagcaagcacaagaacccctaccacaacctgatgcatgctgctgatgtgacccagacagtgcactacctgctgtacaagacaggagtggccaactggctgacagagctggagatctttgccatcatcttctctgctgccatccatgactatgagcacacaggcaccaccaacaacttccacatccagaccaggagtgaccctgccatcctgtacaatgacagatctgtgctggagaaccaccacctgtctgctgcctaccgcctgctgcaggatgatgaggagatgaacatcctgatcaacctgagcaaggatgactggagggagttccgcaccctggtgattgagatggtgatggccacagacatgagctgccacttccagcagatcaaggccatgaagacagccctgcagcagcctgaggccatcgagaagcccaaggccctgagcctgatgctgcacacagctgacatcagccacccagccaaggcctgggacctgcaccaccgctggaccatgagcctgctggaggagttcttccggcagggcgaccgggaggccgagctgggcctgcccttcagccccctgtgtgacaggaagagcaccatggtggcccagagccaggtgggcttcatcgacttcatcgtggagcccaccttcaccgtgctgacagacatgacagagaagatcgtgagccccctgattgatgagaccagccagacaggaggcaccggccagaggaggagcagcctgaacagcatcagcagcagtgatgccaagaggtctggagtgaagaccagcggcagcgagggcagcgcccccatcaacaacagcgtcatctctgtggactacaagagcttcaaggccacctggacagaggtggtgcacatcaaccgggagcgctggagggccaaggtgcccaaggaggagaaggccaagaaggaggccgaggagaaggcccggctggccgctgaggagcagcagaaggagatggaggccaagagccaggccgaggagggcgccagcggcaaggccgagaagaagaccagcggggagaccaagaaccaggtgaatggcacccgggccaacaagagtgacaacccccggggcaagaacagcaaggccgagaagagcagcggggagcagcagcagaatggagacttcaaggatggcaagaacaagacagacaagaaggaccacagcaacattggaaatgacagcaagaagacagatggcaccaagcagaggagccacggcagccctgcccccagcaccagcagcacctgccgcctgaccctgcctgtgatcaagccacccctgcggcacttcaagaggcctgcctatgccagcagcagctatgcccccagcgtgtccaagaagacagatgagcacccagcccgctacaagatgctggaccagaggatcaagatgaagaagatccagaacatcagccacaactggaacaggaagtag

SEQ ID NO: 163895 - DNA, 1905 bp, Artificial Sequence
  Description of Artificial Sequence: Synthetic coding sequence
atggagagccccaccaaggagattgaggagtttgagagcaacagcctgaagtacctgcagcctgagcagatcgagaagatctggctgcggctgcggggcctgaggaagtacaagaagaccagccagaggctgcggagcctggtgaagcagctggagcggggggaggcctctgtggtggacctgaagaagaacctggagtatgctgccaccgtgctggagagcgtgtacattgatgagacccggcggctgctggacacagaagatgagctgagtgacatccagagtgatgctgtgcccagcgaggtgcgggactggctggccagcaccttcacccggcagatgggcatgatgctgcggcggagtgatgagaagccccgcttcaagagcatcgtgcatgctgtgcaggccggcatctttgtggagaggatgtacagaaggaccagcaacatggtgggcctgagctaccccccagctgtgattgaggccctgaaggatgtggacaagtggagctttgatgtgttcagcctgaatgaggccagcggggaccacgccctgaagttcatcttctatgagctgctgaccaggtatgacctgatcagccgcttcaagatccccatcagcgccctggtgtcctttgtggaggccctggaggtgggctacagcaagcacaagaacccctaccacaacctgatgcatgctgctgatgtgacccagacagtgcactacctgctgtacaagacaggagtggccaactggctgacagagctggagatctttgccatcatcttctctgctgccatccatgactatgagcacacaggcaccaccaacaacttccacatccagaccaggagtgaccctgccatcctgtacaatgacagatctgtgctggagaaccaccacctgtctgctgcctaccgcctgctgcaggatgatgaggagatgaacatcctgatcaacctgagcaaggatgactggagggagttccgcaccctggtgattgagatggtgatggccacagacatgagctgccacttccagcagatcaaggccatgaagacagccctgcagcagcctgaggccatcgagaagcccaaggccctgagcctgatgctgcacacagctgacatcagccacccagccaaggcctgggacctgcaccaccgctggaccatgagcctgctggaggagttcttccggcagggcgaccgggaggccgagctgggcctgcccttcagccccctgtgtgacaggaagagcaccatggtggcccagagccaggtgggcttcatcgacttcatcgtggagcccaccttcaccgtgctgacagacatgacagagaagatcgtgagccccctgattgatgagaccagccagacaggaggcaccggccagaggaggagcagcctgaacagcatcagcagcagtgatgccaagaggtctggagtgaagaccagcggcagcgagggcagcgcccccatcaacaacagcgtcatctctgtggactacaagagcttcaaggccacctggacagaggtggtgcacatcaaccgggagcgctggagggccaaggtgcccaaggaggagaaggccaagaaggaggccgaggagaaggcccggctggccgctgaggagcagcagaaggagatggaggccaagagccaggccgaggagggcgccagcggcaaggccgagaagaagaccagcggggagaccaagaaccaggtgaatggcacccgggccaacaagagtgacaacccccggggcaagaacagcaaggccgagaagagcagcggggagcagcagcagaatggagacttcaaggatggcaagaacaagacagacaagaaggaccacagcaacattggaaatgacagcaagaagacagatgacagccaggagtag

SEQ ID NO: 163896 - DNA, 1905 bp, Artificial Sequence; identical to SEQ ID NO: 163895
  Description of Artificial Sequence: Synthetic coding sequence

SEQ ID NO: 163897 - DNA, 141 bp, Artificial Sequence
  Description of Artificial Sequence: Synthetic coding sequence
atggagagccccaccaaggagattgaggagtttgagagcaacagcctgaagtacctgcagcctgagcagatcgagaagatctggctgcggctgcggggcctgaggaagtacaagaagaccagccagaggctgcggagctag

SEQ ID NO: 163898 - DNA, 2130 bp, Artificial Sequence; identical to SEQ ID NO: 163894
  Description of Artificial Sequence: Synthetic coding sequence

SEQ ID NO: 163899 - DNA, 3339 bp, Artificial Sequence
  Description of Artificial Sequence: Synthetic coding sequence
atgagaagagatgaaagagatgccaaggccatgaggagcctgcagcccccagatggagctggcagccccccagagagcctgagaaatggctacgtgaagagctgtgtgagccccctgcggcaggaccccccccggggcttcttcttccacctgtgccgcttctgcaatgtggagctgcggcccccaccagccagcccccagcagccccggcgctgcagccccttctgccgggcccggctgagcctgggcgccctggccgcctttgtgctggccctgctgctgggcgctgagcctgagagctgggccgccggggccgcctggctgcggaccctgctgtctgtgtgcagccacagcctgagccccctcttcagcatcgcctgtgccttcttcttcctgacctgcttcctgaccaggaccaagaggggccctggccctggccgcagctgtggctcctggtggctgctggccctgcctgcctgctgctacctgggggacttcctggtgtggcagtggtggagctggccctggggagatggagatgctggcagcgctgccccccacaccccacctgaggccgccgccggccgcctgctgctggtgctgagctgtgtgggcctgctgctgaccctggcccaccccctgcggctgcggcactgtgtgctggtgctgctgctggccagctttgtgtggtgggtgtccttcaccagcctgggcagcctgcccagcgccctgcggcccctgctgagcggcctggtgggcggggccggctgcctgctggccctgggcctggaccacttcttccagatccgggaggcccccctgcacccccggctgagcagcgctgctgaggagaaggtgcctgtgatccggcccaggagaagaagcagctgtgtgtccctgggggagacagctgccagctactacggcagctgcaagatcttcagaagacccagcctgccctgcatcagccgggagcagatgatcctgtgggactgggacctgaagcagtggtacaagccccactaccagaacagcggcggcggcaatggagtggacctgtctgtgctgaatgaggccaggaacatggtgtctgacctgctgacagaccccagcctgcccccccaggtgatcagcagcctgcggagcatcagcagcctgatgggcgccttcagcggcagctgccggcccaagatcaaccccctgacccccttccctggcttctacccctgcagcgagattgaggaccctgctgagaagggggacaggaagctgaacaagggcctgaacagaaacagcctgcccaccccccagctgcggcgcagcagcggcaccagcggcctgctgcctgtggagcagagcagccgctgggacaggaacaacgggaagaggccccaccaggagtttggcatcagcagccagggctgctacctgaatggccccttcaacagcaacctgctgaccatccccaagcagaggagcagctctgtgtccctgacccaccacgtgggcctgcggcgggccggcgtgctgagcagcctgagccctgtgaacagcagcaaccacggccctgtgtccacaggcagcctgaccaacagaagccccatcgagttcccagacacagctgacttcctgaacaagcccagcgtcatcctgcagaggagcctgggcaatgcccccaacaccccagacttctaccagcagctgaggaacagcgacagcaacctgtgcaacagctgtggccaccagatgctgaagtatgtgtccaccagcgagagtgatggaacagactgctgcagcggcaagagcggggaggaggagaacatcttcagcaaggagagcttcaagctgatggagacccagcaggaggaggagacagagaagaaggacagcaggaagctgttccaggagggggacaagtggctgacagaggaggcccagagcgagcagcagaccaacatcgagcaggaggtgtccctggacctgatcctggtggaggagtatgacagcctgattgagaagatgagcaactggaacttccccatctttgagctggtggagaagatgggagagaagagcggccgcatcctgagccaggtgatgtacaccctcttccaggacaccggcctgctggagatcttcaagatccccacccagcagttcatgaactacttccgggccctggagaatggctacagagacatcccctaccacaaccgcatccacgccacagatgtgctgcatgctgtgtggtacctgaccaccaggcctgtgcccggcctgcagcagatccacaacggctgcggcactggaaatgaaacagacagtgatggccgcatcaaccacggccgcatcgcctacatcagcagcaagagctgcagcaacccagatgagagctatggctgcctgagcagcaacatcccagccctggagctgatggccctgtatgtggccgccgccatgcatgactatgaccaccctggccgcaccaatgccttcctggtggccaccaatgccccccaggccgtgctgtacaatgacagatctgtgctggagaaccaccacgccgccagcgcctggaacctgtacctgagcaggcctgagtacaacttcctgctgcacctggaccacgtggagttcaagcgcttccgcttcctggtgattgaggccatcctggccacagacctgaagaagcactttgacttcctggccgagttcaatgccaaggccaatgatgtgaacagcaatggaattgagtggagcaatgaaaatgaccggctgctggtgtgccaggtgtgcatcaagctggccgacatcaatggacctgccaaggtgcgggacctgcacctgaagtggacagagggcatcgtgaatgagttctatgagcagggagatgaggaggccaacctgggcctgcccatcagccccttcatggacaggagcagcccccagctggccaagctgcaggagagcttcatcacccacatcgtgggccccctgtgcaacagctatgatgctgctggcctgctgcccggccagtggctggaggccgaggaggacaatgacacagagagcggagatgatgaagatggagaggagctggacacagaagatgaggagatggagaacaacctgaaccccaagccacccaggaggaagagcagaagacgcatcttctgccagctgatgcaccacctgacagagaaccacaagatctggaaggagatcgtggaggaggaggagaagtgcaaggcagatggcaacaagctgcaggtggagaacagcagcctgccccaggctgatgagatccaggtgattgaggaggctgatgaggaggagtag

SEQ ID NO: 163900 - DNA, 3186 bp, Artificial Sequence
  Description of Artificial Sequence: Synthetic coding sequence
atgagaagagatgaaagagatgccaaggccatgaggagcctgcagcccccagatggagctggcagccccccagagagcctgagaaatggctacgtgaagagctgtgtgagccccctgcggcaggaccccccccggggcttcttcttccacctgtgccgcttctgcaatgtggagctgcggcccccaccagccagcccccagcagccccggcgctgcagccccttctgccgggcccggctgagcctgggcgccctggccgcctttgtgctggccctgctgctgggcgctgagcctgagagctgggccgccggggccgcctggctgcggaccctgctgtctgtgtgcagccacagcctgagccccctcttcagcatcgcctgtgccttcttcttcctgacctgcttcctgaccaggaccaagaggggccctggccctggccgcagctgtggctcctggtggctgctggccctgcctgcctgctgctacctgggggacttcctggtgtggcagtggtggagctggccctggggagatggagatgctggcagcgctgccccccacaccccacctgaggccgccgccggccgcctgctgctggtgctgagctgtgtgggcctgctgctgaccctggcccaccccctgcggctgcggcactgtgtgctggtgctgctgctggccagctttgtgtggtgggtgtccttcaccagcctgggcagcctgcccagcgccctgcggcccctgctgagcggcctggtgggcggggccggctgcctgctggccctgggcctggaccacttcttccagatccgggaggcccccctgcacccccggctgagcagcgctgctgaggagaaggtgcctgtgatccggcccaggagaagaagcagctgtgtgtccctgggggagacagctgccagctactacggcagctgcaagatcttcagaagacccagcctgccctgcatcagccgggagcagatgatcctgtgggactgggacctgaagcagtggtacaagccccactaccagaacagcggcggcggcaatggagtggacctgtctgtgctgaatgaggccaggaacatggtgtctgacctgctgacagaccccagcctgcccccccagggcctgaacagaaacagcctgcccaccccccagctgcggcgcagcagcggcaccagcggcctgctgcctgtggagcagagcagccgctgggacagaaataatggcaagaggccccaccaggagtttggcatcagcagccagggctgctacctgaatggccccttcaacagcaacctgctgaccatccccaagcagaggagcagctctgtgtccctgacccaccacgtgggcctgcggcgggccggcgtgctgagcagcctgagccctgtgaacagcagcaaccacggccctgtgtccacaggcagcctgaccaacagaagccccatcgagttcccagacacagctgacttcctgaacaagcccagcgtcatcctgcagaggagcctgggcaatgcccccaacaccccagacttctaccagcagctgaggaacagcgacagcaacctgtgcaacagctgtggccaccagatgctgaagtatgtgtccaccagcgagagtgatggaacagactgctgcagcggcaagtctggagaggaggagaacatcttcagcaaggagagcttcaagctgatggagacccagcaggaggaggagacagagaagaaggacagcaggaagctgttccaggagggggacaagtggctgacagaggaggcccagagcgagcagcagaccaacatcgagcaggaggtgtccctggacctgatcctggtggaggagtatgacagcctcatcgagaagatgagcaactggaacttccccatctttgagctggtggagaagatgggagagaagagcggccgcatcctgagccaggtgatgtacaccctcttccaggacaccggcctgctggagatcttcaagatccccacccagcagttcatgaactacttccgggccctggagaatggctacagagacatcccctaccacaaccgcatccacgccacagatgtgctgcatgctgtgtggtacctgaccaccaggcctgtgcccggcctgcagcagatccacaacggctgcggcactggaaatgaaacagacagtgatggccgcatcaaccacggcagaattgcctacatcagcagcaagagctgcagcaacccagatgagagctatggctgcctgagcagcaacatcccagccctggagctgatggccctgtatgtggccgccgccatgcatgactatgaccaccctggccgcaccaatgccttcctggtggccaccaatgccccccaggccgtgctgtacaatgacagatctgtgctggagaaccaccacgccgccagcgcctggaacctgtacctgagcaggcctgagtacaacttcctgctgcacctggaccacgtggagttcaagcgcttccgcttcctggtgattgaggccatcctggccacagacctgaagaagcactttgacttcctggccgagttcaatgccaaggccaatgatgtgaacagcaatggcatcgagtggagcaatgaaaatgaccggctgctggtgtgccaggtgtgcatcaagctggccgacatcaatggacctgccaaggtgcgggacctgcacctgaagtggacagagggcatcgtgaatgagttctatgagcagggagatgaggaggccaacctgggcctgcccatcagccccttcatggacaggagcagcccccagctggccaagctgcaggagagcttcatcacccacatcgtgggccccctgtgcaacagctatgatgctgctggcctgctgcccggccagtggctggaggccgaggaggacaatgacacagaaagtggagatgatgaagatggagaggagctggacacagaagatgaggagatggagaacaacctgaaccccaagccacccaggaggaagagcagaagacgcatcttctgccagctgatgcaccacctgacagagaaccacaagatctggaaggagatcgtggaggaggaggagaagtgcaaggcagatggcaacaagctgcaggtggagaacagcagcctgccccaggctgatgagatccaggtgattgaggaggctgatgaggaggagtag

SEQ ID NO: 163901 - DNA, 2583 bp, Artificial Sequence
  Description of Artificial Sequence: Synthetic coding sequence
atggcccggccccggggcctgggccgcatccctgagctgcagctggtggccttccctgtggccgtggccgcagaagatgaggccttcctgcctgagcccctggccccccgggccccccggcggcccaggagcccccccagcagccctgtgttctttgccagccccagccccaccttcagaagaaggctgcggctgctgcggagctgccaggacctgggccggcaggcctgggccggggccggctttgaagcagaaaatggccccacccccagccctggccgcagccccctggacagccaggccagccctggcctggtgctgcatgctggagctgccaccagccagaggcgggagagcttcctgtacagaagtgacagcgactatgacatgagccccaagaccatgagcaggaacagctctgtgaccagcgaggcccatgctgaggacctgattgtgaccccatttgcccaggtgctggccagcctgcggtctgtgcgcagcaacttcagcctgctgaccaacgtgcctgtgcccagcaacaagaggagccccctgggcggccccacccctgtgtgcaaggccaccctgtctgaggagacctgccagcagctggcccgggagaccctggaggagctggactggtgcctggagcagctggagaccatgcagacctacagatctgtgtctgagatggccagccacaagttcaagaggatgctgaaccgggagctgacccacctgtctgagatgagccgcagcggcaaccaggtgtctgagtacatcagcaccaccttcctggacaagcagaatgaggtggagatccccagccccaccatgaaggagcgggagaagcagcaggccccccggccccggcccagccagcccccacctcctcctgtgccccacctgcagcccatgagccagatcaccggcctgaagaagctgatgcacagcaacagcctgaacaacagcaacatccccaggtttggagtgaagacagaccaggaggagctgctggcccaggagctggagaacctgaacaagtggggcctgaacatcttctgtgtgtctgactatgctgggggccgcagcctgacctgcatcatgtacatgatcttccaggagcgggacctgctgaagaagttccgcatccctgtggacaccatggtgacctacatgctgaccctggaggaccactaccacgcagatgtggcctaccacaacagcctgcacgccgcagatgtgctgcagagcacccacgtgctgctggccaccccagccctggatgctgtgttcacagacctggagatcctggccgccctgtttgctgctgccatccatgatgtggaccaccctggggtgagcaaccagttcctgatcaacaccaacagcgagctggccctgatgtacaatgatgagagcgtgctggagaaccaccacctggccgtgggcttcaagctgctgcaggaggacaactgtgacatcttccagaacctgagcaagaggcagaggcagagcctgaggaagatggtgattgacatggtgctggccacagacatgagcaagcacatgaccctgctggccgacctgaagaccatggtggagaccaagaaggtgaccagcagcggcgtgctgctgctggacaactacagcgaccgcatccaggtgctgaggaacatggtgcactgtgccgacctgagcaaccccaccaagcccctggagctgtaccggcagtggacagaccgcatcatggccgagttcttccagcagggcgaccgggagcgggagcggggcatggagatcagccccatgtgtgacaagcacacagcctctgtggagaagagccaggtgggcttcatcgactacatcgtgcaccccctgtgggagacctgggccgacctggtgcacccagatgcccaggagatcctggacaccctggaggacaacagagactggtactacagcgccatccggcagagccccagccccccacctgaggaggagagccggggccctggccacccccccctgcctgacaagttccagtttgagctgaccctggaggaggaggaggaggaggagatctccatggcccagatcccctgcacagcccaggaggccctgacagcccagggcctgagcggcgtggaggaggccctggatgccaccatcgcctgggaggccagccctgcccaggagagcctggaggtgatggcccaggaggccagcctggaggccgagctggaggccgtgtacctgacccagcaggcccagagcacaggcagcgcccctgtggccccagatgagttcagcagccgggaggagtttgtggtggccgtgagccacagcagccccagcgccctggccctgcagagccccctgctgcctgcctggaggaccctgtctgtgtctgagcacgcccctggcctgcccggcctgcccagcacagctgctgaggtggaggcccagcgggagcaccaggccgccaagagggcctgcagcgcctgtgccggcaccttcggggaggacaccagcgccctgcctgcccctgggggcggcggcagcggcggggaccccacctag

SEQ ID NO: 163902 - DNA, 1944 bp, Artificial Sequence
  Description of Artificial Sequence: Synthetic coding sequence
atgcccctggtggacttcttctgtgagacctgcagcaagccctggctggtgggctggtgggaccagttcaagaggatgctgaaccgggagctgacccacctgtctgagatgagccgcagcggcaaccaggtgtctgagtacatcagcaccaccttcctggacaagcagaatgaggtggagatccccagccccaccatgaaggagcgggagaagcagcaggccccccggccccggcccagccagcccccacctcctcctgtgccccacctgcagcccatgagccagatcaccggcctgaagaagctgatgcacagcaacagcctgaacaacagcaacatcccccgcttcggcgtgaagacagaccaggaggagctgctggcccaggagctggagaacctgaacaagtggggcctgaacatcttctgtgtgtctgactatgccggcggccgcagcctgacctgcatcatgtacatgatcttccaggagcgggacctgctgaagaagttccgcatccctgtggacaccatggtgacctacatgctgaccctggaggaccactaccacgcagatgtggcctaccacaacagcctgcatgctgctgatgtgctgcagagcacccacgtgctgctggccaccccagccctggatgctgtgttcacagacctggagatcctggccgccctgtttgctgctgccatccatgatgtggaccaccctggggtgagcaaccagttcctgatcaacaccaacagcgagctggccctgatgtacaatgatgaatctgtgctggagaaccaccacctggccgtgggcttcaagctgctgcaggaggacaactgtgacatcttccagaacctgagcaagaggcagaggcagagcctgaggaagatggtgattgacatggtgctggccacagacatgagcaagcacatgaccctgctggccgacctgaagaccatggtggagaccaagaaggtgaccagcagtggagtgctgctgctggacaactacagcgaccgcatccaggtgctgaggaacatggtgcactgtgccgacctgagcaaccccaccaagcccctggagctgtaccggcagtggacagaccgcatcatggccgagttcttccagcagggcgaccgggagcgggagcggggcatggagatcagccccatgtgtgacaagcacacagcctctgtggagaagagccaggtgggcttcatcgactacatcgtgcaccccctgtgggagacctgggccgacctggtgcacccagatgcccaggagatcctggacaccctggaggacaacagagactggtactacagcgccatccggcagagccccagccccccacctgaggaggagagccggggccctggccacccccccctgcctgacaagttccagtttgagctgaccctggaggaggaggaggaggaggagatctccatggcccagatcccctgcacagcccaggaggccctgacagcccagggcctgtctggagtggaggaggccctggatgccaccatcgcctgggaggccagccctgcccaggagagcctggaggtgatggcccaggaggccagcctggaggccgagctggaggccgtgtacctgacccagcaggcccagagcactggaagtgcccctgtggccccagatgagttcagcagccgggaggagtttgtggtggccgtgagccacagcagccccagcgccctggccctgcagagccccctgctgcctgcctggaggaccctgtctgtgtctgaacatgcccctggcctgcccggcctgcccagcacagctgctgaggtggaggcccagcgggagcaccaggccgccaagagggcctgcagcgcctgtgccggcacctttggagaggacaccagcgccctgcctgcccctgggggcggcggcagcggcggggaccccacctag

SEQ ID NO: 163903 - DNA, 2661 bp, Artificial Sequence
  Description of Artificial Sequence: Synthetic coding sequence
atggagcccccaacagtgcccagcgagaggagcctgagcctgagcctgcccggcccccgggagggccaggccaccctgaagcccccaccccagcacctgtggaggcagcccaggacccccatccgcatccagcagaggggctacagcgacagcgctgagagagctgagcgggagcggcagccccaccggcccatcgagcgggcagatgccatggacaccagtgacaggcctggcctgcggaccaccaggatgtcctggcccagcagcttccatggaactggaactggaagtggaggagctgggggcggcagcagccgccgctttgaagcagaaaatggccccacccccagccctggccgcagccccctggacagccaggccagccctggcctggtgctgcatgctggagctgccaccagccagaggcgggagagcttcctgtacagaagtgacagcgactatgacatgagccccaagaccatgagcaggaacagctctgtgaccagcgaggcccatgctgaggacctgattgtgaccccatttgcccaggtgctggccagcctgcggtctgtgcgcagcaacttcagcctgctgaccaacgtgcctgtgcccagcaacaagaggagccccctgggcggccccacccctgtgtgcaaggccaccctgtctgaggagacctgccagcagctggcccgggagaccctggaggagctggactggtgcctggagcagctggagaccatgcagacctacagatctgtgtctgagatggccagccacaagttcaagaggatgctgaaccgggagctgacccacctgtctgagatgagccgcagcggcaaccaggtgtctgagtacatcagcaccaccttcctggacaagcagaatgaggtggagatccccagccccaccatgaaggagcgggagaagcagcaggccccccggccccggcccagccagcccccacctcctcctgtgccccacctgcagcccatgagccagatcaccggcctgaagaagctgatgcacagcaacagcctgaacaacagcaacatccccaggtttggagtgaagacagaccaggaggagctgctggcccaggagctggagaacctgaacaagtggggcctgaacatcttctgtgtgtctgactatgctgggggccgcagcctgacctgcatcatgtacatgatcttccaggagcgggacctgctgaagaagttccgcatccctgtggacaccatggtgacctacatgctgaccctggaggaccactaccacgcagatgtggcctaccacaacagcctgcacgccgcagatgtgctgcagagcacccacgtgctgctggccaccccagccctggatgctgtgttcacagacctggagatcctggccgccctgtttgctgctgccatccatgatgtggaccaccctggggtgagcaaccagttcctgatcaacaccaacagcgagctggccctgatgtacaatgatgagagcgtgctggagaaccaccacctggccgtgggcttcaagctgctgcaggaggacaactgtgacatcttccagaacctgagcaagaggcagaggcagagcctgaggaagatggtgattgacatggtgctggccacagacatgagcaagcacatgaccctgctggccgacctgaagaccatggtggagaccaagaaggtgaccagcagcggcgtgctgctgctggacaactacagcgaccgcatccaggtgctgaggaacatggtgcactgtgccgacctgagcaaccccaccaagcccctggagctgtaccggcagtggacagaccgcatcatggccgagttcttccagcagggcgaccgggagcgggagcggggcatggagatcagccccatgtgtgacaagcacacagcctctgtggagaagagccaggtgggcttcatcgactacatcgtgcaccccctgtgggagacctgggccgacctggtgcacccagatgcccaggagatcctggacaccctggaggacaacagagactggtactacagcgccatccggcagagccccagccccccacctgaggaggagagccggggccctggccacccccccctgcctgacaagttccagtttgagctgaccctggaggaggaggaggaggaggagatctccatggcccagatcccctgcacagcccaggaggccctgacagcccagggcctgagcggcgtggaggaggccctggatgccaccatcgcctgggaggccagccctgcccaggagagcctggaggtgatggcccaggaggccagcctggaggccgagctggaggccgtgtacctgacccagcaggcccagagcacaggcagcgcccctgtggccccagatgagttcagcagccgggaggagtttgtggtggccgtgagccacagcagccccagcgccctggccctgcagagccccctgctgcctgcctggaggaccctgtctgtgtctgagcacgcccctggcctgcccggcctgcccagcacagctgctgaggtggaggcccagcgggagcaccaggccgccaagagggcctgcagcgcctgtgccggcaccttcggggaggacaccagcgccctgcctgcccctgggggcggcggcagcggcggggaccccacctag

SEQ ID NO: 163904 - DNA, 972 bp, Artificial Sequence
  Description of Artificial Sequence: Synthetic coding sequence
atggtgctgcccagcgaccagggcttcaagctgctgggcaatgtgctgcagggccctgagccctaccgcctgctgaccagcggcctgcggctgcaccaggagctggagaacctgaacaagtggggcctgaacatcttctgtgtgtctgactatgctgggggccgcagcctgacctgcatcatgtacatgatcttccaggagcgggacctgctgaagaagttccgcatccctgtggacaccatggtgacctacatgctgaccctggaggaccactaccacgcagatgtggcctaccacaacagcctgcacgccgcagatgtgctgcagagcacccacgtgctgctggccaccccagccctggatgctgtgttcacagacctggagatcctggccgccctgtttgctgctgccatccatgatgtggaccaccctggggtgagcaaccagttcctgatcaacaccaacagcgagctggccctgatgtacaatgatgagagcgtgctggagaaccaccacctggccgtgggcttcaagctgctgcaggaggacaactgtgacatcttccagaacctgagcaagaggcagaggcagagcctgaggaagatggtgattgacatggtgctggccacagacatgagcaagcacatgaccctgctggccgacctgaagaccatggtggagaccaagaaggtgaccagcagcggcgtgctgctgctggacaactacagcgaccgcatccaggtgctgaggaacatggtgcactgtgccgacctgagcaaccccaccaagcccctggagctgtaccggcagtggacagaccgcatcatggccgagttcttccagcagggcgaccgggagcgggagcggggcatggagatcagccccatgtgtgacaagcacacagcctctgtggagaagagccaggtgcaggcccggggcattgatggccgggcccagggcgagttctactag

SEQ ID NO: 163905 - DNA, 2595 bp, Artificial Sequence
  Description of Artificial Sequence: Synthetic coding sequence
atgaagaggagccgcagcgccctgtctgtggccggcactggagatgagaggagccgggagaccccagagagtgaccgggccaacatgctgggcgctgacctgcggcggccccggcggcggctgagcagcggccctggcctgggctgggcccagcctgagcccagcgaccccggggtgcccctgcccccccggcccaccaccctgcccctgctgatccccccacgcatcagcatcaccagggcagaaaatgacagctttgaagcagaaaatggccccacccccagccctggccgcagccccctggacagccaggccagccctggcctggtgctgcatgctggagctgccaccagccagaggcgggagagcttcctgtacagaagtgacagcgactatgacatgagccccaagaccatgagcaggaacagctctgtgaccagcgaggcccatgctgaggacctgattgtgaccccatttgcccaggtgctggccagcctgcggtctgtgcgcagcaacttcagcctgctgaccaacgtgcctgtgcccagcaacaagaggagccccctgggcggccccacccctgtgtgcaaggccaccctgtctgaggagacctgccagcagctggcccgggagaccctggaggagctggactggtgcctggagcagctggagaccatgcagacctacagatctgtgtctgagatggccagccacaagttcaagaggatgctgaaccgggagctgacccacctgtctgagatgagccgcagcggcaaccaggtgtctgagtacatcagcaccaccttcctggacaagcagaatgaggtggagatccccagccccaccatgaaggagcgggagaagcagcaggccccccggccccggcccagccagcccccacctcctcctgtgccccacctgcagcccatgagccagatcaccggcctgaagaagctgatgcacagcaacagcctgaacaacagcaacatccccaggtttggagtgaagacagaccaggaggagctgctggcccaggagctggagaacctgaacaagtggggcctgaacatcttctgtgtgtctgactatgctgggggccgcagcctgacctgcatcatgtacatgatcttccaggagcgggacctgctgaagaagttccgcatccctgtggacaccatggtgacctacatgctgaccctggaggaccactaccacgcagatgtggcctaccacaacagcctgcacgccgcagatgtgctgcagagcacccacgtgctgctggccaccccagccctggatgctgtgttcacagacctggagatcctggccgccctgtttgctgctgccatccatgatgtggaccaccctggggtgagcaaccagttcctgatcaacaccaacagcgagctggccctgatgtacaatgatgagagcgtgctggagaaccaccacctggccgtgggcttcaagctgctgcaggaggacaactgtgacatcttccagaacctgagcaagaggcagaggcagagcctgaggaagatggtgattgacatggtgctggccacagacatgagcaagcacatgaccctgctggccgacctgaagaccatggtggagaccaagaaggtgaccagcagcggcgtgctgctgctggacaactacagcgaccgcatccaggtgctgaggaacatggtgcactgtgccgacctgagcaaccccaccaagcccctggagctgtaccggcagtggacagaccgcatcatggccgagttcttccagcagggcgaccgggagcgggagcggggcatggagatcagccccatgtgtgacaagcacacagcctctgtggagaagagccaggtgggcttcatcgactacatcgtgcaccccctgtgggagacctgggccgacctggtgcacccagatgcccaggagatcctggacaccctggaggacaacagagactggtactacagcgccatccggcagagccccagccccccacctgaggaggagagccggggccctggccacccccccctgcctgacaagttccagtttgagctgaccctggaggaggaggaggaggaggagatctccatggcccagatcccctgcacagcccaggaggccctgacagcccagggcctgagcggcgtggaggaggccctggatgccaccatcgcctgggaggccagccctgcccaggagagcctggaggtgatggcccaggaggccagcctggaggccgagctggaggccgtgtacctgacccagcaggcccagagcacaggcagcgcccctgtggccccagatgagttcagcagccgggaggagtttgtggtggccgtgagccacagcagccccagcgccctggccctgcagagccccctgctgcctgcctggaggaccctgtctgtgtctgagcacgcccctggcctgcccggcctgcccagcacagctgctgaggtggaggcccagcgggagcaccaggccgccaagagggcctgcagcgcctgtgccggcaccttcggggaggacaccagcgccctgcctgcccctgggggcggcggcagcggcggggaccccacctag

SEQ ID NO: 163906 - DNA, 309 bp, Artificial Sequence
  Description of Artificial Sequence: Synthetic coding sequence
atggtggagaccaagaaggtgaccagcagcggcgtgctgctgctggacaactacagcgaccgcatccaggtgctgaggaacatggtgcactgtgccgacctgagcaaccccaccaagcccctggagctgtaccggcagtggacagaccgcatcatggccgagttcttccagcagggcgaccgggagcgggagcggggcatggagatcagccccatgtgtgacaagcacacagcctctgtggagaagagccaggtgggcttcatcgactacatcgtgcaccccctgtgggagacctgggccgacctgtag

SEQ ID NO: 163907 - DNA, 2478 bp, Artificial Sequence
  Description of Artificial Sequence: Synthetic coding sequence
atgaggtctggagctgccccccgggcccggccccggcccccagccctggccctgcccccaactggacctgagagcctgacccacttccccttcagtgatgaggacaccaggaggcaccccccaggccgctctgtgtcctttgaagcagaaaatggccccacccccagccctggccgcagccccctggacagccaggccagccctggcctggtgctgcacgccggggccgccaccagccagaggcgggagagcttcctgtacagaagtgacagcgactatgacatgagccccaagaccatgagcaggaacagctctgtgaccagcgaggcccacgcagaagatctcatcgtgaccccatttgcccaggtgctggccagcctgcggtctgtgcgcagcaacttcagcctgctgaccaacgtgcctgtgcccagcaacaagaggagccccctgggcggccccacccctgtgtgcaaggccaccctgtctgaggagacctgccagcagctggcccgggagaccctggaggagctggactggtgcctggagcagctggagaccatgcagacctacagatctgtgtctgagatggccagccacaagttcaagaggatgctgaaccgggagctgacccacctgtctgagatgagccgcagcggcaaccaggtgtctgagtacatcagcaccaccttcctggacaagcagaatgaggtggagatccccagccccaccatgaaggagcgggagaagcagcaggccccccggccccggcccagccagcccccacctcctcctgtgccccacctgcagcccatgagccagatcaccggcctgaagaagctgatgcacagcaacagcctgaacaacagcaacatcccccgcttcggcgtgaagacagaccaggaggagctgctggcccaggagctggagaacctgaacaagtggggcctgaacatcttctgtgtgtctgactatgccggcggccgcagcctgacctgcatcatgtacatgatcttccaggagcgggacctgctgaagaagttccgcatccctgtggacaccatggtgacctacatgctgaccctggaggaccactaccacgcagatgtggcctaccacaacagcctgcatgctgctgatgtgctgcagagcacccacgtgctgctggccaccccagccctggatgctgtgttcacagacctggagatcctggccgccctgtttgctgctgccatccatgatgtggaccaccctggggtgagcaaccagttcctgatcaacaccaacagcgagctggccctgatgtacaatgatgaatctgtgctggagaaccaccacctggccgtgggcttcaagctgctgcaggaggacaactgtgacatcttccagaacctgagcaagaggcagaggcagagcctgaggaagatggtgattgacatggtgctggccacagacatgagcaagcacatgaccctgctggccgacctgaagaccatggtggagaccaagaaggtgaccagcagtggagtgctgctgctggacaactacagcgaccgcatccaggtgctgaggaacatggtgcactgtgccgacctgagcaaccccaccaagcccctggagctgtaccggcagtggacagaccgcatcatggccgagttcttccagcagggcgaccgggagcgggagcggggcatggagatcagccccatgtgtgacaagcacacagcctctgtggagaagagccaggtgggcttcatcgactacatcgtgcaccccctgtgggagacctgggccgacctggtgcacccagatgcccaggagatcctggacaccctggaggacaacagagactggtactacagcgccatccggcagagccccagccccccacctgaggaggagagccggggccctggccacccccccctgcctgacaagttccagtttgagctgaccctggaggaggaggaggaggaggagatctccatggcccagatcccctgcacagcccaggaggccctgacagcccagggcctgtctggagtggaggaggccctggatgccaccatcgcctgggaggccagccctgcccaggagagcctggaggtgatggcccaggaggccagcctggaggccgagctggaggccgtgtacctgacccagcaggcccagagcactggaagtgcccctgtggccccagatgagttcagcagccgggaggagtttgtggtggccgtgagccacagcagccccagcgccctggccctgcagagccccctgctgcctgcctggaggaccctgtctgtgtctgaacatgcccctggcctgcccggcctgcccagcacagctgctgaggtggaggcccagcgggagcaccaggccgccaagagggcctgcagcgcctgtgccggcacctttggagaggacaccagcgccctgcctgcccctgggggcggcggcagcggcggggaccccacctag

SEQ ID NO: 163908 - DNA, 2211 bp, Artificial Sequence
  Description of Artificial Sequence: Synthetic coding sequence
atgaagaagagccgctctgtgatgacagtgatggctgatgacaacgtgaaggactactttgaatgttccctgagcaagagctacagcagcagcagcaacaccctgggcatcgacctgtggagaggaagacgctgctgcagcggcaacctgcagctgccccccctgagccagaggcagagcgagcgggcccggaccccagaaggagatggcatcagccggcccaccaccctgcccctgaccaccctgcccagcatcgccatcaccaccgtgtcccaggagtgctttgatgtggagaatggccccagccctggccgcagccccctggacccccaggccagcagcagcgctggcctggtgctgcacgccaccttccctggccacagccagaggcgggagagcttcctgtacagaagtgacagcgactatgacctgagccccaaggccatgagcaggaacagcagcctgcccagcgagcagcacggagatgacctgattgtgaccccatttgcccaggtgctggccagcctgcggtctgtgaggaacaacttcaccatcctgaccaacctgcacggcaccagcaacaagaggagccctgctgccagccagccccctgtgtcccgggtgaacccccaggaggagagctaccagaagctggccatggagaccctggaggagctggactggtgcctggaccagctggagaccatccagacctacagatctgtgtctgagatggccagcaacaagttcaagaggatgctgaaccgggagctgacccacctgtctgagatgagccgcagcggcaaccaggtgtctgagtacatcagcaacaccttcctggacaagcagaatgatgtggagatccccagccccacccagaaggaccgggagaagaagaagaagcagcagctgatgacccagatctctggagtgaagaagctgatgcacagcagcagcctgaacaacaccagcatcagccgcttcggcgtgaacacagaaaatgaagaccacctggccaaggagctggaggacctgaacaagtggggcctgaacatcttcaacgtggccggctacagccacaaccggcccctgacctgcatcatgtatgccatcttccaggagcgggacctgctgaagaccttccgcatcagcagtgacaccttcatcacctacatgatgaccctggaggaccactaccacagtgatgtggcctaccacaacagcctgcatgctgctgatgtggcccagagcacccacgtgctgctgagcaccccagccctggatgctgtgttcacagacctggagatcctggccgccatctttgctgctgccatccatgatgtggaccaccctggggtgagcaaccagttcctgatcaacaccaacagcgagctggccctgatgtacaatgatgaatctgtgctggagaaccaccacctggccgtgggcttcaagctgctgcaggaggagcactgtgacatcttcatgaacctgaccaagaagcagaggcagaccctgaggaagatggtgattgacatggtgctggccacagacatgagcaagcacatgagcctgctggccgacctgaagaccatggtggagaccaagaaggtgaccagcagtggagtgctgctgctggacaactacacagaccgcatccaggtgctgaggaacatggtgcactgtgccgacctgagcaaccccaccaagagcctggagctgtaccggcagtggacagaccgcatcatggaggagttcttccagcagggcgacaaggagcgggagcggggcatggagatcagccccatgtgtgacaagcacacagcctctgtggagaagagccaggtgggcttcatcgactacatcgtgcaccccctgtgggagacctgggccgacctggtgcagccagatgcccaggacatcctggacaccctggaggacaacagaaactggtaccagagcatgatcccccagagccccagcccccccctggatgagcagaacagagactgccagggcctgatggagaagttccagtttgagctgaccctggatgaagaagattctgagggccctgagaaggagggggagggccacagctacttcagcagcaccaagaccctgtgtgtgattgatcctgagaacagagacagcctgggggagacagacatcgacatcgccacagaggacaagagccctgtggacacctag

SEQ ID NO: 163909 - DNA, 2211 bp, Artificial Sequence; identical to SEQ ID NO: 163908
  Description of Artificial Sequence: Synthetic coding sequence

SEQ ID NO: 163910 - DNA, 1695 bp, Artificial Sequence
  Description of Artificial Sequence: Synthetic coding sequence
atgaaggagcacggcggcaccttcagcagcacaggcatcagcggcggcagcggggacagcgccatggacagcctgcagcccctgcagcccaactacatgcctgtgtgcctgtttgctgaggagagctaccagaagctggccatggagaccctggaggagctggactggtgcctggaccagctggagaccatccagacctacagatctgtgtctgagatggccagcaacaagttcaagaggatgctgaaccgggagctgacccacctgtctgagatgagccgcagcggcaaccaggtgtctgagtacatcagcaacaccttcctggacaagcagaatgatgtggagatccccagccccacccagaaggaccgggagaagaagaagaagcagcagctgatgacccagatctctggagtgaagaagctgatgcacagcagcagcctgaacaacaccagcatcagccgcttcggcgtgaacacagaaaatgaagaccacctggccaaggagctggaggacctgaacaagtggggcctgaacatcttcaacgtggccggctacagccacaaccggcccctgacctgcatcatgtatgccatcttccaggagcgggacctgctgaagaccttccgcatcagcagtgacaccttcatcacctacatgatgaccctggaggaccactaccacagtgatgtggcctaccacaacagcctgcatgctgctgatgtggcccagagcacccacgtgctgctgagcaccccagccctggatgctgtgttcacagacctggagatcctggccgccatctttgctgctgccatccatgatgtggaccaccctggggtgagcaaccagttcctgatcaacaccaacagcgagctggccctgatgtacaatgatgaatctgtgctggagaaccaccacctggccgtgggcttcaagctgctgcaggaggagcactgtgacatcttcatgaacctgaccaagaagcagaggcagaccctgaggaagatggtgattgacatggtgctggccacagacatgagcaagcacatgagcctgctggccgacctgaagaccatggtggagaccaagaaggtgaccagcagtggagtgctgctgctggacaactacacagaccgcatccaggtgctgaggaacatggtgcactgtgccgacctgagcaaccccaccaagagcctggagctgtaccggcagtggacagaccgcatcatggaggagttcttccagcagggcgacaaggagcgggagcggggcatggagatcagccccatgtgtgacaagcacacagcctctgtggagaagagccaggtgggcttcatcgactacatcgtgcaccccctgtgggagacctgggccgacctggtgcagccagatgcccaggacatcctggacaccctggaggacaacagaaactggtaccagagcatgatcccccagagccccagcccccccctggatgagcagaacagagactgccagggcctgatggagaagttccagtttgagctgaccctggatgaagaagattctgagggccctgagaaggagggggagggccacagctacttcagcagcaccaagaccctgtgtgtgattgatcctgagaacagagacagcctgggggagacagacatcgacatcgccacagaggacaagagccctgtggacacctag

SEQ ID NO: 163911 - DNA, 2211 bp, Artificial Sequence; identical to SEQ ID NO: 163908
  Description of Artificial Sequence: Synthetic coding sequence

SEQ ID NO: 163912 - DNA, 2166 bp, Artificial Sequence
  Description of Artificial Sequence: Synthetic coding sequence
atgacagccaaggacagcagcaaggagctgacagccagcgagcctgaggtgtgcatcaagaccttcaaggagcagatgcacctggagctggagctgccccggctgcccggcaaccggcccaccagccccaagatcagccccaggagcagccccaggaacagcccctgcttcttcaggaagctgctggtgaacaagagcatccggcagaggcggcgcttcaccgtggcccacacctgctttgatgtggagaatggccccagccctggccgcagccccctggacccccaggccagcagcagcgctggcctggtgctgcacgccaccttccctggccacagccagaggcgggagagcttcctgtacagaagtgacagcgactatgacctgagccccaaggccatgagcaggaacagcagcctgcccagcgagcagcacggagatgacctgattgtgaccccatttgcccaggtgctggccagcctgcggtctgtgaggaacaacttcaccatcctgaccaacctgcacggcaccagcaacaagaggagccctgctgccagccagccccctgtgtcccgggtgaacccccaggaggagagctaccagaagctggccatggagaccctggaggagctggactggtgcctggaccagctggagaccatccagacctacagatctgtgtctgagatggccagcaacaagttcaagaggatgctgaaccgggagctgacccacctgtctgagatgagccgcagcggcaaccaggtgtctgagtacatcagcaacaccttcctggacaagcagaatgatgtggagatccccagccccacccagaaggaccgggagaagaagaagaagcagcagctgatgacccagatcagcggcgtgaagaagctgatgcacagcagcagcctgaacaacaccagcatcagcagatttggagtgaacacagaaaatgaagaccacctggccaaggagctggaggacctgaacaagtggggcctgaacatcttcaacgtggccggctacagccacaaccggcccctgacctgcatcatgtatgccatcttccaggagcgggacctgctgaagaccttccgcatcagcagtgacaccttcatcacctacatgatgaccctggaggaccactaccacagtgatgtggcctaccacaacagcctgcacgccgcagatgtggcccagagcacccacgtgctgctgagcaccccagccctggatgctgtgttcacagacctggagatcctggccgccatctttgctgctgccatccatgatgtggaccaccctggggtgagcaaccagttcctgatcaacaccaacagcgagctggccctgatgtacaatgatgagagcgtgctggagaaccaccacctggccgtgggcttcaagctgctgcaggaggagcactgtgacatcttcatgaacctgaccaagaagcagaggcagaccctgaggaagatggtgattgacatggtgctggccacagacatgagcaagcacatgagcctgctggccgacctgaagaccatggtggagaccaagaaggtgaccagcagcggcgtgctgctgctggacaactacacagaccgcatccaggtgctgaggaacatggtgcactgtgccgacctgagcaaccccaccaagagcctggagctgtaccggcagtggacagaccgcatcatggaggagttcttccagcagggcgacaaggagcgggagcggggcatggagatcagccccatgtgtgacaagcacacagcctctgtggagaagagccaggtgggcttcatcgactacatcgtgcaccccctgtgggagacctgggccgacctggtgcagccagatgcccaggacatcctggacaccctggaggacaacagaaactggtaccagagcatgatcccccagagccccagcccccccctggatgagcagaacagagactgccagggcctgatggagaagttccagtttgagctgaccctggatgaggaggacagcgagggccctgagaaggagggggagggccacagctacttcagcagcaccaagaccctgtgtgtgattgatcctgaaaatagagacagcctgggggagacagacattgatattgccacagaggacaagagccctgtggacacctag

SEQ ID NO: 163913 - DNA, 2043 bp, Artificial Sequence
  Description of Artificial Sequence: Synthetic coding sequence
atgcagggccccccagccccagcccctgtgcccggccctggcagcccccggggcagcccccggggcagccctggcctcttcaggaagctgctggtgaaccagagcatccggctgcagaggcgcttcaccgtggcccaccccctgtgctttgacctggagaatggcctgagctgtggccggcgggccctggacccccagagcagccctggcctgggccgcatcatgcaggcccctgtgccccacagccagaggcgggagagcttcctgtacagaagtgacagcgactatgagctgagccccaaggccatgagcaggaacagctctgtggccagtgacctgcacggggaggacatgattgtgaccccatttgcccaggtgctggccagcctgaggacagtgcgcagcaatgtggccgccctggcccggcagcagtgcctgggcgccgccaagcagggccctgtgggcaaccccagcagcagcaaccagctgcccccagctgaggacaccggccagaagctggccctggagaccctggatgagctggactggtgcctggaccagctggagaccctgcagaccaggcacagcgtgggggagatggccagcaacaagttcaagaggatcctgaaccgggagctgacccacctgtctgagaccagccgcagcggcaaccaggtgtctgagtacatcagcaggaccttcctggaccagcagacagaggtggagctgcccaaggtgacagctgaggaggccccccagcccatgagccgcatcagcggcctgcacggcctgtgccacagcgccagcctgagcagcgccaccgtgccccgcttcggcgtgcagacagaccaggaggagcagctggccaaggagctggaggacaccaacaagtggggcctggatgtgttcaaggtggccgagctgagcggcaaccggcccctgacagccatcatcttcagcatcttccaggagcgggacctgctgaagaccttccagatcccagctgacaccctggccacctacctgctgatgctggagggccactaccacgccaacgtggcctaccacaacagcctgcatgctgctgatgtggcccagagcacccacgtgctgctggccaccccagccctggaggccgtgttcacagacctggagatcctggccgccctgtttgccagcgccatccatgatgtggaccaccctggggtgagcaaccagttcctgatcaacaccaacagcgagctggccctgatgtacaatgatgcctctgtgctggagaaccaccacctggccgtgggcttcaagctgctgcaggccgagaactgtgacatcttccagaacctgagcgccaagcagaggctgagcctgcggaggatggtgattgacatggtgctggccacagacatgagcaagcacatgaacctgctggccgacctgaagaccatggtggagaccaagaaggtgaccagcctgggcgtgctgctgctggacaactacagcgaccgcatccaggtgctgcagaacctggtgcactgtgccgacctgagcaaccccaccaagcccctgcccctgtaccggcagtggacagaccgcatcatggccgagttcttccagcagggcgaccgggagcgggagagcggcctggacatcagccccatgtgtgacaagcacacagcctctgtggagaagagccaggtgggcttcatcgactacatcgcccaccccctgtgggagacctgggccgacctggtgcacccagatgcccaggacctgctggacaccctggaggacaaccgggagtggtaccagagcaagatccccaggagccccagcgacctgaccaaccctgagagagatggccctgaccgcttccagtttgagctgaccctggaggaggccgaggaggaggatgaggaggaggaggaggagggggaggagacagccctggccaaggaggccctggagctgcctgacacagagctgctgagccctgaggccggccctgaccccggggacctgcccctggacaaccagaggacatag

SEQ ID NO: 163914 - DNA, 1281 bp, Artificial Sequence
  Description of Artificial Sequence: Synthetic coding sequence
atggccagcaacaagttcaagaggatcctgaaccgggagctgacccacctgtctgagaccagccgcagcggcaaccaggtgtctgagtacatcagcaggaccttcctggaccagcagacagaggtggagctgcccaaggtgacagctgaggaggccccccagcccatgagccgcatcagcggcctgcacggcctgtgccacagcgccagcctgagcagcgccaccgtgcccaggtttggagtgcagacagaccaggaggagcagctggccaaggagctggaggacaccaacaagtggggcctggatgtgttcaaggtggccgagctgagcggcaaccggcccctgacagccatcatcttcagcatcttccaggccgtgttcacagacctggagatcctggccgccctgtttgccagcgccatccatgatgtggaccaccctggggtgagcaaccagttcctgatcaacaccaacagcgagctggccctgatgtacaatgatgcctctgtgctggagaaccaccacctggccgtgggcttcaagctgctgcaggccgagaactgtgacatcttccagaacctgagcgccaagcagaggctgagcctgcggaggatggtgattgacatggtgctggccacagacatgagcaagcacatgaacctgctggccgacctgaagaccatggtggagaccaagaaggtgaccagcctgggcgtgctgctgctggacaactacagcgaccgcatccaggtgctgcagaacctggtgcactgtgccgacctgagcaaccccaccaagcccctgcccctgtaccggcagtggacagaccgcatcatggccgagttcttccagcagggcgaccgggagcgggagagcggcctggacatcagccccatgtgtgacaagcacacagcctctgtggagaagagccaggtgggcttcatcgactacatcgcccaccccctgtgggagacctgggccgacctggtgcacccagatgcccaggacctgctggacaccctggaggacaaccgggagtggtaccagagcaagatccccaggagccccagcgacctgaccaaccctgagagagatggccctgaccgcttccagtttgagctgaccctggaggaggccgaggaggaggatgaggaggaggaggaggagggggaggagacagccctggccaaggaggccctggagctgcctgacacagagctgctgagccctgaggccggccctgaccccggggacctgcccctggacaaccagaggacatag

SEQ ID NO: 163915 - DNA, 2139 bp, Artificial Sequence
  Description of Artificial Sequence: Synthetic coding sequence
atggagaacctgggcgtgggggagggcgctgaggcctgcagccggctgagccgcagccggggccgccacagcatgacccgggcccccaagcacctgtggaggcagccccggcggcccatccgcatccagcagcgcttctacagcgaccctgacaagtctgctggctgccgggagcgggacctgagccccaggcctgagctgaggaagagccggctgtcctggcctgtgagcagctgccgccgctttgacctggagaatggcctgagctgtggccggcgggccctggacccccagagcagccctggcctgggccgcatcatgcaggcccctgtgccccacagccagaggcgggagagcttcctgtacagaagtgacagcgactatgagctgagccccaaggccatgagcaggaacagctctgtggccagtgacctgcacggggaggacatgattgtgaccccatttgcccaggtgctggccagcctgaggacagtgcgcagcaatgtggccgccctggcccggcagcagtgcctgggcgccgccaagcagggccctgtgggcaaccccagcagcagcaaccagctgcccccagctgaggacaccggccagaagctggccctggagaccctggatgagctggactggtgcctggaccagctggagaccctgcagaccaggcacagcgtgggggagatggccagcaacaagttcaagaggatcctgaaccgggagctgacccacctgtctgagaccagccgcagcggcaaccaggtgtctgagtacatcagcaggaccttcctggaccagcagacagaggtggagctgcccaaggtgacagctgaggaggccccccagcccatgagccgcatcagcggcctgcacggcctgtgccacagcgccagcctgagcagcgccaccgtgccccgcttcggcgtgcagacagaccaggaggagcagctggccaaggagctggaggacaccaacaagtggggcctggatgtgttcaaggtggccgagctgagcggcaaccggcccctgacagccatcatcttcagcatcttccaggagcgggacctgctgaagaccttccagatcccagctgacaccctggccacctacctgctgatgctggagggccactaccacgccaacgtggcctaccacaacagcctgcatgctgctgatgtggcccagagcacccacgtgctgctggccaccccagccctggaggccgtgttcacagacctggagatcctggccgccctgtttgccagcgccatccatgatgtggaccaccctggggtgagcaaccagttcctgatcaacaccaacagcgagctggccctgatgtacaatgatgcctctgtgctggagaaccaccacctggccgtgggcttcaagctgctgcaggccgagaactgtgacatcttccagaacctgagcgccaagcagaggctgagcctgcggaggatggtgattgacatggtgctggccacagacatgagcaagcacatgaacctgctggccgacctgaagaccatggtggagaccaagaaggtgaccagcctgggcgtgctgctgctggacaactacagcgaccgcatccaggtgctgcagaacctggtgcactgtgccgacctgagcaaccccaccaagcccctgcccctgtaccggcagtggacagaccgcatcatggccgagttcttccagcagggcgaccgggagcgggagagcggcctggacatcagccccatgtgtgacaagcacacagcctctgtggagaagagccaggtgggcttcatcgactacatcgcccaccccctgtgggagacctgggccgacctggtgcacccagatgcccaggacctgctggacaccctggaggacaaccgggagtggtaccagagcaagatccccaggagccccagcgacctgaccaaccctgagagagatggccctgaccgcttccagtttgagctgaccctggaggaggccgaggaggaggatgaggaggaggaggaggagggggaggagacagccctggccaaggaggccctggagctgcctgacacagagctgctgagccctgaggccggccctgaccccggggacctgcccctggacaaccagaggacatag

SEQ ID NO: 163916 - DNA, 1821 bp, Artificial Sequence
  Description of Artificial Sequence: Synthetic coding sequence
atgcaggcccctgtgccccacagccagaggcgggagagcttcctgtacagaagtgacagcgactatgagctgagccccaaggccatgagcaggaacagctctgtggccagtgacctgcacggggaggacatgattgtgaccccatttgcccaggtgctggccagcctgaggacagtgcgcagcaatgtggccgccctggcccggcagcagtgcctgggcgccgccaagcagggccctgtgggcaaccccagcagcagcaaccagctgcccccagctgaggacaccggccagaagctggccctggagaccctggatgagctggactggtgcctggaccagctggagaccctgcagaccaggcacagcgtgggggagatggccagcaacaagttcaagaggatcctgaaccgggagctgacccacctgtctgagaccagccgcagcggcaaccaggtgtctgagtacatcagcaggaccttcctggaccagcagacagaggtggagctgcccaaggtgacagctgaggaggccccccagcccatgagccgcatcagcggcctgcacggcctgtgccacagcgccagcctgagcagcgccaccgtgccccgcttcggcgtgcagacagaccaggaggagcagctggccaaggagctggaggacaccaacaagtggggcctggatgtgttcaaggtggccgagctgagcggcaaccggcccctgacagccatcatcttcagcatcttccaggagcgggacctgctgaagaccttccagatcccagctgacaccctggccacctacctgctgatgctggagggccactaccacgccaacgtggcctaccacaacagcctgcatgctgctgatgtggcccagagcacccacgtgctgctggccaccccagccctggaggccgtgttcacagacctggagatcctggccgccctgtttgccagcgccatccatgatgtggaccaccctggggtgagcaaccagttcctgatcaacaccaacagcgagctggccctgatgtacaatgatgcctctgtgctggagaaccaccacctggccgtgggcttcaagctgctgcaggccgagaactgtgacatcttccagaacctgagcgccaagcagaggctgagcctgcggaggatggtgattgacatggtgctggccacagacatgagcaagcacatgaacctgctggccgacctgaagaccatggtggagaccaagaaggtgaccagcctgggcgtgctgctgctggacaactacagcgaccgcatccaggtgctgcagaacctggtgcactgtgccgacctgagcaaccccaccaagcccctgcccctgtaccggcagtggacagaccgcatcatggccgagttcttccagcagggcgaccgggagcgggagagcggcctggacatcagccccatgtgtgacaagcacacagcctctgtggagaagagccaggtgggcttcatcgactacatcgcccaccccctgtgggagacctgggccgacctggtgcacccagatgcccaggacctgctggacaccctggaggacaaccgggagtggtaccagagcaagatccccaggagccccagcgacctgaccaaccctgagagagatggccctgaccgcttccagtttgagctgaccctggaggaggccgaggaggaggatgaggaggaggaggaggagggggaggagacagccctggccaaggaggccctggagctgcctgacacagagctgctgagccctgaggccggccctgaccccggggacctgcccctggacaaccagaggacatag

SEQ ID NO: 163917 - DNA, 2376 bp, Artificial Sequence
  Description of Artificial Sequence: Synthetic coding sequence
ggcacccaggccggcctgcggagcggggcccccagcggccaccggcagctgctgggcgtgggccccaccctgagccccagcagcaccttctaccgcttcagcaccagcggggctgacagcagcagcctgagcccccccctgcctgccctgggccgcacccgggagcagaccctgctgggcgcccggagccggggccgggtgctgctgcctgccatcccagaccccttcctgtggaggatggagaacctgggcgtgggggagggcgctgaggcctgcagccggctgagccgcagccggggccgccacagcatgacccgggcccccaagcacctgtggaggcagccccggcggcccatccgcatccagcagcgcttctacagcgaccctgacaagtctgctggctgccgggagcgggacctgagccccaggcctgagctgaggaagagccggctgtcctggcctgtgagcagctgcagaagatttgacctggagaatggcctgagctgtggcagaagagccctggacccccagagcagccctggcctgggccgcatcatgcaggcccctgtgccccacagccagaggcgggagagcttcctgtacagaagtgacagcgactatgagctgagccccaaggccatgagcaggaacagctctgtggccagtgacctgcatggagaggacatgattgtgaccccatttgcccaggtgctggccagcctgaggacagtgcgcagcaatgtggccgccctggcccggcagcagtgcctgggcgccgccaagcagggccctgtgggcaaccccagcagcagcaaccagctgcccccagctgaggacaccggccagaagctggccctggagaccctggatgagctggactggtgcctggaccagctggagaccctgcagaccaggcacagcgtgggggagatggccagcaacaagttcaagaggatcctgaaccgggagctgacccacctgtctgagaccagccgcagcggcaaccaggtgtctgagtacatcagcaggaccttcctggaccagcagacagaggtggagctgcccaaggtgacagctgaggaggccccccagcccatgagccgcatcagcggcctgcacggcctgtgccacagcgccagcctgagcagcgccaccgtgcccaggtttggagtgcagacagaccaggaggagcagctggccaaggagctggaggacaccaacaagtggggcctggatgtgttcaaggtggccgagctgagcggcaaccggcccctgacagccatcatcttcagcatcttccaggagcgggacctgctgaagaccttccagatcccagctgacaccctggccacctacctgctgatgctggagggccactaccacgccaacgtggcctaccacaacagcctgcacgccgcagatgtggcccagagcacccacgtgctgctggccaccccagccctggaggccgtgttcacagacctggagatcctggccgccctgtttgccagcgccatccatgatgtggaccaccctggggtgagcaaccagttcctgatcaacaccaacagcgagctggccctgatgtacaatgatgcctctgtgctggagaaccaccacctggccgtgggcttcaagctgctgcaggccgagaactgtgacatcttccagaacctgagcgccaagcagaggctgagcctgcggaggatggtgattgacatggtgctggccacagacatgagcaagcacatgaacctgctggccgacctgaagaccatggtggagaccaagaaggtgaccagcctgggcgtgctgctgctggacaactacagcgaccgcatccaggtgctgcagaacctggtgcactgtgccgacctgagcaaccccaccaagcccctgcccctgtaccggcagtggacagaccgcatcatggccgagttcttccagcagggcgaccgggagcgggagagcggcctggacatcagccccatgtgtgacaagcacacagcctctgtggagaagagccaggtgggcttcatcgactacatcgcccaccccctgtgggagacctgggccgacctggtgcacccagatgcccaggacctgctggacaccctggaggacaaccgggagtggtaccagagcaagatccccaggagccccagcgacctgaccaaccctgagagagatggccctgaccgcttccagtttgagctgaccctggaggaggccgaggaggaggatgaggaggaggaggaggagggggaggagacagccctggccaaggaggccctggagctgcctgacacagagctgctgagccctgaggccggccctgaccccggggacctgcccctggacaaccagaggacatag

SEQ ID NO: 163918 - DNA, 2103 bp, Artificial Sequence
  Description of Artificial Sequence: Synthetic coding sequence
gctgtgcagaagaggagcagagctgctggggcccggagcagcctgcatgctgtgctggccatgcagggccccccagccccagcccctgtgcccggccctggcagcccccggggcagcccccggggcagccctggcctcttcaggaagctgctggtgaaccagagcatccggctgcagaggcgcttcaccgtggcccaccccctgtgctttgacctggagaatggcctgagctgtggccggcgggccctggacccccagagcagccctggcctgggccgcatcatgcaggcccctgtgccccacagccagaggcgggagagcttcctgtacagaagtgacagcgactatgagctgagccccaaggccatgagcaggaacagctctgtggccagtgacctgcacggggaggacatgattgtgaccccatttgcccaggtgctggccagcctgaggacagtgcgcagcaatgtggccgccctggcccggcagcagtgcctgggcgccgccaagcagggccctgtgggcaaccccagcagcagcaaccagctgcccccagctgaggacaccggccagaagctggccctggagaccctggatgagctggactggtgcctggaccagctggagaccctgcagaccaggcacagcgtgggggagatggccagcaacaagttcaagaggatcctgaaccgggagctgacccacctgtctgagaccagccgcagcggcaaccaggtgtctgagtacatcagcaggaccttcctggaccagcagacagaggtggagctgcccaaggtgacagctgaggaggccccccagcccatgagccgcatcagcggcctgcacggcctgtgccacagcgccagcctgagcagcgccaccgtgccccgcttcggcgtgcagacagaccaggaggagcagctggccaaggagctggaggacaccaacaagtggggcctggatgtgttcaaggtggccgagctgagcggcaaccggcccctgacagccatcatcttcagcatcttccaggagcgggacctgctgaagaccttccagatcccagctgacaccctggccacctacctgctgatgctggagggccactaccacgccaacgtggcctaccacaacagcctgcatgctgctgatgtggcccagagcacccacgtgctgctggccaccccagccctggaggccgtgttcacagacctggagatcctggccgccctgtttgccagcgccatccatgatgtggaccaccctggggtgagcaaccagttcctgatcaacaccaacagcgagctggccctgatgtacaatgatgcctctgtgctggagaaccaccacctggccgtgggcttcaagctgctgcaggccgagaactgtgacatcttccagaacctgagcgccaagcagaggctgagcctgcggaggatggtgattgacatggtgctggccacagacatgagcaagcacatgaacctgctggccgacctgaagaccatggtggagaccaagaaggtgaccagcctgggcgtgctgctgctggacaactacagcgaccgcatccaggtgctgcagaacctggtgcactgtgccgacctgagcaaccccaccaagcccctgcccctgtaccggcagtggacagaccgcatcatggccgagttcttccagcagggcgaccgggagcgggagagcggcctggacatcagccccatgtgtgacaagcacacagcctctgtggagaagagccaggtgggcttcatcgactacatcgcccaccccctgtgggagacctgggccgacctggtgcacccagatgcccaggacctgctggacaccctggaggacaaccgggagtggtaccagagcaagatccccaggagccccagcgacctgaccaaccctgagagagatggccctgaccgcttccagtttgagctgaccctggaggaggccgaggaggaggatgaggaggaggaggaggagggggaggagacagccctggccaaggaggccctggagctgcctgacacagagctgctgagccctgaggccggccctgaccccggggacctgcccctggacaaccagaggacatag

SEQ ID NO: 163919 - DNA, 1446 bp, Artificial Sequence
  Description of Artificial Sequence: Synthetic coding sequence
atggccagcaacaagttcaagaggatcctgaaccgggagctgacccacctgtctgagaccagccgcagcggcaaccaggtgtctgagtacatcagcaggaccttcctggaccagcagacagaggtggagctgcccaaggtgacagctgaggaggccccccagcccatgagccgcatcagcggcctgcacggcctgtgccacagcgccagcctgagcagcgccaccgtgcccaggtttggagtgcagacagaccaggaggagcagctggccaaggagctggaggacaccaacaagtggggcctggatgtgttcaaggtggccgagctgagcggcaaccggcccctgacagccatcatcttcagcatcttccaggagcgggacctgctgaagaccttccagatcccagctgacaccctggccacctacctgctgatgctggagggccactaccacgccaacgtggcctaccacaacagcctgcacgccgcagatgtggcccagagcacccacgtgctgctggccaccccagccctggaggccgtgttcacagacctggagatcctggccgccctgtttgccagcgccatccatgatgtggaccaccctggggtgagcaaccagttcctgatcaacaccaacagcgagctggccctgatgtacaatgatgcctctgtgctggagaaccaccacctggccgtgggcttcaagctgctgcaggccgagaactgtgacatcttccagaacctgagcgccaagcagaggctgagcctgcggaggatggtgattgacatggtgctggccacagacatgagcaagcacatgaacctgctggccgacctgaagaccatggtggagaccaagaaggtgaccagcctgggcgtgctgctgctggacaactacagcgaccgcatccaggtgctgcagaacctggtgcactgtgccgacctgagcaaccccaccaagcccctgcccctgtaccggcagtggacagaccgcatcatggccgagttcttccagcagggcgaccgggagcgggagagcggcctggacatcagccccatgtgtgacaagcacacagcctctgtggagaagagccaggtgggcttcatcgactacatcgcccaccccctgtgggagacctgggccgacctggtgcacccagatgcccaggacctgctggacaccctggaggacaaccgggagtggtaccagagcaagatccccaggagccccagcgacctgaccaaccctgagagagatggccctgaccgcttccagtttgagctgaccctggaggaggccgaggaggaggatgaggaggaggaggaggagggggaggagacagccctggccaaggaggccctggagctgcctgacacagagctgctgagccctgaggccggccctgaccccggggacctgcccctggacaaccagaggacatag

SEQ ID NO: 163920 - DNA, 2466 bp, Artificial Sequence
  Description of Artificial Sequence: Synthetic coding sequence
atgcagcgctaccggggccggcagacagtgtttggagctggggtgctgggcggcgtgtcctctgcccccagcttcaacacccccagccccaggagcagccccctcttctaccccagcgcccccagcggccaccggcagctgctgggcgtgggccccaccctgagccccagcagcaccttctaccgcttcagcaccagcggggctgacagcagcagcctgagcccccccctgcctgccctgggccgcacccgggagcagaccctgctgggcgcccggagccggggccgggtgctgctgcctgccatcccagaccccttcctgtggaggatggagaacctgggcgtgggggagggcgctgaggcctgcagccggctgagccgcagccggggccgccacagcatgacccgggcccccaagcacctgtggaggcagccccggcggcccatccgcatccagcagcgcttctacagcgaccctgacaagtctgctggctgccgggagcgggacctgagccccaggcctgagctgaggaagagccggctgtcctggcctgtgagcagctgcagaagatttgacctggagaatggcctgagctgtggcagaagagccctggacccccagagcagccctggcctgggccgcatcatgcaggcccctgtgccccacagccagaggcgggagagcttcctgtacagaagtgacagcgactatgagctgagccccaaggccatgagcaggaacagctctgtggccagtgacctgcatggagaggacatgattgtgaccccatttgcccaggtgctggccagcctgaggacagtgcgcagcaatgtggccgccctggcccggcagcagtgcctgggcgccgccaagcagggccctgtgggcaaccccagcagcagcaaccagctgcccccagctgaggacaccggccagaagctggccctggagaccctggatgagctggactggtgcctggaccagctggagaccctgcagaccaggcacagcgtgggggagatggccagcaacaagttcaagaggatcctgaaccgggagctgacccacctgtctgagaccagccgcagcggcaaccaggtgtctgagtacatcagcaggaccttcctggaccagcagacagaggtggagctgcccaaggtgacagctgaggaggccccccagcccatgagccgcatcagcggcctgcacggcctgtgccacagcgccagcctgagcagcgccaccgtgcccaggtttggagtgcagacagaccaggaggagcagctggccaaggagctggaggacaccaacaagtggggcctggatgtgttcaaggtggccgagctgagcggcaaccggcccctgacagccatcatcttcagcatcttccaggagcgggacctgctgaagaccttccagatcccagctgacaccctggccacctacctgctgatgctggagggccactaccacgccaacgtggcctaccacaacagcctgcacgccgcagatgtggcccagagcacccacgtgctgctggccaccccagccctggaggccgtgttcacagacctggagatcctggccgccctgtttgccagcgccatccatgatgtggaccaccctggggtgagcaaccagttcctgatcaacaccaacagcgagctggccctgatgtacaatgatgcctctgtgctggagaaccaccacctggccgtgggcttcaagctgctgcaggccgagaactgtgacatcttccagaacctgagcgccaagcagaggctgagcctgcggaggatggtgattgacatggtgctggccacagacatgagcaagcacatgaacctgctggccgacctgaagaccatggtggagaccaagaaggtgaccagcctgggcgtgctgctgctggacaactacagcgaccgcatccaggtgctgcagaacctggtgcactgtgccgacctgagcaaccccaccaagcccctgcccctgtaccggcagtggacagaccgcatcatggccgagttcttccagcagggcgaccgggagcgggagagcggcctggacatcagccccatgtgtgacaagcacacagcctctgtggagaagagccaggtgggcttcatcgactacatcgcccaccccctgtgggagacctgggccgacctggtgcacccagatgcccaggacctgctggacaccctggaggacaaccgggagtggtaccagagcaagatccccaggagccccagcgacctgaccaaccctgagagagatggccctgaccgcttccagtttgagctgaccctggaggaggccgaggaggaggatgaggaggaggaggaggagggggaggagacagccctggccaaggaggccctggagctgcctgacacagagctgctgagccctgaggccggccctgaccccggggacctgcccctggacaaccagaggacatag

SEQ ID NO: 163921 - DNA, 1557 bp, Artificial Sequence
  Description of Artificial Sequence: Synthetic coding sequence
cccctgcgcatccggcccctgctgcccacagcctaccacctgctgcccactggacctggccagagcgctgacagaagtgagcagaggggcggcccctgccccccagccatgcccaggagcagccagttcaagaggatcctgaaccgggagctgacccacctgtctgagaccagccgcagcggcaaccaggtgtctgagtacatcagcaggaccttcctggaccagcagacagaggtggagctgcccaaggtgacagctgaggaggccccccagcccatgagccgcatcagcggcctgcacggcctgtgccacagcgccagcctgagcagcgccaccgtgccccgcttcggcgtgcagacagaccaggaggagcagctggccaaggagctggaggacaccaacaagtggggcctggatgtgttcaaggtggccgagctgagcggcaaccggcccctgacagccatcatcttcagcatcttccaggagcgggacctgctgaagaccttccagatcccagctgacaccctggccacctacctgctgatgctggagggccactaccacgccaacgtggcctaccacaacagcctgcatgctgctgatgtggcccagagcacccacgtgctgctggccaccccagccctggaggccgtgttcacagacctggagatcctggccgccctgtttgccagcgccatccatgatgtggaccaccctggggtgagcaaccagttcctgatcaacaccaacagcgagctggccctgatgtacaatgatgcctctgtgctggagaaccaccacctggccgtgggcttcaagctgctgcaggccgagaactgtgacatcttccagaacctgagcgccaagcagaggctgagcctgcggaggatggtgattgacatggtgctggccacagacatgagcaagcacatgaacctgctggccgacctgaagaccatggtggagaccaagaaggtgaccagcctgggcgtgctgctgctggacaactacagcgaccgcatccaggtgctgcagaacctggtgcactgtgccgacctgagcaaccccaccaagcccctgcccctgtaccggcagtggacagaccgcatcatggccgagttcttccagcagggcgaccgggagcgggagagcggcctggacatcagccccatgtgtgacaagcacacagcctctgtggagaagagccaggtgggcttcatcgactacatcgcccaccccctgtgggagacctgggccgacctggtgcacccagatgcccaggacctgctggacaccctggaggacaaccgggagtggtaccagagcaagatccccaggagccccagcgacctgaccaaccctgagagagatggccctgaccgcttccagtttgagctgaccctggaggaggccgaggaggaggatgaggaggaggaggaggagggggaggagacagccctggccaaggaggccctggagctgcctgacacagagctgctgagccctgaggccggccctgaccccggggacctgcccctggacaaccagaggacatag

SEQ ID NO: 163922 - DNA, 6723 bp, Artificial Sequence
  Description of Artificial Sequence: Synthetic coding sequence
atggagcagacctggacccgggactactttgctgaagatgatggagagatggtgcccaggaccagccacacagctgccttcctgagtgacaccaaggaccggggcccccctgtgcagagccagatctggaggtctggagagaaggtgccctttgtgcagacctacagcctgcgggcctttgagaagccaccccaggtgcagacccaggccctgcgggactttgagaagcacctgaatgacctgaagaaggagaacttcagcctgaagctgcgcatctacttcctggaggagaggatgcagcagaagtatgaggccagccgggaggacatctacaagagaaatattgagctgaaggtggaggtggagagcctgaagcgggagctgcaggacaagaagcagcacctggacaagacctgggcagatgtggagaacctgaacagccagaatgaagctgagctgcggcggcagtttgaggagcggcagcaggagacagagcacgtgtatgagctgctggagaacaagatccagctgctgcaggaggagagccggctggccaagaatgaagctgccaggatggccgccctggtggaggccgagaaggagtgcaacctggagctgtctgagaagctgaagggcgtgaccaagaactgggaggatgtgcctggggaccaggtgaagccagaccagtacacagaggccctggcccagagggacaagagaattgaggagctgaaccagagcctggccgcccaggagcggctggtggagcagctgagccgggagaagcagcagctgctgcacctgctggaggagcccacctccatggaggtgcagcccatgacagaggagctgctgaagcagcagaagctgaacagccatgagaccaccatcacccagcagagcgtgtctgacagccacctggccgagctgcaggagaagatccagcagacagaggccaccaacaagatcctgcaggagaagctgaatgagatgtcctatgagctgaagtgtgcccaggagagcagccagaagcaggacggcaccatccagaacctgaaggagaccctgaagagccgggagcgggagacagaggagctgtaccaggtgattgagggccagaatgacaccatggccaagctgcgggagatgctgcaccagagccagctgggccagctgcacagcagcgagggcaccagccctgcccagcagcaggtggccctgctggacctgcagagcgccctcttctgcagccagctggagatccagaagctgcagagggtggtgcggcagaaggagcggcagctggctgatgccaagcagtgtgtgcagtttgtggaggccgccgcccacgagagcgagcagcagaaggaggcctcctggaagcacaaccaggagctgaggaaggccctgcagcagctgcaggaggagctgcagaacaagagccagcagctgcgggcctgggaggccgagaagtacaatgagatccgcacccaggagcagaacatccagcacctgaaccacagcctgagccacaaggagcagctgctgcaggagttccgggagctgctgcagtacagagacaacagcgacaagaccctggaggccaatgagatgctgctggagaagctgcggcagagaattcatgacaaggctgtggccctggagcgggccattgatgagaagttcagcgccctggaggagaaggagaaggagctgcggcagctgcggctggccgtgcgggagcgggaccatgacctggagcggctgagagatgtgctgagcagcaatgaggccaccatgcagagcatggagagcctgctgcgggccaagggcctggaggtggagcagctgagcaccacctgccagaacctgcagtggctgaaggaggagatggagaccaagttcagccgctggcagaaggagcaggagagcatcatccagcagctgcagaccagcctgcatgacaggaacaaggaggtggaggacctgagcgccaccctgctgtgcaagctgggccctggccagagcgagattgctgaggagctgtgccagaggctgcagaggaaggagaggatgctgcaggacctgctgagtgacaggaacaagcaggtgctggagcacgagatggagatccagggcctgctgcagagcgtgtccacccgggagcaggagagccaggccgctgctgagaagctggtgcaggccctgatggagagaaattctgagctgcaggccctgcggcagtacctgggcggccgggacagcctgatgagccaggcccccatcagcaaccagcaggccgaggtgacccccaccggctgcctgggcaagcagacagaccagggctccatgcagatccccagcagagatgacagcaccagcctgacagccaaggaggatgtgtccatccccaggagcaccctgggggacctggacacagtggccggcctggagaaggagctgagcaatgccaaggaggagctggagctgatggccaagaaggagcgggagagccagatggagctgagcgccctgcagagcatgatggctgtgcaggaggaggagctgcaggtgcaggccgctgacatggagagcctgaccaggaacatccagatcaaggaggacctgatcaaggacctgcagatgcagctggtggaccctgaggacatcccagccatggagcggctgacccaggaggtgctgctgctgcgggagaaggtggcctctgtggagagccagggccaggagatcagcggcaacagacggcagcagctgctgctgatgctggagggcctggtggatgagaggagccggctgaatgaggccctgcaggccgagcggcagctgtacagcagcctggtgaagttccacgcccaccctgagagcagcgagcgggacaggaccctgcaggtggagctggagggcgcccaggtgctgcggagccggctggaggaggtgctgggccgcagcctggagcggctgaaccggctggagaccctggccgccatcggcggcgctgctgctggagatgacacagaggacaccagcacagagttcacagacagcattgaggaggaggccgcccaccacagccaccagcagctggtgaaggtggccctggagaagagcctggccaccgtggagacccagaaccccagcttcagcccccccagccccatgggcggggacagcaaccgctgcctgcaggaggagatgctgcacctgcgggcagagttccaccagcacctggaggagaagaggaaggccgaggaggagctgaaggagctgaaggcccagatcgaggaggccggcttcagctctgtgagccacatccggaacaccatgctgagcctgtgcctggagaatgctgagctgaaggagcagatgggagaggccatgtctgatggctgggagattgaggaggacaaggagaagggggagctggacaaccagagccagccccgggaccccggcccccagagcgccttcagcctgcccggcagcacccagcacctgcggagccagctgagccagtgcaagcagcgctaccaggacctgcaggagaagctgctgctgtctgaggccaccgtgtttgcccaggccaatgagctggagaagtacagagtgatgctgaccggggagagcctggtgaagcaggacagcaagcagatccaggtggacctgcaggacctgggctatgagacctgtggccgctcagaaaatgaagctgagcgggaggagaccaccagcccagaatgtgaggagcacaacagcctgaaggagatggtgctgatggagggcctgtgcagcgagcagggccggcggggcagcaccctggccagcagcagcgagaggaagcccctggagaaccagctgggcaagcaggaggagttccgggtgtatggcaagtctgagaacatcctggtgctgaggaaggacatcaaggacctgaaggcccagctgcagaatgccaacaaggtgatccagaacctgaagagccgggtgcgcagcctgtctgtgaccagtgactacagcagcagcctggagcggccctggaagctgcgggctgtgggcaccctggagggcagcagcccccacagcgtgcctgatgaagatgagggctggctgagtgatggcaccggggccttctacagccctggcctgcaggccaagaaggacctggagagcctcatccagagggtgtcccagctggaggcccagctgcccaagaatggcctggaggagaagctggccgaggagctgcggagcgcctcctggccaggcaagtatgacagcctcatccaggaccaggcccgggagctgagctacctgcggcagaagatccgggagggccggggcatctgctacctgatcaccaggcatgccaaggacacagtgaagagctttgaggacctgctgcggagcaatgacatcgactactacctgggccagagcttccgggagcagctggcccagggcagccagctgacagagcggctgaccagcaagctgagcaccaaggaccacaagtctgagaaggaccaggccggcctggagcccctggccctgcggctgagccgggagctgcaggagaaggagaaggtgattgaggtgctgcaggccaagctggatgcccggagcctgacccccagcagcagccacgccctgagtgacagccacaggagccccagcagcaccagcttcctgagtgatgagctggaggcctgcagcgacatggacatcgtgtctgagtacacccactatgaggagaagaaggccagccccagccacagcgacagcatccaccacagcagccacagcgctgtgctgagcagcaagcccagcagcaccagcgccagccagggcgccaaggccgagagcaacagcaaccccatcagcctgcccaccccccagaacacccccaaggaggccaaccaggcccacagcggggccagcacagtgcccccagccagcacagccaccctgctgagcaatgacctggaggccgacagcagctactacctgaacagcgcccagccccacagccccccccggggcaccatcgagctgggccgcatcctggagcccggctacctgggcagcagcggcaagtgggatgtgatgaggccccagaagggctctgtgtctggggacctgagcagcggcagctctgtgtaccagctgaacagcaagcccactggagctgacctgctggaggagcacctgggggagatccggaacctgcggcagaggctggaggagagcatctgcatcaatgaccggctgcgggagcagctggagcaccggctgaccagcacagcccggggccggggcagcaccagcaacttctacagccagggcctggagagcatcccccagctgtgcaatgaaaatagagtgctgcgggaggacaacagaaggctgcaggcccagctgagccacgtgtcccgggagcacagccaggagacagagagcctgcgggaggccctgctgagcagccgcagccacctgcaggagctggagaaggagctggagcaccagaaggtggagcggcagcagctgctggaggacctgcgggagaagcagcaggaggtgctgcacttccgggaggagcggctgagcctgcaggagaatgacagccggctgcagcacaagctggtgctgctgcagcagcagtgtgaggagaagcagcagctgtttgagagcctgcagagcgagctgcagatctatgaggccctgtatggcaacagcaagaagggcctgaaggcctacagcctggatgcctgccaccagatccccctgagcagtgacctgagccacctggtggccgaggtgcgggccctgcggggccagctggagcagagcatccagggcaacaactgcctgcggctgcagctgcagcagcagctggagagcggggccggcaaggccagcctgagccccagcagcatcaaccagaacttccctgccagcacagaccccggcaacaagcagctgctgctgcaggacagcgctgtgagcccccctgtgagagatgtgggcatgaacagccctgccctggtgttccccagcagcgccagcagcaccccaggcagcgagacccccatcatcaacagagccaacggcctgggcctggacaccagccctgtgatgaagaccccacccaagctggagggagatgccacagatggcagctttgccaacaagcacggcagacatgtgattggccacattgatgactacagcgccctgcggcagcagattgctgagggcaagctgctggtgaagaagatcgtgtccctggtgcgcagcgcctgcagcttccctggcctggaggcccagggcacagaggtgctgggcagcaagggcatccacgagctgcggagcagcaccagcgccctgcaccacgccctggaggagagcgccagcctgctgaccatgttctggagggctgccctgcccagcacccacatccctgtgctgcccgggaaggtgggggagagcacagagcgggagctgctggagctgcggaccaaggtgtccaagcaggagcggctgctgcagagcaccacagagcacctgaagaatgccaaccagcagaaggagagcatggagcagttcatcgtgtcccagctgaccaggacccatgatgtgctgaagaaggcccggaccaacctggaggtgaagagcctgcgggccctgccctgcaccccagccctgtag

SEQ ID NO: 163923 - DNA, 3399 bp, Artificial Sequence
  Description of Artificial Sequence: Synthetic coding sequence
atgaaggagatctgccgcatctgtgcccgggagctgtgtggcaaccagaggcgctggatcttccacacagccagcaagctgaacctgcaggtgctgctgagccacgtgctgggcaaggatgtgcccagagatggcaaggccgagtttgcctgcagcaaatgtgccttcatgctggaccgcatctacagatttgacaccgtcatcgccagaattgaggccctgagcattgaaaggctgcagaagctgctgctggagaaggaccggctgaagttctgcatcgcctccatgtacaggaagaacaatgatgacagcggggctgagatcaaggctggaaatggcaccgtggacatgtctgtgctgcctgatgcccgctacagcgccctgctgcaggaggactttgcctacagcggctttgagtgctgggtggagaatgaagaccagatccaggagccccacagctgccacggcagcgagggccctggcaaccggccccggcgctgccggggctgtgccgccctgcgggtggccgacagcgactatgaggccatctgcaaggtgcccaggaaggtggcccggagcatcagctgtggccccagcagccgctggagcaccagcatctgcacagaggagcccgccctgtctgaggtgggccccccagacctggccagcaccaaggtgcccccagatggagagagcatggaggaggagaccccaggcagctctgtggagagcctggatgcctctgtgcaggccagccccccccagcagaaggatgaggagacagagaggtctgccaaggagctgggcaaatgtgactgctgcagtgatgaccaggccccccagcacggctgcaaccacaagctggagctggccctgtccatgatcaagggcctggactacaagcccatccagagcccccggggcagccggctgcccatccctgtgaagagcagcctgcccggggccaagccaggccccagcatgacagatggagtgagcagcggcttcctgaacagaagcctgaagcccctgtacaagacccctgtgtcctaccccctggagctgagtgacctgcaggagctgtgggatgacctgtgtgaggactacctgcccctgcgggtgcagcccatgacagaggagctgctgaagcagcagaagctgaacagccatgagaccaccatcacccagcagagcgtgtctgacagccacctggccgagctgcaggagaagatccagcagacagaggccaccaacaagatcctgcaggagaagctgaatgagatgtcctatgagctgaagtgtgcccaggagagcagccagaagcaggacggcaccatccagaacctgaaggagaccctgaagagccgggagcgggagacagaggagctgtaccaggtgattgagggccagaatgacaccatggccaagctgcgggagatgctgcaccagagccagctgggccagctgcacagcagcgagggcaccagccctgcccagcagcaggtggccctgctggacctgcagagcgccctcttctgcagccagctggagatccagaagctgcagagggtggtgcggcagaaggagcggcagctggctgatgccaagcagtgtgtgcagtttgtggaggccgccgcccatgaaagtgagcagcagaaggaggcctcctggaagcacaaccaggagctgaggaaggccctgcagcagctgcaggaggagctgcagaacaagagccagcagctgcgggcctgggaggccgagaagtacaatgagatccgcacccaggagcagaacatccagcacctgaaccacagcctgagccacaaggagcagctgctgcaggagttccgggagctgctgcagtacagagacaacagcgacaagaccctggaggccaatgagatgctgctggagaagctgcggcagagaattcatgacaaggctgtggccctggagcgggccattgatgagaagttcagcgccctggaggagaaggagaaggagctgcggcagctgcggctggccgtgcgggagcgggaccatgacctggagcggctgagagatgtgctgagcagcaatgaggccaccatgcagagcatggagagcctgctgcgggccaagggcctggaggtggagcagctgagcaccacctgccagaacctgcagtggctgaaggaggagatggagaccaagttcagccgctggcagaaggagcaggagagcatcatccagcagctgcagaccagcctgcatgacaggaacaaggaggtggaggacctgagcgccaccctgctgtgcaagctgggccctggccagagcgagattgctgaggagctgtgccagaggctgcagaggaaggagaggatgctgcaggacctgctgagtgacaggaacaagcaggtgctggagcacgagatggagatccagggcctgctgcagagcgtgtccacccgggagcaggagagccaggccgctgctgagaagctggtgcaggccctgatggagaggaacagcgagctgcaggccctgcggcagtacctgggcggccgggacagcctgatgagccaggcccccatcagcaaccagcaggccgaggtgacccccaccggctgcctgggcaagcagacagaccagggctccatgcagatccccagcagagatgacagcaccagcctgacagccaaggaggatgtgtccatccccaggagcaccctgggggacctggacacagtggccggcctggagaaggagctgagcaatgccaaggaggagctggagctgatggccaagaaggagcgggagagccagatggagctgagcgccctgcagagcatgatggctgtgcaggaggaggagctgcaggtgcaggccgctgacatggagagcctgaccaggaacatccagatcaaggaggacctgatcaaggacctgcagatgcagctggtggaccctgaggacatcccagccatggagcggctgacccaggaggtgctgctgctgcgggagaaggtggcctctgtggagagccagggccaggagatcagcggcaacagacggcagcagctgctgctgatgctggagggcctggtggatgagaggagccggctgaatgaggccctgcaggccgagcggcagctgtacagcagcctggtgaagttccacgcccaccctgagagcagcgagcgggacaggaccctgcaggtggagctggagggcgcccaggtgctgcggagccggctggaggaggtgctgggccgcagcctggagcggctgaaccggctggagaccctggccgccatcggcggcgctgctgctggagatgacacagaggacaccagcacagagttcacagacagcattgaggaggaggccgcccaccacagccaccagcagctgtag

SEQ ID NO: 163924 - DNA, 522 bp, Artificial Sequence
  Description of Artificial Sequence: Synthetic coding sequence
atgagcaatggctaccgcaccctgagccagcacctgaatgacctgaagaaggagaacttcagcctgaagctgcgcatctacttcctggaggagaggatgcagcagaagtatgaggccagccgggaggacatctacaagagaaatattgagctgaaggtggaggtggagagcctgaagcgggagctgcaggacaagaagcagcacctggacaagacctgggcagatgtggagaacctgaacagccagaatgaagctgagctgcggcggcagtttgaggagcggcagcaggagacagagcacgtgtatgagctgctggagaacaagatccagctgctgcaggaggagagccggctggccaagaatgaagctgccaggatggccgccctggtggaggccgagaaggagtgcaacctggagctgtctgagaagctgaagggcgtgaccaagaactgggaggatgtgcctggggaccaggtgaagccagaccagtacacagaggccctggcccagagggacaagtag

SEQ ID NO: 163925 - DNA, 933 bp, Artificial Sequence
  Description of Artificial Sequence: Synthetic coding sequence
atgaagggcacagacagcggcagctgctgcagaagaagatgtgactttggctgctgctgccgggccagccggcgggcccactacaccccctacagaagtggagatgccaccaggaccccccagagcccccggcagacccccagccgggagcggcggcggcctgagcctgctggctcctgggccgctgctgctgaggaggaggaggccgctgctgctgccaccccctggatgagggactactttgctgaagatgatggagagatggtgcccaggaccagccacacagctgccttcctgagtgacaccaaggaccggggcccccctgtgcagagccagatctggaggtctggagagaaggtgccctttgtgcagacctacagcctgcgggcctttgagaagccaccccaggtgcagacccaggccctgcgggactttgagaagcacctgaatgacctgaagaaggagaacttcagcctgaagctgcgcatctacttcctggaggagaggatgcagcagaagtatgaggccagccgggaggacatctacaagaggaacatcgagctgaaggtggaggtggagagcctgaagcgggagctgcaggacaagaagcagcacctggacaagacctgggcagatgtggagaacctgaacagccagaatgaggccgagctgcggcggcagtttgaggagcggcagcaggagacagaacatgtgtatgagctgctggagaacaagatccagctgctgcaggaggagagccggctggccaagaatgaggccgccaggatggccgccctggtggaggccgagaaggagtgcaacctggagctgtctgagaagctgaagggcgtgaccaagaactgggaggatgtgcctggggaccaggtgaagccagaccagtacacagaggccctggcccagagggacaagtag

SEQ ID NO: 163926 - DNA, 2910 bp, Artificial Sequence
  Description of Artificial Sequence: Synthetic coding sequence
atgagcaatggctaccgcaccctgagccagcacctgaatgacctgaagaaggagaacttcagcctgaagctgcgcatctacttcctggaggagaggatgcagcagaagtatgaggccagccgggaggacatctacaagagaaatattgagctgaaggtggaggtggagagcctgaagcgggagctgcaggacaagaagcagcacctggacaagacctgggcagatgtggagaacctgaacagccagaatgaagctgagctgcggcggcagtttgaggagcggcagcaggagacagagcacgtgtatgagctgctggagaacaagatccagctgctgcaggaggagagccggctggccaagaatgaagctgccaggatggccgccctggtggaggccgagaaggagtgcaacctggagctgtctgagaagctgaagggcgtgaccaagaactgggaggatgtgcctggggaccaggtgaagccagaccagtacacagaggccctggcccagagggacaagagaattgaggagctgaaccagagcctggccgcccaggagcggctggtggagcagctgagccgggagaagcagcagctgctgcacctgctggaggagcccacctccatggaggtgcagcccatgacagaggagctgctgaagcagcagaagctgaacagccatgagaccaccatcacccagcagagcgtgtctgacagccacctggccgagctgcaggagaagatccagcagacagaggccaccaacaagatcctgcaggagaagctgaatgagatgtcctatgagctgaagtgtgcccaggagagcagccagaagcaggacggcaccatccagaacctgaaggagaccctgaagagccgggagcgggagacagaggagctgtaccaggtgattgagggccagaatgacaccatggccaagctgcgggagatgctgcaccagagccagctgggccagctgcacagcagcgagggcaccagccctgcccagcagcaggtggccctgctggacctgcagagcgccctcttctgcagccagctggagatccagaagctgcagagggtggtgcggcagaaggagcggcagctggctgatgccaagcagtgtgtgcagtttgtggaggccgccgcccacgagagcgagcagcagaaggaggcctcctggaagcacaaccaggagctgaggaaggccctgcagcagctgcaggaggagctgcagaacaagagccagcagctgcgggcctgggaggccgagaagtacaatgagatccgcacccaggagcagaacatccagcacctgaaccacagcctgagccacaaggagcagctgctgcaggagttccgggagctgctgcagtacagagacaacagcgacaagaccctggaggccaatgagatgctgctggagaagctgcggcagagaattcatgacaaggctgtggccctggagcgggccattgatgagaagttcagcgccctggaggagaaggagaaggagctgcggcagctgcggctggccgtgcgggagcgggaccatgacctggagcggctgagagatgtgctgagcagcaatgaggccaccatgcagagcatggagagcctgctgcgggccaagggcctggaggtggagcagctgagcaccacctgccagaacctgcagtggctgaaggaggagatggagaccaagttcagccgctggcagaaggagcaggagagcatcatccagcagctgcagaccagcctgcatgacaggaacaaggaggtggaggacctgagcgccaccctgctgtgcaagctgggccctggccagagcgagattgctgaggagctgtgccagaggctgcagaggaaggagaggatgctgcaggacctgctgagtgacaggaacaagcaggtgctggagcacgagatggagatccagggcctgctgcagagcgtgtccacccgggagcaggagagccaggccgctgctgagaagctggtgcaggccctgatggagagaaattctgagctgcaggccctgcggcagtacctgggcggccgggacagcctgatgagccaggcccccatcagcaaccagcaggccgaggtgacccccaccggctgcctgggcaagcagacagaccagggctccatgcagatccccagcagagatgacagcaccagcctgacagccaaggaggatgtgtccatccccaggagcaccctgggggacctggacacagtggccggcctggagaaggagctgagcaatgccaaggaggagctggagctgatggccaagaaggagcgggagagccagatggagctgagcgccctgcagagcatgatggctgtgcaggaggaggagctgcaggtgcaggccgctgacatggagagcctgaccaggaacatccagatcaaggaggacctgatcaaggacctgcagatgcagctggtggaccctgaggacatcccagccatggagcggctgacccaggaggtgctgctgctgcgggagaaggtggcctctgtggagagccagggccaggagatcagcggcaacagacggcagcagctgctgctgatgctggagggcctggtggatgagaggagccggctgaatgaggccctgcaggccgagcggcagctgtacagcagcctggtgaagttccacgcccaccctgagagcagcgagcgggacaggaccctgcaggtggagctggagggcgcccaggtgctgcggagccggctggaggaggtgctgggccgcagcctggagcggctgaaccggctggagaccctggccgccatcggcggcgctgctgctggagatgacacagaggacaccagcacagagttcacagacagcattgaggaggaggccgcccaccacagccaccagcagctgtag

SEQ ID NO: 163927 - DNA, 2967 bp, Artificial Sequence
  Description of Artificial Sequence: Synthetic coding sequence
atgagcaatggctaccgcaccctgagccagcacctgaatgacctgaagaaggagaacttcagcctgaagctgcgcatctacttcctggaggagaggatgcagcagaagtatgaggccagccgggaggacatctacaagagaaatattgagctgaaggtggaggtggagagcctgaagcgggagctgcaggacaagaagcagcacctggacaagacctgggcagatgtggagaacctgaacagccagaatgaagctgagctgcggcggcagtttgaggagcggcagcaggagacagagcacgtgtatgagctgctggagaacaagatccagctgctgcaggaggagagccggctggccaagaatgaagctgccaggatggccgccctggtggaggccgagaaggagtgcaacctggagctgtctgagaagctgaagggcgtgaccaagaactgggaggatgtgcctggggaccaggtgaagccagaccagtacacagaggccctggcccagagggacaagagaattgaggagctgaaccagagcctggccgcccaggagcggctggtggagcagctgagccgggagaagcagcagctgctgcacctgctggaggagcccacctccatggaggtgcagcccatgacagaggagctgctgaagcagcagaagctgaacagccatgagaccaccatcacccagcagagcgtgtctgacagccacctggccgagctgcaggagaagatccagcagacagaggccaccaacaagatcctgcaggagaagctgaatgagatgtcctatgagctgaagtgtgcccaggagagcagccagaagcaggacggcaccatccagaacctgaaggagaccctgaagagccgggagcgggagacagaggagctgtaccaggtgattgagggccagaatgacaccatggccaagctgcgggagatgctgcaccagagccagctgggccagctgcacagcagcgagggcaccagccctgcccagcagcaggtggccctgctggacctgcagagcgccctcttctgcagccagctggagatccagaagctgcagagggtggtgcggcagaaggagcggcagctggctgatgccaagcagtgtgtgcagtttgtggaggccgccgcccacgagagcgagcagcagaaggaggcctcctggaagcacaaccaggagctgaggaaggccctgcagcagctgcaggaggagctgcagaacaagagccagcagctgcgggcctgggaggccgagaagtacaatgagatccgcacccaggagcagaacatccagcacctgaaccacagcctgagccacaaggagcagctgctgcaggagttccgggagctgctgcagtacagagacaacagcgacaagaccctggaggccaatgagatgctgctggagaagctgcggcagagaattcatgacaaggctgtggccctggagcgggccattgatgagaagttcagcgccctggaggagaaggagaaggagctgcggcagctgcggctggccgtgcgggagcgggaccatgacctggagcggctgagagatgtgctgagcagcaatgaggccaccatgcagagcatggagagcctgctgcgggccaagggcctggaggtggagcagctgagcaccacctgccagaacctgcagtggctgaaggaggagatggagaccaagttcagccgctggcagaaggagcaggagagcatcatccagcagctgcagaccagcctgcatgacaggaacaaggaggtggaggacctgagcgccaccctgctgtgcaagctgggccctggccagagcgagattgctgaggagctgtgccagaggctgcagaggaaggagaggatgctgcaggacctgctgagtgacaggaacaagcaggtgctggagcacgagatggagatccagggcctgctgcagagcgtgtccacccgggagcaggagagccaggccgctgctgagaagctggtgcaggccctgatggagagaaattctgagctgcaggccctgcggcagtacctgggcggccgggacagcctgatgagccaggcccccatcagcaaccagcaggccgaggtgacccccaccggctgcctgggcaagcagacagaccagggctccatgcagatccccagcagagatgacagcaccagcctgacagccaaggaggatgtgtccatccccaggagcaccctgggggacctggacacagtggccggcctggagaaggagctgagcaatgccaaggaggagctggagctgatggccaagaaggagcgggagagccagatggagctgagcgccctgcagagcatgatggctgtgcaggaggaggagctgcaggtgcaggccgctgacatggagagcctgaccaggaacatccagatcaaggaggacctgatcaaggacctgcagatgcagctggtggaccctgaggacatcccagccatggagcggctgacccaggaggtgctgctgctgcgggagaaggtggcctctgtggagagccagggccaggagatcagcggcaacagacggcagcagctgctgctgatgctggagggcctggtggatgagaggagccggctgaatgaggccctgcaggccgagcggcagctgtacagcagcctggtgaagttccacgcccaccctgagagcagcgagcgggacaggaccctgcaggtggagctggagggcgcccaggtgctgcggagccggctggaggaggtgctgggccgcagcctggagcggctgaaccggctggagaccctggccgccatcggcggcgctgctgctggagatgacacagaggacaccagcacagagttcacagacagcattgaggaggaggccgcccaccacagccaccagcaggtgtcccagtgccagggcctgggcctgcccggctggacagcccacagccccagcgaggtgtag

SEQ ID NO: 163928 - DNA, 3396 bp, Artificial Sequence
  Description of Artificial Sequence: Synthetic coding sequence
atgaaggagatctgccgcatctgtgcccgggagctgtgtggcaaccagaggcgctggatcttccacacagccagcaagctgaacctgcaggtgctgctgagccacgtgctgggcaaggatgtgcccagagatggcaaggccgagtttgcctgcagcaaatgtgccttcatgctggaccgcatctacagatttgacaccgtcatcgccagaattgaggccctgagcattgaaaggctgcagaagctgctgctggagaaggaccggctgaagttctgcatcgcctccatgtacaggaagaacaatgatgacagcggggctgagatcaaggctggaaatggcaccgtggacatgtctgtgctgcctgatgcccgctacagcgccctgctgcaggaggactttgcctacagcggctttgagtgctgggtggagaatgaagaccagatccaggagccccacagctgccacggcagcgagggccctggcaaccggccccggcgctgccggggctgtgccgccctgcgggtggccgacagcgactatgaggccatctgcaaggtgcccaggaaggtggcccggagcatcagctgtggccccagcagccgctggagcaccagcatctgcacagaggagcccgccctgtctgaggtgggccccccagacctggccagcaccaaggtgcccccagatggagagagcatggaggaggagaccccaggcagctctgtggagagcctggatgcctctgtgcaggccagccccccccagcagaaggatgaggagacagagaggtctgccaaggagctgggcaaatgtgactgctgcagtgatgaccaggccccccagcacggctgcaaccacaagctggagctggccctgtccatgatcaagggcctggactacaagcccatccagagcccccggggcagccggctgcccatccctgtgaagagcagcctgcccggggccaagccaggccccagcatgacagatggagtgagcagcggcttcctgaacagaagcctgaagcccctgtacaagacccctgtgtcctaccccctggagctgagtgacctgcaggagctgtgggatgacctgtgtgaggactacctgcccctgcgggtgcagcccatgacagaggagctgctgaagcagcagaagctgaacagccatgagaccaccatcacccagcagagcgtgtctgacagccacctggccgagctgcaggagaagatccagcagacagaggccaccaacaagatcctgcaggagaagctgaatgagatgtcctatgagctgaagtgtgcccaggagagcagccagaagcaggacggcaccatccagaacctgaaggagaccctgaagagccgggagcgggagacagaggagctgtaccaggtgattgagggccagaatgacaccatggccaagctgcgggagatgctgcaccagagccagctgggccagctgcacagcagcgagggcaccagccctgcccagcagcaggtggccctgctggacctgcagagcgccctcttctgcagccagctggagatccagaagctgcagagggtggtgcggcagaaggagcggcagctggctgatgccaagcagtgtgtgcagtttgtggaggccgccgcccatgaaagtgagcagcagaaggaggcctcctggaagcacaaccaggagctgaggaaggccctgcagcagctgcaggaggagctgcagaacaagagccagcagctgcgggcctgggaggccgagaagtacaatgagatccgcacccaggagcagaacatccagcacctgaaccacagcctgagccacaaggagcagctgctgcaggagttccgggagctgctgcagtacagagacaacagcgacaagaccctggaggccaatgagatgctgctggagaagctgcggcagagaattcatgacaaggctgtggccctggagcgggccattgatgagaagttcagcgccctggaggagaaggagaaggagctgcggcagctgcggctggccgtgcgggagcgggaccatgacctggagcggctgagagatgtgctgagcagcaatgaggccaccatgcagagcatggagagcctgctgcgggccaagggcctggaggtggagcagctgagcaccacctgccagaacctgcagtggctgaaggaggagatggagaccaagttcagccgctggcagaaggagcaggagagcatcatccagcagctgcagaccagcctgcatgacaggaacaaggaggtggaggacctgagcgccaccctgctgtgcaagctgggccctggccagagcgagattgctgaggagctgtgccagaggctgcagaggaaggagaggatgctgcaggacctgctgagtgacaggaacaagcaggtgctggagcacgagatggagatccagggcctgctgcagagcgtgtccacccgggagcaggagagccaggccgctgctgagaagctggtgcaggccctgatggagaggaacagcgagctgcaggccctgcggcagtacctgggcggccgggacagcctgatgagccaggcccccatcagcaaccagcaggccgaggtgacccccaccggctgcctgggcaagcagacagaccagggctccatgcagatccccagcagagatgacagcaccagcctgacagccaaggaggatgtgtccatccccaggagcaccctgggggacctggacacagtggccggcctggagaaggagctgagcaatgccaaggaggagctggagctgatggccaagaaggagcgggagagccagatggagctgagcgccctgcagagcatgatggctgtgcaggaggaggagctgcaggtgcaggccgctgacatggagagcctgaccaggaacatccagatcaaggaggacctgatcaaggacctgcagatgcagctggtggaccctgaggacatcccagccatggagcggctgacccaggaggtgctgctgctgcgggagaaggtggcctctgtggagagccagggccaggagatcagcggcaacagacggcagcagctgctgctgatgctggagggcctggtggatgagaggagccggctgaatgaggccctgcaggccgagcggcagctgtacagcagcctggtgaagttccacgcccaccctgagagcagcgagcgggacaggaccctgcaggtggagctggagggcgcccaggtgctgcggagccggctggaggaggtgctgggccgcagcctggagcggctgaaccggctggagaccctggccgccatcggcggcgctgctgctggagatgacacagaggacaccagcacagagttcacagacagcattgaggaggaggccgcccaccacagccaccagcagtag

SEQ ID NO: 163929 - DNA, 7041 bp, Artificial Sequence
  Description of Artificial Sequence: Synthetic coding sequence
atgagcaatggctaccgcaccctgagccagcacctgaatgacctgaagaaggagaacttcagcctgaagctgcgcatctacttcctggaggagaggatgcagcagaagtatgaggccagccgggaggacatctacaagagaaatattgagctgaaggtggaggtggagagcctgaagcgggagctgcaggacaagaagcagcacctggacaagacctgggcagatgtggagaacctgaacagccagaatgaagctgagctgcggcggcagtttgaggagcggcagcaggagacagagcacgtgtatgagctgctggagaacaagatccagctgctgcaggaggagagccggctggccaagaatgaagctgccaggatggccgccctggtggaggccgagaaggagtgcaacctggagctgtctgagaagctgaagggcgtgaccaagaactgggaggatgtgcctggggaccaggtgaagccagaccagtacacagaggccctggcccagagggacaagagaattgaggagctgaaccagagcctggccgcccaggagcggctggtggagcagctgagccgggagaagcagcagctgctgcacctgctggaggagcccacctccatggaggtgcagcccatgacagaggagctgctgaagcagcagaagctgaacagccatgagaccaccatcacccagcagagcgtgtctgacagccacctggccgagctgcaggagaagatccagcagacagaggccaccaacaagatcctgcaggagaagctgaatgagatgtcctatgagctgaagtgtgcccaggagagcagccagaagcaggacggcaccatccagaacctgaaggagaccctgaagagccgggagcgggagacagaggagctgtaccaggtgattgagggccagaatgacaccatggccaagctgcgggagatgctgcaccagagccagctgggccagctgcacagcagcgagggcaccagccctgcccagcagcaggtggccctgctggacctgcagagcgccctcttctgcagccagctggagatccagaagctgcagagggtggtgcggcagaaggagcggcagctggctgatgccaagcagtgtgtgcagtttgtggaggccgccgcccacgagagcgagcagcagaaggaggcctcctggaagcacaaccaggagctgaggaaggccctgcagcagctgcaggaggagctgcagaacaagagccagcagctgcgggcctgggaggccgagaagtacaatgagatccgcacccaggagcagaacatccagcacctgaaccacagcctgagccacaaggagcagctgctgcaggagttccgggagctgctgcagtacagagacaacagcgacaagaccctggaggccaatgagatgctgctggagaagctgcggcagagaattcatgacaaggctgtggccctggagcgggccattgatgagaagttcagcgccctggaggagaaggagaaggagctgcggcagctgcggctggccgtgcgggagcgggaccatgacctggagcggctgagagatgtgctgagcagcaatgaggccaccatgcagagcatggagagcctgctgcgggccaagggcctggaggtggagcagctgagcaccacctgccagaacctgcagtggctgaaggaggagatggagaccaagttcagccgctggcagaaggagcaggagagcatcatccagcagctgcagaccagcctgcatgacaggaacaaggaggtggaggacctgagcgccaccctgctgtgcaagctgggccctggccagagcgagattgctgaggagctgtgccagaggctgcagaggaaggagaggatgctgcaggacctgctgagtgacaggaacaagcaggtgctggagcacgagatggagatccagggcctgctgcagagcgtgtccacccgggagcaggagagccaggccgctgctgagaagctggtgcaggccctgatggagagaaattctgagctgcaggccctgcggcagtacctgggcggccgggacagcctgatgagccaggcccccatcagcaaccagcaggccgaggtgacccccaccggctgcctgggcaagcagacagaccagggctccatgcagatccccagcagagatgacagcaccagcctgacagccaaggaggatgtgtccatccccaggagcaccctgggggacctggacacagtggccggcctggagaaggagctgagcaatgccaaggaggagctggagctgatggccaagaaggagcgggagagccagatggagctgagcgccctgcagagcatgatggctgtgcaggaggaggagctgcaggtgcaggccgctgacatggagagcctgaccaggaacatccagatcaaggaggacctgatcaaggacctgcagatgcagctggtggaccctgaggacatcccagccatggagcggctgacccaggaggtgctgctgctgcgggagaaggtggcctctgtggagagccagggccaggagatcagcggcaacagacggcagcagctgctgctgatgctggagggcctggtggatgagaggagccggctgaatgaggccctgcaggccgagcggcagctgtacagcagcctggtgaagttccacgcccaccctgagagcagcgagcgggacaggaccctgcaggtggagctggagggcgcccaggtgctgcggagccggctggaggaggtgctgggccgcagcctggagcggctgaaccggctggagaccctggccgccatcggcggcgctgctgctggagatgacacagaggacaccagcacagagttcacagacagcattgaggaggaggccgcccaccacagccaccagcagctggtgaaggtggccctggagaagagcctggccaccgtggagacccagaaccccagcttcagcccccccagccccatgggcggggacagcaaccgctgcctgcaggaggagatgctgcacctgcgggcagagttccaccagcacctggaggagaagaggaaggccgaggaggagctgaaggagctgaaggcccagatcgaggaggccggcttcagctctgtgagccacatccggaacaccatgctgagcctgtgcctggagaatgctgagctgaaggagcagatgggagaggccatgtctgatggctgggagattgaggaggacaaggagaagggggaggtgatggtggagaccgtggtgaccaaggagggcctgtctgagagcagcctgcaggccgagttcaggaagctgcagggcaagctgaagaatgcccacaacatcatcaacctgctgaaggagcagctggtgctgagcagcaaggagggcaacagcaagctgaccccagagctgctggtgcacctgaccagcaccatcgagcgcatcaacacagagctggtgggcagccctgggaagcaccagcaccaggaggagggcaatgtgacagtgcggcccttcccccggccccagagcctggacctgggcgccaccttcaccgtggatgcccaccagctggacaaccagagccagccccgggaccccggcccccagagcgccttcagcctgcccggcagcacccagcacctgcggagccagctgagccagtgcaagcagcgctaccaggacctgcaggagaagctgctgctgtctgaggccaccgtgtttgcccaggccaatgagctggagaagtacagagtgatgctgaccggggagagcctggtgaagcaggacagcaagcagatccaggtggacctgcaggacctgggctatgagacctgtggccgctcagaaaatgaagctgagcgggaggagaccaccagcccagaatgtgaggagcacaacagcctgaaggagatggtgctgatggagggcctgtgcagcgagcagggccggcggggcagcaccctggccagcagcagcgagaggaagcccctggagaaccagctgggcaagcaggaggagttccgggtgtatggcaagtctgagaacatcctggtgctgaggaaggacatcaaggacctgaaggcccagctgcagaatgccaacaaggtgatccagaacctgaagagccgggtgcgcagcctgtctgtgaccagtgactacagcagcagcctggagcggccctggaagctgcgggctgtgggcaccctggagggcagcagcccccacagcgtgcctgatgaagatgagggctggctgagtgatggcaccggggccttctacagccctggcctgcaggccaagaaggacctggagagcctcatccagagggtgtcccagctggaggcccagctgcccaagaatggcctggaggagaagctggccgaggagctgcggagcgcctcctggccaggcaagtatgacagcctcatccaggaccaggcccgggagctgagctacctgcggcagaagatccgggagggccggggcatctgctacctgatcaccaggcatgccaaggacacagtgaagagctttgaggacctgctgcggagcaatgacatcgactactacctgggccagagcttccgggagcagctggcccagggcagccagctgacagagcggctgaccagcaagctgagcaccaaggaccacaagtctgagaaggaccaggccggcctggagcccctggccctgcggctgagccgggagctgcaggagaaggagaaggtgattgaggtgctgcaggccaagctggatgcccggagcctgacccccagcagcagccacgccctgagtgacagccacaggagccccagcagcaccagcttcctgagtgatgagctggaggcctgcagcgacatggacatcgtgtctgagtacacccactatgaggagaagaaggccagccccagccacagcgacagcatccaccacagcagccacagcgctgtgctgagcagcaagcccagcagcaccagcgccagccagggcgccaaggccgagagcaacagcaaccccatcagcctgcccaccccccagaacacccccaaggaggccaaccaggcccacagcggcttccacttccacagcatccccaagctggccagcctgccccaggcccccctgcccagcgcccccagcagcttcctgcccttcagccccaccggccccctgctgctgggctgctgtgagacccctgtggtgtccctggccgaggcccagcaggagctgcagatgctgcagaagcagctgggggagagcgccagcacagtgcccccagccagcacagccaccctgctgagcaatgacctggaggccgacagcagctactacctgaacagcgcccagccccacagccccccccggggcaccatcgagctgggccgcatcctggagcccggctacctgggcagcagcggcaagtgggatgtgatgaggccccagaagggctctgtgtctggggacctgagcagcggcagctctgtgtaccagctgaacagcaagcccactggagctgacctgctggaggagcacctgggggagatccggaacctgcggcagaggctggaggagagcatctgcatcaatgaccggctgcgggagcagctggagcaccggctgaccagcacagcccggggccggggcagcaccagcaacttctacagccagggcctggagagcatcccccagctgtgcaatgaaaatagagtgctgcgggaggacaacagaaggctgcaggcccagctgagccacgtgtcccgggagcacagccaggagacagagagcctgcgggaggccctgctgagcagccgcagccacctgcaggagctggagaaggagctggagcaccagaaggtggagcggcagcagctgctggaggacctgcgggagaagcagcaggaggtgctgcacttccgggaggagcggctgagcctgcaggagaatgacagccggctgcagcacaagctggtgctgctgcagcagcagtgtgaggagaagcagcagctgtttgagagcctgcagagcgagctgcagatctatgaggccctgtatggcaacagcaagaagggcctgaaggcctacagcctggatgcctgccaccagatccccctgagcagtgacctgagccacctggtggccgaggtgcgggccctgcggggccagctggagcagagcatccagggcaacaactgcctgcggctgcagctgcagcagcagctggagagcggggccggcaaggccagcctgagccccagcagcatcaaccagaacttccctgccagcacagaccccggcaacaagcagctgctgctgcaggacagcgctgtgagcccccctgtgagagatgtgggcatgaacagccctgccctggtgttccccagcagcgccagcagcaccccaggcagcgagacccccatcatcaacagagccaacggcctgggcctggacaccagccctgtgatgaagaccccacccaagctggagggagatgccacagatggcagctttgccaacaagcacggcagacatgtgattggccacattgatgactacagcgccctgcggcagcagattgctgagggcaagctgctggtgaagaagatcgtgtccctggtgcgcagcgcctgcagcttccctggcctggaggcccagggcacagaggtgctgggcagcaagggcatccacgagctgcggagcagcaccagcgccctgcaccacgccctggaggagagcgccagcctgctgaccatgttctggagggctgccctgcccagcacccacatccctgtgctgcccgggaaggtgggggagagcacagagcgggagctgctggagctgcggaccaaggtgtccaagcaggagcggctgctgcagagcaccacagagcacctgaagaatgccaaccagcagaaggagagcatggagcagttcatcgtgtcccagctgaccaggacccatgatgtgctgaagaaggcccggaccaacctggaggtgaagagcctgcgggccctgccctgcaccccagccctgtag

SEQ ID NO: 163930 - DNA, 7089 bp, Artificial Sequence
  Description of Artificial Sequence: Synthetic coding sequence
atgagcaatggctaccgcaccctgagccagcacctgaatgacctgaagaaggagaacttcagcctgaagctgcgcatctacttcctggaggagaggatgcagcagaagtatgaggccagccgggaggacatctacaagagaaatattgagctgaaggtggaggtggagagcctgaagcgggagctgcaggacaagaagcagcacctggacaagacctgggcagatgtggagaacctgaacagccagaatgaagctgagctgcggcggcagtttgaggagcggcagcaggagacagagcacgtgtatgagctgctggagaacaagatccagctgctgcaggaggagagccggctggccaagaatgaagctgccaggatggccgccctggtggaggccgagaaggagtgcaacctggagctgtctgagaagctgaagggcgtgaccaagaactgggaggatgtgcctggggaccaggtgaagccagaccagtacacagaggccctggcccagagggacaagagaattgaggagctgaaccagagcctggccgcccaggagcggctggtggagcagctgagccgggagaagcagcagctgctgcacctgctggaggagcccacctccatggaggtgcagcccatgacagaggagctgctgaagcagcagaagctgaacagccatgagaccaccatcacccagcagagcgtgtctgacagccacctggccgagctgcaggagaagatccagcagacagaggccaccaacaagatcctgcaggagaagctgaatgagatgtcctatgagctgaagtgtgcccaggagagcagccagaagcaggacggcaccatccagaacctgaaggagaccctgaagagccgggagcgggagacagaggagctgtaccaggtgattgagggccagaatgacaccatggccaagctgcgggagatgctgcaccagagccagctgggccagctgcacagcagcgagggcaccagccctgcccagcagcaggtggccctgctggacctgcagagcgccctcttctgcagccagctggagatccagaagctgcagagggtggtgcggcagaaggagcggcagctggctgatgccaagcagtgtgtgcagtttgtggaggccgccgcccacgagagcgagcagcagaaggaggcctcctggaagcacaaccaggagctgaggaaggccctgcagcagctgcaggaggagctgcagaacaagagccagcagctgcgggcctgggaggccgagaagtacaatgagatccgcacccaggagcagaacatccagcacctgaaccacagcctgagccacaaggagcagctgctgcaggagttccgggagctgctgcagtacagagacaacagcgacaagaccctggaggccaatgagatgctgctggagaagctgcggcagagaattcatgacaaggctgtggccctggagcgggccattgatgagaagttcagcgccctggaggagaaggagaaggagctgcggcagctgcggctggccgtgcgggagcgggaccatgacctggagcggctgagagatgtgctgagcagcaatgaggccaccatgcagagcatggagagcctgctgcgggccaagggcctggaggtggagcagctgagcaccacctgccagaacctgcagtggctgaaggaggagatggagaccaagttcagccgctggcagaaggagcaggagagcatcatccagcagctgcagaccagcctgcatgacaggaacaaggaggtggaggacctgagcgccaccctgctgtgcaagctgggccctggccagagcgagattgctgaggagctgtgccagaggctgcagaggaaggagaggatgctgcaggacctgctgagtgacaggaacaagcaggtgctggagcacgagatggagatccagggcctgctgcagagcgtgtccacccgggagcaggagagccaggccgctgctgagaagctggtgcaggccctgatggagagaaattctgagctgcaggccctgcggcagtacctgggcggccgggacagcctgatgagccaggcccccatcagcaaccagcaggccgaggtgacccccaccggctgcctgggcaagcagacagaccagggctccatgcagatccccagcagagatgacagcaccagcctgacagccaaggaggatgtgtccatccccaggagcaccctgggggacctggacacagtggccggcctggagaaggagctgagcaatgccaaggaggagctggagctgatggccaagaaggagcgggagagccagatggagctgagcgccctgcagagcatgatggctgtgcaggaggaggagctgcaggtgcaggccgctgacatggagagcctgaccaggaacatccagatcaaggaggacctgatcaaggacctgcagatgcagctggtggaccctgaggacatcccagccatggagcggctgacccaggaggtgctgctgctgcgggagaaggtggcctctgtggagagccagggccaggagatcagcggcaacagacggcagcagctgctgctgatgctggagggcctggtggatgagaggagccggctgaatgaggccctgcaggccgagcggcagctgtacagcagcctggtgaagttccacgcccaccctgagagcagcgagcgggacaggaccctgcaggtggagctggagggcgcccaggtgctgcggagccggctggaggaggtgctgggccgcagcctggagcggctgaaccggctggagaccctggccgccatcggcggcgctgctgctggagatgacacagaggacaccagcacagagttcacagacagcattgaggaggaggccgcccaccacagccaccagcagctggtgaaggtggccctggagaagagcctggccaccgtggagacccagaaccccagcttcagcccccccagccccatgggcggggacagcaaccgctgcctgcaggaggagatgctgcacctgcgggcagagttccaccagcacctggaggagaagaggaaggccgaggaggagctgaaggagctgaaggcccagatcgaggaggccggcttcagctctgtgagccacatccggaacaccatgctgagcctgtgcctggagaatgctgagctgaaggagcagatgggagaggccatgtctgatggctgggagattgaggaggacaaggagaagggggaggtgatggtggagaccgtggtgaccaaggagggcctgtctgagagcagcctgcaggccgagttcaggaagctgcagggcaagctgaagaatgcccacaacatcatcaacctgctgaaggagcagctggtgctgagcagcaaggagggcaacagcaagctgaccccagagctgctggtgcacctgaccagcaccatcgagcgcatcaacacagagctggtgggcagccctgggaagcaccagcaccaggaggagggcaatgtgacagtgcggcccttcccccggccccagagcctggacctgggcgccaccttcaccgtggatgcccaccagctggacaaccagagccagccccgggaccccggcccccagagcgccttcagcctgcccggcagcacccagcacctgcggagccagctgagccagtgcaagcagcgctaccaggacctgcaggagaagctgctgctgtctgaggccaccgtgtttgcccaggccaatgagctggagaagtacagagtgatgctgaccggggagagcctggtgaagcaggacagcaagcagatccaggtggacctgcaggacctgggctatgagacctgtggccgctcagaaaatgaagctgagcgggaggagaccaccagcccagaatgtgaggagcacaacagcctgaaggagatggtgctgatggagggcctgtgcagcgagcagggccggcggggcagcaccctggccagcagcagcgagaggaagcccctggagaaccagctgggcaagcaggaggagttccgggtgtatggcaagtctgagaacatcctggtgctgaggaaggacatcaaggacctgaaggcccagctgcagaatgccaacaaggtgatccagaacctgaagagccgggtgcgcagcctgtctgtgaccagtgactacagcagcagcctggagcggccctggaagctgcgggctgtgggcaccctggagggcagcagcccccacagcgtgcctgatgaagatgagggctggctgagtgatggcaccggggccttctacagccctggcctgcaggccaagaaggacctggagagcctcatccagagggtgtcccagctggaggcccagctgcccaagaatggcctggaggagaagctggccgaggagctgcggagcgcctcctggccaggcaagtatgacagcctcatccaggaccaggcccgggagctgagctacctgcggcagaagatccgggagggccggggcatctgctacctgatcaccaggcatgccaaggacacagtgaagagctttgaggacctgctgcggagcaatgacatcgactactacctgggccagagcttccgggagcagctggcccagggcagccagctgacagagcggctgaccagcaagctgagcaccaaggaccacaagtctgagaaggaccaggccggcctggagcccctggccctgcggctgagccgggagctgcaggagaaggagaaggtgattgaggtgctgcaggccaagctggatgcccggagcctgacccccagcagcagccacgccctgagtgacagccacaggagccccagcagcaccagcttcctgagtgatgagctggaggcctgcagcgacatggacatcgtgtctgagtacacccactatgaggagaagaaggccagccccagccacagcgacagcatccaccacagcagccacagcgctgtgctgagcagcaagcccagcagcaccagcgccagccagggcgccaaggccgagagcaacagcaaccccatcagcctgcccaccccccagaacacccccaaggaggccaaccaggcccacagcggcttccacttccacagcatccccaagctggccagcctgccccaggcccccctgcccagcgcccccagcagcttcctgcccttcagccccaccggccccctgctgctgggctgctgtgagacccctgtggtgtccctggccgaggcccagcaggagctgcagatgctgcagaagcagctgggggagagcgccagcacagtgcccccagccagcacagccaccctgctgagcaatgacctggaggccgacagcagctactacctgaacagcgcccagccccacagccccccccggggcaccatcgagctgggccgcatcctggagcccggctacctgggcagcagcggcaagtgggatgtgatgaggccccagaagggctctgtgtctggggacctgagcagcggcagctctgtgtaccagctgaacagcaagcccactggagctgacctgctggaggagcacctgggggagatccggaacctgcggcagaggctggaggagagcatctgcatcaatgaccggctgcgggagcagctggagcaccggctgaccagcacagcccggggccggggcagcaccagcaacttctacagccagggcctggagagcatcccccagctgtgcaatgaaaatagagtgctgcgggaggacaacagaaggctgcaggcccagctgagccacgtgtcccgggagcacagccaggagacagagagcctgcgggaggccctgctgagcagccgcagccacctgcaggagctggagaaggagctggagcaccagaaggtggagcggcagcagctgctggaggacctgcgggagaagcagcaggaggtgctgcacttccgggaggagcggctgagcctgcaggagaatgacagccggctgcagcacaagctggtgctgctgcagcagcagtgtgaggagaagcagcagctgtttgagagcctgcagagcgagctgcagatctatgaggccctgtatggcaacagcaagaagggcctgaaggcctacagcctggatgcctgccaccagatccccctgagcagtgacctgagccacctggtggccgaggtgcgggccctgcggggccagctggagcagagcatccagggcaacaactgcctgcggctgcagctgcagcagcagctggagagcggggccggcaaggccagcctgagccccagcagcatcaaccagaacttccctgccagcacagaccccggcaacaagcagctgctgctgcaggacagcgctgtgagcccccctgtgagagatgtgggcatgaacagccctgccctggtgttccccagcagcgccagcagcaccccaggcagcgagacccccatcatcaacagagccaacggcctgggcctggacaccagccctgtgatgaagaccccacccaagctggagggagatgccacagatggcagctttgccaacaagcacggcagacatgtgattggccacattgatgactacagcgccctgcggcagcagattgctgagggcaagctgctggtgaagaagatcgtgtccctggtgcgcagcgcctgcagcttccctggcctggaggcccagggcacagaggtgctgggcagcaagggcatccacgagctgcggagcagcaccagcgccctgcaccacgccctggaggagagcgccagcctgctgaccatgttctggagggctgccctgcccagcacccacatccctgtgctgcccgggaaggtgggggagagcacagagcgggagctgctggagctgcggaccaaggtgtccaagcaggagcggctgctgcagagcaccacagagcacctgaagaatgccaaccagcagaaggagagcatggagcagttcatcgtgtcccagctgaccaggacccatgatgtgctgaagaaggcccggaccaacctggaggagccctgcaagaagaggagccaccagaagagcctgaagcagcaggagcgctgggcctgccccccatttgtgcagctgcccatctgctag

SEQ ID NO: 163931 - DNA, 1557 bp, Artificial Sequence
  Description of Artificial Sequence: Synthetic coding sequence
atgcctgaggccaactacctgctgtctgtgtcctggggctacatcaagttcaagaggatgctgaaccgggagctgacccacctgtctgagatgagccgcagcggcaaccaggtgtctgagttcatcagcaacaccttcctggacaagcagcacgaggtggagatccccagccccacccagaaggagaaggagaagaagaagaggcccatgagccagatcagcggcgtgaagaagctgatgcacagcagcagcctgaccaacagcagcatccccaggtttggagtgaagacagagcaggaggatgtgctggccaaggagctggaggatgtgaacaagtggggcctgcacgtgttcagaattgctgagctgagcggcaaccggcccctgaccgtcatcatgcacaccatcttccaggagcgggacctgctgaagaccttcaagatccctgtggacaccctcatcacctacctgatgaccctggaggaccactaccacgcagatgtggcctaccacaacaacatccacgccgcagatgtggtgcagagcacccacgtgctgctgagcaccccagccctggaggccgtgttcacagacctggagatcctggccgccatctttgccagcgccatccatgatgtggaccaccctggggtgagcaaccagttcctgatcaacaccaacagcgagctggccctgatgtacaatgacagctctgtgctggagaaccaccacctggccgtgggcttcaagctgctgcaggaggagaactgtgacatcttccagaacctgaccaagaagcagaggcagagcctgaggaagatggtgattgacatcgtgctggccacagacatgagcaagcacatgaacctgctggccgacctgaagaccatggtggagaccaagaaggtgaccagcagcggcgtgctgctgctggacaactacagcgaccgcatccaggtgctgcagaacatggtgcactgtgccgacctgagcaaccccaccaagcccctgcagctgtaccggcagtggacagaccgcatcatggaggagttcttccggcagggcgaccgggagcgggagcggggcatggagatcagccccatgtgtgacaagcacaatgcctctgtggagaagagccaggtgggcttcatcgactacatcgtgcaccccctgtgggagacctgggccgacctggtgcacccagatgcccaggacatcctggacaccctggaggacaaccgggagtggtaccagagcaccatcccccagagccccagccctgccccagatgatcctgaggagggccggcagggccagacagagaagttccagtttgagctgaccctggaggaggatggagagagtgacacagagaaggacagcggcagccaggtggaggaggacaccagctgcagcgacagcaagaccctgtgcacccaggacagcgagagcacagagatccccctggatgagcaggtggaggaggaggccgtgggggaggaggaggagagccagcctgaggcctgtgtgattgatgacaggagcccagacacctag

SEQ ID NO: 163932 - DNA, 2430 bp, Artificial Sequence
  Description of Artificial Sequence: Synthetic coding sequence
atggaggccgagggcagcagcgccccagcccgggccggcagcggggagggcagtgacagcgctggaggagccaccctgaaggcccccaagcacctgtggaggcatgagcagcaccaccagtaccccctgcggcagccccagttccggctgctgcacccccaccaccacctgcccccacctcctccacccagcccccagccccagccccagtgccccctgcagcccccacctcctccacccctgcccccacctcctcctcctcctggggccgcccggggccgctatgccagcagcggggccaccggccgggtgcgccaccggggctacagcgacacagagcgctacctgtactgccgggccatggacaggaccagctatgctgtggagaccggccaccggcccggcctgaagaagagcaggatgtcctggcccagcagcttccagggcctgcggagatttgatgtggacaatggcaccagcgctggccgcagccccctggaccccatgaccagccctggcagcggcctcatcctgcaggccaactttgtgcacagccagaggcgggagagcttcctgtacagaagtgacagcgactatgacctgagccccaagtccatgagcaggaacagcagcatcgccagtgacatccatggagatgacctgattgtgaccccatttgcccaggtgctggccagcctgaggacagtgaggaacaactttgctgccctgaccaacctgcaggaccgggcccccagcaagaggagccccatgtgcaaccagcccagcatcaacaaggccaccatcacagaggaggcctaccagaagctggccagcgagaccctggaggagctggactggtgcctggaccagctggagaccctgcagaccaggcacagcgtgtctgagatggccagcaacaagttcaagaggatgctgaaccgggagctgacccacctgtctgagatgagccgcagcggcaaccaggtgtctgagttcatcagcaacaccttcctggacaagcagcacgaggtggagatccccagccccacccagaaggagaaggagaagaagaagaggcccatgagccagatctctggagtgaagaagctgatgcacagcagcagcctgaccaacagcagcatcccccgcttcggcgtgaagacagagcaggaggatgtgctggccaaggagctggaggatgtgaacaagtggggcctgcacgtgttcagaattgctgagctgagcggcaaccggcccctgaccgtcatcatgcacaccatcttccaggagcgggacctgctgaagaccttcaagatccctgtggacaccctcatcacctacctgatgaccctggaggaccactaccacgcagatgtggcctaccacaacaacatccatgctgctgatgtggtgcagagcacccacgtgctgctgagcaccccagccctggaggccgtgttcacagacctggagatcctggccgccatctttgccagcgccatccatgatgtggaccaccctggggtgagcaaccagttcctgatcaacaccaacagcgagctggccctgatgtacaatgacagctctgtgctggagaaccaccacctggccgtgggcttcaagctgctgcaggaggagaactgtgacatcttccagaacctgaccaagaagcagaggcagagcctgaggaagatggtgattgatattgtgctggccacagacatgagcaagcacatgaacctgctggccgacctgaagaccatggtggagaccaagaaggtgaccagcagtggagtgctgctgctggacaactacagcgaccgcatccaggtgctgcagaacatggtgcactgtgccgacctgagcaaccccaccaagcccctgcagctgtaccggcagtggacagaccgcatcatggaggagttcttccggcagggcgaccgggagcgggagcggggcatggagatcagccccatgtgtgacaagcacaatgcctctgtggagaagagccaggtgggcttcatcgactacatcgtgcaccccctgtgggagacctgggccgacctggtgcacccagatgcccaggacatcctggacaccctggaggacaaccgggagtggtaccagagcaccatcccccagagccccagccctgccccagatgatcctgaggagggccggcagggccagacagagaagttccagtttgagctgaccctggaggaggatggagagagtgacacagagaaggacagcggcagccaggtggaggaggacaccagctgcagcgacagcaagaccctgtgcacccaggacagcgagagcacagagatccccctggatgagcaggtggaggaggaggccgtgggggaggaggaggagagccagcctgaggcctgtgtgattgatgacaggagcccagacacctag

SEQ ID NO: 163933 - DNA, 2037 bp, Artificial Sequence
  Description of Artificial Sequence: Synthetic coding sequence
atgttcatctacagcttcaacaagttcttcttcaagaccacccactgctgggccatcatcagctttgatgtggacaatggcaccagcgctggccgcagccccctggaccccatgaccagccctggcagcggcctcatcctgcaggccaactttgtgcacagccagaggcgggagagcttcctgtacagaagtgacagcgactatgacctgagccccaagtccatgagcaggaacagcagcatcgccagtgacatccatggagatgacctgattgtgaccccatttgcccaggtgctggccagcctgaggacagtgaggaacaactttgctgccctgaccaacctgcaggaccgggcccccagcaagaggagccccatgtgcaaccagcccagcatcaacaaggccaccatcacagaggaggcctaccagaagctggccagcgagaccctggaggagctggactggtgcctggaccagctggagaccctgcagaccaggcacagcgtgtctgagatggccagcaacaagttcaagaggatgctgaaccgggagctgacccacctgtctgagatgagccgcagcggcaaccaggtgtctgagttcatcagcaacaccttcctggacaagcagcacgaggtggagatccccagccccacccagaaggagaaggagaagaagaagaggcccatgagccagatcagcggcgtgaagaagctgatgcacagcagcagcctgaccaacagcagcatccccaggtttggagtgaagacagagcaggaggatgtgctggccaaggagctggaggatgtgaacaagtggggcctgcacgtgttcagaattgctgagctgagcggcaaccggcccctgaccgtcatcatgcacaccatcttccaggagcgggacctgctgaagaccttcaagatccctgtggacaccctcatcacctacctgatgaccctggaggaccactaccacgcagatgtggcctaccacaacaacatccacgccgcagatgtggtgcagagcacccacgtgctgctgagcaccccagccctggaggccgtgttcacagacctggagatcctggccgccatctttgccagcgccatccatgatgtggaccaccctggggtgagcaaccagttcctgatcaacaccaacagcgagctggccctgatgtacaatgacagctctgtgctggagaaccaccacctggccgtgggcttcaagctgctgcaggaggagaactgtgacatcttccagaacctgaccaagaagcagaggcagagcctgaggaagatggtgattgacatcgtgctggccacagacatgagcaagcacatgaacctgctggccgacctgaagaccatggtggagaccaagaaggtgaccagcagcggcgtgctgctgctggacaactacagcgaccgcatccaggtgctgcagaacatggtgcactgtgccgacctgagcaaccccaccaagcccctgcagctgtaccggcagtggacagaccgcatcatggaggagttcttccggcagggcgaccgggagcgggagcggggcatggagatcagccccatgtgtgacaagcacaatgcctctgtggagaagagccaggtgggcttcatcgactacatcgtgcaccccctgtgggagacctgggccgacctggtgcacccagatgcccaggacatcctggacaccctggaggacaaccgggagtggtaccagagcaccatcccccagagccccagccctgccccagatgatcctgaggagggccggcagggccagacagagaagttccagtttgagctgaccctggaggaggatggagagagtgacacagagaaggacagcggcagccaggtggaggaggacaccagctgcagcgacagcaagaccctgtgcacccaggacagcgagagcacagagatccccctggatgagcaggtggaggaggaggccgtgggggaggaggaggagagccagcctgaggcctgtgtgattgatgacaggagcccagacacctag

SEQ ID NO: 163934 - DNA, 1524 bp, Artificial Sequence
  Description of Artificial Sequence: Synthetic coding sequence
atggccagcaacaagttcaagaggatgctgaaccgggagctgacccacctgtctgagatgagccgcagcggcaaccaggtgtctgagttcatcagcaacaccttcctggacaagcagcacgaggtggagatccccagccccacccagaaggagaaggagaagaagaagaggcccatgagccagatctctggagtgaagaagctgatgcacagcagcagcctgaccaacagcagcatcccccgcttcggcgtgaagacagagcaggaggatgtgctggccaaggagctggaggatgtgaacaagtggggcctgcacgtgttcagaattgctgagctgagcggcaaccggcccctgaccgtcatcatgcacaccatcttccaggagcgggacctgctgaagaccttcaagatccctgtggacaccctcatcacctacctgatgaccctggaggaccactaccacgcagatgtggcctaccacaacaacatccatgctgctgatgtggtgcagagcacccacgtgctgctgagcaccccagccctggaggccgtgttcacagacctggagatcctggccgccatctttgccagcgccatccatgatgtggaccaccctggggtgagcaaccagttcctgatcaacaccaacagcgagctggccctgatgtacaatgacagctctgtgctggagaaccaccacctggccgtgggcttcaagctgctgcaggaggagaactgtgacatcttccagaacctgaccaagaagcagaggcagagcctgaggaagatggtgattgatattgtgctggccacagacatgagcaagcacatgaacctgctggccgacctgaagaccatggtggagaccaagaaggtgaccagcagtggagtgctgctgctggacaactacagcgaccgcatccaggtgctgcagaacatggtgcactgtgccgacctgagcaaccccaccaagcccctgcagctgtaccggcagtggacagaccgcatcatggaggagttcttccggcagggcgaccgggagcgggagcggggcatggagatcagccccatgtgtgacaagcacaatgcctctgtggagaagagccaggtgggcttcatcgactacatcgtgcaccccctgtgggagacctgggccgacctggtgcacccagatgcccaggacatcctggacaccctggaggacaaccgggagtggtaccagagcaccatcccccagagccccagccctgccccagatgatcctgaggagggccggcagggccagacagagaagttccagtttgagctgaccctggaggaggatggagagagtgacacagagaaggacagcggcagccaggtggaggaggacaccagctgcagcgacagcaagaccctgtgcacccaggacagcgagagcacagagatccccctggatgagcaggtggaggaggaggccgtgggggaggaggaggagagccagcctgaggcctgtgtgattgatgacaggagcccagacacctag

SEQ ID NO: 163935 - DNA, 2022 bp, Artificial Sequence
  Description of Artificial Sequence: Synthetic coding sequence
atgatgcacgtgaacaacttccccttccgccgccacagctggatctgctttgatgtggacaatggcaccagcgctggccgcagccccctggaccccatgaccagccctggcagcggcctcatcctgcaggccaactttgtgcacagccagaggcgggagagcttcctgtacagaagtgacagcgactatgacctgagccccaagtccatgagcaggaacagcagcatcgccagtgacatccatggagatgacctgattgtgaccccatttgcccaggtgctggccagcctgaggacagtgaggaacaactttgctgccctgaccaacctgcaggaccgggcccccagcaagaggagccccatgtgcaaccagcccagcatcaacaaggccaccatcacagaggaggcctaccagaagctggccagcgagaccctggaggagctggactggtgcctggaccagctggagaccctgcagaccaggcacagcgtgtctgagatggccagcaacaagttcaagaggatgctgaaccgggagctgacccacctgtctgagatgagccgcagcggcaaccaggtgtctgagttcatcagcaacaccttcctggacaagcagcacgaggtggagatccccagccccacccagaaggagaaggagaagaagaagaggcccatgagccagatctctggagtgaagaagctgatgcacagcagcagcctgaccaacagcagcatcccccgcttcggcgtgaagacagagcaggaggatgtgctggccaaggagctggaggatgtgaacaagtggggcctgcacgtgttcagaattgctgagctgagcggcaaccggcccctgaccgtcatcatgcacaccatcttccaggagcgggacctgctgaagaccttcaagatccctgtggacaccctcatcacctacctgatgaccctggaggaccactaccacgcagatgtggcctaccacaacaacatccatgctgctgatgtggtgcagagcacccacgtgctgctgagcaccccagccctggaggccgtgttcacagacctggagatcctggccgccatctttgccagcgccatccatgatgtggaccaccctggggtgagcaaccagttcctgatcaacaccaacagcgagctggccctgatgtacaatgacagctctgtgctggagaaccaccacctggccgtgggcttcaagctgctgcaggaggagaactgtgacatcttccagaacctgaccaagaagcagaggcagagcctgaggaagatggtgattgatattgtgctggccacagacatgagcaagcacatgaacctgctggccgacctgaagaccatggtggagaccaagaaggtgaccagcagtggagtgctgctgctggacaactacagcgaccgcatccaggtgctgcagaacatggtgcactgtgccgacctgagcaaccccaccaagcccctgcagctgtaccggcagtggacagaccgcatcatggaggagttcttccggcagggcgaccgggagcgggagcggggcatggagatcagccccatgtgtgacaagcacaatgcctctgtggagaagagccaggtgggcttcatcgactacatcgtgcaccccctgtgggagacctgggccgacctggtgcacccagatgcccaggacatcctggacaccctggaggacaaccgggagtggtaccagagcaccatcccccagagccccagccctgccccagatgatcctgaggagggccggcagggccagacagagaagttccagtttgagctgaccctggaggaggatggagagagtgacacagagaaggacagcggcagccaggtggaggaggacaccagctgcagcgacagcaagaccctgtgcacccaggacagcgagagcacagagatccccctggatgagcaggtggaggaggaggccgtgggggaggaggaggagagccagcctgaggcctgtgtgattgatgacaggagcccagacacctag

SEQ ID NO: 163936 - DNA, 2064 bp, Artificial Sequence
  Description of Artificial Sequence: Synthetic coding sequence
atggcctttgtgtgggaccccctgggcgccaccgtgcccggccccagcacccgggccaagagccggctgcgcttcagcaagagctacagctttgatgtggacaatggcaccagcgctggccgcagccccctggaccccatgaccagccctggcagcggcctcatcctgcaggccaactttgtgcacagccagaggcgggagagcttcctgtacagaagtgacagcgactatgacctgagccccaagtccatgagcaggaacagcagcatcgccagtgacatccatggagatgacctgattgtgaccccatttgcccaggtgctggccagcctgaggacagtgaggaacaactttgctgccctgaccaacctgcaggaccgggcccccagcaagaggagccccatgtgcaaccagcccagcatcaacaaggccaccatcacagaggaggcctaccagaagctggccagcgagaccctggaggagctggactggtgcctggaccagctggagaccctgcagaccaggcacagcgtgtctgagatggccagcaacaagttcaagaggatgctgaaccgggagctgacccacctgtctgagatgagccgcagcggcaaccaggtgtctgagttcatcagcaacaccttcctggacaagcagcacgaggtggagatccccagccccacccagaaggagaaggagaagaagaagaggcccatgagccagatctctggagtgaagaagctgatgcacagcagcagcctgaccaacagcagcatcccccgcttcggcgtgaagacagagcaggaggatgtgctggccaaggagctggaggatgtgaacaagtggggcctgcacgtgttcagaattgctgagctgagcggcaaccggcccctgaccgtcatcatgcacaccatcttccaggagcgggacctgctgaagaccttcaagatccctgtggacaccctcatcacctacctgatgaccctggaggaccactaccacgcagatgtggcctaccacaacaacatccatgctgctgatgtggtgcagagcacccacgtgctgctgagcaccccagccctggaggccgtgttcacagacctggagatcctggccgccatctttgccagcgccatccatgatgtggaccaccctggggtgagcaaccagttcctgatcaacaccaacagcgagctggccctgatgtacaatgacagctctgtgctggagaaccaccacctggccgtgggcttcaagctgctgcaggaggagaactgtgacatcttccagaacctgaccaagaagcagaggcagagcctgaggaagatggtgattgatattgtgctggccacagacatgagcaagcacatgaacctgctggccgacctgaagaccatggtggagaccaagaaggtgaccagcagtggagtgctgctgctggacaactacagcgaccgcatccaggtgctgcagaacatggtgcactgtgccgacctgagcaaccccaccaagcccctgcagctgtaccggcagtggacagaccgcatcatggaggagttcttccggcagggcgaccgggagcgggagcggggcatggagatcagccccatgtgtgacaagcacaatgcctctgtggagaagagccaggtgggcttcatcgactacatcgtgcaccccctgtgggagacctgggccgacctggtgcacccagatgcccaggacatcctggacaccctggaggacaaccgggagtggtaccagagcaccatcccccagagccccagccctgccccagatgatcctgaggagggccggcagggccagacagagaagttccagtttgagctgaccctggaggaggatggagagagtgacacagagaaggacagcggcagccaggtggaggaggacaccagctgcagcgacagcaagaccctgtgcacccaggacagcgagagcacagagatccccctggatgagcaggtggaggaggaggccgtgggggaggaggaggagagccagcctgaggcctgtgtgattgatgacaggagcccagacacctag

SEQ ID NO: 163937 - DNA, 2247 bp, Artificial Sequence
  Description of Artificial Sequence: Synthetic coding sequence
atgaagaggaacacctgtgacctgctgagccgcagcaagagcgccagcgaggagaccctgcacagcagcaatgaggaggaggaccccttccggggcatggagccctacctggtgcggcggctgagctgcaggaacatccagctgccccccctggccttccggcagctggagcaggccgacctgaagtctgagagcgagaacatccagaggcccaccagcctgcccctgaagatcctgcccctcatcgccatcaccagcgctgagagcagcggctttgatgtggacaatggcaccagcgctggccgcagccccctggaccccatgaccagccctggcagcggcctcatcctgcaggccaactttgtgcacagccagaggcgggagagcttcctgtacagaagtgacagcgactatgacctgagccccaagtccatgagcaggaacagcagcatcgccagtgacatccatggagatgacctgattgtgaccccatttgcccaggtgctggccagcctgaggacagtgaggaacaactttgctgccctgaccaacctgcaggaccgggcccccagcaagaggagccccatgtgcaaccagcccagcatcaacaaggccaccatcacagaggaggcctaccagaagctggccagcgagaccctggaggagctggactggtgcctggaccagctggagaccctgcagaccaggcacagcgtgtctgagatggccagcaacaagttcaagaggatgctgaaccgggagctgacccacctgtctgagatgagccgcagcggcaaccaggtgtctgagttcatcagcaacaccttcctggacaagcagcacgaggtggagatccccagccccacccagaaggagaaggagaagaagaagaggcccatgagccagatcagcggcgtgaagaagctgatgcacagcagcagcctgaccaacagcagcatccccaggtttggagtgaagacagagcaggaggatgtgctggccaaggagctggaggatgtgaacaagtggggcctgcacgtgttcagaattgctgagctgagcggcaaccggcccctgaccgtcatcatgcacaccatcttccaggagcgggacctgctgaagaccttcaagatccctgtggacaccctcatcacctacctgatgaccctggaggaccactaccacgcagatgtggcctaccacaacaacatccacgccgcagatgtggtgcagagcacccacgtgctgctgagcaccccagccctggaggccgtgttcacagacctggagatcctggccgccatctttgccagcgccatccatgatgtggaccaccctggggtgagcaaccagttcctgatcaacaccaacagcgagctggccctgatgtacaatgacagctctgtgctggagaaccaccacctggccgtgggcttcaagctgctgcaggaggagaactgtgacatcttccagaacctgaccaagaagcagaggcagagcctgaggaagatggtgattgacatcgtgctggccacagacatgagcaagcacatgaacctgctggccgacctgaagaccatggtggagaccaagaaggtgaccagcagcggcgtgctgctgctggacaactacagcgaccgcatccaggtgctgcagaacatggtgcactgtgccgacctgagcaaccccaccaagcccctgcagctgtaccggcagtggacagaccgcatcatggaggagttcttccggcagggcgaccgggagcgggagcggggcatggagatcagccccatgtgtgacaagcacaatgcctctgtggagaagagccaggtgggcttcatcgactacatcgtgcaccccctgtgggagacctgggccgacctggtgcacccagatgcccaggacatcctggacaccctggaggacaaccgggagtggtaccagagcaccatcccccagagccccagccctgccccagatgatcctgaggagggccggcagggccagacagagaagttccagtttgagctgaccctggaggaggatggagagagtgacacagagaaggacagcggcagccaggtggaggaggacaccagctgcagcgacagcaagaccctgtgcacccaggacagcgagagcacagagatccccctggatgagcaggtggaggaggaggccgtgggggaggaggaggagagccagcctgaggcctgtgtgattgatgacaggagcccagacacctag

SEQ ID NO: 163938 - DNA, 660 bp, Artificial Sequence
  Description of Artificial Sequence: Synthetic coding sequence
atggcccagcagaccagcccagacaccctgactgtgcctgaggtggacaacccccactgccccaacccctggctgaatgaagacctggtgaagagcctgcgggagaacctgctgcagcacgagaagagcaagacagccaggaagtctgtgagccccaagctgagccctgtgatcagccccaggaacagcccccggctgctgcggaggatgctgctgagcagcaacatccccaagcagaggcgcttcaccgtggcccacacctgctttgatgtggacaatggcaccagcgctggccgcagccccctggaccccatgaccagccctggcagcggcctcatcctgcaggccaactttgtgcacagccagaggcgggagagcttcctgtacagaagtgacagcgactatgacctgagccccaagtccatgagcaggaacagcagcatcgccagtgacatccatggagatgacctgattgtgaccccatttgcccaggtgctggccagcctgaggacagtgaggaacaactttgctgccctgaccaacctgcaggaccgggcccccagcaagaggagccccatgtgcaaccagcccagcatcaacaaggccaccatcaccggctcctggatggagctgaacccctacaccctgctggacatgtag

SEQ ID NO: 163939 - DNA, 2040 bp, Artificial Sequence
  Description of Artificial Sequence: Synthetic coding sequence
atgagcatcatcatgaagcccaggagccgcagcaccagcagcctgaggacagctgaggccgtgtgctttgatgtggacaatggcaccagcgctggccgcagccccctggaccccatgaccagccctggcagcggcctcatcctgcaggccaactttgtgcacagccagaggcgggagagcttcctgtacagaagtgacagcgactatgacctgagccccaagtccatgagcaggaacagcagcatcgccagtgacatccatggagatgacctgattgtgaccccatttgcccaggtgctggccagcctgaggacagtgaggaacaactttgctgccctgaccaacctgcaggaccgggcccccagcaagaggagccccatgtgcaaccagcccagcatcaacaaggccaccatcacagaggaggcctaccagaagctggccagcgagaccctggaggagctggactggtgcctggaccagctggagaccctgcagaccaggcacagcgtgtctgagatggccagcaacaagttcaagaggatgctgaaccgggagctgacccacctgtctgagatgagccgcagcggcaaccaggtgtctgagttcatcagcaacaccttcctggacaagcagcacgaggtggagatccccagccccacccagaaggagaaggagaagaagaagaggcccatgagccagatctctggagtgaagaagctgatgcacagcagcagcctgaccaacagcagcatcccccgcttcggcgtgaagacagagcaggaggatgtgctggccaaggagctggaggatgtgaacaagtggggcctgcacgtgttcagaattgctgagctgagcggcaaccggcccctgaccgtcatcatgcacaccatcttccaggagcgggacctgctgaagaccttcaagatccctgtggacaccctcatcacctacctgatgaccctggaggaccactaccacgcagatgtggcctaccacaacaacatccatgctgctgatgtggtgcagagcacccacgtgctgctgagcaccccagccctggaggccgtgttcacagacctggagatcctggccgccatctttgccagcgccatccatgatgtggaccaccctggggtgagcaaccagttcctgatcaacaccaacagcgagctggccctgatgtacaatgacagctctgtgctggagaaccaccacctggccgtgggcttcaagctgctgcaggaggagaactgtgacatcttccagaacctgaccaagaagcagaggcagagcctgaggaagatggtgattgatattgtgctggccacagacatgagcaagcacatgaacctgctggccgacctgaagaccatggtggagaccaagaaggtgaccagcagtggagtgctgctgctggacaactacagcgaccgcatccaggtgctgcagaacatggtgcactgtgccgacctgagcaaccccaccaagcccctgcagctgtaccggcagtggacagaccgcatcatggaggagttcttccggcagggcgaccgggagcgggagcggggcatggagatcagccccatgtgtgacaagcacaatgcctctgtggagaagagccaggtgggcttcatcgactacatcgtgcaccccctgtgggagacctgggccgacctggtgcacccagatgcccaggacatcctggacaccctggaggacaaccgggagtggtaccagagcaccatcccccagagccccagccctgccccagatgatcctgaggagggccggcagggccagacagagaagttccagtttgagctgaccctggaggaggatggagagagtgacacagagaaggacagcggcagccaggtggaggaggacaccagctgcagcgacagcaagaccctgtgcacccaggacagcgagagcacagagatccccctggatgagcaggtggaggaggaggccgtgggggaggaggaggagagccagcctgaggcctgtgtgattgatgacaggagcccagacacctag

SEQ ID NO: 163940 - DNA, 1269 bp, Artificial Sequence
  Description of Artificial Sequence: Synthetic coding sequence
atggccagcaacaagttcaagaggatgctgaaccgggagctgacccacctgtctgagatgagccgcagcggcaaccaggtgtctgagttcatcagcaacaccttcctggacaagcagcacgaggtggagatccccagccccacccagaaggagaaggagaagaagaagaggcccatgagccagatctctggagtgaagaagctgatgcacagcagcagcctgaccaacagcagcatcccccgcttcggcgtgaagacagagcaggaggatgtgctggccaaggagctggaggatgtgaacaagtggggcctgcacgtgttcagaattgctgagctgagcggcaaccggcccctgaccgtcatcatgcacaccatcttccaggagcgggacctgctgaagaccttcaagatccctgtggacaccctcatcacctacctgatgaccctggaggaccactaccacgcagatgtggcctaccacaacaacatccatgctgctgatgtggtgcagagcacccacgtgctgctgagcaccccagccctggaggccgtgttcacagacctggagatcctggccgccatctttgccagcgccatccatgatgtggaccaccctggggtgagcaaccagttcctgatcaacaccaacagcgagctggccctgatgtacaatgacagctctgtgctggagaaccaccacctggccgtgggcttcaagctgctgcaggaggagaactgtgacatcttccagaacctgaccaagaagcagaggcagagcctgaggaagatggtgattgatattgtgctggccacagacatgagcaagcacatgaacctgctggccgacctgaagaccatggtggagaccaagaaggtgaccagcagtggagtgctgctgctggacaactacagcgaccgcatccaggtgctgcagaacatggtgcactgtgccgacctgagcaaccccaccaagcccctgcagctgtaccggcagtggacagaccgcatcatggaggagttcttccggcagggcgaccgggagcgggagcggggcatggagatcagccccatgtgtgacaagcacaatgcctctgtggagaagagccaggtgggcttcatcgactacatcgtgcaccccctgtgggagacctgggccgacctggtgcacccagatgcccaggacatcctggacaccctggaggacaaccgggagtggtaccagagcaccatcccccagagccccagccctgccccagatgatcctgagtag

SEQ ID NO: 163941 - DNA, 246 bp, Artificial Sequence
  Description of Artificial Sequence: Synthetic coding sequence
atgaagaggaacacctgtgacctgctgagccgcagcaagagcgccagcgaggagaccctgcacagcagcaatgaggaggaggaccccttccggggcatggagccctacctggtgcggcggctgagctgcaggaacatccagctgccccccctggccttccggcagctggagcaggccgacctgaagtctgagagcgagaacatccagaggcccaccagcctgcccctgaagatcctgcccctgtag

SEQ ID NO: 163942 - DNA, 2238 bp, Artificial Sequence
  Description of Artificial Sequence: Synthetic coding sequence
atggcccagcagaccagcccagacaccctgactgtgcctgaggtggacaacccccactgccccaacccctggctgaatgaagacctggtgaagagcctgcgggagaacctgctgcagcacgagaagagcaagacagccaggaagtctgtgagccccaagctgagccctgtgatcagccccaggaacagcccccggctgctgcggaggatgctgctgagcagcaacatccccaagcagaggcgcttcaccgtggcccacacctgctttgatgtggacaatggcaccagcgctggccgcagccccctggaccccatgaccagccctggcagcggcctcatcctgcaggccaactttgtgcacagccagaggcgggagagcttcctgtacagaagtgacagcgactatgacctgagccccaagtccatgagcaggaacagcagcatcgccagtgacatccatggagatgacctgattgtgaccccatttgcccaggtgctggccagcctgaggacagtgaggaacaactttgctgccctgaccaacctgcaggaccgggcccccagcaagaggagccccatgtgcaaccagcccagcatcaacaaggccaccatcacagaggaggcctaccagaagctggccagcgagaccctggaggagctggactggtgcctggaccagctggagaccctgcagaccaggcacagcgtgtctgagatggccagcaacaagttcaagaggatgctgaaccgggagctgacccacctgtctgagatgagccgcagcggcaaccaggtgtctgagttcatcagcaacaccttcctggacaagcagcacgaggtggagatccccagccccacccagaaggagaaggagaagaagaagaggcccatgagccagatctctggagtgaagaagctgatgcacagcagcagcctgaccaacagcagcatcccccgcttcggcgtgaagacagagcaggaggatgtgctggccaaggagctggaggatgtgaacaagtggggcctgcacgtgttcagaattgctgagctgagcggcaaccggcccctgaccgtcatcatgcacaccatcttccaggagcgggacctgctgaagaccttcaagatccctgtggacaccctcatcacctacctgatgaccctggaggaccactaccacgcagatgtggcctaccacaacaacatccatgctgctgatgtggtgcagagcacccacgtgctgctgagcaccccagccctggaggccgtgttcacagacctggagatcctggccgccatctttgccagcgccatccatgatgtggaccaccctggggtgagcaaccagttcctgatcaacaccaacagcgagctggccctgatgtacaatgacagctctgtgctggagaaccaccacctggccgtgggcttcaagctgctgcaggaggagaactgtgacatcttccagaacctgaccaagaagcagaggcagagcctgaggaagatggtgattgatattgtgctggccacagacatgagcaagcacatgaacctgctggccgacctgaagaccatggtggagaccaagaaggtgaccagcagtggagtgctgctgctggacaactacagcgaccgcatccaggtgctgcagaacatggtgcactgtgccgacctgagcaaccccaccaagcccctgcagctgtaccggcagtggacagaccgcatcatggaggagttcttccggcagggcgaccgggagcgggagcggggcatggagatcagccccatgtgtgacaagcacaatgcctctgtggagaagagccaggtgggcttcatcgactacatcgtgcaccccctgtgggagacctgggccgacctggtgcacccagatgcccaggacatcctggacaccctggaggacaaccgggagtggtaccagagcaccatcccccagagccccagccctgccccagatgatcctgaggagggccggcagggccagacagagaagttccagtttgagctgaccctggaggaggatggagagagtgacacagagaaggacagcggcagccaggtggaggaggacaccagctgcagcgacagcaagaccctgtgcacccaggacagcgagagcacagagatccccctggatgagcaggtggaggaggaggccgtgggggaggaggaggagagccagcctgaggcctgtgtgattgatgacaggagcccagacacctag

SEQ ID NO: 163943 - DNA, 228 bp, Artificial Sequence
  Description of Artificial Sequence: Synthetic coding sequence
atgaagaggaacacctgtgacctgctgagccgcagcaagagcgccagcgaggagaccctgcacagcagcaatgaggaggaggaccccttccggggcatggagccctacctggtgcggcggctgagctgcaggaacatccagctgccccccctggccttccggcagctggagcaggccgacctgaagtctgagagcgagaacatccagaggcccaccagcctgccctag

SEQ ID NO: 163944 - DNA, 2247 bp, Artificial Sequence; identical to SEQ ID NO: 163937
  Description of Artificial Sequence: Synthetic coding sequence

SEQ ID NO: 163945 - DNA, 2502 bp, Artificial Sequence
  Description of Artificial Sequence: Synthetic coding sequence
atgctgccctttggagacaagacccgggagatggtgaatgcctggtttgctgagcgggtgcacaccatccctgtgtgcaaggagggcatccggggccacacagagagctgcagctgccccctgcagcagagccccagggctgacaacagcgcccctggcacccccaccaggaagatcagcgccagcgagtttgaccggcccctgcggcccatcgtggtgaaggacagcgagggcaccgtgtccttcctgagtgacagcgagaagaaggagcagatgcccctgaccccacccaggtttgaccatgatgaaggagaccagtgcagccggctgctggagctggtgaaggacatcagcagccacctggatgtgacagccctgtgccacaagatcttcctgcacatccacggcctcatctctgctgaccgctacagcctcttcctggtgtgtgaggacagcagcaatgacaagttcctgatcagccggctgtttgatgtggccgagggcagcaccctggaggaggtgagcaacaactgcatccggctggagtggaacaagggcatcgtgggccacgtggccgccctgggggagcccctgaacatcaaggatgcctatgaggacccccgcttcaatgctgaggtggaccagatcaccggctacaagacccagagcatcctgtgcatgcccatcaagaaccaccgggaggaggtggtgggcgtggcccaggccatcaacaagaagtctggaaatggaggcaccttcacagagaaggatgagaaggactttgctgcctacctggccttctgtggcatcgtgctgcacaatgcccagctgtatgagaccagcctgctggagaacaagaggaaccaggtgctgctggacctggccagcctcatctttgaggagcagcagagcctggaggtgatcctgaagaagattgctgccaccatcatctccttcatgcaggtgcagaagtgcaccatcttcatcgtggatgaggactgcagcgacagcttcagcagcgtcttccacatggagtgtgaggagctggagaagagcagtgacaccctgacccgggagcatgatgccaacaagatcaactacatgtatgcccagtatgtgaagaacaccatggagcccctgaacatcccagatgtgtccaaggacaagcgcttcccctggaccacagagaacacaggaaatgtgaaccagcagtgcatccgcagcctgctgtgcacccccatcaagaatggcaagaagaacaaggtgattggagtgtgccagctggtgaacaagatggaggagaacacaggcaaggtgaagcccttcaacagaaatgatgagcagttcctggaggcctttgtgatcttctgtggcctgggcatccagaacacccagatgtatgaagctgtggagcgggccatggccaagcagatggtgaccctggaggtgctgagctaccacgccagcgctgctgaggaggagacccgggagctgcagagcctggccgctgctgtggtgcccagcgcccagaccctgaagatcacagacttctccttcagtgactttgagctgagtgacctggagacagccctgtgcaccatccgcatgttcacagacctgaacctggtgcagaacttccagatgaagcatgaggtgctgtgccgctggatcctgtctgtgaagaagaactacaggaagaatgtggcctaccacaactggaggcatgccttcaacacagcccagtgcatgtttgctgccctgaaggccggcaagatccagaacaagctgacagacctggagatcctggccctgctgattgctgccctgagccatgacctggaccacagaggagtgaacaacagctacatccagaggtctgagcaccccctggcccagctgtactgccacagcatcatggagcaccaccactttgaccagtgcctgatgatcctgaacagccctggcaaccagatcctgagcggcctgagcattgaggagtacaagaccaccctgaagatcatcaagcaggccatcctggccacagacctggccctgtacatcaagagaagaggagagttctttgagctgatcaggaagaaccagttcaacctggaggacccccaccagaaggagctgttcctggccatgctgatgacagcctgtgacctgagcgccatcaccaagccctggcccatccagcagagaattgctgagctggtggccacagagttctttgaccagggcgaccgggagaggaaggagctgaacatcgagcccacagacctgatgaaccgggagaagaagaacaagatccccagcatgcaggtgggcttcattgatgccatctgcctgcagctgtatgaggccctgacccacgtgtctgaggactgcttccccctgctggatggctgcaggaagaaccggcagaagtggcaggccctggccgagcagcaggagaagatgctgatcaacggggagagcggccaggccaagaggaactag

SEQ ID NO: 163946 - DNA, 2628 bp, Artificial Sequence
  Description of Artificial Sequence: Synthetic coding sequence
atggagcgggccggccccagctttggccagcagaggcagcagcagcagccccagcagcagaagcagcagcagagggaccaggacagcgtggaggcctggctggatgaccactgggacttcaccttctcctactttgtgaggaaggccacccgggagatggtgaatgcctggtttgctgagcgggtgcacaccatccctgtgtgcaaggagggcatccggggccacacagagagctgcagctgccccctgcagcagagccccagggctgacaacagcgcccctggcacccccaccaggaagatcagcgccagcgagtttgaccggcccctgcggcccatcgtggtgaaggacagcgagggcaccgtgtccttcctgagtgacagcgagaagaaggagcagatgcccctgaccccacccaggtttgaccatgatgaaggagaccagtgcagccggctgctggagctggtgaaggacatcagcagccacctggatgtgacagccctgtgccacaagatcttcctgcacatccacggcctcatctctgctgaccgctacagcctcttcctggtgtgtgaggacagcagcaatgacaagttcctgatcagccggctgtttgatgtggccgagggcagcaccctggaggaggtgagcaacaactgcatccggctggagtggaacaagggcatcgtgggccacgtggccgccctgggggagcccctgaacatcaaggatgcctatgaggacccccgcttcaatgctgaggtggaccagatcaccggctacaagacccagagcatcctgtgcatgcccatcaagaaccaccgggaggaggtggtgggcgtggcccaggccatcaacaagaagtctggaaatggaggcaccttcacagagaaggatgagaaggactttgctgcctacctggccttctgtggcatcgtgctgcacaatgcccagctgtatgagaccagcctgctggagaacaagaggaaccaggtgctgctggacctggccagcctcatctttgaggagcagcagagcctggaggtgatcctgaagaagattgctgccaccatcatctccttcatgcaggtgcagaagtgcaccatcttcatcgtggatgaggactgcagcgacagcttcagcagcgtcttccacatggagtgtgaggagctggagaagagcagtgacaccctgacccgggagcatgatgccaacaagatcaactacatgtatgcccagtatgtgaagaacaccatggagcccctgaacatcccagatgtgtccaaggacaagcgcttcccctggaccacagagaacacaggaaatgtgaaccagcagtgcatccgcagcctgctgtgcacccccatcaagaatggcaagaagaacaaggtgattggagtgtgccagctggtgaacaagatggaggagaacacaggcaaggtgaagcccttcaacagaaatgatgagcagttcctggaggcctttgtgatcttctgtggcctgggcatccagaacacccagatgtatgaagctgtggagcgggccatggccaagcagatggtgaccctggaggtgctgagctaccacgccagcgctgctgaggaggagacccgggagctgcagagcctggccgctgctgtggtgcccagcgcccagaccctgaagatcacagacttctccttcagtgactttgagctgagtgacctggagacagccctgtgcaccatccgcatgttcacagacctgaacctggtgcagaacttccagatgaagcatgaggtgctgtgccgctggatcctgtctgtgaagaagaactacaggaagaatgtggcctaccacaactggaggcatgccttcaacacagcccagtgcatgtttgctgccctgaaggccggcaagatccagaacaagctgacagacctggagatcctggccctgctgattgctgccctgagccatgacctggaccacagaggagtgaacaacagctacatccagaggtctgagcaccccctggcccagctgtactgccacagcatcatggagcaccaccactttgaccagtgcctgatgatcctgaacagccctggcaaccagatcctgagcggcctgagcattgaggagtacaagaccaccctgaagatcatcaagcaggccatcctggccacagacctggccctgtacatcaagagaagaggagagttctttgagctgatcaggaagaaccagttcaacctggaggacccccaccagaaggagctgttcctggccatgctgatgacagcctgtgacctgagcgccatcaccaagccctggcccatccagcagagaattgctgagctggtggccacagagttctttgaccagggcgaccgggagaggaaggagctgaacatcgagcccacagacctgatgaaccgggagaagaagaacaagatccccagcatgcaggtgggcttcattgatgccatctgcctgcagctgtatgaggccctgacccacgtgtctgaggactgcttccccctgctggatggctgcaggaagaaccggcagaagtggcaggccctggccgagcagcaggagaagatgctgatcaacggggagagcggccaggccaagaggaactag

SEQ ID NO: 163947 - DNA, 2472 bp, Artificial Sequence
  Description of Artificial Sequence: Synthetic coding sequence
atggtgaatgcctggtttgctgagcgggtgcacaccatccctgtgtgcaaggagggcatccggggccacacagagagctgcagctgccccctgcagcagagccccagggctgacaacagcgcccctggcacccccaccaggaagatcagcgccagcgagtttgaccggcccctgcggcccatcgtggtgaaggacagcgagggcaccgtgtccttcctgagtgacagcgagaagaaggagcagatgcccctgaccccacccaggtttgaccatgatgaaggagaccagtgcagccggctgctggagctggtgaaggacatcagcagccacctggatgtgacagccctgtgccacaagatcttcctgcacatccacggcctcatctctgctgaccgctacagcctcttcctggtgtgtgaggacagcagcaatgacaagttcctgatcagccggctgtttgatgtggccgagggcagcaccctggaggaggtgagcaacaactgcatccggctggagtggaacaagggcatcgtgggccacgtggccgccctgggggagcccctgaacatcaaggatgcctatgaggacccccgcttcaatgctgaggtggaccagatcaccggctacaagacccagagcatcctgtgcatgcccatcaagaaccaccgggaggaggtggtgggcgtggcccaggccatcaacaagaagtctggaaatggaggcaccttcacagagaaggatgagaaggactttgctgcctacctggccttctgtggcatcgtgctgcacaatgcccagctgtatgagaccagcctgctggagaacaagaggaaccaggtgctgctggacctggccagcctcatctttgaggagcagcagagcctggaggtgatcctgaagaagattgctgccaccatcatctccttcatgcaggtgcagaagtgcaccatcttcatcgtggatgaggactgcagcgacagcttcagcagcgtcttccacatggagtgtgaggagctggagaagagcagtgacaccctgacccgggagcatgatgccaacaagatcaactacatgtatgcccagtatgtgaagaacaccatggagcccctgaacatcccagatgtgtccaaggacaagcgcttcccctggaccacagagaacacaggaaatgtgaaccagcagtgcatccgcagcctgctgtgcacccccatcaagaatggcaagaagaacaaggtgattggagtgtgccagctggtgaacaagatggaggagaacacaggcaaggtgaagcccttcaacagaaatgatgagcagttcctggaggcctttgtgatcttctgtggcctgggcatccagaacacccagatgtatgaagctgtggagcgggccatggccaagcagatggtgaccctggaggtgctgagctaccacgccagcgctgctgaggaggagacccgggagctgcagagcctggccgctgctgtggtgcccagcgcccagaccctgaagatcacagacttctccttcagtgactttgagctgagtgacctggagacagccctgtgcaccatccgcatgttcacagacctgaacctggtgcagaacttccagatgaagcatgaggtgctgtgccgctggatcctgtctgtgaagaagaactacaggaagaatgtggcctaccacaactggaggcatgccttcaacacagcccagtgcatgtttgctgccctgaaggccggcaagatccagaacaagctgacagacctggagatcctggccctgctgattgctgccctgagccatgacctggaccacagaggagtgaacaacagctacatccagaggtctgagcaccccctggcccagctgtactgccacagcatcatggagcaccaccactttgaccagtgcctgatgatcctgaacagccctggcaaccagatcctgagcggcctgagcattgaggagtacaagaccaccctgaagatcatcaagcaggccatcctggccacagacctggccctgtacatcaagagaagaggagagttctttgagctgatcaggaagaaccagttcaacctggaggacccccaccagaaggagctgttcctggccatgctgatgacagcctgtgacctgagcgccatcaccaagccctggcccatccagcagagaattgctgagctggtggccacagagttctttgaccagggcgaccgggagaggaaggagctgaacatcgagcccacagacctgatgaaccgggagaagaagaacaagatccccagcatgcaggtgggcttcattgatgccatctgcctgcagctgtatgaggccctgacccacgtgtctgaggactgcttccccctgctggatggctgcaggaagaaccggcagaagtggcaggccctggccgagcagcaggagaagatgctgatcaacggggagagcggccaggccaagaggaactag

SEQ ID NO: 163948 - DNA, 2583 bp, Artificial Sequence
  Description of Artificial Sequence: Synthetic coding sequence
atgggagaggtgacagctgaggaggtggagaagttcctggacagcaacattggatttgccaagcagtactacaacctgcactaccgggccaagctgatcagtgacctgctgggcgccaaggaggccgctgtggacttcagcaactaccacagccccagctccatggaggagagcgagatcatctttgacctgctgcgggacttccaggagaacctgcagacagagaagtgcatcttcaacgtgatgaagaagctgtgcttcctgctgcaggccgacaggatgagcctcttcatgtaccgcaccagaaatggaattgctgagctggccaccaggctcttcaacgtgcacaaggatgctgtgctggaggactgcctggtgatgccagaccaggagatcgtgttccccctggacatgggcatcgtgggccacgtggcccacagcaagaagatcgccaacgtgcccaacacagaggaggatgagcacttctgtgactttgtggacatcctgacagagtacaagaccaagaacatcctggccagccccatcatgaatggcaaggatgtggtggccatcatcatggctgtgaacaaggtggatggcagccacttcaccaagagagatgaggagatcctgctgaagtacctgaactttgccaacctgatcatgaaggtgtaccacctgagctacctgcacaactgtgagacccggcggggccagatcctgctgtggagcggcagcaaggtgtttgaggagctgacagacatcgagcggcagttccacaaggccctgtacacagtgcgggccttcctgaactgtgaccgctacagcgtgggcctgctggacatgaccaagcagaaggagttctttgatgtgtggcctgtgctgatgggagaggtgcccccctacagcggccccaggaccccagatggccgggagatcaacttctacaaggtgattgactacatcctgcacggcaaggaggacatcaaggtgatccccaaccccccaccagaccactgggccctggtgtctggcctgcctgcctacgtggcccagaatggcctcatctgcaacatcatgaatgccccagctgaggacttctttgccttccagaaggagcccctggatgagagcggctggatgatcaagaatgtgctgtccatgcccatcgtgaacaagaaggaggagatcgtgggcgtggccaccttctacaacaggaaggatggcaagccctttgatgagatggatgagaccctgatggagagcctgacccagttcctgggctggagcgtgctgaacccagacacctatgaatccatgaacaagctggagaacaggaaggacatcttccaggacatcgtgaagtaccacgtgaagtgtgacaatgaggagatccagaagatcctgaagacccgggaggtgtatggcaaggagccctgggagtgtgaggaggaggagctggccgagatcctgcaggccgagctgcctgatgctgacaagtatgagatcaacaagttccacttcagtgacctgcccctgacagagctggagctggtgaagtgtggcatccagatgtactatgagctgaaggtggtggacaagttccacatcccccaggaggccctggtgcgcttcatgtacagcctgagcaagggctacaggaagatcacctaccacaactggaggcatggcttcaacgtgggccagaccatgttcagcctgctggtgacaggcaagctgaagcgctacttcacagacctggaggccctggccatggtgacagctgccttctgccacgacatcgaccaccggggcaccaacaacctgtaccagatgaagagccagaaccccctggccaagctgcacggcagcagcatcctggagcggcaccacctggagtttgggaagaccctgctgagagatgagagcctgaacatcttccagaacctgaacagacggcagcatgaacatgccatccacatgatggacatcgccatcatcgccacagacctggccctgtacttcaagaagaggaccatgttccagaagatcgtggaccagagcaagacctatgaaagtgagcaggagtggacccagtacatgatgctggagcagaccaggaaggagatcgtgatggccatgatgatgacagcctgtgacctgagcgccatcaccaagccctgggaggtgcagagccaggtggccctgctggtggccgctgagttctgggagcagggcgacctggagaggacagtgctgcagcagaaccccatccccatgatggacaggaacaaggcagatgagctgcccaagctgcaggtgggcttcatcgactttgtgtgcacctttgtgtacaaggagttcagccgcttccacgaggagatcacccccatgctggatggcatcaccaacaacaggaaggagtggaaggccctggctgatgaatatgatgccaagatgaaggtgcaggaggagaagaagcagaagcagcagagcgccaagtctgctgctgctggcaaccagcccggcggcaaccccagccctgggggcgccaccaccagcaagagctgctgcatccagtag

SEQ ID NO: 163949 - DNA, 1728 bp, Artificial Sequence
  Description of Artificial Sequence: Synthetic coding sequence
atgaccaaggagaaggagttctttgatgtgtggagcgtgctgatgggagagagccagccctacagcggccccaggaccccagatggccgggagatcgtgttctacaaggtgattgattatgtgctgcacggcaaggaggagatcaaggtgatccccaccccatctgctgaccactgggccctggccagcggcctgcccagctatgtggccgagagcggcttcatctgcaacatcatgaatgccagcgcagatgagatgttcaagttccaggagggcgccctggatgattctggctggctgatcaagaatgtgctgtccatgcccatcgtgaacaagaaggaggagatcgtgggcgtggccaccttctacaacaggaaggatggcaagccctttgatgagcaggatgaggtgctgatggagagcctgacccagttcctgggctggagcgtgatgaacacagacacctatgacaagatgaacaagctggagaacaggaaggacatcgcccaggacatggtgctgtaccacgtgaagtgtgacagagatgagatccagctgatcctgcccacccgggcccggctgggcaaggagcctgctgactgtgatgaagatgagctgggggagatcctgaaggaggagctgcccggccccaccacctttgacatctatgagttccacttcagtgacctggagtgcacagagctggacctggtgaagtgtggcatccagatgtactatgagctgggcgtggtgaggaagttccagatcccccaggaggtgctggtgcgcttcctgttcagcatcagcaagggctaccgccgcatcacctaccacaactggaggcatggcttcaacgtggcccagaccatgttcaccctgctgatgaccgggaagctgaagagctactacacagacctggaggcctttgccatggtgacagctggcctgtgccacgacatcgaccaccggggcaccaacaacctgtaccagatgaagagccagaaccccctggccaagctgcacggcagcagcatcctggagcggcaccacctggagtttgggaagttcctgctgtctgaggagaccctgaacatctaccagaacctgaacagacggcagcacgagcacgtgatccacctgatggacatcgccatcatcgccacagacctggccctgtacttcaagaagagggccatgttccagaagatcgtggatgagagcaagaactaccaggacaagaagtcctgggtggagtacctgagcctggagaccaccaggaaggagatcgtgatggccatgatgatgacagcctgtgacctgagcgccatcaccaagccctgggaggtgcagagcaaggtggccctgctggtggccgctgagttctgggagcagggcgacctggagaggacagtgctggaccagcagcccatccccatgatggacaggaacaaggctgctgagctgcccaagctgcaggtgggcttcatcgactttgtgtgcacctttgtgtacaaggagttcagccgcttccacgaggagatcctgcccatgtttgaccggctgcagaacaacaggaaggagtggaaggccctggctgatgaatatgaggccaaggtgaaggccctggaggagaaggaggaggaggagcgggtggccgccaagaaggtgggcacagagatctgcaatggaggccctgcccccaagagcagcacctgctgcatcctgtag

SEQ ID NO: 163950 - DNA, 2562 bp, Artificial Sequence
  Description of Artificial Sequence: Synthetic coding sequence
atgagcctgtctgaggagcaggcccggagcttcctggaccagaacccagactttgcccggcagtactttgggaagaagctgagcccagaaaatgtggccgccgcctgtgaagatggctgccccccagactgtgacagcctgcgggacctgtgccaggtggaggagagcacagccctgctggagctggtgcaggacatgcaggagagcatcaacatggagcgggtggtgttcaaggtgctgcggcggctgtgcaccctgctgcaggccgaccgctgcagcctcttcatgtaccggcagagaaatggagtggccgagctggccaccaggctcttctctgtgcagccagattctgtgctggaggactgcctggtgcccccagacagcgagatcgtgttccccctggacatcggcgtggtgggccacgtggcccagaccaagaagatggtgaatgtggaggatgtggccgagtgcccccacttcagcagctttgctgatgagctgacagactacaagaccaagaacatgctggccacccccatcatgaatggcaaggatgtggtggccgtcatcatggctgtgaacaagctgaatggccccttcttcaccagtgaagatgaagatgtgttcctgaagtacctgaactttgccaccctgtacctgaagatctaccacctgagctacctgcacaactgtgagacccggcggggccaggtgctgctgtggagcgccaacaaggtgtttgaggagctgacagacatcgagcggcagttccacaaggccttctacacagtgcgggcctacctgaactgtgagcgctacagcgtgggcctgctggacatgaccaaggagaaggagttctttgatgtgtggagcgtgctgatgggagagagccagccctacagcggccccaggaccccagatggccgggagatcgtgttctacaaggtgattgattatgtgctgcacggcaaggaggagatcaaggtgatccccacccccagcgctgaccactgggccctggccagcggcctgcccagctatgtggccgagagcggcttcatctgcaacatcatgaatgccagcgcagatgagatgttcaagttccaggagggcgccctggatgacagcggctggctgatcaagaatgtgctgtccatgcccatcgtgaacaagaaggaggagatcgtgggcgtggccaccttctacaacaggaaggatggcaagccctttgatgagcaggatgaggtgctgatggagagcctgacccagttcctgggctggagcgtgatgaacacagacacctatgacaagatgaacaagctggagaacaggaaggacatcgcccaggacatggtgctgtaccacgtgaagtgtgacagagatgagatccagctgatcctgcccacccgggcccggctgggcaaggagcctgctgactgtgatgaagatgagctgggggagatcctgaaggaggagctgcccggccccaccacctttgacatctatgagttccacttcagtgacctggagtgcacagagctggacctggtgaagtgtggcatccagatgtactatgagctgggcgtggtgaggaagttccagatcccccaggaggtgctggtgcgcttcctgttcagcatcagcaagggctaccgccgcatcacctaccacaactggaggcatggcttcaacgtggcccagaccatgttcaccctgctgatgaccgggaagctgaagagctactacacagacctggaggcctttgccatggtgacagctggcctgtgccacgacatcgaccaccggggcaccaacaacctgtaccagatgaagagccagaaccccctggccaagctgcacggcagcagcatcctggagcggcaccacctggagtttgggaagttcctgctgtctgaggagaccctgaacatctaccagaacctgaacagacggcagcatgaacatgtgatccacctgatggacatcgccatcatcgccacagacctggccctgtacttcaagaagagggccatgttccagaagatcgtggatgagagcaagaactaccaggacaagaagtcctgggtggagtacctgagcctggagaccaccaggaaggagatcgtgatggccatgatgatgacagcctgtgacctgagcgccatcaccaagccctgggaggtgcagagcaaggtggccctgctggtggccgctgagttctgggagcagggcgacctggagaggacagtgctggaccagcagcccatccccatgatggacaggaacaaggctgctgagctgcccaagctgcaggtgggcttcatcgactttgtgtgcacctttgtgtacaaggagttcagccgcttccacgaggagatcctgcccatgtttgaccggctgcagaacaacaggaaggagtggaaggccctggctgatgaatatgaggccaaggtgaaggccctggaggagaaggaggaggaggagcgggtggccgccaagaagggcacagagatctgcaatggaggccctgcccccaagagcagcacctgctgcatcctgtag

SEQ ID NO: 163951 - DNA, 2565 bp, Artificial Sequence
  Description of Artificial Sequence: Synthetic coding sequence
atgagcctgtctgaggagcaggcccggagcttcctggaccagaacccagactttgcccggcagtactttgggaagaagctgagcccagaaaatgtggccgccgcctgtgaagatggctgccccccagactgtgacagcctgcgggacctgtgccaggtggaggagagcacagccctgctggagctggtgcaggacatgcaggagagcatcaacatggagcgggtggtgttcaaggtgctgcggcggctgtgcaccctgctgcaggccgaccgctgcagcctcttcatgtaccggcagagaaatggagtggccgagctggccaccaggctcttctctgtgcagccagattctgtgctggaggactgcctggtgcccccagacagcgagatcgtgttccccctggacatcggcgtggtgggccacgtggcccagaccaagaagatggtgaatgtggaggatgtggccgagtgcccccacttcagcagctttgctgatgagctgacagactacaagaccaagaacatgctggccacccccatcatgaatggcaaggatgtggtggccgtcatcatggctgtgaacaagctgaatggccccttcttcaccagtgaagatgaagatgtgttcctgaagtacctgaactttgccaccctgtacctgaagatctaccacctgagctacctgcacaactgtgagacccggcggggccaggtgctgctgtggagcgccaacaaggtgtttgaggagctgacagacatcgagcggcagttccacaaggccttctacacagtgcgggcctacctgaactgtgagcgctacagcgtgggcctgctggacatgaccaaggagaaggagttctttgatgtgtggagcgtgctgatgggagagagccagccctacagcggccccaggaccccagatggccgggagatcgtgttctacaaggtgattgattatgtgctgcacggcaaggaggagatcaaggtgatccccacccccagcgctgaccactgggccctggccagcggcctgcccagctatgtggccgagagcggcttcatctgcaacatcatgaatgccagcgcagatgagatgttcaagttccaggagggcgccctggatgacagcggctggctgatcaagaatgtgctgtccatgcccatcgtgaacaagaaggaggagatcgtgggcgtggccaccttctacaacaggaaggatggcaagccctttgatgagcaggatgaggtgctgatggagagcctgacccagttcctgggctggagcgtgatgaacacagacacctatgacaagatgaacaagctggagaacaggaaggacatcgcccaggacatggtgctgtaccacgtgaagtgtgacagagatgagatccagctgatcctgcccacccgggcccggctgggcaaggagcctgctgactgtgatgaagatgagctgggggagatcctgaaggaggagctgcccggccccaccacctttgacatctatgagttccacttcagtgacctggagtgcacagagctggacctggtgaagtgtggcatccagatgtactatgagctgggcgtggtgaggaagttccagatcccccaggaggtgctggtgcgcttcctgttcagcatcagcaagggctaccgccgcatcacctaccacaactggaggcatggcttcaacgtggcccagaccatgttcaccctgctgatgaccgggaagctgaagagctactacacagacctggaggcctttgccatggtgacagctggcctgtgccacgacatcgaccaccggggcaccaacaacctgtaccagatgaagagccagaaccccctggccaagctgcacggcagcagcatcctggagcggcaccacctggagtttgggaagttcctgctgtctgaggagaccctgaacatctaccagaacctgaacagacggcagcatgaacatgtgatccacctgatggacatcgccatcatcgccacagacctggccctgtacttcaagaagagggccatgttccagaagatcgtggatgagagcaagaactaccaggacaagaagtcctgggtggagtacctgagcctggagaccaccaggaaggagatcgtgatggccatgatgatgacagcctgtgacctgagcgccatcaccaagccctgggaggtgcagagcaaggtggccctgctggtggccgctgagttctgggagcagggcgacctggagaggacagtgctggaccagcagcccatccccatgatggacaggaacaaggctgctgagctgcccaagctgcaggtgggcttcatcgactttgtgtgcacctttgtgtacaaggagttcagccgcttccacgaggagatcctgcccatgtttgaccggctgcagaacaacaggaaggagtggaaggccctggctgatgaatatgaggccaaggtgaaggccctggaggagaaggaggaggaggagcgggtggccgccaagaaggtgggcacagagatctgcaatggaggccctgcccccaagagcagcacctgctgcatcctgtag

SEQ ID NO: 163952 - DNA, 2577 bp, Artificial Sequence
  Description of Artificial Sequence: Synthetic coding sequence
atgggagagatcaaccaggtggccgtggagaagtacctggaggagaacccccagtttgccaaggagtactttgacaggaagctgcgggtggaggtgctgggggagatcttcaagaacagccaggtgcctgtgcagagctccatgtccttcagcgagctgacccaggtggaggagagcgccctgtgcctggagctgctgtggacagtgcaggaggagggcggcaccccagagcagggcgtgcaccgggccctgcagaggctggcccacctgctgcaggccgaccgctgcagcatgttcctgtgccgcagcagaaatggcatccctgaggtggccagccggctgctggatgtgacccccaccagcaagtttgaggacaacctggtgggccctgacaaggaggtggtgttccccctggacatcggcatcgtgggctgggccgcccacaccaagaagacccacaacgtgcctgatgtgaagaagaacagccacttcagtgacttcatggacaagcagacaggctacgtgaccaagaacctgctggccacccccatcgtggtgggcaaggaggtgctggccgtcatcatggctgtgaacaaggtgaatgccagcgagttcagcaagcaggatgaggaggtgttcagcaagtacctgaactttgtgtccatcatcctgcggctgcaccacaccagctacatgtacaacatcgagagccgccgcagccagatcctgatgtggagcgccaacaaggtgtttgaggagctgacagatgtggagcggcagttccacaaggccctgtacacagtgcgcagctacctgaactgtgagcgctacagcatcggcctgctggacatgaccaaggagaaggagttctatgatgagtggcccatcaagctgggggaggtggagccctacaagggccccaagaccccagatggccgggaggtgaacttctacaagatcatcgactacatcctgcacggcaaggaggagatcaaggtgatccccaccccacctgctgaccactggaccctcatcagcggcctgcccacctacgtggccgagaatggcttcatctgcaacatgatgaatgccccagcagatgagtacttcaccttccagaagggccctgtggatgagaccggctgggtgatcaagaatgtgctgagcctgcccatcgtgaacaagaaggaggacatcgtgggcgtggccaccttctacaacaggaaggatggcaagccctttgatgaacatgatgagtacatcacagagaccctgacccagttcctgggctggagcctgctgaacacagacacctatgacaagatgaacaagctggagaacaggaaggacatcgcccaggagatgctgatgaaccagaccaaggccaccccagaggagatcaagagcatcctgaagttccaggagaagctgaatgtggatgtgattgatgactgtgaggagaagcagctggtggccatcctgaaggaggacctgcctgaccccaggtctgctgagctgtatgagttccgcttcagtgacttccccctgacagaacatggcctcatcaagtgtggcatccgcctcttctttgagatcaacgtggtggagaagttcaaggtgcctgtggaggtgctgacccgctggatgtacacagtgaggaagggctacagagctgtgacctaccacaactggaggcatggcttcaacgtgggccagaccatgttcaccctgctgatgacaggccgcctgaagaagtactacacagacctggaggcctttgccatgctggccgccgccttctgccacgacatcgaccaccggggcaccaacaacctgtaccagatgaagagcaccagccccctggcccggctgcacggcagcagcatcctggagcggcaccacctggagtacagcaagaccctgctgcaggatgagagcctgaacatcttccagaacctgaacaagaggcagtttgagaccgtcatccacctgtttgaggtggccatcatcgccacagacctggccctgtacttcaagaagaggaccatgttccagaagatcgtggatgcctgtgagcagatgcagacagaggaggaggccatcaagtatgtgacagtggaccccaccaagaaggagatcatcatggccatgatgatgacagcctgtgacctgagcgccatcaccaagccctgggaggtgcagagccaggtggccctgatggtggccaatgagttctgggagcagggcgacctggagaggacagtgctgcagcagcagcccatccccatgatggacaggaacaagagagatgagctgcccaagctgcaggtgggcttcatcgactttgtgtgcacctttgtgtacaaggagttcagccgcttccacaaggagatcacccccatgctgagcggcctgcagaacaacagagtggagtggaagagcctggctgatgaatatgatgccaagatgaaggtgattgaggaggaggccaagaagcaggagggcggcgctgagaaggctgctgaggacagcggcggcggagatgacaagaagagcaagacctgcctgatgctgtag

SEQ ID NO: 163953 - DNA, 453 bp, Artificial Sequence
  Description of Artificial Sequence: Synthetic coding sequence
atgtctgccaaggatgagcgggcccgggagatcctgcggggcttcaagctgaactggatgaacctgagagatgctgagaccgggaagatcctgtggcagggcacagaggacctgtctgtgcctggggtggagcacgaggcccgggtgcccaagaagatcctgaagtgcaaggctgtgtcccgggagctgaacttcagcagcacagagcagatggagaagttccggctggagcagaaggtgtacttcaagggccagtgcctggaggagtggttctttgaatttggcttcgtcatccccaacagcaccaacacctggcagagcctgattgaagctgcccctgagagccagatgatgcctgcctctgtgctgactggaaatgtcatcatcgagaccaagttctttgatgatgacctgctggtgtccaccagccgggtgcggctcttctacgtgtag

SEQ ID NO: 163954 - DNA, 414 bp, Artificial Sequence
  Description of Artificial Sequence: Synthetic coding sequence
atgaagcagagggacaagggccggggctggcaccctgctgagggcggccctgccctgacagcccagcccccagagaccaggcctgccctggacaggagccggcgggagagccgcagccagggctgccggggcgtgtctgtgtccctgaccatgaacctggagccccccaaggccgagttccgcagcgccaccagggtggccggcggccctgtgacccccaggaaaggaccacccaagttcaagcagaggcagacccggcagttcaagagcaagccacccaagaagggcgtgcagggctttggagatgacatccctggcatggagggcctgggcacagacatcaccgtcatctgcccctgggaggccttcaaccacctggagctgcacgagctggcccagtatggcatcatctag

SEQ ID NO: 163955 - DNA, 264 bp, Artificial Sequence
  Description of Artificial Sequence: Synthetic coding sequence
atgaacctggagccccccaaggccgagttccgcagcgccaccagggtggccggcggccctgtgacccccaggaaaggaccacccaagttcaagcagaggcagacccggcagttcaagagcaagccacccaagaagggcgtgcagggctttggagatgacatccctggcatggagggcctgggcacagacatcaccgtcatctgcccctgggaggccttcaaccacctggagctgcacgagctggcccagtatggcatcatctag

SEQ ID NO: 163956 - DNA, 252 bp, Artificial Sequence
  Description of Artificial Sequence: Synthetic coding sequence
atgtctgacaacaccaccctgcctgccccagccagcaaccagggccccaccacccccaggaaaggaccacccaagttcaagcagaggcagacccggcagttcaagagcaagccacccaagaagggcgtgaagggctttggagatgacatccctggcatggagggcctgggcacagacatcaccgtcatctgcccctgggaggccttcagccacctggagctgcacgagctggcccagtttggcatcatctag

SEQ ID NO: 163957 - DNA, 1371 bp, Artificial Sequence
  Description of Artificial Sequence: Synthetic coding sequence
atgggcatcaccctcatctggtgcctggccctggtgctgatcaagtggatcaccagcaagagaagaggagccatctcctatgacagcagtgaccagacagccctgtacatccgcatgctgggagatgtgcgggtgcgcagcagagctggctttgaaagtgaaagaagaggcagccacccctacatcgacttccgcatcttccacagccagagcgagattgaggtgtctgtgtctgccaggaacatccggcggctgctgtccttccagcgctacctgcggagcagccgcttcttccggggcacagctgtgagcaacagcctgaacatcctggatgatgactacaacggccaggccaagtgcatgctggagaaggtgggcaactggaactttgacatcttcctgtttgaccggctgaccaacggcaacagcctggtgtccctgaccttccacctgttcagcctgcacggcctcatcgagtacttccacctggacatgatgaagctgcggcgcttcctggtgatgatccaggaggactaccacagccagaacccctaccacaatgctgtgcatgctgctgatgtgacccaggccatgcactgctacctgaaggagcccaagctggccaacagcgtgaccccctgggacatcctgctgagcctgattgctgctgccacccatgacctggaccaccctggggtgaaccagcccttcctgatcaagaccaaccactacctggccaccctgtacaagaacacctctgtgctggagaaccaccactggaggtctgctgtgggcctgctgcgggagagcggcctcttcagccacctgcccctggagagccggcagcagatggagacccagatcggggccctgatcctggccacagacatcagccggcagaatgagtacctgagcctcttccgcagccacctggacagaggagacctgtgcctggaggacaccaggcaccgccacctggtgctgcagatggccctgaagtgtgccgacatctgcaacccctgcaggacctgggagctgagcaagcagtggagcgagaaggtgacagaggagttcttccaccagggcgacatcgagaagaagtaccacctgggcgtgagccccctgtgtgacagacacacagagagcatcgccaacatccagatcggcttcatgacctacctggtggagcccctcttcacagagtgggcccgcttcagcaacacccggctgagccagaccatgctgggccacgtgggcctgaacaaggcctcctggaagggcctgcagcgggagcagagcagcagcgaggacacagatgctgcctttgagctgaacagccagctgctgccccaggagaaccggctgtcctag

SEQ ID NO: 163958 - DNA, 1275 bp, Artificial Sequence
  Description of Artificial Sequence: Synthetic coding sequence
atggaggtgtgctaccagctgcctgtgctgcccctggacaggcctgtgccccagcacgtgctgagcagaagaggagccatctccttcagcagcagcagcgccctgtttggctgccccaacccccggcagctgagccagaggagaggagccatctcctatgacagcagtgaccagacagccctgtacatccgcatgctgggagatgtgcgggtgcgcagcagagctggctttgaaagtgaaagaagaggcagccacccctacatcgacttccgcatcttccacagccagagcgagattgaggtgtctgtgtctgccaggaacatccggcggctgctgtccttccagcgctacctgcggagcagccgcttcttccggggcacagctgtgagcaacagcctgaacatcctggatgatgactacaacggccaggccaagtgcatgctggagaaggtgggcaactggaactttgacatcttcctgtttgaccggctgaccaacggcaacagcctggtgtccctgaccttccacctgttcagcctgcacggcctcatcgagtacttccacctggacatgatgaagctgcggcgcttcctggtgatgatccaggaggactaccacagccagaacccctaccacaatgctgtgcatgctgctgatgtgacccaggccatgcactgctacctgaaggagcccaagctggccaacagcgtgaccccctgggacatcctgctgagcctgattgctgctgccacccatgacctggaccaccctggggtgaaccagcccttcctgatcaagaccaaccactacctggccaccctgtacaagaacacctctgtgctggagaaccaccactggaggtctgctgtgggcctgctgcgggagagcggcctcttcagccacctgcccctggagagccggcagcagatggagacccagatcggggccctgatcctggccacagacatcagccggcagaatgagtacctgagcctcttccgcagccacctggacagaggagacctgtgcctggaggacaccaggcaccgccacctggtgctgcagatggccctgaagtgtgccgacatctgcaacccctgcaggacctgggagctgagcaagcagtggagcgagaaggtgacagaggagttcttccaccagggcgacatcgagaagaagtaccacctgggcgtgagccccctgtgtgacagacacacagagagcatcgccaacatccagatcggcaactacacctacctggacattgctggatag

SEQ ID NO: 163959 - DNA, 1449 bp, Artificial Sequence
  Description of Artificial Sequence: Synthetic coding sequence
atggaggtgtgctaccagctgcctgtgctgcccctggacaggcctgtgccccagcacgtgctgagcagaagaggagccatctccttcagcagcagcagcgccctgtttggctgccccaacccccggcagctgagccagaggagaggagccatctcctatgacagcagtgaccagacagccctgtacatccgcatgctgggagatgtgcgggtgcgcagcagagctggctttgaaagtgaaagaagaggcagccacccctacatcgacttccgcatcttccacagccagagcgagattgaggtgtctgtgtctgccaggaacatccggcggctgctgtccttccagcgctacctgcggagcagccgcttcttccggggcacagctgtgagcaacagcctgaacatcctggatgatgactacaacggccaggccaagtgcatgctggagaaggtgggcaactggaactttgacatcttcctgtttgaccggctgaccaacggcaacagcctggtgtccctgaccttccacctgttcagcctgcacggcctcatcgagtacttccacctggacatgatgaagctgcggcgcttcctggtgatgatccaggaggactaccacagccagaacccctaccacaatgctgtgcatgctgctgatgtgacccaggccatgcactgctacctgaaggagcccaagctggccaacagcgtgaccccctgggacatcctgctgagcctgattgctgctgccacccatgacctggaccaccctggggtgaaccagcccttcctgatcaagaccaaccactacctggccaccctgtacaagaacacctctgtgctggagaaccaccactggaggtctgctgtgggcctgctgcgggagagcggcctcttcagccacctgcccctggagagccggcagcagatggagacccagatcggggccctgatcctggccacagacatcagccggcagaatgagtacctgagcctcttccgcagccacctggacagaggagacctgtgcctggaggacaccaggcaccgccacctggtgctgcagatggccctgaagtgtgccgacatctgcaacccctgcaggacctgggagctgagcaagcagtggagcgagaaggtgacagaggagttcttccaccagggcgacatcgagaagaagtaccacctgggcgtgagccccctgtgtgacagacacacagagagcatcgccaacatccagatcggcttcatgacctacctggtggagcccctcttcacagagtgggcccgcttcagcaacacccggctgagccagaccatgctgggccacgtgggcctgaacaaggcctcctggaagggcctgcagcgggagcagagcagcagcgaggacacagatgctgcctttgagctgaacagccagctgctgccccaggagaaccggctgtcctag

SEQ ID NO: 163960 - DNA, 2490 bp, Artificial Sequence
  Description of Artificial Sequence: Synthetic coding sequence
atgggctgtgcccccagcatccacatcagcgagcggctggtggccgaggatgcccccagccctgctgccccacccctgagcagcggcggcccccggctgccccagggccagaagacagctgccctgcccaggaccaggggggccggcctgctggagagcgagctgagagatggcagcggcaagaaggtggccgtggctgatgtgcagtttggccccatgaggttccaccaggaccagctgcaggtgctgctggtgttcaccaaggaggacaaccagtgcaatggcttctgccgggcctgtgagaaggccggcttcaagtgcaccgtgaccaaggaggcccaggccgtgctggcctgcttcctggacaagcaccacgacatcatcatcatcgaccacaggaacccccggcagctggatgctgaggccctgtgccgcagcatccgcagcagcaagctgtctgagaacacagtcatcgtgggcgtggtgagaagagtggaccgggaggagctgtctgtgatgcccttcatctctgctggcttcacccggcgctacgtggagaaccccaacatcatggcctgctacaatgagctgctgcagctggagtttggagaggtgcgcagccagctgaagctgcgggcctgcaacagcgtcttcaccgccctggagaacagtgaagatgccatcgagatcaccagtgaagatcgcttcatccagtatgccaacccagcctttgagaccaccatgggctaccagagcggggagctgattggcaaggagctgggggaggtgcccatcaatgagaagaaggctgacctgctggacaccatcaacagctgcatccgcatcggcaaggagtggcagggcatctactatgccaagaagaagaatggagacaacatccagcagaatgtgaagatcatccctgtgattggccagggcggcaagatccgccactacgtgtccatcatccgggtgtgcaatggaaacaacaaggccgagaagatcagtgaatgtgtgcagagcgacacccacacagacaaccagacaggcaagcacaaggacaggaggaagggcagcctggatgtgaaggctgtggccagccgggccacagaggtgagcagccagaggaggcacagctccatggcccgcatccacagcatgaccatcgaggcccccatcaccaaggtgatcaacatcatcaatgctgcccaggagagcagccccatgcctgtgacagaggccctggacagagtgctggagatcctgcggaccacagagctgtacagcccccagtttggagccaaggatgatgacccccacgccaatgacctggtgggcggcctgatgtctgatggcctgcggcggctgtctggaaatgaatatgtgctgagcaccaagaacacccagatggtgagcagcaacatcatcacccccatcagcctggatgatgtgcccccacgcatcgcccgggccatggagaatgaggagtactgggactttgacatctttgagctggaggccgccacccacaaccggcccctcatctacctgggcctgaagatgtttgccaggtttggcatctgtgagttcctgcactgcagcgagagcaccctgcgctcctggctgcagatcatcgaggccaactaccacagcagcaacccctaccacaacagcacccacagcgcagatgtgctgcacgccacagcctacttcctgagcaaggagcgcatcaaggagaccctggaccccattgatgaggtggccgccctgattgctgccaccatccatgatgtggaccaccctggccgcaccaacagcttcctgtgcaatgccggcagcgagctggccatcctgtacaatgacacagctgtgctggagagccaccacgccgccctggccttccagctgaccactggagatgacaagtgcaacatcttcaagaacatggagagaaatgactaccgcaccctgcggcagggcatcatcgacatggtgctggccacagagatgaccaagcactttgagcacgtgaacaagtttgtgaacagcatcaacaagcccctggccaccctggaggagaatggagaaacagacaagaaccaggaggtgatcaacaccatgctgcggaccccagagaacagaaccctcatcaagaggatgctgatcaagtgtgctgatgtgagcaacccctgccggcccctgcagtactgcatcgagtgggccgcccgcatcagcgaggagtacttcagccagacagatgaggagaagcagcagggcctgcctgtggtgatgcctgtgtttgacaggaacacctgcagcatccccaagagccagatctccttcatcgactacttcatcacagacatgtttgatgcctgggatgcctttgtggacctgcctgacctgatgcagcacctggacaacaacttcaagtactggaagggcctggatgagatgaagctgaggaacctgcggcccccacctgagtag

SEQ ID NO: 163961 - DNA, 2352 bp, Artificial Sequence
  Description of Artificial Sequence: Synthetic coding sequence
atgggctgtgcccccagcatccacatcagcgagcggctggtggccgaggatgcccccagccctgctgccccacccctgagcagcggcggcccccggctgccccagggccagaagacagctgccctgcccaggaccaggggggccggcctgctggagagcgagctgagagatggcagcggcaagaaggtggccgtggctgatgtgcagtttggccccatgaggttccaccaggaccagctgcaggtgctgctggtgttcaccaaggaggacaaccagtgcaatggcttctgccgggcctgtgagaaggccggcttcaagtgcaccgtgaccaaggaggcccaggccgtgctggcctgcttcctggacaagcaccacgacatcatcatcatcgaccacaggaacccccggcagctggatgctgaggccctgtgccgcagcatccgcagcagcaagctgtctgagaacacagtcatcgtgggcgtggtgagaagagtggaccgggaggagctgtctgtgatgcccttcatctctgctggcttcacccggcgctacgtggagaaccccaacatcatggcctgctacaatgagctgctgcagctggagtttggagaggtgcgcagccagctgaagctgcgggcctgcaacagcgtcttcaccgccctggagaacagtgaagatgccatcgagatcaccagtgaagatcgcttcatccaggagtggcagggcatctactatgccaagaagaagaatggagacaacatccagcagaatgtgaagatcatccctgtgattggccagggcggcaagatccgccactacgtgtccatcatccgggtgtgcaatggaaacaacaaggccgagaagatcagtgaatgtgtgcagagcgacacccacacagacaaccagacaggcaagcacaaggacaggaggaagggcagcctggatgtgaaggctgtggccagccgggccacagaggtgagcagccagaggaggcacagctccatggcccgcatccacagcatgaccatcgaggcccccatcaccaaggtgatcaacatcatcaatgctgcccaggagagcagccccatgcctgtgacagaggccctggacagagtgctggagatcctgcggaccacagagctgtacagcccccagtttggagccaaggatgatgacccccacgccaatgacctggtgggcggcctgatgtctgatggcctgcggcggctgtctggaaatgaatatgtgctgagcaccaagaacacccagatggtgagcagcaacatcatcacccccatcagcctggatgatgtgcccccacgcatcgcccgggccatggagaatgaggagtactgggactttgacatctttgagctggaggccgccacccacaaccggcccctcatctacctgggcctgaagatgtttgccaggtttggcatctgtgagttcctgcactgcagcgagagcaccctgcgctcctggctgcagatcatcgaggccaactaccacagcagcaacccctaccacaacagcacccacagcgcagatgtgctgcacgccacagcctacttcctgagcaaggagcgcatcaaggagaccctggaccccattgatgaggtggccgccctgattgctgccaccatccatgatgtggaccaccctggccgcaccaacagcttcctgtgcaatgccggcagcgagctggccatcctgtacaatgacacagctgtgctggagagccaccacgccgccctggccttccagctgaccactggagatgacaagtgcaacatcttcaagaacatggagagaaatgactaccgcaccctgcggcagggcatcatcgacatggtgctggccacagagatgaccaagcactttgagcacgtgaacaagtttgtgaacagcatcaacaagcccctggccaccctggaggagaatggagaaacagacaagaaccaggaggtgatcaacaccatgctgcggaccccagagaacagaaccctcatcaagaggatgctgatcaagtgtgctgatgtgagcaacccctgccggcccctgcagtactgcatcgagtgggccgcccgcatcagcgaggagtacttcagccagacagatgaggagaagcagcagggcctgcctgtggtgatgcctgtgtttgacaggaacacctgcagcatccccaagagccagatctccttcatcgactacttcatcacagacatgtttgatgcctgggatgcctttgtggacctgcctgacctgatgcagcacctggacaacaacttcaagtactggaagggcctggatgagatgaagctgaggaacctgcggcccccacctgagtag

SEQ ID NO: 163962 - DNA, 2490 bp, Artificial Sequence; identical to SEQ ID NO: 163960
  Description of Artificial Sequence: Synthetic coding sequence

SEQ ID NO: 163963 - DNA, 2274 bp, Artificial Sequence
  Description of Artificial Sequence: Synthetic coding sequence
atgaggttccaccaggaccagctgcaggtgctgctggtgttcaccaaggaggacaaccagtgcaatggcttctgccgggcctgtgagaaggccggcttcaagtgcaccgtgaccaaggaggcccaggccgtgctggcctgcttcctggacaagcaccacgacatcatcatcatcgaccacaggaacccccggcagctggatgctgaggccctgtgccgcagcatccgcagcagcaagctgtctgagaacacagtcatcgtgggcgtggtgagaagagtggaccgggaggagctgtctgtgatgcccttcatctctgctggcttcacccggcgctacgtggagaaccccaacatcatggcctgctacaatgagctgctgcagctggagtttggagaggtgcgcagccagctgaagctgcgggcctgcaacagcgtcttcaccgccctggagaacagtgaagatgccatcgagatcaccagtgaagatcgcttcatccagtatgccaacccagcctttgagaccaccatgggctaccagagcggggagctgattggcaaggagctgggggaggtgcccatcaatgagaagaaggctgacctgctggacaccatcaacagctgcatccgcatcggcaaggagtggcagggcatctactatgccaagaagaagaatggagacaacatccagcagaatgtgaagatcatccctgtgattggccagggcggcaagatccgccactacgtgtccatcatccgggtgtgcaatggaaacaacaaggccgagaagatcagtgaatgtgtgcagagcgacacccacacagacaaccagacaggcaagcacaaggacaggaggaagggcagcctggatgtgaaggctgtggccagccgggccacagaggtgagcagccagaggaggcacagctccatggcccgcatccacagcatgaccatcgaggcccccatcaccaaggtgatcaacatcatcaatgctgcccaggagagcagccccatgcctgtgacagaggccctggacagagtgctggagatcctgcggaccacagagctgtacagcccccagtttggagccaaggatgatgacccccacgccaatgacctggtgggcggcctgatgtctgatggcctgcggcggctgtctggaaatgaatatgtgctgagcaccaagaacacccagatggtgagcagcaacatcatcacccccatcagcctggatgatgtgcccccacgcatcgcccgggccatggagaatgaggagtactgggactttgacatctttgagctggaggccgccacccacaaccggcccctcatctacctgggcctgaagatgtttgccaggtttggcatctgtgagttcctgcactgcagcgagagcaccctgcgctcctggctgcagatcatcgaggccaactaccacagcagcaacccctaccacaacagcacccacagcgcagatgtgctgcacgccacagcctacttcctgagcaaggagcgcatcaaggagaccctggaccccattgatgaggtggccgccctgattgctgccaccatccatgatgtggaccaccctggccgcaccaacagcttcctgtgcaatgccggcagcgagctggccatcctgtacaatgacacagctgtgctggagagccaccacgccgccctggccttccagctgaccactggagatgacaagtgcaacatcttcaagaacatggagagaaatgactaccgcaccctgcggcagggcatcatcgacatggtgctggccacagagatgaccaagcactttgagcacgtgaacaagtttgtgaacagcatcaacaagcccctggccaccctggaggagaatggagaaacagacaagaaccaggaggtgatcaacaccatgctgcggaccccagagaacagaaccctcatcaagaggatgctgatcaagtgtgctgatgtgagcaacccctgccggcccctgcagtactgcatcgagtgggccgcccgcatcagcgaggagtacttcagccagacagatgaggagaagcagcagggcctgcctgtggtgatgcctgtgtttgacaggaacacctgcagcatccccaagagccagatctccttcatcgactacttcatcacagacatgtttgatgcctgggatgcctttgtggacctgcctgacctgatgcagcacctggacaacaacttcaagtactggaagggcctggatgagatgaagctgaggaacctgcggcccccacctgagtag

SEQ ID NO: 163964 - DNA, 2658 bp, Artificial Sequence
  Description of Artificial Sequence: Synthetic coding sequence
atgggctgtgcccccagcatccacgtgtcccagagcggggtcatctactgccgggacagtgatgagagcagcagcccccggcagaccacctctgtgtcccagggccctgctgcccccctgcccggcctgtttgtgcagacagatgctgctgatgccatcccccccagccgggccagcggccccccatctgtggcccgggtgcggcgggccaggacagagctgggcagcggcagcagcgctggcagcgctgccccagctgccaccaccagccggggcagaagaagacactgctgcagcagcgctgaggccgagacccagacctgctacacctctgtgaagcaggtgtcctctgctgaggtgcgcatcggccccatgaggctgacccaggaccccatccaggtgctgctgatctttgccaaggaggacagccagagtgatggcttctggtgggcctgtgacagagctggctaccgctgcaacatcgcccggaccccagagagcgccctggagtgcttcctggacaagcaccacgagatcatcgtcatcgaccaccggcagacccagaactttgatgctgaggccgtgtgccgcagcatccgggccaccaaccccagcgagcacacagtcatcctggccgtggtgtcccgggtgtctgatgaccacgaggaggcctctgtgctgcccctgctgcacgccggcttcaacagacgcttcatggagaacagcagcatcatcgcctgctacaatgaactcatccagatcgagcacggggaggtgcgcagccagttcaagctgcgggcctgcaacagcgtcttcaccgccctggaccactgccacgaggccatcgagatcaccagtgatgaccacgtgatccagtatgtgaacccagcctttgagaggatgatgggctaccacaagggggagctgctgggcaaggagctggccgacctgcccaagagtgacaagaacagagctgacctgctggacaccatcaacacctgcatcaagaagggcaaggagtggcagggcgtgtactatgcccggaggaagagcggggacagcatccagcagcacgtgaagatcacccctgtgattggccagggcggcaagatccgccactttgtgtccctgaagaagctgtgctgcaccacagacaacaacaagcagatccacaagatccaccgggacagcggggacaacagccagacagagccccacagcttccgctacaagaacagaaggaaggagagcattgatgtgaagagcatcagcagccggggcagtgatgcccccagcctgcagaacagacgctaccccagcatggcccgcatccacagcatgaccatcgaggcccccatcaccaaggtgatcaacatcatcaatgctgcccaggagaacagccctgtgacagtggccgaggccctggacagagtgctggagatcctgcggaccacagagctgtacagcccccagctgggcaccaaggatgaggacccccacaccagtgacctggtgggcggcctgatgacagatggcctgcggcggctgtctggaaatgaatatgtgttcaccaagaatgtgcaccagagccacagccacctggccatgcccatcaccatcaatgatgtgcccccctgcatcagccagctgctggacaatgaggagagctgggacttcaacatctttgagctggaggccatcacccacaagaggcccctggtgtacctgggcctgaaggtgttcagccgcttcggcgtgtgtgagttcctgaactgcagcgagaccaccctgcgggcctggttccaggtgattgaggccaactaccacagcagcaatgcctaccacaacagcacccacgccgcagatgtgctgcacgccacagccttcttcctgggcaaggagcgggtgaagggcagcctggaccagctggatgaggtggccgccctgattgctgccaccgtgcatgatgtggaccaccctggccgcaccaacagcttcctgtgcaatgccggcagcgagctggccgtgctgtacaatgacacagctgtgctggagagccaccacacagccctggccttccagctgactgtgaaggacaccaagtgcaacatcttcaagaacatcgacaggaaccactaccgcaccctgcggcaggccatcatcgacatggtgctggccacagagatgaccaagcactttgaacatgtgaacaagtttgtgaacagcatcaacaagcccatggctgctgagattgagggcagtgactgtgagtgcaacccagctgggaagaacttccctgagaaccagatcctgatcaagaggatgatgatcaagtgtgctgatgtggccaacccctgccggcccctggacctgtgcatcgagtgggccggccgcatcagcgaggagtactttgcccagacagatgaggagaagaggcagggcctgcctgtggtgatgcctgtgtttgacaggaacacctgcagcatccccaagagccagatctccttcatcgactacttcatcacagacatgtttgatgcctgggatgcctttgcccacctgcctgccctgatgcagcacctggccgacaactacaagcactggaagaccctggatgacctgaagtgcaagagcctgcggctgcccagcgacagctag

SEQ ID NO: 163965 - DNA, 2493 bp, Artificial Sequence
  Description of Artificial Sequence: Synthetic coding sequence
atgggctgtgcccccagcatccacgtgtcccagagcggggtcatctactgccgggacagtgatgagagcagcagcccccggcagaccacctctgtgtcccagggccctgctgcccccctgcccggcctgtttgtgcagacagatgctgctgatgccatcccccccagccgggccagcggccccccatctgtggcccgggtgcggcgggccaggacagagctgggcagcggcagcagcgctggcagcgctgccccagctgccaccaccagccggggcagaagaagacactgctgcagcagcgctgaggccgagacccagacctgctacacctctgtgaagcaggtgtcctctgctgaggtgcgcatcggccccatgaggctgacccaggaccccatccaggtgctgctgatctttgccaaggaggacagccagagtgatggcttctggtgggcctgtgacagagctggctaccgctgcaacatcgcccggaccccagagagcgccctggagtgcttcctggacaagcaccacgagatcatcgtcatcgaccaccggcagacccagaactttgatgctgaggccgtgtgccgcagcatccgggccaccaaccccagcgagcacacagtcatcctggccgtggtgtcccgggtgtctgatgaccacgaggaggcctctgtgctgcccctgctgcacgccggcttcaacagacgcttcatggagaacagcagcatcatcgcctgctacaatgaactcatccagatcgagcacggggaggtgcgcagccagttcaagctgcgggcctgcaacagcgtcttcaccgccctggaccactgccacgaggccatcgagatcaccagtgatgaccacgtgatccagtatgtgaacccagcctttgagaggatgatgggctaccacaagggggagctgctgggcaaggagctggccgacctgcccaagagtgacaagaacagagctgacctgctggacaccatcaacacctgcatcaagaagggcaaggagtggcagggcgtgtactatgcccggaggaagagcggggacagcatccagcagcacgtgaagatcacccctgtgattggccagggcggcaagatccgccactttgtgtccctgaagaagctgtgctgcaccacagacaacaacaagcagatccacaagatccaccgggacagcggggacaacagccagacagagccccacagcttccgctacaagaacagaaggaaggagagcattgatgtgaagagcatcagcagccggggcagtgatgcccccagcctgcagaacagacgctaccccagcatggcccgcatccacagcatgaccatcgaggcccccatcaccaaggatggcctgcggcggctgtctggaaatgaatatgtgttcaccaagaatgtgcaccagagccacagccacctggccatgcccatcaccatcaatgatgtgcccccctgcatcagccagctgctggacaatgaggagagctgggacttcaacatctttgagctggaggccatcacccacaagaggcccctggtgtacctgggcctgaaggtgttcagcagatttggagtgtgtgagttcctgaactgcagcgagaccaccctgcgggcctggttccaggtgattgaggccaactaccacagcagcaatgcctaccacaacagcacccatgctgctgatgtgctgcacgccacagccttcttcctgggcaaggagcgggtgaagggcagcctggaccagctggatgaggtggccgccctgattgctgccaccgtgcatgatgtggaccaccctggccgcaccaacagcttcctgtgcaatgccggcagcgagctggccgtgctgtacaatgacacagctgtgctggagagccaccacacagccctggccttccagctgactgtgaaggacaccaagtgcaacatcttcaagaacatcgacaggaaccactaccgcaccctgcggcaggccatcatcgacatggtgctggccacagagatgaccaagcactttgagcacgtgaacaagtttgtgaacagcatcaacaagcccatggctgctgagattgagggcagtgactgtgagtgcaacccagctgggaagaacttccctgagaaccagatcctgatcaagaggatgatgatcaagtgtgctgatgtggccaacccctgccggcccctggacctgtgcatcgagtgggccggccgcatcagcgaggagtactttgcccagacagatgaggagaagaggcagggcctgcctgtggtgatgcctgtgtttgacaggaacacctgcagcatccccaagagccagatctccttcatcgactacttcatcacagacatgtttgatgcctgggatgcctttgcccacctgcctgccctgatgcagcacctggccgacaactacaagcactggaagaccctggatgacctgaagtgcaagagcctgcggctgcccagcgacagctag

SEQ ID NO: 163966 - DNA, 2517 bp, Artificial Sequence
  Description of Artificial Sequence: Synthetic coding sequence
atgggctgtgcccccagcatccacgtgtcccagagcggggtcatctactgccgggacagtgatgagagcagcagcccccggcagaccacctctgtgtcccagggccctgctgcccccctgcccggcctgtttgtgcagacagatgctgctgatgccatcccccccagccgggccagcggccccccatctgtggcccgggtgcggcgggccaggacagagctgggcagcggcagcagcgctggcagcgctgccccagctgccaccaccagccggggcagaagaagacactgctgcagcagcgctgaggccgagacccagacctgctacacctctgtgaagcaggtgtcctctgctgaggtgcgcatcggccccatgaggctgacccaggaccccatccaggtgctgctgatctttgccaaggaggacagccagagtgatggcttctggtgggcctgtgacagagctggctaccgctgcaacatcgcccggaccccagagagcgccctggagtgcttcctggacaagcaccacgagatcatcgtcatcgaccaccggcagacccagaactttgatgctgaggccgtgtgccgcagcatccgggccaccaaccccagcgagcacacagtcatcctggccgtggtgtcccgggtgtctgatgaccacgaggaggcctctgtgctgcccctgctgcacgccggcttcaacagacgcttcatggagaacagcagcatcatcgcctgctacaatgaactcatccagatcgagcacggggaggtgcgcagccagttcaagctgcgggcctgcaacagcgtcttcaccgccctggaccactgccacgaggccatcgagatcaccagtgatgaccacgtgatccaggagtggcagggcgtgtactatgcccggaggaagagcggggacagcatccagcagcacgtgaagatcacccctgtgattggccagggcggcaagatccgccactttgtgtccctgaagaagctgtgctgcaccacagacaacaacaagcagatccacaagatccaccgggacagcggggacaacagccagacagagccccacagcttccgctacaagaacagaaggaaggagagcattgatgtgaagagcatcagcagccggggcagtgatgcccccagcctgcagaacagacgctaccccagcatggcccgcatccacagcatgaccatcgaggcccccatcaccaaggtgatcaacatcatcaatgctgcccaggagaacagccctgtgacagtggccgaggccctggacagagtgctggagatcctgcggaccacagagctgtacagcccccagctgggcaccaaggatgaggacccccacaccagtgacctggtgggcggcctgatgacagatggcctgcggcggctgtctggaaatgaatatgtgttcaccaagaatgtgcaccagagccacagccacctggccatgcccatcaccatcaatgatgtgcccccctgcatcagccagctgctggacaatgaggagagctgggacttcaacatctttgagctggaggccatcacccacaagaggcccctggtgtacctgggcctgaaggtgttcagcagatttggagtgtgtgagttcctgaactgcagcgagaccaccctgcgggcctggttccaggtgattgaggccaactaccacagcagcaatgcctaccacaacagcacccatgctgctgatgtgctgcacgccacagccttcttcctgggcaaggagcgggtgaagggcagcctggaccagctggatgaggtggccgccctgattgctgccaccgtgcatgatgtggaccaccctggccgcaccaacagcttcctgtgcaatgccggcagcgagctggccgtgctgtacaatgacacagctgtgctggagagccaccacacagccctggccttccagctgactgtgaaggacaccaagtgcaacatcttcaagaacatcgacaggaaccactaccgcaccctgcggcaggccatcatcgacatggtgctggccacagagatgaccaagcactttgagcacgtgaacaagtttgtgaacagcatcaacaagcccatggctgctgagattgagggcagtgactgtgagtgcaacccagctgggaagaacttccctgagaaccagatcctgatcaagaggatgatgatcaagtgtgctgatgtggccaacccctgccggcccctggacctgtgcatcgagtgggccggccgcatcagcgaggagtactttgcccagacagatgaggagaagaggcagggcctgcctgtggtgatgcctgtgtttgacaggaacacctgcagcatccccaagagccagatctccttcatcgactacttcatcacagacatgtttgatgcctgggatgcctttgcccacctgcctgccctgatgcagcacctggccgacaactacaagcactggaagaccctggatgacctgaagtgcaagagcctgcggctgcccagcgacagctag

SEQ ID NO: 163967 - DNA, 2598 bp, Artificial Sequence
  Description of Artificial Sequence: Synthetic coding sequence
atgggctgtgcccccagcatccacgtgtcccagagcggggtcatctactgccgggacagtgatgagagcagcagcccccggcagaccacctctgtgtcccagggccctgctgcccccctgcccggcctgtttgtgcagacagatgctgctgatgccatcccccccagccgggccagcggccccccatctgtggcccgggtgcggcgggccaggacagagctgggcagcggcagcagcgctggcagcgctgccccagctgccaccaccagccggggcagaagaagacactgctgcagcagcgctgaggccgagacccagacctgctacacctctgtgaaggtgctgctgatctttgccaaggaggacagccagagtgatggcttctggtgggcctgtgacagagctggctaccgctgcaacatcgcccggaccccagagagcgccctggagtgcttcctggacaagcaccacgagatcatcgtcatcgaccaccggcagacccagaactttgatgctgaggccgtgtgccgcagcatccgggccaccaaccccagcgagcacacagtcatcctggccgtggtgtcccgggtgtctgatgaccacgaggaggcctctgtgctgcccctgctgcacgccggcttcaacagacgcttcatggagaacagcagcatcatcgcctgctacaatgaactcatccagatcgagcacggggaggtgcgcagccagttcaagctgcgggcctgcaacagcgtcttcaccgccctggaccactgccacgaggccatcgagatcaccagtgatgaccacgtgatccagtatgtgaacccagcctttgagaggatgatgggctaccacaagggggagctgctgggcaaggagctggccgacctgcccaagagtgacaagaacagagctgacctgctggacaccatcaacacctgcatcaagaagggcaaggagtggcagggcgtgtactatgcccggaggaagagcggggacagcatccagcagcacgtgaagatcacccctgtgattggccagggcggcaagatccgccactttgtgtccctgaagaagctgtgctgcaccacagacaacaacaagcagatccacaagatccaccgggacagcggggacaacagccagacagagccccacagcttccgctacaagaacagaaggaaggagagcattgatgtgaagagcatcagcagccggggcagtgatgcccccagcctgcagaacagacgctaccccagcatggcccgcatccacagcatgaccatcgaggcccccatcaccaaggtgatcaacatcatcaatgctgcccaggagaacagccctgtgacagtggccgaggccctggacagagtgctggagatcctgcggaccacagagctgtacagcccccagctgggcaccaaggatgaggacccccacaccagtgacctggtgggcggcctgatgacagatggcctgcggcggctgtctggaaatgaatatgtgttcaccaagaatgtgcaccagagccacagccacctggccatgcccatcaccatcaatgatgtgcccccctgcatcagccagctgctggacaatgaggagagctgggacttcaacatctttgagctggaggccatcacccacaagaggcccctggtgtacctgggcctgaaggtgttcagccgcttcggcgtgtgtgagttcctgaactgcagcgagaccaccctgcgggcctggttccaggtgattgaggccaactaccacagcagcaatgcctaccacaacagcacccacgccgcagatgtgctgcacgccacagccttcttcctgggcaaggagcgggtgaagggcagcctggaccagctggatgaggtggccgccctgattgctgccaccgtgcatgatgtggaccaccctggccgcaccaacagcttcctgtgcaatgccggcagcgagctggccgtgctgtacaatgacacagctgtgctggagagccaccacacagccctggccttccagctgactgtgaaggacaccaagtgcaacatcttcaagaacatcgacaggaaccactaccgcaccctgcggcaggccatcatcgacatggtgctggccacagagatgaccaagcactttgaacatgtgaacaagtttgtgaacagcatcaacaagcccatggctgctgagattgagggcagtgactgtgagtgcaacccagctgggaagaacttccctgagaaccagatcctgatcaagaggatgatgatcaagtgtgctgatgtggccaacccctgccggcccctggacctgtgcatcgagtgggccggccgcatcagcgaggagtactttgcccagacagatgaggagaagaggcagggcctgcctgtggtgatgcctgtgtttgacaggaacacctgcagcatccccaagagccagatctccttcatcgactacttcatcacagacatgtttgatgcctgggatgcctttgcccacctgcctgccctgatgcagcacctggccgacaactacaagcactggaagaccctggatgacctgaagtgcaagagcctgcggctgcccagcgacagctag

SEQ ID NO: 163968 - DNA, 2367 bp, Artificial Sequence
  Description of Artificial Sequence: Synthetic coding sequence
atgggctgtgcccccagcatccacgtgtcccagagcggggtcatctactgccgggacagtgatgagagcagcagcccccggcagaccacctctgtgtcccagggccctgctgcccccctgcccggcctgtttgtgcagacagatgctgctgatgccatcccccccagccgggccagcggccccccatctgtggcccgggtgcggcgggccaggacagagctgggcagcggcagcagcgctggcagcgctgccccagctgccaccaccagccggggcagaagaagacactgctgcagcagcgctgaggccgagacccagacctgctacacctctgtgaagcaggtgtcctctgctgaggtgcgcatcggccccatgaggctgacccaggaccccatccaggtgctgctgatctttgccaaggaggacagccagagtgatggcttctggtgggcctgtgacagagctggctaccgctgcaacatcgcccggaccccagagagcgccctggagtgcttcctggacaagcaccacgagatcatcgtcatcgaccaccggcagacccagaactttgatgctgaggccgtgtgccgcagcatccgggccaccaaccccagcgagcacacagtcatcctggccgtggtgtcccgggtgtctgatgaccacgaggaggcctctgtgctgcccctgctgcacgccggcttcaacagacgcttcatggagaacagcagcatcatcgcctgctacaatgaactcatccagatcgagcacggggaggtgcgcagccagttcaagctgcgggcctgcaacagcgtcttcaccgccctggaccactgccacgaggccatcgagatcaccagtgatgaccacgtgatccagatccacaagatccaccgggacagcggggacaacagccagacagagccccacagcttccgctacaagaacagaaggaaggagagcattgatgtgaagagcatcagcagccggggcagtgatgcccccagcctgcagaacagacgctaccccagcatggcccgcatccacagcatgaccatcgaggcccccatcaccaaggtgatcaacatcatcaatgctgcccaggagaacagccctgtgacagtggccgaggccctggacagagtgctggagatcctgcggaccacagagctgtacagcccccagctgggcaccaaggatgaggacccccacaccagtgacctggtgggcggcctgatgacagatggcctgcggcggctgtctggaaatgaatatgtgttcaccaagaatgtgcaccagagccacagccacctggccatgcccatcaccatcaatgatgtgcccccctgcatcagccagctgctggacaatgaggagagctgggacttcaacatctttgagctggaggccatcacccacaagaggcccctggtgtacctgggcctgaaggtgttcagcagatttggagtgtgtgagttcctgaactgcagcgagaccaccctgcgggcctggttccaggtgattgaggccaactaccacagcagcaatgcctaccacaacagcacccatgctgctgatgtgctgcacgccacagccttcttcctgggcaaggagcgggtgaagggcagcctggaccagctggatgaggtggccgccctgattgctgccaccgtgcatgatgtggaccaccctggccgcaccaacagcttcctgtgcaatgccggcagcgagctggccgtgctgtacaatgacacagctgtgctggagagccaccacacagccctggccttccagctgactgtgaaggacaccaagtgcaacatcttcaagaacatcgacaggaaccactaccgcaccctgcggcaggccatcatcgacatggtgctggccacagagatgaccaagcactttgagcacgtgaacaagtttgtgaacagcatcaacaagcccatggctgctgagattgagggcagtgactgtgagtgcaacccagctgggaagaacttccctgagaaccagatcctgatcaagaggatgatgatcaagtgtgctgatgtggccaacccctgccggcccctggacctgtgcatcgagtgggccggccgcatcagcgaggagtactttgcccagacagatgaggagaagaggcagggcctgcctgtggtgatgcctgtgtttgacaggaacacctgcagcatccccaagagccagatctccttcatcgactacttcatcacagacatgtttgatgcctgggatgcctttgcccacctgcctgccctgatgcagcacctggccgacaactacaagcactggaagaccctggatgacctgaagtgcaagagcctgcggctgcccagcgacagctag

SEQ ID NO: 163969 - DNA, 1053 bp, Artificial Sequence
  Description of Artificial Sequence: Synthetic coding sequence
atgcccatcaccatcaatgatgtgcccccctgcatcagccagctgctggacaatgaggagagctgggacttcaacatctttgagctggaggccatcacccacaagaggcccctggtgtacctgggcctgaaggtgttcagcagatttggagtgtgtgagttcctgaactgcagcgagaccaccctgcgggcctggttccaggtgattgaggccaactaccacagcagcaatgcctaccacaacagcacccatgctgctgatgtgctgcacgccacagccttcttcctgggcaaggagcgggtgaagggcagcctggaccagctggatgaggtggccgccctgattgctgccaccgtgcatgatgtggaccaccctggccgcaccaacagcttcctgtgcaatgccggcagcgagctggccgtgctgtacaatgacacagctgtgctggagagccaccacacagccctggccttccagctgactgtgaaggacaccaagtgcaacatcttcaagaacatcgacaggaaccactaccgcaccctgcggcaggccatcatcgacatggtgctggccacagagatgaccaagcactttgagcacgtgaacaagtttgtgaacagcatcaacaagcccatggctgctgagattgagggcagtgactgtgagtgcaacccagctgggaagaacttccctgagaaccagatcctgatcaagaggatgatgatcaagtgtgctgatgtggccaacccctgccggcccctggacctgtgcatcgagtgggccggccgcatcagcgaggagtactttgcccagacagatgaggagaagaggcagggcctgcctgtggtgatgcctgtgtttgacaggaacacctgcagcatccccaagagccagatctccttcatcgactacttcatcacagacatgtttgatgcctgggatgcctttgcccacctgcctgccctgatgcagcacctggccgacaactacaagcactggaagaccctggatgacctgaagtgcaagagcctgcggctgcccagcgacagctag

SEQ ID NO: 163970 - DNA, 1782 bp, Artificial Sequence
  Description of Artificial Sequence: Synthetic coding sequence
atgggcagcggcagcagcagctaccggcccaaggccatctacctggacattgatggccgcatccagaaggtgatcttcagcaagtactgcaacagcagtgacatcatggacctcttctgcatcgccaccggcctgcccaggaacaccaccatcagcctgctgaccacagatgatgccatggtgtccattgaccccaccatgcctgccaacagcgagaggaccccctacaaggtgcggcctgtggccatcaagcagctgtctgctggggtggaggacaagaggaccaccagccggggccagagcgctgagcggcccctgcgggacagaagagtggtgggcctggagcagccccggcgggagggcgcctttgaaagtggccaggtggagccccggccccgggagccccagggctgctaccaggagggccagaggatccccccagagcgggaggagctgatccagagcgtgctggcccaggtggccgagcagttcagccgggccttcaagatcaatgagctgaaggccgaggtggccaaccacctggccgtgctggagaagagggtggagctggagggcctgaaggtggtggagattgagaagtgcaagagtgacatcaagaagatgagggaggagctggccgcccggagcagcaggaccaactgcccctgcaagtacagcttcctggacaaccacaagaagctgaccccaagaagagatgtgcccacctaccccaagtacctgctgagccctgagaccatcgaggccctgaggaagcccacctttgatgtgtggctgtgggagcccaatgagatgctgagctgcctggagcacatgtaccatgacctgggcctggtgcgggacttcagcatcaaccctgtgaccctgcggcgctggctgttctgtgtgcatgacaactacagaaacaaccccttccacaacttccgccactgcttctgtgtggcccagatgatgtacagcatggtgtggctgtgcagcctgcaggagaagttcagccagacagacatcctgatcctgatgacagctgccatctgccacgacctggaccaccctggctacaacaacacctaccagatcaatgccaggacagagctggccgtgcgctacaatgacatcagccccctggagaaccaccactgtgctgtggccttccagatcctggccgagcctgagtgcaacatcttcagcaacatccccccagatggcttcaagcagatccggcagggcatgatcaccctcatcctggccacagacatggcccggcatgctgagatcatggacagcttcaaggagaagatggagaactttgactacagcaatgaggagcacatgaccctgctgaagatgatcctgatcaagtgctgtgacatcagcaatgaggtgcggcccatggaggtggccgagccctgggtggactgcctgctggaggagtacttcatgcagagcgaccgggagaagtctgagggcctgcctgtggcccccttcatggaccgggacaaggtgaccaaggccacagcccagatcggcttcatcaagtttgtgctgatccccatgtttgaaacagtgaccaagctgttccccatggtggaggagatcatgctgcagcccctgtgggagagccgggacagatatgaggagctgaagagaattgatgatgccatgaaggagctgcagaagaagacagacagcctgaccagcggggccacagagaagagccgggagaggagcagagatgtgaagaacagcgagggggactgtgcctag

SEQ ID NO: 163971 - DNA, 1704 bp, Artificial Sequence
  Description of Artificial Sequence: Synthetic coding sequence
atgggcagcggcagcagcagctaccggcccaaggccatctacctggacattgatggccgcatccagaaggtgatcttcagcaagtactgcaacagcagtgacatcatggacctcttctgcatcgccaccggcctgcccaggaccccctacaaggtgcggcctgtggccatcaagcagctgtctgctggggtggaggacaagaggaccaccagccggggccagagcgctgagcggcccctgcgggacagaagagtggtgggcctggagcagccccggcgggagggcgcctttgaaagtggccaggtggagccccggccccgggagccccagggctgctaccaggagggccagaggatccccccagagcgggaggagctgatccagagcgtgctggcccaggtggccgagcagttcagccgggccttcaagatcaatgagctgaaggccgaggtggccaaccacctggccgtgctggagaagagggtggagctggagggcctgaaggtggtggagattgagaagtgcaagagtgacatcaagaagatgagggaggagctggccgcccggagcagcaggaccaactgcccctgcaagtacagcttcctggacaaccacaagaagctgaccccaagaagagatgtgcccacctaccccaagtacctgctgagccctgagaccatcgaggccctgaggaagcccacctttgatgtgtggctgtgggagcccaatgagatgctgagctgcctggagcacatgtaccatgacctgggcctggtgcgggacttcagcatcaaccctgtgaccctgcggcgctggctgttctgtgtgcatgacaactacagaaacaaccccttccacaacttccgccactgcttctgtgtggcccagatgatgtacagcatggtgtggctgtgcagcctgcaggagaagttcagccagacagacatcctgatcctgatgacagctgccatctgccacgacctggaccaccctggctacaacaacacctaccagatcaatgccaggacagagctggccgtgcgctacaatgacatcagccccctggagaaccaccactgtgctgtggccttccagatcctggccgagcctgagtgcaacatcttcagcaacatccccccagatggcttcaagcagatccggcagggcatgatcaccctcatcctggccacagacatggcccggcatgctgagatcatggacagcttcaaggagaagatggagaactttgactacagcaatgaggagcacatgaccctgctgaagatgatcctgatcaagtgctgtgacatcagcaatgaggtgcggcccatggaggtggccgagccctgggtggactgcctgctggaggagtacttcatgcagagcgaccgggagaagtctgagggcctgcctgtggcccccttcatggaccgggacaaggtgaccaaggccacagcccagatcggcttcatcaagtttgtgctgatccccatgtttgaaacagtgaccaagctgttccccatggtggaggagatcatgctgcagcccctgtgggagagccgggacagatatgaggagctgaagagaattgatgatgccatgaaggagctgcagaagaagacagacagcctgaccagcggggccacagagaagagccgggagaggagcagagatgtgaagaacagcgagggggactgtgcctag

SEQ ID NO: 163972 - DNA, 1476 bp, Artificial Sequence
  Description of Artificial Sequence: Synthetic coding sequence
atgggcagcggcagcagcagctaccggcccaaggccatctacctggacattgatggccgcatccagaaggagcatgaccacctgcctgctgaccacagaagaagacatggcctgcaccggccccaccacgcccgggagttccgcacccacagcgtgcagagcgagacctgtggccaccaggccaccctgcgggccttcaagatcaatgagctgaaggccgaggtggccaaccacctggccgtgctggagaagagggtggagctggagggcctgaaggtggtggagattgagaagtgcaagagtgacatcaagaagatgagggaggagctggccgcccggagcagcaggaccaactgcccctgcaagtacagcttcctggacaaccacaagaagctgaccccaagaagagatgtgcccacctaccccaagtacctgctgagccctgagaccatcgaggccctgaggaagcccacctttgatgtgtggctgtgggagcccaatgagatgctgagctgcctggagcacatgtaccatgacctgggcctggtgcgggacttcagcatcaaccctgtgaccctgcggcgctggctgttctgtgtgcatgacaactacagaaacaaccccttccacaacttccgccactgcttctgtgtggcccagatgatgtacagcatggtgtggctgtgcagcctgcaggagaagttcagccagacagacatcctgatcctgatgacagctgccatctgccacgacctggaccaccctggctacaacaacacctaccagatcaatgccaggacagagctggccgtgcgctacaatgacatcagccccctggagaaccaccactgtgctgtggccttccagatcctggccgagcctgagtgcaacatcttcagcaacatccccccagatggcttcaagcagatccggcagggcatgatcaccctcatcctggccacagacatggcccggcatgctgagatcatggacagcttcaaggagaagatggagaactttgactacagcaatgaggagcacatgaccctgctgaagatgatcctgatcaagtgctgtgacatcagcaatgaggtgcggcccatggaggtggccgagccctgggtggactgcctgctggaggagtacttcatgcagagcgaccgggagaagtctgagggcctgcctgtggcccccttcatggaccgggacaaggtgaccaaggccacagcccagatcggcttcatcaagtttgtgctgatccccatgtttgaaacagtgaccaagctgttccccatggtggaggagatcatgctgcagcccctgtgggagagccgggacagatatgaggagctgaagagaattgatgatgccatgaaggagctgcagaagaagacagacagcctgaccagcggggccacagagaagagccgggagaggagcagagatgtgaagaacagcgagggggactgtgcctag

SEQ ID NO: 163973 - DNA, 1602 bp, Artificial Sequence
  Description of Artificial Sequence: Synthetic coding sequence
atgggcagcggcagcagcagctaccggcccaaggccatctacctggacattgatggccgcatccagaaggtgatcttcagcaagtactgcaacagcagtgacatcatggacctcttctgcatcgccaccggcctgcccaggaacaccaccatcagcctgctgaccacagatgatgccatggtgtccattgaccccaccatgcctgccaacagcgagaggaccccctacaaggtgcggcctgtggccatcaagcagctgtctgagcgggaggagctgatccagagcgtgctggcccaggtggccgagcagttcagccgggccttcaagatcaatgagctgaaggccgaggtggccaaccacctggccgtgctggagaagagggtggagctggagggcctgaaggtggtggagattgagaagtgcaagagtgacatcaagaagatgagggaggagctggccgcccggagcagcaggaccaactgcccctgcaagtacagcttcctggacaaccacaagaagctgaccccaagaagagatgtgcccacctaccccaagtacctgctgagccctgagaccatcgaggccctgaggaagcccacctttgatgtgtggctgtgggagcccaatgagatgctgagctgcctggagcacatgtaccatgacctgggcctggtgcgggacttcagcatcaaccctgtgaccctgcggcgctggctgttctgtgtgcatgacaactacagaaacaaccccttccacaacttccgccactgcttctgtgtggcccagatgatgtacagcatggtgtggctgtgcagcctgcaggagaagttcagccagacagacatcctgatcctgatgacagctgccatctgccacgacctggaccaccctggctacaacaacacctaccagatcaatgccaggacagagctggccgtgcgctacaatgacatcagccccctggagaaccaccactgtgctgtggccttccagatcctggccgagcctgagtgcaacatcttcagcaacatccccccagatggcttcaagcagatccggcagggcatgatcaccctcatcctggccacagacatggcccggcatgctgagatcatggacagcttcaaggagaagatggagaactttgactacagcaatgaggagcacatgaccctgctgaagatgatcctgatcaagtgctgtgacatcagcaatgaggtgcggcccatggaggtggccgagccctgggtggactgcctgctggaggagtacttcatgcagagcgaccgggagaagtctgagggcctgcctgtggcccccttcatggaccgggacaaggtgaccaaggccacagcccagatcggcttcatcaagtttgtgctgatccccatgtttgaaacagtgaccaagctgttccccatggtggaggagatcatgctgcagcccctgtgggagagccgggacagatatgaggagctgaagagaattgatgatgccatgaaggagctgcagaagaagacagacagcctgaccagcggggccacagagaagagccgggagaggagcagagatgtgaagaacagcgagggggactgtgcctag

SEQ ID NO: 163974 - DNA, 1398 bp, Artificial Sequence
  Description of Artificial Sequence: Synthetic coding sequence
atgggcagcggcagcagcagctaccggcccaaggccatctacctggacattgatggccgcatccagaagcacagcgtgcagagcgagacctgtggccaccaggccaccctgcgggccttcaagatcaatgagctgaaggccgaggtggccaaccacctggccgtgctggagaagagggtggagctggagggcctgaaggtggtggagattgagaagtgcaagagtgacatcaagaagatgagggaggagctggccgcccggagcagcaggaccaactgcccctgcaagtacagcttcctggacaaccacaagaagctgaccccaagaagagatgtgcccacctaccccaagtacctgctgagccctgagaccatcgaggccctgaggaagcccacctttgatgtgtggctgtgggagcccaatgagatgctgagctgcctggagcacatgtaccatgacctgggcctggtgcgggacttcagcatcaaccctgtgaccctgcggcgctggctgttctgtgtgcatgacaactacagaaacaaccccttccacaacttccgccactgcttctgtgtggcccagatgatgtacagcatggtgtggctgtgcagcctgcaggagaagttcagccagacagacatcctgatcctgatgacagctgccatctgccacgacctggaccaccctggctacaacaacacctaccagatcaatgccaggacagagctggccgtgcgctacaatgacatcagccccctggagaaccaccactgtgctgtggccttccagatcctggccgagcctgagtgcaacatcttcagcaacatccccccagatggcttcaagcagatccggcagggcatgatcaccctcatcctggccacagacatggcccggcatgctgagatcatggacagcttcaaggagaagatggagaactttgactacagcaatgaggagcacatgaccctgctgaagatgatcctgatcaagtgctgtgacatcagcaatgaggtgcggcccatggaggtggccgagccctgggtggactgcctgctggaggagtacttcatgcagagcgaccgggagaagtctgagggcctgcctgtggcccccttcatggaccgggacaaggtgaccaaggccacagcccagatcggcttcatcaagtttgtgctgatccccatgtttgaaacagtgaccaagctgttccccatggtggaggagatcatgctgcagcccctgtgggagagccgggacagatatgaggagctgaagagaattgatgatgccatgaaggagctgcagaagaagacagacagcctgaccagcggggccacagagaagagccgggagaggagcagagatgtgaagaacagcgagggggactgtgcctag

SEQ ID NO: 163975 - DNA, 1623 bp, Artificial Sequence
  Description of Artificial Sequence: Synthetic coding sequence
atgggcagcggcagcagcagctaccggcccaaggccatctacctggacattgatggccgcatccagaaggtgatcttcagcaagtactgcaacagcagtgacatcatggacctcttctgcatcgccaccggcctgcccaggaacaccaccatcagcctgctgaccacagatgatgccatggtgtccattgaccccaccatgcctgccaacagcgagagaaatgagctgatcctgtacaccagcctgaggaacctgctcttcctgcccagcaaggagagctgggccagccaccagcacagcgtgcagagcgagacctgtggccaccaggccaccctgcgggccttcaagatcaatgagctgaaggccgaggtggccaaccacctggccgtgctggagaagagggtggagctggagggcctgaaggtggtggagattgagaagtgcaagagtgacatcaagaagatgagggaggagctggccgcccggagcagcaggaccaactgcccctgcaagtacagcttcctggacaaccacaagaagctgacccccaggagagatgtgcccacctaccccaagtacctgctgagccctgagaccatcgaggccctgaggaagcccacctttgatgtgtggctgtgggagcccaatgagatgctgagctgcctggagcacatgtaccatgacctgggcctggtgcgggacttcagcatcaaccctgtgaccctgcggcgctggctgttctgtgtgcatgacaactacagaaacaaccccttccacaacttccgccactgcttctgtgtggcccagatgatgtacagcatggtgtggctgtgcagcctgcaggagaagttcagccagacagacatcctgatcctgatgacagctgccatctgccacgacctggaccaccctggctacaacaacacctaccagatcaatgccaggacagagctggccgtgcgctacaatgacatcagccccctggagaaccaccactgtgctgtggccttccagatcctggccgagcctgagtgcaacatcttcagcaacatccccccagatggcttcaagcagatccggcagggcatgatcaccctcatcctggccacagacatggcccggcatgctgagatcatggacagcttcaaggagaagatggagaactttgactacagcaatgaggagcacatgaccctgctgaagatgatcctgatcaagtgctgtgacatcagcaatgaggtgcggcccatggaggtggccgagccctgggtggactgcctgctggaggagtacttcatgcagagcgaccgggagaagtctgagggcctgcctgtggcccccttcatggaccgggacaaggtgaccaaggccacagcccagatcggcttcatcaagtttgtgctgatccccatgtttgagaccgtgaccaagctgttccccatggtggaggagatcatgctgcagcccctgtgggagagccgggacagatatgaggagctgaagagaattgatgatgccatgaaggagctgcagaagaagacagacagcctgaccagcggggccacagagaagagccgggagaggagcagagatgtgaagaacagcgagggggactgtgcctag

SEQ ID NO: 163976 - DNA, 1401 bp, Artificial Sequence
  Description of Artificial Sequence: Synthetic coding sequence
atggatgccttccgcagcaccccctacaaggtgcggcctgtggccatcaagcagctgtctgagcgggaggagctgatccagagcgtgctggcccaggtggccgagcagttcagccgggccttcaagatcaatgagctgaaggccgaggtggccaaccacctggccgtgctggagaagagggtggagctggagggcctgaaggtggtggagattgagaagtgcaagagtgacatcaagaagatgagggaggagctggccgcccggagcagcaggaccaactgcccctgcaagtacagcttcctggacaaccacaagaagctgacccccaggagagatgtgcccacctaccccaagtacctgctgagccctgagaccatcgaggccctgaggaagcccacctttgatgtgtggctgtgggagcccaatgagatgctgagctgcctggagcacatgtaccatgacctgggcctggtgcgggacttcagcatcaaccctgtgaccctgcggcgctggctgttctgtgtgcatgacaactacagaaacaaccccttccacaacttccgccactgcttctgtgtggcccagatgatgtacagcatggtgtggctgtgcagcctgcaggagaagttcagccagacagacatcctgatcctgatgacagctgccatctgccacgacctggaccaccctggctacaacaacacctaccagatcaatgccaggacagagctggccgtgcgctacaatgacatcagccccctggagaaccaccactgtgctgtggccttccagatcctggccgagcctgagtgcaacatcttcagcaacatccccccagatggcttcaagcagatccggcagggcatgatcaccctcatcctggccacagacatggcccggcatgctgagatcatggacagcttcaaggagaagatggagaactttgactacagcaatgaggagcacatgaccctgctgaagatgatcctgatcaagtgctgtgacatcagcaatgaggtgcggcccatggaggtggccgagccctgggtggactgcctgctggaggagtacttcatgcagagcgaccgggagaagtctgagggcctgcctgtggcccccttcatggaccgggacaaggtgaccaaggccacagcccagatcggcttcatcaagtttgtgctgatccccatgtttgagaccgtgaccaagctgttccccatggtggaggagatcatgctgcagcccctgtgggagagccgggacagatatgaggagctgaagagaattgatgatgccatgaaggagctgcagaagaagacagacagcctgaccagcggggccacagagaagagccgggagaggagcagagatgtgaagaacagcgagggggactgtgcctag

SEQ ID NO: 163977 - DNA, 1659 bp, Artificial Sequence
  Description of Artificial Sequence: Synthetic coding sequence
atggatgccttcagaagaaacaccaccatcagcctgctgaccacagatgatgccatggtgtccattgaccccaccatgcctgccaacagcgagaggaccccctacaaggtgcggcctgtggccatcaagcagctgtctgctggggtggaggacaagaggaccaccagccggggccagagcgctgagcggcccctgcgggaccggcgggtggtgggcctggagcagccccggcgggagggcgcctttgagagcggccaggtggagccccggccccgggagccccagggctgctaccaggagggccagagaattcctcctgagcgggaggagctgatccagagcgtgctggcccaggtggccgagcagttcagccgggccttcaagatcaatgagctgaaggccgaggtggccaaccacctggccgtgctggagaagagggtggagctggagggcctgaaggtggtggagattgagaagtgcaagagtgacatcaagaagatgagggaggagctggccgcccggagcagcaggaccaactgcccctgcaagtacagcttcctggacaaccacaagaagctgacccccaggagagatgtgcccacctaccccaagtacctgctgagccctgagaccatcgaggccctgaggaagcccacctttgatgtgtggctgtgggagcccaatgagatgctgagctgcctggagcacatgtaccatgacctgggcctggtgcgggacttcagcatcaaccctgtgaccctgcggcgctggctgttctgtgtgcatgacaactacagaaacaaccccttccacaacttccgccactgcttctgtgtggcccagatgatgtacagcatggtgtggctgtgcagcctgcaggagaagttcagccagacagacatcctgatcctgatgacagctgccatctgccacgacctggaccaccctggctacaacaacacctaccagatcaatgccaggacagagctggccgtgcgctacaatgacatcagccccctggagaaccaccactgtgctgtggccttccagatcctggccgagcctgagtgcaacatcttcagcaacatccccccagatggcttcaagcagatccggcagggcatgatcaccctcatcctggccacagacatggcccggcatgctgagatcatggacagcttcaaggagaagatggagaactttgactacagcaatgaggagcacatgaccctgctgaagatgatcctgatcaagtgctgtgacatcagcaatgaggtgcggcccatggaggtggccgagccctgggtggactgcctgctggaggagtacttcatgcagagcgaccgggagaagtctgagggcctgcctgtggcccccttcatggaccgggacaaggtgaccaaggccacagcccagatcggcttcatcaagtttgtgctgatccccatgtttgagaccgtgaccaagctgttccccatggtggaggagatcatgctgcagcccctgtgggagagccgggacagatatgaggagctgaagagaattgatgatgccatgaaggagctgcagaagaagacagacagcctgaccagcggggccacagagaagagccgggagaggagcagagatgtgaagaacagcgagggggactgtgcctag

SEQ ID NO: 163978 - DNA, 1302 bp, Artificial Sequence
  Description of Artificial Sequence: Synthetic coding sequence
atggatgccttcagaagagccttcaagatcaatgagctgaaggccgaggtggccaaccacctggccgtgctggagaagagggtggagctggagggcctgaaggtggtggagattgagaagtgcaagagtgacatcaagaagatgagggaggagctggccgcccggagcagcaggaccaactgcccctgcaagtacagcttcctggacaaccacaagaagctgaccccaagaagagatgtgcccacctaccccaagtacctgctgagccctgagaccatcgaggccctgaggaagcccacctttgatgtgtggctgtgggagcccaatgagatgctgagctgcctggagcacatgtaccatgacctgggcctggtgcgggacttcagcatcaaccctgtgaccctgcggcgctggctgttctgtgtgcatgacaactacagaaacaaccccttccacaacttccgccactgcttctgtgtggcccagatgatgtacagcatggtgtggctgtgcagcctgcaggagaagttcagccagacagacatcctgatcctgatgacagctgccatctgccacgacctggaccaccctggctacaacaacacctaccagatcaatgccaggacagagctggccgtgcgctacaatgacatcagccccctggagaaccaccactgtgctgtggccttccagatcctggccgagcctgagtgcaacatcttcagcaacatccccccagatggcttcaagcagatccggcagggcatgatcaccctcatcctggccacagacatggcccggcatgctgagatcatggacagcttcaaggagaagatggagaactttgactacagcaatgaggagcacatgaccctgctgaagatgatcctgatcaagtgctgtgacatcagcaatgaggtgcggcccatggaggtggccgagccctgggtggactgcctgctggaggagtacttcatgcagagcgaccgggagaagtctgagggcctgcctgtggcccccttcatggaccgggacaaggtgaccaaggccacagcccagatcggcttcatcaagtttgtgctgatccccatgtttgaaacagtgaccaagctgttccccatggtggaggagatcatgctgcagcccctgtgggagagccgggacagatatgaggagctgaagagaattgatgatgccatgaaggagctgcagaagaagacagacagcctgaccagcggggccacagagaagagccgggagaggagcagagatgtgaagaacagcgagggggactgtgcctag

SEQ ID NO: 163979 - DNA, 1380 bp, Artificial Sequence
  Description of Artificial Sequence: Synthetic coding sequence
atggatgccttcagaagaaacaccaccatcagcctgctgaccacagatgatgccatggtgtccattgaccccaccatgcctgccaacagcgagcgggccttcaagatcaatgagctgaaggccgaggtggccaaccacctggccgtgctggagaagagggtggagctggagggcctgaaggtggtggagattgagaagtgcaagagtgacatcaagaagatgagggaggagctggccgcccggagcagcaggaccaactgcccctgcaagtacagcttcctggacaaccacaagaagctgaccccaagaagagatgtgcccacctaccccaagtacctgctgagccctgagaccatcgaggccctgaggaagcccacctttgatgtgtggctgtgggagcccaatgagatgctgagctgcctggagcacatgtaccatgacctgggcctggtgcgggacttcagcatcaaccctgtgaccctgcggcgctggctgttctgtgtgcatgacaactacagaaacaaccccttccacaacttccgccactgcttctgtgtggcccagatgatgtacagcatggtgtggctgtgcagcctgcaggagaagttcagccagacagacatcctgatcctgatgacagctgccatctgccacgacctggaccaccctggctacaacaacacctaccagatcaatgccaggacagagctggccgtgcgctacaatgacatcagccccctggagaaccaccactgtgctgtggccttccagatcctggccgagcctgagtgcaacatcttcagcaacatccccccagatggcttcaagcagatccggcagggcatgatcaccctcatcctggccacagacatggcccggcatgctgagatcatggacagcttcaaggagaagatggagaactttgactacagcaatgaggagcacatgaccctgctgaagatgatcctgatcaagtgctgtgacatcagcaatgaggtgcggcccatggaggtggccgagccctgggtggactgcctgctggaggagtacttcatgcagagcgaccgggagaagtctgagggcctgcctgtggcccccttcatggaccgggacaaggtgaccaaggccacagcccagatcggcttcatcaagtttgtgctgatccccatgtttgaaacagtgaccaagctgttccccatggtggaggagatcatgctgcagcccctgtgggagagccgggacagatatgaggagctgaagagaattgatgatgccatgaaggagctgcagaagaagacagacagcctgaccagcggggccacagagaagagccgggagaggagcagagatgtgaagaacagcgagggggactgtgcctag

SEQ ID NO: 163980 - DNA, 1581 bp, Artificial Sequence
  Description of Artificial Sequence: Synthetic coding sequence
atggatgccttccgcagcaccccctacaaggtgcggcctgtggccatcaagcagctgtctgctggggtggaggacaagaggaccaccagccggggccagagcgctgagcggcccctgcgggaccggcgggtggtgggcctggagcagccccggcgggagggcgcctttgagagcggccaggtggagccccggccccgggagccccagggctgctaccaggagggccagagaattcctcctgagcgggaggagctgatccagagcgtgctggcccaggtggccgagcagttcagccgggccttcaagatcaatgagctgaaggccgaggtggccaaccacctggccgtgctggagaagagggtggagctggagggcctgaaggtggtggagattgagaagtgcaagagtgacatcaagaagatgagggaggagctggccgcccggagcagcaggaccaactgcccctgcaagtacagcttcctggacaaccacaagaagctgacccccaggagagatgtgcccacctaccccaagtacctgctgagccctgagaccatcgaggccctgaggaagcccacctttgatgtgtggctgtgggagcccaatgagatgctgagctgcctggagcacatgtaccatgacctgggcctggtgcgggacttcagcatcaaccctgtgaccctgcggcgctggctgttctgtgtgcatgacaactacagaaacaaccccttccacaacttccgccactgcttctgtgtggcccagatgatgtacagcatggtgtggctgtgcagcctgcaggagaagttcagccagacagacatcctgatcctgatgacagctgccatctgccacgacctggaccaccctggctacaacaacacctaccagatcaatgccaggacagagctggccgtgcgctacaatgacatcagccccctggagaaccaccactgtgctgtggccttccagatcctggccgagcctgagtgcaacatcttcagcaacatccccccagatggcttcaagcagatccggcagggcatgatcaccctcatcctggccacagacatggcccggcatgctgagatcatggacagcttcaaggagaagatggagaactttgactacagcaatgaggagcacatgaccctgctgaagatgatcctgatcaagtgctgtgacatcagcaatgaggtgcggcccatggaggtggccgagccctgggtggactgcctgctggaggagtacttcatgcagagcgaccgggagaagtctgagggcctgcctgtggcccccttcatggaccgggacaaggtgaccaaggccacagcccagatcggcttcatcaagtttgtgctgatccccatgtttgagaccgtgaccaagctgttccccatggtggaggagatcatgctgcagcccctgtgggagagccgggacagatatgaggagctgaagagaattgatgatgccatgaaggagctgcagaagaagacagacagcctgaccagcggggccacagagaagagccgggagaggagcagagatgtgaagaacagcgagggggactgtgcctag

SEQ ID NO: 163981 - DNA, 1479 bp, Artificial Sequence
  Description of Artificial Sequence: Synthetic coding sequence
atggatgccttcagaagaaacaccaccatcagcctgctgaccacagatgatgccatggtgtccattgaccccaccatgcctgccaacagcgagaggaccccctacaaggtgcggcctgtggccatcaagcagctgtctgagcgggaggagctgatccagagcgtgctggcccaggtggccgagcagttcagccgggccttcaagatcaatgagctgaaggccgaggtggccaaccacctggccgtgctggagaagagggtggagctggagggcctgaaggtggtggagattgagaagtgcaagagtgacatcaagaagatgagggaggagctggccgcccggagcagcaggaccaactgcccctgcaagtacagcttcctggacaaccacaagaagctgacccccaggagagatgtgcccacctaccccaagtacctgctgagccctgagaccatcgaggccctgaggaagcccacctttgatgtgtggctgtgggagcccaatgagatgctgagctgcctggagcacatgtaccatgacctgggcctggtgcgggacttcagcatcaaccctgtgaccctgcggcgctggctgttctgtgtgcatgacaactacagaaacaaccccttccacaacttccgccactgcttctgtgtggcccagatgatgtacagcatggtgtggctgtgcagcctgcaggagaagttcagccagacagacatcctgatcctgatgacagctgccatctgccacgacctggaccaccctggctacaacaacacctaccagatcaatgccaggacagagctggccgtgcgctacaatgacatcagccccctggagaaccaccactgtgctgtggccttccagatcctggccgagcctgagtgcaacatcttcagcaacatccccccagatggcttcaagcagatccggcagggcatgatcaccctcatcctggccacagacatggcccggcatgctgagatcatggacagcttcaaggagaagatggagaactttgactacagcaatgaggagcacatgaccctgctgaagatgatcctgatcaagtgctgtgacatcagcaatgaggtgcggcccatggaggtggccgagccctgggtggactgcctgctggaggagtacttcatgcagagcgaccgggagaagtctgagggcctgcctgtggcccccttcatggaccgggacaaggtgaccaaggccacagcccagatcggcttcatcaagtttgtgctgatccccatgtttgagaccgtgaccaagctgttccccatggtggaggagatcatgctgcagcccctgtgggagagccgggacagatatgaggagctgaagagaattgatgatgccatgaaggagctgcagaagaagacagacagcctgaccagcggggccacagagaagagccgggagaggagcagagatgtgaagaacagcgagggggactgtgcctag

SEQ ID NO: 163982 - DNA, 1524 bp, Artificial Sequence
  Description of Artificial Sequence: Synthetic coding sequence
atgggcagcggcagcagcagctaccggcccaaggccatctacctggacattgatggccgcatccagaaggtgatcttcagcaagtactgcaacagcagtgacatcatggacctcttctgcatcgccaccggcctgcccaggaccccctacaaggtgcggcctgtggccatcaagcagctgtctgagcgggaggagctgatccagagcgtgctggcccaggtggccgagcagttcagccgggccttcaagatcaatgagctgaaggccgaggtggccaaccacctggccgtgctggagaagagggtggagctggagggcctgaaggtggtggagattgagaagtgcaagagtgacatcaagaagatgagggaggagctggccgcccggagcagcaggaccaactgcccctgcaagtacagcttcctggacaaccacaagaagctgaccccaagaagagatgtgcccacctaccccaagtacctgctgagccctgagaccatcgaggccctgaggaagcccacctttgatgtgtggctgtgggagcccaatgagatgctgagctgcctggagcacatgtaccatgacctgggcctggtgcgggacttcagcatcaaccctgtgaccctgcggcgctggctgttctgtgtgcatgacaactacagaaacaaccccttccacaacttccgccactgcttctgtgtggcccagatgatgtacagcatggtgtggctgtgcagcctgcaggagaagttcagccagacagacatcctgatcctgatgacagctgccatctgccacgacctggaccaccctggctacaacaacacctaccagatcaatgccaggacagagctggccgtgcgctacaatgacatcagccccctggagaaccaccactgtgctgtggccttccagatcctggccgagcctgagtgcaacatcttcagcaacatccccccagatggcttcaagcagatccggcagggcatgatcaccctcatcctggccacagacatggcccggcatgctgagatcatggacagcttcaaggagaagatggagaactttgactacagcaatgaggagcacatgaccctgctgaagatgatcctgatcaagtgctgtgacatcagcaatgaggtgcggcccatggaggtggccgagccctgggtggactgcctgctggaggagtacttcatgcagagcgaccgggagaagtctgagggcctgcctgtggcccccttcatggaccgggacaaggtgaccaaggccacagcccagatcggcttcatcaagtttgtgctgatccccatgtttgaaacagtgaccaagctgttccccatggtggaggagatcatgctgcagcccctgtgggagagccgggacagatatgaggagctgaagagaattgatgatgccatgaaggagctgcagaagaagacagacagcctgaccagcggggccacagagaagagccgggagaggagcagagatgtgaagaacagcgagggggactgtgcctag

SEQ ID NO: 163983 - DNA, 1398 bp, Artificial Sequence
  Description of Artificial Sequence: Synthetic coding sequence
atggacctcttctgcatcgccaccggcctgcccaggaacaccaccatcagcctgctgaccacagatgatgccatggtgtccattgaccccaccatgcctgccaacagcgagcgggccttcaagatcaatgagctgaaggccgaggtggccaaccacctggccgtgctggagaagagggtggagctggagggcctgaaggtggtggagattgagaagtgcaagagtgacatcaagaagatgagggaggagctggccgcccggagcagcaggaccaactgcccctgcaagtacagcttcctggacaaccacaagaagctgaccccaagaagagatgtgcccacctaccccaagtacctgctgagccctgagaccatcgaggccctgaggaagcccacctttgatgtgtggctgtgggagcccaatgagatgctgagctgcctggagcacatgtaccatgacctgggcctggtgcgggacttcagcatcaaccctgtgaccctgcggcgctggctgttctgtgtgcatgacaactacagaaacaaccccttccacaacttccgccactgcttctgtgtggcccagatgatgtacagcatggtgtggctgtgcagcctgcaggagaagttcagccagacagacatcctgatcctgatgacagctgccatctgccacgacctggaccaccctggctacaacaacacctaccagatcaatgccaggacagagctggccgtgcgctacaatgacatcagccccctggagaaccaccactgtgctgtggccttccagatcctggccgagcctgagtgcaacatcttcagcaacatccccccagatggcttcaagcagatccggcagggcatgatcaccctcatcctggccacagacatggcccggcatgctgagatcatggacagcttcaaggagaagatggagaactttgactacagcaatgaggagcacatgaccctgctgaagatgatcctgatcaagtgctgtgacatcagcaatgaggtgcggcccatggaggtggccgagccctgggtggactgcctgctggaggagtacttcatgcagagcgaccgggagaagtctgagggcctgcctgtggcccccttcatggaccgggacaaggtgaccaaggccacagcccagatcggcttcatcaagtttgtgctgatccccatgtttgaaacagtgaccaagctgttccccatggtggaggagatcatgctgcagcccctgtgggagagccgggacagatatgaggagctgaagagaattgatgatgccatgaaggagctgcagaagaagacagacagcctgaccagcggggccacagagaagagccgggagaggagcagagatgtgaagaacagcgagggggactgtgcctag

SEQ ID NO: 163984 - DNA, 1869 bp, Artificial Sequence
  Description of Artificial Sequence: Synthetic coding sequence
atgccaccccagctgcagaatggcctgaacctgagcgccaaggtggtgcagggcagcctggacagcctgccccaggccgtgcgggagttcctggagaacaatgctgagctgtgccagcctgaccacatccacatctgtgatggcagcgaggaggagaatggccgcctgctgggccagatggaggaggagggcatcctgcggcggctgaagaagtatgacaactgctggctggccctgacagaccccagagatgtggcccgcatcgagagcaagacagtcatcgtgacccaggagcagagggacacagtgcccatccccaagacaggcctgagccagctgggccgctggatgtctgaggaggactttgagaaggccttcaatgcccgcttccctggctgcatgaagggccgcaccatgtatgtgatccccttctccatgggccccctgggcagccccctgagcaagattggcatcgagctgacagacagcccctacgtggtggcctccatgaggatcatgaccaggatgggcacccctgtgctggaggccgtgggagatggagaatttgtgaagtgcctgcacagcgtgggctgccccctgcccctgcagaagcccctggtgaacaactggccctgcaaccctgagctgaccctgattgcccacctgcctgacagaagagagatcatcagctttggaagtggctatggaggcaacagcctgctgggcaagaagtgctttgccctgaggatggccagccggctggccaaggaggagggctggctggccgagcacatgctgatcctgggcatcaccaaccctgagggggagaagaagtacctggccgccgccttccccagcgcctgtgggaagaccaacctggccatgatgaaccccagcctgcccggctggaaggtggagtgtgtgggagatgacatcgcctggatgaagtttgatgcccagggccacctgcgggccatcaacccagaaaatggcttctttggagtggcccctggcacctctgtgaagaccaaccccaatgccatcaagaccatccagaagaacaccatcttcaccaacgtggccgagaccagtgatggaggagtgtactgggagggcattgatgagcccctggccagcggcgtgaccatcacctcctggaagaacaaggagtggagcagtgaagatggagagccctgtgcccaccccaacagccgcttctgcaccccagccagccagtgccccatcattgatgctgcctgggagagccctgagggcgtgcccatcgagggcatcatctttggaggccggcggcctgctggggtgcccctggtgtatgaggccctgtcctggcagcacggcgtgtttgtgggcgccgccatgaggtctgaggccacagctgctgctgagcacaagggcaagatcatcatgcatgacccctttgccatgaggcccttcttcggctacaactttgggaagtacctggcccactggctgtccatggcccagcaccctgctgccaagctgcccaagatcttccacgtgaactggttcaggaaggacaaggagggcaagttcctgtggccaggctttggagagaacagccgggtgctggagtggatgttcaacagaattgatggcaaggccagcaccaagctgacccccatcggctacatccccaaggaggatgccctgaacctgaagggcctgggccacatcaacatgatggagctgttcagcatcagcaaggagttctgggagaaggaggtggaggacatcgagaagtacctggaggaccaggtgaatgctgacctgccctgtgaaattgaaagagagatcctggccctgaagcagaggatcagccagatgtag

SEQ ID NO: 163985 - DNA, 942 bp, Artificial Sequence
  Description of Artificial Sequence: Synthetic coding sequence
atgaccactggaagaaccatgtatgtgatccccttctccatgggccccctgggcagccccctgagcaagattggcatcgagctgacagacagcccctacgtggtggcctccatgaggatcatgaccaggatgggcacccctgtgctggaggccgtgggagatggagaatttgtgaagtgcctgcacagcgtgggctgccccctgcccctgcagaagcccctggtgaacaactggccctgcaaccctgagctgaccctgattgcccacctgcctgacagaagagagatcatcagctttggaagtggctatggaggcaacagcctgctgggcaagaagtgctttgccctgaggatggccagccggctggccaaggaggagggctggctggccgagcacatgctgatcctgggcatcaccaaccctgagggggagaagaagtacctggccgccgccttccccagcgcctgtgggaagaccaacctggccatgatgaaccccagcctgcccggctggaaggtggagtgtgtgggagatgacatcgcctggatgaagtttgatgcccagggccacctgcgggccatcaacccagaaaatggcttctttggagtggcccctggcacctctgtgaagaccaaccccaatgccatcaagaccatccagaagaacaccatcttcaccaacgtggccgagaccagtgatggaggagtgtactgggagggcattgatgagcccctggccagcggcgtgaccatcacctcctggaagaacaaggagtggagcagtgaagatggagtgtccctgcctgaggccctggtgtgcagagctgctggaacagcctgcctgagccaggccctgaccagcctgagcctgagctaccggggcaccctgtgccccccccagctggaggtgctgcacccctgccagcctgtgccccaccactag

SEQ ID NO: 163986 - DNA, 915 bp, Artificial Sequence
  Description of Artificial Sequence: Synthetic coding sequence
accaccggccacctgcgggccatcaacccagaaaatggcttctttggagtggcccctggcacctctgtgaagaccaaccccaatgccatcaagaccatccagaagaacaccatcttcaccaacgtggccgagaccagtgatggaggagtgtactgggagggcattgatgagcccctggccagcggcgtgaccatcacctcctggaagaacaaggagtggagcagtgaagatggagagccctgtgcccaccccaacagccgcttctgcaccccagccagccagtgccccatcattgatgctgcctgggagagccctgagggcgtgcccatcgagggcatcatctttggaggccggcggcctgctggggtgcccctggtgtatgaggccctgtcctggcagcacggcgtgtttgtgggcgccgccatgaggtctgaggccacagctgctgctgagcacaagggcaagatcatcatgcatgacccctttgccatgaggcccttcttcggctacaactttgggaagtacctggcccactggctgtccatggcccagcaccctgctgccaagctgcccaagatcttccacgtgaactggttcaggaaggacaaggagggcaagttcctgtggccaggctttggagagaacagccgggtgctggagtggatgttcaacagaattgatggcaaggccagcaccaagctgacccccatcggctacatccccaaggaggatgccctgaacctgaagggcctgggccacatcaacatgatggagctgttcagcatcagcaaggagttctgggagaaggaggtggaggacatcgagaagtacctggaggaccaggtgaatgctgacctgccctgtgaaattgaaagagagatcctggccctgaagcagaggatcagccagatgtag

SEQ ID NO: 163987 - DNA, 918 bp, Artificial Sequence
  Description of Artificial Sequence: Synthetic coding sequence
atgaccaccggccacctgcgggccatcaacccagaaaatggcttcttcggcgtggcccctggcacctctgtgaagaccaaccccaatgccatcaagaccatccagaagaacaccatcttcaccaacgtggccgagaccagtgatggcggcgtgtactgggagggcattgatgagcccctggccagcggcgtgaccatcacctcctggaagaacaaggagtggagcagtgaagatggagagccctgtgcccaccccaacagccgcttctgcaccccagccagccagtgccccatcattgatgctgcctgggagagccctgagggcgtgcccatcgagggcatcatctttggaggaagaagacctgctggggtgcccctggtgtatgaggccctgtcctggcagcacggcgtgtttgtgggcgccgccatgaggtctgaggccacagctgctgctgagcacaagggcaagatcatcatgcatgacccctttgccatgaggcccttcttcggctacaactttgggaagtacctggcccactggctgtccatggcccagcaccctgctgccaagctgcccaagatcttccacgtgaactggttcaggaaggacaaggagggcaagttcctgtggccaggctttggagagaacagccgggtgctggagtggatgttcaacagaattgatggcaaggccagcaccaagctgacccccatcggctacatccccaaggaggatgccctgaacctgaagggcctgggccacatcaacatgatggagctgttcagcatcagcaaggagttctgggagaaggaggtggaggacatcgagaagtacctggaggaccaggtgaatgctgacctgccctgtgaaattgagcgggagatcctggccctgaagcagaggatcagccagatgtag

SEQ ID NO: 163988 - DNA, 1674 bp, Artificial Sequence; identical to SEQ ID NO: 148425
  Description of Artificial Sequence: Synthetic coding sequence

SEQ ID NO: 163989 - DNA, 1326 bp, Artificial Sequence
  Description of Artificial Sequence: Synthetic coding sequence
atggccgccctgtacagacctggcctgcggctgaactggcacggcctgagccccctgggctggcccagctgccgcagcatccagaccctgcgggtgctgagcggggacctgggccagctgcccaccggcatccgggactttgtggagcacagcgcccggctgtgccagcctgagggcatccacatctgtgatggaacagaagcagaaaatacagccaccctgaccctgctggagcagcagggcctcatcaggaagctgcccaagtacaacaactgctggctggccaggacagaccccaaggatgtggcccgggtggagagcaagacagtgattgtgacccccagccagagggacacagtgcagctgcccccaggaggagcccggggccagctgggcaactggatgagccctgctgacttccagagagctgtggatgagcgcttccctggctgcatgcagggccgcaccatgtatgtgctgcccttctccatgggccctgtgggcagccccctgagccgcatcggcgtgcagctgacagattctgcctacgtggtggcctccatgaggatcatgacccggctgggcacccctgtgctgcaggccctgggagatggagactttgtgaagtgcctgcacagcgtgggccagcccctgaccggccagggcgagcctgtgtcccagtggccctgcaaccctgagaagaccctgattggacatgtgcctgaccagcgggagatcatcagctttggaagtggctatggaggcaacagcctgctgggcaagaagtgctttgccctgcgcatcgccagccggctggccagagatgagggctggctggccgagcacatgctgatcctgggcatcaccagccctgctgggaagaagagatatgtggccgccgccttccccagcgcctgtgggaagaccaacctggccatgatgaggcctgccctgcccggctggaaggtggagtgtgtgggagatgacatcgcctggatgagatttgattctgagggccgcctgcgggccatcaacccagaaaatggcttctttggagtggcccctggcaccagcgccaccaccaaccccaatgccatggccaccatccagagcaacaccatcttcaccaacgtggccgagaccagtgatggaggagtgtactgggagggcatcgaccagcccctgcccccaggagtgacagtgacctcctggctgggcaagccctggaagccaggcatgtgtggcggggagggcgtggcccagcccccaggcctgagcaccctgatggtggagaagctgagcccccagccccccaccatcttctag

SEQ ID NO: 163990 - DNA, 1521 bp, Artificial Sequence
  Description of Artificial Sequence: Synthetic coding sequence
atgagccctgctgacttccagagagctgtggatgagcgcttccctggctgcatgcagggccgcaccatgtatgtgctgcccttctccatgggccctgtgggcagccccctgagccgcatcggcgtgcagctgacagattctgcctacgtggtggcctccatgaggatcatgacccggctgggcacccctgtgctgcaggccctgggagatggagactttgtgaagtgcctgcacagcgtgggccagcccctgaccggccagggcgagcctgtgtcccagtggccctgcaaccctgagaagaccctgattggacatgtgcctgaccagcgggagatcatcagctttggaagtggctatggaggcaacagcctgctgggcaagaagtgctttgccctgcgcatcgccagccggctggccagagatgagggctggctggccgagcacatgctgatcctgggcatcaccagccctgctgggaagaagagatatgtggccgccgccttccccagcgcctgtgggaagaccaacctggccatgatgaggcctgccctgcccggctggaaggtggagtgtgtgggagatgacatcgcctggatgagatttgattctgagggccgcctgcgggccatcaacccagaaaatggcttctttggagtggcccctggcaccagcgccaccaccaaccccaatgccatggccaccatccagagcaacaccatcttcaccaacgtggccgagaccagtgatggaggagtgtactgggagggcatcgaccagcccctgcccccaggagtgacagtgacctcctggctgggcaagccctggaagccaggggacaaggagccctgtgcccaccccaacagccgcttctgtgccccagcccggcagtgccccatcatggaccctgcctgggaggcccctgagggcgtgcccattgatgccatcatctttggaggccggcggcccaagggcgtgcccctggtgtatgaggccttcaactggaggcatggagtgtttgtgggcagcgccatgaggtctgagagcacagctgctgctgagcacaagggcaagatcatcatgcatgacccctttgccatgaggcccttcttcggctacaactttggccactacctggagcactggctgtccatggagggcaggaagggggcccagctgccccgcatcttccacgtgaactggttcagaagagatgaggccggccacttcctgtggccaggctttggagaaaatgcccgggtgctggactggatctgccggcggctggagggagaagattctgcccgggagacccccatcggcctggtgcccaaggagggcgccctggacctgagcggcctgcgggccatcgacaccacccagctgttcagcctgcccaaggacttctgggagcaggaggtgcgggacatccgcagctacctgacagagcaggtgaaccaggacctgcccaaggaggtgctggccgagctggaggccctggagaggagagtgcacaagatgtag

SEQ ID NO: 163991 - DNA, 1521 bp, Artificial Sequence; identical to SEQ ID NO: 163990
  Description of Artificial Sequence: Synthetic coding sequence

SEQ ID NO: 163992 - DNA, 2343 bp, Artificial Sequence
  Description of Artificial Sequence: Synthetic coding sequence
atggctgctgtggacctggagaagctgcgggccagcggggccggcaaggccatcggcgtgctgaccagcggaggagatgcccagggcatgaatgctgctgtgcgggctgtgaccaggatgggcatctacgtgggcgccaaggtgttcctgatctatgagggctatgagggcctggtggagggcggggagaacatcaagcaggccaactggctgtctgtgagcaacatcatccagctgggcggcaccatcatcggcagcgcccgctgcaaggccttcaccacccgggagggccggcgggctgctgcctacaacctggtgcagcacggcatcaccaacctgtgtgtgattggaggagatggcagcctgactggagccaacatcttccgctctgagtggggcagcctgctggaggagctggtggccgagggcaagatcagcgagaccacagcccggacctacagccacctgaacattgctggcctggtgggcagcattgacaatgacttctgtggcacagacatgaccatcggcacagacagcgccctgcaccgcatcatggaggtgattgatgccatcaccaccacagcccagagccaccagaggacctttgtgctggaggtgatgggccgccactgcggctacctggccctggtgtctgccctggccagcggggctgactggctgttcatccctgaggcccccccagaagatggctgggagaacttcatgtgtgagcggctgggggagaccaggagccggggcagccggctgaacatcatcatcatcgccgagggcgccatcgacagaaatggcaagcccatcagcagcagctatgtgaaggacctggtggtgcagaggctgggctttgacaccagggtgacagtgctgggccacgtgcagaggggcggcacccccagcgcctttgaccgcatcctgagcagcaagatgggcatggaggccgtgatggccctgctggaggccaccccagacaccccagcctgtgtggtgaccctgagcggcaaccagagcgtgcggctgcccctgatggagtgtgtgcagatgaccaaggaggtgcagaaggccatggatgacaagagatttgatgaggccacccagctgcggggcggcagctttgagaacaactggaacatctacaagctgctggcccaccagaagccacccaaggagaagagcaacttcagcctggccatcctgaatgtgggcgccccagctgctggcatgaatgctgctgtgcgctctgctgtgaggacaggcatcagccacggccacacagtgtatgtggtgcatgatggctttgagggcctggccaagggccaggtgcaggaggtgggctggcatgatgtggccggctggctgggccggggcggctccatgctgggcaccaagaggaccctgcccaagggccagctggagagcatcgtggagaacatccgcatctacggcatccacgccctgctggtggtgggcggctttgaggcctatgaaggagtgctgcagctggtggaggcccggggccgctatgaggagctgtgcatcgtgatgtgtgtgatcccagccaccatcagcaacaacgtgcctggaacagacttcagcctgggcagtgacacagctgtgaatgctgccatggagagctgtgaccgcatcaagcagagcgccagcggcaccaagagaagagtcttcatcgtggagaccatgggcggctactgcggctacctggccaccgtgactggaattgctgtgggcgcagatgctgcctacgtgtttgaggaccccttcaacatccatgacctgaaggtgaatgtggagcacatgacagagaagatgaagacagacatccagaggggcctggtgctgagaaatgaaaaatgtcatgactactacaccacagagttcctgtacaacctgtacagcagcgagggcaagggcgtgtttgactgcaggaccaacgtgctgggccacctgcagcagggcggggcccccaccccatttgacaggaactacggcaccaagctgggcgtgaaggccatgctgtggctgtctgagaagctgcgggaggtgtacaggaagggccgggtgtttgccaatgccccagacagcgcctgcgtcatcggcctgaagaagaaggctgtggccttcagccctgtgacagagctgaagaaggacacagactttgagcacaggatgccccgggagcagtggtggctgagcctgcggctgatgctgaagatgctggcccagtaccgcatctccatggccgcctacgtgtctggagagctggagcacgtgaccaggaggaccctgtccatggacaagggcttctag

SEQ ID NO: 163993 - DNA, 762 bp, Artificial Sequence
  Description of Artificial Sequence: Synthetic coding sequence
atgaggtccatgtgcaaccagggccggggccgggagagcagccggggcggcctgcacgtgcagggcagctgccggggcctgagccgcagcccccagcaggagactggatttgccaaggccccagctggaacagactgcttcttccactgcagccctggcagccggggccagggcgacaggaaggaggaggtgaccagcgagcccggcggcaccagcatcatgagccggctgggcggcatgaatgctgctgtgcgggctgtgaccaggatgggcatctacgtgggcgccaaggtgttcctgatctatgagggctatgagggcctggtggagggcggggagaacatcaagcaggccaactggctgtctgtgagcaacatcatccagctgggcggcaccatcatcggcagcgcccgctgcaaggccttcaccacccgggagggccggcgggctgctgcctacaacctggtgcagcacggcatcaccaacctgtgtgtgattggaggagatggcagcctgactggagccaacatcttccgctctgagtggggcagcctgctggaggagctggtggccgagggcaagatcagcgagaccacagcccggacctacagccacctgaacattgctggcctggtgggcagcattgacaatgacttctgtggcacagacatgaccatcggcacagacagcgccctgcaccgcatcatggaggtgattgatgccatcaccacccggggccgcctgggggagctgcacgtgtag

SEQ ID NO: 163994 - DNA, 2484 bp, Artificial Sequence
  Description of Artificial Sequence: Synthetic coding sequence
atgtgcaaccagggccggggccgggagagcagcagaggaggcctgcacgtgcagggcagctgccggggcctgagccgcagcccccagcaggagaccggctttgccaaggccccagctggaacagactgcttcttccactgcagccctggcagccggggccagggcgacaggaaggaggaggtgaccagcgagcccggcggcaccagcatcatgagccggctgggcggcatgaatgctgctgtgcgggctgtgaccaggatgggcatctacgtgggcgccaaggtgttcctgatctatgagggctatgagggcctggtggagggcggggagaacatcaagcaggccaactggctgtctgtgagcaacatcatccagctgggcggcaccatcatcggcagcgcccgctgcaaggccttcaccacccgggagggcagaagagctgctgcctacaacctggtgcagcacggcatcaccaacctgtgtgtgattggaggagatggcagcctgaccggggccaacatcttccgctctgagtggggcagcctgctggaggagctggtggccgagggcaagatcagcgagaccacagcccggacctacagccacctgaacattgctggcctggtgggcagcattgacaatgacttctgtggcacagacatgaccatcggcacagattctgccctgcaccgcatcatggaggtgattgatgccatcaccaccacagcccagagccaccagaggacctttgtgctggaggtgatgggccgccactgcggctacctggccctggtgtctgccctggccagcggggctgactggctgttcatccctgaggcccccccagaagatggctgggagaacttcatgtgtgagcggctgggggagaccaggagccggggcagccggctgaacatcatcatcatcgccgagggcgccatcgacagaaatggcaagcccatcagcagcagctatgtgaaggacctggtggtgcagaggctgggctttgacaccagggtgacagtgctgggccacgtgcagagaggaggcaccccatctgcctttgaccgcatcctgagcagcaagatgggcatggaggccgtgatggccctgctggaggccaccccagacaccccagcctgtgtggtgaccctgagcggcaaccagagcgtgcggctgcccctgatggagtgtgtgcagatgaccaaggaggtgcagaaggccatggatgacaagagatttgatgaggccacccagctgcggggcggcagctttgagaacaactggaacatctacaagctgctggcccaccagaagccacccaaggagaagagcaacttcagcctggccatcctgaatgtgggcgccccagctgctggcatgaatgctgctgtgcgctctgctgtgaggacaggcatcagccacggccacacagtgtatgtggtgcatgatggctttgagggcctggccaagggccaggtgcaggaggtgggctggcatgatgtggccggctggctgggccggggcggctccatgctgggcaccaagaggaccctgcccaagggccagctggagagcatcgtggagaacatccgcatctacggcatccacgccctgctggtggtgggcggctttgaggcctatgagggcgtgctgcagctggtggaggcccggggccgctatgaggagctgtgcatcgtgatgtgtgtgatcccagccaccatcagcaacaacgtgcccggcacagacttcagcctgggcagtgacacagctgtgaatgctgccatggagagctgtgaccgcatcaagcagagcgccagcggcaccaagagaagagtcttcatcgtggagaccatgggcggctactgcggctacctggccaccgtgactggaattgctgtgggcgcagatgctgcctacgtgtttgaggaccccttcaacatccatgacctgaaggtgaatgtggagcacatgacagagaagatgaagacagacatccagaggggcctggtgctgagaaatgagaagtgccacgactactacaccacagagttcctgtacaacctgtacagcagcgagggcaaaggagtgtttgactgcaggaccaacgtgctgggccacctgcagcagggcggggcccccaccccatttgacagaaattatggcaccaagctgggcgtgaaggccatgctgtggctgtctgagaagctgcgggaggtgtacaggaagggccgggtgtttgccaatgccccagattctgcctgtgtgattggcctgaagaagaaggctgtggccttcagccctgtgacagagctgaagaaggacacagactttgagcacaggatgccccgggagcagtggtggctgagcctgcggctgatgctgaagatgctggcccagtaccgcatctccatggccgcctacgtgtctggagagctggagcacgtgaccaggaggaccctgtccatggacaagggcttctag

SEQ ID NO: 163995 - DNA, 1722 bp, Artificial Sequence
  Description of Artificial Sequence: Synthetic coding sequence
atgggccgccactgcggctacctggccctggtgtctgccctggccagcggggctgactggctgttcatccctgaggcccccccagaagatggctgggagaacttcatgtgtgagcggctgggggagaccaggagccggggcagccggctgaacatcatcatcatcgccgagggcgccatcgacagaaatggcaagcccatcagcagcagctatgtgaaggacctggtggtgcagaggctgggctttgacaccagggtgacagtgctgggccacgtgcagagaggaggcaccccatctgcctttgaccgcatcctgagcagcaagatgggcatggaggccgtgatggccctgctggaggccaccccagacaccccagcctgtgtggtgaccctgagcggcaaccagagcgtgcggctgcccctgatggagtgtgtgcagatgaccaaggaggtgcagaaggccatggatgacaagagatttgatgaggccacccagctgcggggcggcagctttgagaacaactggaacatctacaagctgctggcccaccagaagccacccaaggagaagagcaacttcagcctggccatcctgaatgtgggcgccccagctgctggcatgaatgctgctgtgcgctctgctgtgaggacaggcatcagccacggccacacagtgtatgtggtgcatgatggctttgagggcctggccaagggccaggtgcaggaggtgggctggcatgatgtggccggctggctgggccggggcggctccatgctgggcaccaagaggaccctgcccaagggccagctggagagcatcgtggagaacatccgcatctacggcatccacgccctgctggtggtgggcggctttgaggcctatgagggcgtgctgcagctggtggaggcccggggccgctatgaggagctgtgcatcgtgatgtgtgtgatcccagccaccatcagcaacaacgtgcccggcacagacttcagcctgggcagtgacacagctgtgaatgctgccatggagagctgtgaccgcatcaagcagagcgccagcggcaccaagagaagagtcttcatcgtggagaccatgggcggctactgcggctacctggccaccgtgactggaattgctgtgggcgcagatgctgcctacgtgtttgaggaccccttcaacatccatgacctgaaggtgaatgtggagcacatgacagagaagatgaagacagacatccagaggggcctggtgctgagaaatgagaagtgccacgactactacaccacagagttcctgtacaacctgtacagcagcgagggcaaaggagtgtttgactgcaggaccaacgtgctgggccacctgcagcagggcggggcccccaccccatttgacagaaattatggcaccaagctgggcgtgaaggccatgctgtggctgtctgagaagctgcgggaggtgtacaggaagggccgggtgtttgccaatgccccagattctgcctgtgtgattggcctgaagaagaaggctgtggccttcagccctgtgacagagctgaagaaggacacagactttgagcacaggatgccccgggagcagtggtggctgagcctgcggctgatgctgaagatgctggcccagtaccgcatctccatggccgcctacgtgtctggagagctggagcacgtgaccaggaggaccctgtccatggacaagggcttctag

SEQ ID NO: 163996 - DNA, 2343 bp, Artificial Sequence
  Description of Artificial Sequence: Synthetic coding sequence
atgacccatgaggagcaccacgccgccaagaccctgggcatcggcaaggccatcgctgtgctgaccagcggaggagatgcccagggcatgaatgctgctgtgcgggctgtggtgcgggtgggcatcttcaccggggcccgggtcttctttgtgcatgagggctaccagggcctggtggatggaggagaccacatcaaggaggccacctgggagagcgtgtccatgatgctgcagctgggcggcaccgtcatcggcagcgcccgctgcaaggacttccgggagcgggagggccgcctgcgggccgcctacaacctggtgaagaggggcatcaccaacctgtgtgtgattggaggagatggcagcctgactggagctgacaccttccgctctgagtggagcgacctgctgagtgacctgcagaaggccggcaagatcacagatgaggaggccaccaagagcagctacctgaacatcgtgggcctggtgggcagcattgacaatgacttctgtggcacagacatgaccatcggcacagacagcgccctgcaccgcatcatggagatcgtggatgccatcaccaccacagcccagagccaccagaggacctttgtgctggaggtgatgggccgccactgcggctacctggccctggtgaccagcctgagctgtggggctgactgggtgttcatccctgagtgccccccagatgatgactgggaggagcacctgtgccggcggctgtctgagaccaggacccggggcagccggctgaacatcatcatcgtggccgagggcgccatcgacaagaatggcaagcccatcaccagcgaggacatcaagaacctggtggtgaagaggctgggctatgacaccagggtgacagtgctgggccacgtgcagaggggcggcacccccagcgcctttgaccgcatcctgggcagcaggatgggcgtggaggccgtgatggccctgctggagggcaccccagacaccccagcctgtgtggtgtccctgagcggcaaccaggccgtgcggctgcccctgatggagtgtgtgcaggtgaccaaggatgtgaccaaggccatggatgagaagaagtttgatgaggccctgaagctgcggggccgctccttcatgaacaactgggaggtgtacaagctgctggcccacgtgcggccccctgtgtccaagagcggcagccacacagtggccgtgatgaatgtgggcgccccagctgctggcatgaatgctgctgtgcgcagcacagtgagaattggcctcatccagggcaacagagtgctggtggtgcatgatggctttgagggcctggccaagggccagatcgaggaggccggctggagctatgtgggcggctggacaggccagggcggcagcaagctgggcaccaagaggaccctgcccaagaagagctttgagcagatcagcgccaacatcaccaagttcaacatccagggcctggtgatcatcggcggctttgaggcctacacaggaggcctggagctgatggagggcaggaagcagtttgatgagctgtgcatcccctttgtggtgatcccagccaccgtgagcaacaacgtgcccggcagtgacttctctgtgggcgctgacacagccctgaacaccatctgcaccacctgtgaccgcatcaagcagagcgctgctggcaccaagagaagagtcttcatcatcgagaccatgggcggctactgcggctacctggccaccatggccggcctggccgccggggctgatgctgcctacatctttgaggagcccttcaccatccgggacctgcaggccaacgtggagcacctggtgcagaagatgaagaccaccgtgaagaggggcctggtgctgagaaatgagaagtgcaatgaaaactacaccacagacttcatcttcaacctgtacagcgaggagggcaagggcatctttgacagcaggaagaatgtgctgggccacatgcagcagggcggcagccccaccccatttgacaggaactttgccaccaagatgggcgccaaggccatgaactggatgtctgggaagatcaaggagagctacagaaatggccgcatctttgccaacaccccagattctggctgtgtgctgggcatgaggaagagggccctggtgttccagcctgtggccgagctgaaggaccagacagactttgagcaccgcatccccaaggagcagtggtggctgaagctgcggcccatcctgaagatcctggccaagtatgaaattgacctggacaccagtgaccacgcccacctggagcacatcaccaggaagaggtctggagaggccgctgtgtag

SEQ ID NO: 163997 - DNA, 2556 bp, Artificial Sequence
  Description of Artificial Sequence: Synthetic coding sequence
atgcacaaggatgagttccacctgaagttcttcatgtgtgtgatccagagccggcagctggtgaggaccccccagaggacagctggggaggccagcaccagctccatgctgatccccaagcccccacccaagacagacatcctgaagagcctggacaccatggatgatcctgacacagtgggcagcatccctgtgttcaagacagagtggatcatgacccatgaggagcaccacgccgccaagaccctgggcatcggcaaggccatcgctgtgctgaccagcggaggagatgcccagggcatgaatgctgctgtgcgggctgtggtgcgggtgggcatcttcaccggggcccgggtcttctttgtgcatgagggctaccagggcctggtggatggaggagaccacatcaaggaggccacctgggagagcgtgtccatgatgctgcagctgggcggcaccgtgattggcagcgcccgctgcaaggacttccgggagcgggagggccgcctgcgggccgcctacaacctggtgaagaggggcatcaccaacctgtgtgtgattggaggagatggcagcctgaccggggctgacaccttccgctctgagtggagcgacctgctgagtgacctgcagaaggccggcaagatcacagatgaggaggccaccaagagcagctacctgaacatcgtgggcctggtgggcagcattgacaatgacttctgtggcacagacatgaccatcggcacagattctgccctgcaccgcatcatggagatcgtggatgccatcaccaccacagcccagagccaccagaggacctttgtgctggaggtgatgggccgccactgcggctacctggccctggtgaccagcctgagctgtggggctgactgggtgttcatcccagaatgtcctccagatgatgactgggaggagcacctgtgccggcggctgtctgagaccaggacccggggcagccggctgaacatcatcatcgtggccgagggcgccatcgacaagaatggcaagcccatcaccagcgaggacatcaagaacctggtggtgaagaggctgggctatgacaccagggtgacagtgctgggccacgtgcagagaggaggcaccccatctgcctttgaccgcatcctgggcagcaggatgggcgtggaggccgtgatggccctgctggagggcaccccagacaccccagcctgtgtggtgtccctgagcggcaaccaggccgtgcggctgcccctgatggagtgtgtgcaggtgaccaaggatgtgaccaaggccatggatgagaagaagtttgatgaggccctgaagctgcggggccgctccttcatgaacaactgggaggtgtacaagctgctggcccacgtgcggccccctgtgtccaagagcggcagccacacagtggccgtgatgaatgtgggcgccccagctgctggcatgaatgctgctgtgcgcagcacagtgcgcatcggcctcatccagggcaacagagtgctggtggtgcatgatggctttgagggcctggccaagggccagatcgaggaggccggctggagctatgtgggcggctggacaggccagggcggcagcaagctgggcaccaagaggaccctgcccaagaagagctttgagcagatcagcgccaacatcaccaagttcaacatccagggcctggtgatcattggaggctttgaggcctacacaggaggcctggagctgatggagggcaggaagcagtttgatgagctgtgcatcccctttgtggtgatcccagccaccgtgagcaacaacgtgcccggcagtgacttctctgtgggcgctgacacagccctgaacaccatctgcaccacctgtgaccgcatcaagcagagcgctgctggcaccaagagaagagtcttcatcatcgagaccatgggcggctactgcggctacctggccaccatggccggcctggccgccggggctgatgctgcctacatctttgaggagcccttcaccatccgggacctgcaggccaacgtggagcacctggtgcagaagatgaagaccaccgtgaagaggggcctggtgctgagaaatgaaaaatgtaatgaaaactacaccacagacttcatcttcaacctgtacagcgaggagggcaagggcatctttgacagcaggaagaatgtgctgggccacatgcagcagggcggcagccccaccccatttgacaggaactttgccaccaagatgggcgccaaggccatgaactggatgtctgggaagatcaaggagagctacagaaatggccgcatctttgccaacaccccagacagcggctgtgtgctgggcatgaggaagagggccctggtgttccagcctgtggccgagctgaaggaccagacagactttgagcaccgcatccccaaggagcagtggtggctgaagctgcggcccatcctgaagatcctggccaagtatgaaattgacctggacaccagtgaccacgcccacctggagcacatcaccaggaagaggtctggagaggccgctgtgtag

SEQ ID NO: 163998 - DNA, 2343 bp, Artificial Sequence; identical to SEQ ID NO: 163996
  Description of Artificial Sequence: Synthetic coding sequence

SEQ ID NO: 163999 - DNA, 2250 bp, Artificial Sequence
  Description of Artificial Sequence: Synthetic coding sequence
atgacccatgaggagcaccacgccgccaagaccctgggcatcggcaaggccatcgctgtgctgaccagcggaggagatgcccagggcatgaatgctgctgtgcgggctgtggtgcgggtgggcatcttcaccggggcccgggtcttctttgtgcatgagggctaccagggcctggtggatggaggagaccacatcaaggaggccacctgggagagcgtgtccatgatgctgcagctgggcggcaccgtcatcggcagcgcccgctgcaaggacttccgggagcgggagggccgcctgcgggccgcctacaacctggtgaagaggggcatcaccaacctgtgtgtgattggaggagatggcagcctgactggagctgacaccttccgctctgagtggagcgacctgctgagtgacctgcagaaggccggcaagatcacagatgaggaggccaccaagagcagctacctgaacatcgtgggcctggtgggcagcattgacaatgacttctgtggcacagacatgaccatcggcacagacagcgccctgcaccgcatcatggagatcgtggatgccatcaccaccacagcccagagccaccagaggacctttgtgctggaggtgatgggccgccactgcggctacctggccctggtgaccagcctgagctgtggggctgactgggtgttcatccctgagtgccccccagatgatgactgggaggagcacctgtgccggcggctgtctgagaccaggacccggggcagccggctgaacatcatcatcgtggccgagggcgccatcgacaagaatggcaagcccatcaccagcgaggacatcaagaatggcagcaggatgggcgtggaggccgtgatggccctgctggagggcaccccagacaccccagcctgtgtggtgtccctgagcggcaaccaggccgtgcggctgcccctgatggagtgtgtgcaggtgaccaaggatgtgaccaaggccatggatgagaagaagtttgatgaggccctgaagctgcggggccgctccttcatgaacaactgggaggtgtacaagctgctggcccacgtgcggccccctgtgtccaagagcggcagccacacagtggccgtgatgaatgtgggcgccccagctgctggcatgaatgctgctgtgcgcagcacagtgcgcatcggcctcatccagggcaacagagtgctggtggtgcatgatggctttgagggcctggccaagggccagatcgaggaggccggctggagctatgtgggcggctggacaggccagggcggcagcaagctgggcaccaagaggaccctgcccaagaagagctttgagcagatcagcgccaacatcaccaagttcaacatccagggcctggtgatcattggaggctttgaggcctacacaggaggcctggagctgatggagggcaggaagcagtttgatgagctgtgcatcccctttgtggtgatcccagccaccgtgagcaacaacgtgcccggcagtgacttctctgtgggcgctgacacagccctgaacaccatctgcaccacctgtgaccgcatcaagcagagcgctgctggcaccaagagaagagtcttcatcatcgagaccatgggcggctactgcggctacctggccaccatggccggcctggccgccggggctgatgctgcctacatctttgaggagcccttcaccatccgggacctgcaggccaacgtggagcacctggtgcagaagatgaagaccaccgtgaagaggggcctggtgctgagaaatgaaaaatgtaatgaaaactacaccacagacttcatcttcaacctgtacagcgaggagggcaagggcatctttgacagcaggaagaatgtgctgggccacatgcagcagggcggcagccccaccccatttgacaggaactttgccaccaagatgggcgccaaggccatgaactggatgtctgggaagatcaaggagagctacagaaatggccgcatctttgccaacaccccagacagcggctgtgtgctgggcatgaggaagagggccctggtgttccagcctgtggccgagctgaaggaccagacagactttgagcaccgcatccccaaggagcagtggtggctgaagctgcggcccatcctgaagatcctggccaagtatgaaattgacctggacaccagtgaccacgcccacctggagcacatcaccaggaagaggtctggagaggccgctgtgtag

SEQ ID NO: 164000 - DNA, 534 bp, Artificial Sequence
  Description of Artificial Sequence: Synthetic coding sequence
atgacccatgaggagcaccacgccgccaagaccctgggcatcggcaaggccatcgctgtgctgaccagcggaggagatgcccagggcatgaatgctgctgtgcgcagcacagtgcgcatcggcctcatccagggcaacagagtgctggtggtgcatgatggctttgagggcctggccaagggccagatcgaggaggccggctggagctatgtgggcggctggacaggccagggcggcagcaagctgggcaccaagaggaccctgcccaagaagagctttgagcagatcagcgccaacatcaccaagttcaacatccagggcctggtgatcattggaggctttgaggcctacacaggaggcctggagctgatggagggcaggaagcagtttgatgagctgtgcatcccctttgtggtgatcccagccaccgtgagcaacaacgtgcccggcagtgacttctctgtgggcgctgacacagccctgaacaccatctgcaccacctgtgaccgcatcaagcagagcgctgctggatag

SEQ ID NO: 164001 - DNA, 2343 bp, Artificial Sequence; identical to SEQ ID NO: 163996
  Description of Artificial Sequence: Synthetic coding sequence

SEQ ID NO: 164002 - DNA, 354 bp, Artificial Sequence
  Description of Artificial Sequence: Synthetic coding sequence
atgacccatgaggagcaccacgccgccaagaccctgggcatcggcaaggccatcgctgtgctgaccagcggaggagatgcccagggcatgaatgctgctgtgcgggctgtggtgcgggtgggcatcttcaccggggcccgggtcttctttgtgcatgagggctaccagggcctggtggatggaggagaccacatcaaggaggccacctgggagagcgtgtccatgatgctgcagctgggcggcaccgtcatcggcagcgcccgctgcaaggacttccgggagcgggagggccgcctgcgggccgcctacaacctggtgaagaggggcatcaccaacctgtgtgtgattggatag

SEQ ID NO: 164003 - DNA, 486 bp, Artificial Sequence
  Description of Artificial Sequence: Synthetic coding sequence
atgacccatgaggagcaccacgccgccaagaccctgggcatcggcaaggccatcgctgtgctgaccagcggaggagatgcccagggcatgaatgctgctgtgcgggctgtggtgcgggtgggcatcttcaccggggcccgggtcttctttgtgcatgagggctaccagggcctggtggatggaggagaccacatcaaggaggccacctgggagagcgtgtccatgatgctgcagctgggcggcaccgtcatcggcagcgcccgctgcaaggacttccgggagcgggagggccgcctgcgggccgcctacaacctggtgaagaggggcatcaccaacctgtgtgtgattggaggagatggcagcctgactggagctgacaccttccgctctgagtggagcgacctgctgagtgacctgcagaaggccggcaagatcacagatgaggaggccaccaagagcagctacctgaacatcgtgggcctgtag

SEQ ID NO: 164004 - DNA, 474 bp, Artificial Sequence
  Description of Artificial Sequence: Synthetic coding sequence
atgacccatgaggagcaccacgccgccaagaccctgggcatcggcaaggccatcgctgtgctgaccagcggaggagatgcccagggcatgaatgctgctgtgcgggctgtggtgcgggtgggcatcttcaccggggcccgggtcttctttgtgcatgagggctaccagggcctggtggatggaggagaccacatcaaggaggccacctgggagagcgtgtccatgatgctgcagctgggcggcaccgtcatcggcagcgcccgctgcaaggacttccgggagcgggagggccgcctgcgggccgcctacaacctggtgaagaggggcatcaccaacctgtgtgtgattggaggagatggcagcctgactggagctgacaccttccgctctgagtggagcgacctgctgagtgacctgcagaaggccggcaagatcacagatgaggaggccaccaagagcagctacctgaactag

SEQ ID NO: 164005 - DNA, 258 bp, Artificial Sequence
  Description of Artificial Sequence: Synthetic coding sequence
atgacccatgaggagcaccacgccgccaagaccctgggcatcggcaaggccatcgctgtgctgaccagcggaggagatgcccagggcatgaatgctgctgtgcgggctgtggtgcgggtgggcatcttcaccggggcccgggtcttctttgtgcatgagggctaccagggcctggtggatggaggagaccacatcaaggaggccacctgggagagcgtgtccatgatgctgcagctgggcggcaccgtcatcggctag

SEQ ID NO: 164006 - DNA, 420 bp, Artificial Sequence
  Description of Artificial Sequence: Synthetic coding sequence
atgacccatgaggagcaccacgccgccaagaccctgggcatcggcaaggccatcgctgtgctgaccagcggaggagatgcccagggcatgaatgctgctgtgcgggctgtggtgcgggtgggcatcttcaccggggcccgggtcttctttgtgcatgagggctaccagggcctggtggatggaggagaccacatcaaggaggccacctgggagagcgtgtccatgatgctgcagctgggcggcaccgtcatcggcagcgcccgctgcaaggacttccgggagcgggagggccgcctgcgggccgcctacaacctggtgaagaggggcatcaccaacctgtgtgtgattggaggagatggcagcctgactggagctgacaccttccgctctgagtggagcgacctgctgagtgacctgtag

SEQ ID NO: 164007 - DNA, 2250 bp, Artificial Sequence; identical to SEQ ID NO: 163999
  Description of Artificial Sequence: Synthetic coding sequence

SEQ ID NO: 164008 - DNA, 609 bp, Artificial Sequence
  Description of Artificial Sequence: Synthetic coding sequence
atgggcggctactgcggctacctggccaacatgggcggcctggccgccggggctgatgctgcctacatctttgaggagccctttgacatccgggacctgcagagcaatgtggagcacctgacagagaagatgaagaccaccatccagaggggcctggtgctgagaaatgaaagctgcagcgagaactacaccacagacttcatctaccagctgtacagcgaggagggcaaaggagtgtttgactgcaggaagaatgtgctgggccacatgcagcagggcggggcccccagcccctttgacaggaactttggcaccaagatcagcgcccgggccatggagtggatcacagccaagctgaaggaggcccggggccggggcaagaagttcaccacagatgacagcatctgtgtgctgggcatcagcaagagaaatgtcatcttccagcctgtggccgagctgaagaagcagacagactttgagcaccgcatccccaaggagcagtggtggctgaagctgcggcccctgatgaagatcctggccaagtacaaggccagctatgatgtgtctgattctggccagctggagcacgtgcagccctggagcgtgtag

SEQ ID NO: 164009 - DNA, 2331 bp, Artificial Sequence
  Description of Artificial Sequence: Synthetic coding sequence
atgtgtggctatgagcgctgccggccctgccgcggggcccacggctacctgcggggcggccagggcgtgctgcacctgcggggcctgcccggccacggcggccgccgcctgaagcaccggcggggccgcctgggggagtgcctgcagcacccagccagcggggctgtgcggggggactggagggagaagccaggctgctggagccaccgcttcccctgccccggcagacatgccctggtgggcggcaccatcatcggcagcgcccgctgccaggccttccgcacccgggagggccgcctgaaggccgcctgcaacctgctgcagaggggcatcaccaacctgtgtgtgattggaggagatggcagcctgaccggggccaacctcttcaggaaggagtggagcggcctgctggaggagctggccagaaatggccagattgacaaggaggccgtgcagaagtatgcctacctgaatgtggtgggcatggtgggcagcattgacaatgacttctgtggcacagacatgaccatcggcacagattctgccctgcaccgcatcatcgaggtggtggatgccatcatgaccacagcccagagccaccagaggacctttgtgctggaggtgatgggccgccactgcggctacctggccctggtgtctgccctggcctgtggggctgactgggtgttcctgcctgagagccccccagaggagggctgggaggagcagatgtgtgtgaagctgtctgagaacagagccaggaagaagaggctgaacatcatcatcgtggccgagggcgccatcgacacccagaacaagcccatcaccagcgagaagatcaaggagctggtggtgacccagctgggctatgacaccagggtgaccatcctgggccacgtgcagagaggaggcaccccatctgcctttgaccgcatcctggccagcaggatgggcgtggaggccgtgattgccctgctggaggccaccccagacaccccagcctgtgtggtgtccctgaatggaaatcatgctgtgcggctgcccctgatggagtgtgtgcagatgacccaggatgtgcagaaggccatggatgagcggcgcttccaggatgctgtgcggctgcggggccgcagctttgctggcaacctgaacacctacaagaggctggccatcaagctgcctgatgaccagatccccaagaccaactgcaatgtggccgtcatcaacgtgggcgccccagctgctggcatgaatgctgctgtgcgctctgctgtgcgggtgggcattgctgatggccacaggatgctggccatctatgatggctttgatggctttgccaagggccagatcaaggagatcggctggacagatgtgggcggctggacaggccagggcggcagcatcctgggcaccaagagggtgctgcccgggaagtacctggaggagatcgccacccagatgaggacccacagcatcaatgccctgctgatcatcggcggctttgaggcctacctgggcctgctggagctgtctgctgcccgggagaagcatgaggagttctgtgtgcccatggtgatggtgcctgccaccgtgagcaacaacgtgcccggcagtgacttcagcatcggggctgacacagccctgaacaccatcacagacacctgtgaccgcatcaagcagagcgccagcggcaccaagagaagagtcttcatcatcgagaccatgggcggctactgcggctacctggccaacatgggcggcctggccgccggggctgatgctgcctacatctttgaggagccctttgacatccgggacctgcagagcaatgtggagcacctgacagagaagatgaagaccaccatccagaggggcctggtgctgagaaatgaaagctgcagcgagaactacaccacagacttcatctaccagctgtacagcgaggagggcaaaggagtgtttgactgcaggaagaatgtgctgggccacatgcagcagggcggggcccccagcccctttgacaggaactttggcaccaagatcagcgcccgggccatggagtggatcacagccaagctgaaggaggcccggggccggggcaagaagttcaccacagatgacagcatctgtgtgctgggcatcagcaagagaaatgtcatcttccagcctgtggccgagctgaagaagcagacagactttgagcaccgcatccccaaggagcagtggtggctgaagctgcggcccctgatgaagatcctggccaagtacaaggccagctatgatgtgtctgattctggccagctggagcacgtgcagccctggagcgtgtag

SEQ ID NO: 164010 - DNA, 2355 bp, Artificial Sequence
  Description of Artificial Sequence: Synthetic coding sequence
atggatgctgatgacagccgggcccccaagggcagcctgaggaagttcctggagcacctgtctggagctgggaaggccatcggcgtgctgaccagcggaggagatgcccagggcatgaatgctgctgtgcgggctgtggtgaggatgggcatctacgtgggcgccaaggtgtacttcatctatgagggctaccagggcatggtggatggcggcagcaacattgctgaggccgactgggagagcgtgagcagcatcctgcaggtgggcggcaccatcatcggcagcgcccgctgccaggccttccgcacccgggagggccgcctgaaggccgcctgcaacctgctgcagaggggcatcaccaacctgtgtgtgattggaggagatggcagcctgaccggggccaacctcttcaggaaggagtggagcggcctgctggaggagctggccagaaatggccagattgacaaggaggccgtgcagaagtatgcctacctgaatgtggtgggcatggtgggcagcattgacaatgacttctgtggcacagacatgaccatcggcacagattctgccctgcaccgcatcatcgaggtggtggatgccatcatgaccacagcccagagccaccagaggacctttgtgctggaggtgatgggccgccactgcggctacctggccctggtgtctgccctggcctgtggggctgactgggtgttcctgcctgagagccccccagaggagggctgggaggagcagatgtgtgtgaagctgtctgagaacagagccaggaagaagaggctgaacatcatcatcgtggccgagggcgccatcgacacccagaacaagcccatcaccagcgagaagatcaaggagctggtggtgacccagctgggctatgacaccagggtgaccatcctgggccacgtgcagagaggaggcaccccatctgcctttgaccgcatcctggccagcaggatgggcgtggaggccgtgattgccctgctggaggccaccccagacaccccagcctgtgtggtgtccctgaatggaaatcatgctgtgcggctgcccctgatggagtgtgtgcagatgacccaggatgtgcagaaggccatggatgagcggcgcttccaggatgctgtgcggctgcggggccgcagctttgctggcaacctgaacacctacaagaggctggccatcaagctgcctgatgaccagatccccaagaccaactgcaatgtggccgtcatcaacgtgggcgccccagctgctggcatgaatgctgctgtgcgctctgctgtgcgggtgggcattgctgatggccacaggatgctggccatctatgatggctttgatggctttgccaagggccagatcaaggagatcggctggacagatgtgggcggctggacaggccagggcggcagcatcctgggcaccaagagggtgctgcccgggaagtacctggaggagatcgccacccagatgaggacccacagcatcaatgccctgctgatcatcggcggctttgaggcctacctgggcctgctggagctgtctgctgcccgggagaagcatgaggagttctgtgtgcccatggtgatggtgcctgccaccgtgagcaacaacgtgcccggcagtgacttcagcatcggggctgacacagccctgaacaccatcacagacacctgtgaccgcatcaagcagagcgccagcggcaccaagagaagagtcttcatcatcgagaccatgggcggctactgcggctacctggccaacatgggcggcctggccgccggggctgatgctgcctacatctttgaggagccctttgacatccgggacctgcagagcaatgtggagcacctgacagagaagatgaagaccaccatccagaggggcctggtgctgagaaatgaaagctgcagcgagaactacaccacagacttcatctaccagctgtacagcgaggagggcaaaggagtgtttgactgcaggaagaatgtgctgggccacatgcagcagggcggggcccccagcccctttgacaggaactttggcaccaagatcagcgcccgggccatggagtggatcacagccaagctgaaggaggcccggggccggggcaagaagttcaccacagatgacagcatctgtgtgctgggcatcagcaagagaaatgtcatcttccagcctgtggccgagctgaagaagcagacagactttgagcaccgcatccccaaggagcagtggtggctgaagctgcggcccctgatgaagatcctggccaagtacaaggccagctatgatgtgtctgattctggccagctggagcacgtgcagccctggagcgtgtag

SEQ ID NO: 164011 - DNA, 2322 bp, Artificial Sequence
  Description of Artificial Sequence: Synthetic coding sequence
tatgagcgctgccggccctgccgcggggcccacggctacctgcggggcggccagggcgtgctgcacctgcggggcctgcccggccatggaggccggcggctgaagcacagaagaggccgcctgggagaatgtctgcagcacccagccagcggggctgtgcggggggactggagggagaagccaggctgctggagccaccgcttcccctgccccggcagacatgccctggtgggcggcaccatcatcggcagcgcccgctgccaggccttccgcacccgggagggccgcctgaaggccgcctgcaacctgctgcagaggggcatcaccaacctgtgtgtgattggaggagatggcagcctgactggagccaacctcttcaggaaggagtggagcggcctgctggaggagctggccagaaatggccagattgacaaggaggccgtgcagaagtatgcctacctgaatgtggtgggcatggtgggcagcattgacaatgacttctgtggcacagacatgaccatcggcacagacagcgccctgcaccgcatcatcgaggtggtggatgccatcatgaccacagcccagagccaccagaggacctttgtgctggaggtgatgggccgccactgcggctacctggccctggtgtctgccctggcctgtggggctgactgggtgttcctgcctgagagccccccagaggagggctgggaggagcagatgtgtgtgaagctgtctgaaaatagagccaggaagaagaggctgaacatcatcatcgtggccgagggcgccatcgacacccagaacaagcccatcaccagcgagaagatcaaggagctggtggtgacccagctgggctatgacaccagggtgaccatcctgggccacgtgcagaggggcggcacccccagcgcctttgaccgcatcctggccagcaggatgggcgtggaggccgtcatcgccctgctggaggccaccccagacaccccagcctgtgtggtgtccctgaatggaaaccacgctgtgcggctgcccctgatggagtgtgtgcagatgacccaggatgtgcagaaggccatggatgaaagacgcttccaggatgctgtgcggctgcggggccgcagctttgctggcaacctgaacacctacaagaggctggccatcaagctgcctgatgaccagatccccaagaccaactgcaatgtggccgtcatcaacgtgggcgccccagctgctggcatgaatgctgctgtgcgctctgctgtgcgggtgggcattgctgatggccacaggatgctggccatctatgatggctttgatggctttgccaagggccagatcaaggagatcggctggacagatgtgggcggctggacaggccagggcggcagcatcctgggcaccaagagggtgctgcccgggaagtacctggaggagatcgccacccagatgaggacccacagcatcaatgccctgctgatcattggaggctttgaggcctacctgggcctgctggagctgtctgctgcccgggagaagcatgaggagttctgtgtgcccatggtgatggtgcctgccaccgtgagcaacaacgtgcccggcagtgacttcagcattggagctgacacagccctgaacaccatcacagacacctgtgaccgcatcaagcagagcgccagcggcaccaagagaagagtcttcatcatcgagaccatgggcggctactgcggctacctggccaacatgggcggcctggccgccggggctgatgctgcctacatctttgaggagccctttgacatccgggacctgcagagcaatgtggagcacctgacagagaagatgaagaccaccatccagaggggcctggtgctgagaaatgaaagctgcagcgagaactacaccacagacttcatctaccagctgtacagcgaggagggcaagggcgtgtttgactgcaggaagaatgtgctgggccacatgcagcagggcggggcccccagcccctttgacaggaactttggcaccaagatcagcgcccgggccatggagtggatcacagccaagctgaaggaggcccggggccggggcaagaagttcaccacagatgacagcatctgtgtgctgggcatcagcaagagaaatgtcatcttccagcctgtggccgagctgaagaagcagacagactttgagcaccgcatccccaaggagcagtggtggctgaagctgcggcccctgatgaagatcctggccaagtacaaggccagctatgatgtgtctgacagcggccagctggagcacgtgcagccctggagcgtgtag

SEQ ID NO: 164012 - DNA, 633 bp, Artificial Sequence
  Description of Artificial Sequence: Synthetic coding sequence
atgaatgctgctgtgcgggctgtggtgaggatgggcatctacgtgggcgccaaggtgtacttcatctatgagggctaccagggcatggtggatggcggcagcaacattgctgaggccgactgggagagcgtgagcagcatcctgcaggtgggcggcaccatcatcggcagcgcccgctgccaggccttccgcacccgggagggccgcctgaaggccgcctgcaacctgctgcagaggggcatcaccaacctgtgtgtgattggaggagatggcagcctgaccggggccaacctcttcaggaaggagtggagcggcctgctggaggagctggccagaaatggccagattgacaaggaggccgtgcagaagtatgcctacctgaatgtggtgggcatggtgggcagcattgacaatgacttctgtggcacagacatgaccatcggcacagattctgccctgcaccgcatcatcgaggtggtggatgccatcatgaccacagcccagagccaccagaggacctttgtgctggaggtgatgggccgccactgcggctacctggccctggtgtctgccctggcctgtggggctgactgggtgttcctgcctgagagccccccagaggagggctggtag

SEQ ID NO: 164013 - DNA, 501 bp, Artificial Sequence
  Description of Artificial Sequence: Synthetic coding sequence
tgagctgatggccacaggatgctggccatctatgatggctttgatggctttgccaagggccagatcaaggagatcggctggacagatgtgggcggctggacaggccagggcggcagcatcctgggcaccaagagggtgctgcccgggaagtacctggaggagatcgccacccagatgaggacccacagcatcaatgccctgctgatcatcggcggctttgaggcctacaagagcgcctgtgacatggccgaggcccggggccgccaccaggagctgtgcatccccctgtgtgtggtgcctgccaccatcagcaacaacgtgcccggcacagagatcagcctgggcagtgacaccggcctgaatgctgtggtggagacctgtgaccgcatcaagcagagcgccagcggcaccaagagaagagtcttcatcatcgagaccatgggcggctactgcggctacctggccaacatgggcggcctggccgccggggctgatgcctag

SEQ ID NO: 164014 - DNA, 723 bp, Artificial Sequence
  Description of Artificial Sequence: Synthetic coding sequence
atgggccgccactgcggctacctggccctggtgtctgccctggcctgtggggctgactgggtgttcctgcctgagagccccccagaggagggctgggaggagcagatgtgtgtgaagctgtctgagaacagagccaggaagaagaggctgaacatcatcatcgtggccgagggcgccatcgacacccagaacaagcccatcaccagcgagaagatcaaggagctggtggtgacccagctgggctatgacaccagggtgaccatcctgggccacgtgcagagaggaggcaccccatctgcctttgaccgcatcctggccagcaggatgggcgtggaggccgtgattgccctgctggaggccaccccagacaccccagcctgtgtggtgtccctgaatggaaatcatgctgtgcggctgcccctgatggagtgtgtgcagatgacccaggatgtgcagaaggccatggatgagcggcgcttccaggatgctgtgcggctgcggggccgcagctttgctggcaacctgaacacctacaagaggctggccatcaagctgcctgatgaccagatccccaagaccaactgcaatgtggccgtcatcaacgtgggcgccccagctgctggcatgaatgctgctgtgcgctctgctgtgcgggtgggcattgctgatggccacaggatgctggccatctatgatggctttgatggctttgccaagggctag

SEQ ID NO: 164015 - DNA, 501 bp, Artificial Sequence
  Description of Artificial Sequence: Synthetic coding sequence
atgaatgctgctgtgcgggctgtggtgaggatgggcatctacgtgggcgccaaggtgtacttcatctatgagggctaccagggcatggtggatggcggcagcaacattgctgaggccgactgggagagcgtgagcagcatcctgcaggtgggcggcaccatcatcggcagcgcccgctgccaggccttccgcacccgggagggccgcctgaaggccgcctgcaacctgctgcagaggggcatcaccaacctgtgtgtgattggaggagatggcagcctgaccggggccaacctcttcaggaaggagtggagcggcctgctggaggagctggccagaaatggccagattgacaaggaggccgtgcagaagtatgcctacctgaatgtggtgggcatggtgggcagcattgacaatgacttctgtggcacagacatgaccatcggcacagattctgccctgcaccgcatcatcgaggtggtggatgccatcatgaccacctag

SEQ ID NO: 164016 - DNA, 312 bp, Artificial Sequence
  Description of Artificial Sequence: Synthetic coding sequence
tgattcatctaccagctgtacagcgaggagggcaagggcgtgtttgactgcaggaagaatgtgctgggccacatgcagcagggcggggcccccagcccctttgacaggaactttggcaccaagatcagcgcccgggccatggagtggatcacagccaagctgaaggaggcccggggccggggcaagaagttcaccacagatgacagcatctgtgtgctgggcatcagcaagagaaatgtcatcttccagcctgtggccgagctgaagaagcagacagactttgagaccgtgtccatgcagcccccaagatag

SEQ ID NO: 164017 - DNA, 1743 bp, Artificial Sequence
  Description of Artificial Sequence: Synthetic coding sequence
atgtctgactttgaggagtggatcagcggcacctacaggaagatggaggagggccccctgcccctgctgacctttgccacagccccctaccatgaccagaagccaggcaccagcggcctgaggaagaagacctactactttgaggagaagccctgctacctggagaacttcatccagagcatcttcttcagcattgacctgaaggaccggcagggcagcagcctggtggtgggcggagatggccgctacttcaacaagagcgccatcgagaccatcgtgcagatggctgctgccaatggaattggccgcctggtgattggccagaatggcatcctgagcaccccagctgtgtcctgcatcatcaggaagatcaaggccatcggcggcatcatcctgacagccagccacaaccctgggggccccaacggggactttggcatcaagttcaacatcagcaatggaggccctgcccctgaggccatcacagacaagatcttccagatcagcaagaccatcgaggagtatgctgtgtgcccagacctgaaggtggacctgggcgtgctgggcaagcagcagtttgacctggagaacaagttcaagcccttcaccgtggagatcgtggacagcgtggaggcctatgccaccatgctgcggagcatctttgacttcagcgccctgaaggagctgctgagcggccccaaccggctgaagatcagaattgatgccatgcacggcgtggtgggcccctacgtgaagaagatcctgtgtgaggagctgggcgccccagccaacagcgctgtgaactgtgtgcccctggaggactttggaggccaccacccagaccccaacctgacctatgctgctgacctggtggagaccatgaagagcggggagcatgactttggagctgcctttgatggagatggagacaggaacatgatcctgggcaagcacggcttctttgtgaaccccagcgacagcgtggccgtgattgctgccaacatcttcagcatcccctacttccagcagacaggagtgcggggctttgcccgctccatgcccaccagcggggccctggacagagtggccagcgccaccaagatcgccctgtatgagacccccaccggctggaagttcttcggcaacctgatggatgccagcaagctgagcctgtgtggggaggagagctttggaactggaagtgaccacatccgggagaaggatggcctgtgggccgtgctggcctggctgagcatcctggccaccaggaagcagagcgtggaggacatcctgaaggaccactggcagaagtatggcaggaacttcttcaccaggtatgactatgaggaggtggaggccgagggcgccaacaagatgatgaaggacctggaggccctgatgtttgacaggagctttgtgggcaagcagttcagcgccaatgacaaggtgtacacagtggagaaggctgacaactttgagtacagcgaccctgtggatggcagcatcagcaggaaccagggcctgcggctcatcttcacagatggcagccgcatcgtgttccggctgtctggaactggatctgctggggccaccatccggctgtacatcgacagctatgagaaggatgtggccaagatcaaccaggacccccaggtgatgctggcccccctcatcagcatcgccctgaaggtgtcccagctgcaggagaggactggaagaacagcccccaccgtcatcacctag

SEQ ID NO: 164018 - DNA, 1689 bp, Artificial Sequence
  Description of Artificial Sequence: Synthetic coding sequence
atggtgaagatcgtgacagtgaagacccaggcctaccaggaccagaagccaggcaccagcggcctgaggaagagggtgaaggtgttccagagcagcgccaactatgcagagaacttcatccagagcatcatcagcacagtggagcccgcccagaggcaggaggccaccctggtggtgggcggagatggccgcttctacatgaaggaggccatccagctgattgccagaattgctgctgccaatggaattggccgcctggtgattggccagaatggcatcctgagcaccccagctgtgtcctgcatcatcaggaagatcaaggccatcggcggcatcatcctgacagccagccacaaccctgggggccccaacggggactttggcatcaagttcaacatcagcaatggaggccctgcccctgaggccatcacagacaagatcttccagatcagcaagaccatcgaggagtatgctgtgtgcccagacctgaaggtggacctgggcgtgctgggcaagcagcagtttgacctggagaacaagttcaagcccttcaccgtggagatcgtggacagcgtggaggcctatgccaccatgctgcggagcatctttgacttcagcgccctgaaggagctgctgagcggccccaaccggctgaagatcagaattgatgccatgcacggcgtggtgggcccctacgtgaagaagatcctgtgtgaggagctgggcgccccagccaacagcgctgtgaactgtgtgcccctggaggactttggaggccaccacccagaccccaacctgacctatgctgctgacctggtggagaccatgaagagcggggagcatgactttggagctgcctttgatggagatggagacaggaacatgatcctgggcaagcacggcttctttgtgaaccccagcgacagcgtggccgtgattgctgccaacatcttcagcatcccctacttccagcagacaggagtgcggggctttgcccgctccatgcccaccagcggggccctggacagagtggccagcgccaccaagatcgccctgtatgagacccccaccggctggaagttcttcggcaacctgatggatgccagcaagctgagcctgtgtggggaggagagctttggaactggaagtgaccacatccgggagaaggatggcctgtgggccgtgctggcctggctgagcatcctggccaccaggaagcagagcgtggaggacatcctgaaggaccactggcagaagtatggcaggaacttcttcaccaggtatgactatgaggaggtggaggccgagggcgccaacaagatgatgaaggacctggaggccctgatgtttgacaggagctttgtgggcaagcagttcagcgccaatgacaaggtgtacacagtggagaaggctgacaactttgagtacagcgaccctgtggatggcagcatcagcaggaaccagggcctgcggctcatcttcacagatggcagccgcatcgtgttccggctgtctggaactggatctgctggggccaccatccggctgtacatcgacagctatgagaaggatgtggccaagatcaaccaggacccccaggtgatgctggcccccctcatcagcatcgccctgaaggtgtcccagctgcaggagaggactggaagaacagcccccaccgtcatcacctag

SEQ ID NO: 164019 - DNA, 1617 bp, Artificial Sequence
  Description of Artificial Sequence: Synthetic coding sequence
atggtgaaggtgttccagagcagcgccaactatgcagagaacttcatccagagcatcatcagcacagtggagcccgcccagaggcaggaggccaccctggtggtgggcggagatggccgcttctacatgaaggaggccatccagctgattgccagaattgctgctgccaatggaattggccgcctggtgattggccagaatggcatcctgagcaccccagctgtgtcctgcatcatcaggaagatcaaggccatcggcggcatcatcctgacagccagccacaaccctgggggccccaacggggactttggcatcaagttcaacatcagcaatggaggccctgcccctgaggccatcacagacaagatcttccagatcagcaagaccatcgaggagtatgctgtgtgcccagacctgaaggtggacctgggcgtgctgggcaagcagcagtttgacctggagaacaagttcaagcccttcaccgtggagatcgtggacagcgtggaggcctatgccaccatgctgcggagcatctttgacttcagcgccctgaaggagctgctgagcggccccaaccggctgaagatcagaattgatgccatgcacggcgtggtgggcccctacgtgaagaagatcctgtgtgaggagctgggcgccccagccaacagcgctgtgaactgtgtgcccctggaggactttggaggccaccacccagaccccaacctgacctatgctgctgacctggtggagaccatgaagagcggggagcatgactttggagctgcctttgatggagatggagacaggaacatgatcctgggcaagcacggcttctttgtgaaccccagcgacagcgtggccgtgattgctgccaacatcttcagcatcccctacttccagcagacaggagtgcggggctttgcccgctccatgcccaccagcggggccctggacagagtggccagcgccaccaagatcgccctgtatgagacccccaccggctggaagttcttcggcaacctgatggatgccagcaagctgagcctgtgtggggaggagagctttggaactggaagtgaccacatccgggagaaggatggcctgtgggccgtgctggcctggctgagcatcctggccaccaggaagcagagcgtggaggacatcctgaaggaccactggcagaagtatggcaggaacttcttcaccaggtatgactatgaggaggtggaggccgagggcgccaacaagatgatgaaggacctggaggccctgatgtttgacaggagctttgtgggcaagcagttcagcgccaatgacaaggtgtacacagtggagaaggctgacaactttgagtacagcgaccctgtggatggcagcatcagcaggaaccagggcctgcggctcatcttcacagatggcagccgcatcgtgttccggctgtctggaactggatctgctggggccaccatccggctgtacatcgacagctatgagaaggatgtggccaagatcaaccaggacccccaggtgatgctggcccccctcatcagcatcgccctgaaggtgtcccagctgcaggagaggactggaagaacagcccccaccgtcatcacctag

SEQ ID NO: 164020 - DNA, 1098 bp, Artificial Sequence
  Description of Artificial Sequence: Synthetic coding sequence
atgctgcggagcatctttgacttcagcgccctgaaggagctgctgagcggccccaaccggctgaagatcagaattgatgccatgcatggagtggtgggcccctacgtgaagaagatcctgtgtgaggagctgggcgccccagccaacagcgctgtgaactgtgtgcccctggaggactttggaggccaccacccagaccccaacctgacctacgccgctgacctggtggagaccatgaagtctggagaacatgactttggagctgcctttgatggagatggagacaggaacatgatcctgggcaagcacggcttctttgtgaaccccagcgacagcgtggccgtgattgctgccaacatcttcagcatcccctacttccagcagacaggagtgcggggctttgcccgctccatgcccaccagcggggccctggacagagtggccagcgccaccaagatcgccctgtatgagacccccaccggctggaagttctttggaaacctgatggatgccagcaagctgagcctgtgtggggaggagagctttggcaccggcagtgaccacatccgggagaaggatggcctgtgggccgtgctggcctggctgagcatcctggccaccaggaagcagagcgtggaggacatcctgaaggaccactggcagaagtatggaagaaacttcttcaccaggtatgactatgaggaggtggaggccgagggcgccaacaagatgatgaaggacctggaggccctgatgtttgacaggagctttgtgggcaagcagttcagcgccaatgacaaggtgtacacagtggagaaggctgacaactttgagtacagcgaccctgtggatggcagcatcagcaggaaccagggcctgcggctcatcttcacagatggcagcagaattgtgttccggctgagcggcaccggcagcgctggggccaccatccggctgtacatcgacagctatgagaaggatgtggccaagatcaaccaggacccccaggtgatgctggcccccctcatcagcatcgccctgaaggtgtcccagctgcaggagaggacaggccgcacagcccccaccgtcatcacctag

SEQ ID NO: 164021 - DNA, 1839 bp, Artificial Sequence
  Description of Artificial Sequence: Synthetic coding sequence
atggccgcccctgagggcagcggcctgggagaagatgcccggctggaccaggagacagcccagtggctgcgctgggacaagaacagcctgaccctggaggccgtgaagaggctgattgctgagggcaacaaggaggagctgaggaaatgttttggagccaggatggagtttggaacagctggcctgcgggccgccatgggccctggcatcagcaggatgaatgacctgaccatcatccagaccacccagggcttctgccgctacctggagaagcagttcagtgacctgaagcagaagggcatcgtcatcagctttgatgcccgggcccaccccagcagcggcggcagcagccgccgctttgcccggctggccgccaccaccttcatcagccagggcatccctgtgtacctgttcagtgacatcacccccaccccatttgtgcccttcaccgtgagccacctgaagctgtgtgccggcatcatgatcacagccagccacaaccccaagcaggacaatggctacaaggtgtactgggacaacggggcccagatcatcagcccccatgacaagggcatcagccaggccatcgaggagaacctggagccctggccccaggcctgggatgacagcctgattgacagcagccccctgctgcacaaccccagcgccagcatcaacaatgactactttgaggacctgaagaagtactgcttccacaggtctgtgaaccgggagaccaaggtgaagtttgtgcacacctctgtgcacggcgtgggccacagctttgtgcagagcgccttcaaggcctttgacctggtgcccccagaggccgtgcctgagcagaaggaccctgaccctgagttccccaccgtgaagtaccccaaccctgaggagggcaagggcgtgctgaccctgagctttgccctggccgacaagaccaaggccagaattgtgctggccaatgaccctgatgctgaccggctggccgtggccgagaagcaggacagcggggagtggagggtcttctctggaaatgagctgggcgccctgctgggctggtggctgttcacctcctggaaggagaagaaccaggacagaagtgccctgaaggacacctacatgctgagcagcacagtgagcagcaagatcctgcgggccatcgccctgaaggagggcttccactttgaggagaccctgaccggcttcaagtggatgggcaacagagccaagcagctgattgaccagggcaagacagtgctgtttgcctttgaggaggccatcggctacatgtgctgcccctttgtgctggacaaggatggagtgtctgctgctgtgatctctgctgagctggccagcttcctggccaccaagaacctgagcctgagccagcagctgaaggccatctacgtggagtatggctaccacatcaccaaggccagctacttcatctgccacgaccaggagaccatcaagaagctgtttgagaacctgaggaactatgatggcaagaacaactaccccaaggcctgtgggaagtttgagatcagcgccatccgggacctgaccaccggctatgatgacagccagcctgacaagaaggctgtgctgcccaccagcaagagcagccagatgatcaccttcacctttgccaatggaggagtggccaccatgaggaccagcggcacagagcccaagatcaagtactatgcagagctgtgtgcccctcctggcaacagcgaccctgagcagctgaagaaggagctgaatgagctggtgtctgccatcgaggagcacttcttccagccccagaagtacaacctgcagcccaaggctgactag

SEQ ID NO: 164022 - DNA, 1359 bp, Artificial Sequence
  Description of Artificial Sequence: Synthetic coding sequence
atgatcacagccagccacaaccccaagcaggacaatggctacaaggtgtactgggacaacggggcccagatcatcagcccccatgacaagggcatcagccaggccatcgaggagaacctggagccctggccccaggcctgggatgacagcctgattgacagcagccccctgctgcacaaccccagcgccagcatcaacaatgactactttgaggacctgaagaagtactgcttccacaggtctgtgaaccgggagaccaaggtgaagtttgtgcacacctctgtgcacggcgtgggccacagctttgtgcagagcgccttcaaggcctttgacctggtgcccccagaggccgtgcctgagcagaaggaccctgaccctgagttccccaccgtgaagtaccccaaccctgaggagggcaagggcgtgctgaccctgagctttgccctggccgacaagaccaaggccagaattgtgctggccaatgaccctgatgctgaccggctggccgtggccgagaagcaggacagcggggagtggagggtcttctctggaaatgagctgggcgccctgctgggctggtggctgttcacctcctggaaggagaagaaccaggacagaagtgccctgaaggacacctacatgctgagcagcacagtgagcagcaagatcctgcgggccatcgccctgaaggagggcttccactttgaggagaccctgaccggcttcaagtggatgggcaacagagccaagcagctgattgaccagggcaagacagtgctgtttgcctttgaggaggccatcggctacatgtgctgcccctttgtgctggacaaggatggagtgtctgctgctgtgatctctgctgagctggccagcttcctggccaccaagaacctgagcctgagccagcagctgaaggccatctacgtggagtatggctaccacatcaccaaggccagctacttcatctgccacgaccaggagaccatcaagaagctgtttgagaacctgaggaactatgatggcaagaacaactaccccaaggcctgtgggaagtttgagatcagcgccatccgggacctgaccaccggctatgatgacagccagcctgacaagaaggctgtgctgcccaccagcaagagcagccagatgatcaccttcacctttgccaatggaggagtggccaccatgaggaccagcggcacagagcccaagatcaagtactatgcagagctgtgtgcccctcctggcaacagcgaccctgagcagctgaagaaggagctgaatgagctggtgtctgccatcgaggagcacttcttccagccccagaagtacaacctgcagcccaaggctgactag

SEQ ID NO: 164023 - DNA, 876 bp, Artificial Sequence
  Description of Artificial Sequence: Synthetic coding sequence
atgagcagccagctgatcctgcggcccttcaccgtgagccacctgaagctgtgtgccggcatcatgatcacagccagccacaaccccaagcaggacaatggctacaaggtgtactgggacaatggagcccagatcatcagcccccatgacaagggcatcagccaggccatcgaggagaacctggagccctggccccaggcctgggatgacagcctgattgacagcagccccctgctgcacaaccccagcgccagcatcaacaatgactactttgaggacctgaagaagtactgcttccacaggtctgtgaaccgggagaccaaggtgaagtttgtgcacacctctgtgcatggagtgggccacagctttgtgcagagcgccttcaaggcctttgacctggtgcccccagaggccgtgcctgagcagaaggaccctgaccctgagttccccaccgtgaagtaccccaaccctgaggagggcaaaggagtgctgaccctgagctttgccctggccgacaagaccaaggcccgcatcgtgctggccaatgaccctgatgctgaccggctggccgtggccgagaagcaggacagcggggagtggagggtcttctctggaaatgagctgggcgccctgctgggctggtggctgttcacctcctggaaggagaagaaccaggacagaagtgccctgaaggacacctacatgctgagcagcacagtgagcagcaagatcctgcgggccatcgccctgaaggagggcttccactttgaggagaccctgaccggcttcaagtggatgggcaacagagccaagcagctgattgaccagggcaagacagtgctgtttgcctttgaggaggccatcggcaagaagtag

SEQ ID NO: 164024 - DNA, 1869 bp, Artificial Sequence
  Description of Artificial Sequence: Synthetic coding sequence
atggctgaaaatacagaaggagacctgaacagcaacctgctgcacgccccctaccacactggagacccccagctggacacagccatcggccagtggctgcgctgggacaagaaccccaagaccaaggagcagatcgagaacctgctgagaaatggcatgaacaaggagctgcgggaccggctgtgctgcaggatgacctttggaacagctggcctgcggagcgccatgggcgccggcttctgctacatcaatgacctgaccgtcatccagagcacccagggcatgtacaagtacctggagcgctgcttcagtgacttcaagcagaggggctttgtggtgggctatgacacccggggccaggtgaccagcagctgcagcagccagaggctggccaagctgacagctgctgtgctgctggccaaggatgtgcctgtgtacctgttcagccgctacgtgcccaccccatttgtgccctatgctgtgcagaagctgaaggctgtggccggcgtgatgatcacagccagccacaacaggaaggaggacaatggctacaaggtgtactgggagaccggggcccagatcaccagcccccatgacaaggagatcctgaagtgcatcgaggagtgtgtggagccctggaatggctcctggaatgacaacctggtggacaccagccccctgaagagggaccccctgcaggacatctgccgccgctacatggaggacctgaagaagatctgcttctaccgggagctgaacagcaagaccaccctgaagtttgtgcacaccagcttccacggcgtgggccatgactatgtgcagctggccttcaaggtgtttggcttcaagccacccatccctgtgcctgagcagaaggaccctgaccctgacttcagcacagtgaagtgccccaaccctgaggagggggagagcgtgctggagctgagcctgcggctggccgagaaggaaaatgcccgggtggtgctggccacagatcctgatgctgaccggctggccgctgctgagctgcaggagaatggctgctggaaggtgttcaccggaaatgagctggccgccctgtttggctggtggatgtttgactgctggaagaagaacaagagcagaaatgctgatgtgaagaatgtgtacatgctggccaccaccgtgagcagcaagatcctgaaggccatcgccctgaaggagggcttccactttgaggagaccctgcccggcttcaagtggattggcagccgcatcatcgacctgctggagaatggcaaggaggtgctgtttgcctttgaggagagcatcggcttcctgtgtggcacctctgtgctggacaaggatggagtgtctgctgctgtggtggtggccgagatggccagctacctggagaccatgaacatcaccctgaagcagcagctggtgaaggtgtatgagaagtatggctaccacatcagcaagaccagctacttcctgtgctatgagccccccaccatcaagagcatctttgagcggctgaggaactttgacagccccaaggagtaccccaagttctgtggcacctttgccatcctgcacgtgagagatgtgaccaccggctatgacagcagccagcccaacaagaagtctgtgctgcctgtgtccaagaacagccagatgatcaccttcaccttccagaatggctgtgtggccaccctgcggaccagcggcacagagcccaagatcaagtactatgcagagatgtgtgccagcccagaccagagcgacacagccctgctggaggaggagctgaagaagctgattgatgccctgattgagaacttcctgcagcccagcaagaatggcctcatctggaggtctgtgtag

SEQ ID NO: 164025 - DNA, 1713 bp, Artificial Sequence
  Description of Artificial Sequence: Synthetic coding sequence
atgggcggggagtggggccagagcgccatctgcccagagagcgcccaggagtggacctaccaggtgggccagcacctggtggacatggacctgggcgccatcaccaagtacagcgccctgcacgccaagcccaacggcctcatcctgcagtatggaacagctggcttccgcaccaaggccgagcacctggaccacgtgatgttcaggatgggcctgctggccgtgctgcggagcaagcagaccaagagcaccatcggcgtgatggtgacagccagccacaacccagaagaagataatggagtgaagctggtggaccccctgggggagatgctggcccccagctgggaggagcacgccacctgcctggccaatgctgaggagcaggacatgcagagggtgctgattgacatcagcgagaaggaggccgtgaacctgcagcaggatgcctttgtggtgattggccgggacacccggcccagcagcgagaagctgagccagagcgtgattgatggagtgacagtgctgggcggccagttccatgactatggcctgctgaccaccccccagctgcactacatggtgtactgcagaaatactggaggccgctatggcaaggccaccatcgagggctactaccagaagctgagcaaggcctttgtggagctgaccaagcaggccagctgcagcggagatgagtaccgcagcctgaaggtggactgtgccaacggcatcggggccctgaagctgcgggagatggagcactacttcagccagggcctgtctgtgcagctgttcaatgatggcagcaagggcaagctgaaccacctgtgtggggctgactttgtgaagagccaccagaagccaccccagggcatggagatcaagagcaatgaacgctgctgcagctttgatggagatgctgaccgcatcgtgtactactaccatgatgctgatggccacttccacctgattgatggagacaagatcgccaccctcatcagcagcttcctgaaggagctgctggtggagatcggggagagcctgaacatcggcgtggtgcagacagcctatgccaacggcagcagcacccgctacctggaggaggtgatgaaggtgcctgtgtactgcaccaagacaggagtgaagcacctgcaccacaaggcccaggagtttgatattggagtgtactttgaggccaacggccacggcacagccctcttcagcacagctgtggagatgaagatcaagcagagcgctgagcagctggaggacaagaagaggaaggccgccaagatgctggagaacatcatcgacctcttcaaccaggccgctggagatgccatcagtgacatgctggtgattgaggccatcctggccctgaagggcctgactgtgcagcagtgggatgccctgtacacagacctgcccaaccggcagctgaaggtgcaggtggccgacagaagagtcatcagcaccacagatgctgagcggcaggccgtgaccccacctggcctgcaggaggccatcaatgacctggtgaagaagtacaagctgagccgggcctttgtgcggcccagcggcacagaagatgtggtgcgggtgtatgcagaggccgacagccaggagagcgctgaccacctggcccacgaggtgtccctggccgtgttccagctggccggcggcatcggggagcggccccagcccggcttctag

SEQ ID NO: 164026 - DNA, 444 bp, Artificial Sequence
  Description of Artificial Sequence: Synthetic coding sequence
atggacctgggcgccatcaccaagtacagcgccctgcacgccaagcccaacggcctcatcctgcagtatggaacagctggcttccgcaccaaggccgagcacctggaccacgtgatgttcaggatgggcctgctggccgtgctgcggagcaagcagaccaagagcaccatcggcgtgatggtgacagccagccacaacccagaagaagataatggagtgaagctggtggaccccctgggggagatgctggcccccagctgggaggagcacgccacctgcctggccaatgctgaggagcaggacatgcagagggtgctgattgacatcagcgagaaggaggccgtgaacctgcagcaggatgcctttgtggtgattggccgggacacccggcccagcagcgagaagctgagccagagcgtgattgatggagtgacagtgctgtag

SEQ ID NO: 164027 - DNA, 1629 bp, Artificial Sequence
  Description of Artificial Sequence: Synthetic coding sequence
atggacctgggcgccatcaccaagtacagcgccctgcacgccaagcccaacggcctcatcctgcagtatggaacagctggcttccgcaccaaggccgagcacctggaccacgtgatgttcaggatgggcctgctggccgtgctgcggagcaagcagaccaagagcaccatcggcgtgatggtgacagccagccacaacccagaagaagataatggagtgaagctggtggaccccctgggggagatgctggcccccagctgggaggagcacgccacctgcctggccaatgctgaggagcaggacatgcagagggtgctgattgacatcagcgagaaggaggccgtgaacctgcagcaggatgcctttgtggtgattggccgggacacccggcccagcagcgagaagctgagccagagcgtgattgatggagtgacagtgctgggcggccagttccatgactatggcctgctgaccaccccccagctgcactacatggtgtactgcagaaatactggaggccgctatggcaaggccaccatcgagggctactaccagaagctgagcaaggcctttgtggagctgaccaagcaggccagctgcagcggagatgagtaccgcagcctgaaggtggactgtgccaacggcatcggggccctgaagctgcgggagatggagcactacttcagccagggcctgtctgtgcagctgttcaatgatggcagcaagggcaagctgaaccacctgtgtggggctgactttgtgaagagccaccagaagccaccccagggcatggagatcaagagcaatgaacgctgctgcagctttgatggagatgctgaccgcatcgtgtactactaccatgatgctgatggccacttccacctgattgatggagacaagatcgccaccctcatcagcagcttcctgaaggagctgctggtggagatcggggagagcctgaacatcggcgtggtgcagacagcctatgccaacggcagcagcacccgctacctggaggaggtgatgaaggtgcctgtgtactgcaccaagacaggagtgaagcacctgcaccacaaggcccaggagtttgatattggagtgtactttgaggccaacggccacggcacagccctcttcagcacagctgtggagatgaagatcaagcagagcgctgagcagctggaggacaagaagaggaaggccgccaagatgctggagaacatcatcgacctcttcaaccaggccgctggagatgccatcagtgacatgctggtgattgaggccatcctggccctgaagggcctgactgtgcagcagtgggatgccctgtacacagacctgcccaaccggcagctgaaggtgcaggtggccgacagaagagtcatcagcaccacagatgctgagcggcaggccgtgaccccacctggcctgcaggaggccatcaatgacctggtgaagaagtacaagctgagccgggcctttgtgcggcccagcggcacagaagatgtggtgcgggtgtatgcagaggccgacagccaggagagcgctgaccacctggcccacgaggtgtccctggccgtgttccagctggccggcggcatcggggagcggccccagcccggcttctag

SEQ ID NO: 164028 - DNA, 1701 bp, Artificial Sequence
  Description of Artificial Sequence: Synthetic coding sequence
atggacctgggcgccatcaccaagtacagcgccctgcacgccaagcccaacggcctcatcctgcagtatggaacagctggcttccgcaccaaggccgagcacctggaccacgtgatgttcaggatgggcctgctggccgtgctgcggagcaagcagaccaagagcaccatcggcgtgatggtgacagccagccacaacccagaagaagataatggagtgaagctggtggaccccctgggggagatgctggcccccagctgggaggagcacgccacctgcctggccaatgctgaggagcaggacatgcagagggtgctgattgacatcagcgagaaggaggccgtgaacctgcagcaggatgcctttgtggtgattggccgggacacccggcccagcagcgagaagctgagccagagcgtgattgatggagtgacagtgctgggcggccagttccatgactatggcctgctgaccaccccccagctgcactacatggtgtactgcagaaatactggaggccgctatggcaaggccaccatcgagggctactaccagaagctgagcaaggcctttgtggagctgaccaagcaggccagctgcagcggagatgagtaccgcagcctgaaggtggactgtgccaacggcatcggggccctgaagctgcgggagatggagcactacttcagccagggcctgtctgtgcagctgttcaatgatggcagcaagggcaagctgaaccacctgtgtggggctgactttgtgaagagccaccagaagccaccccagggcatggagatcaagagcaatgaacgctgctgcagctttgatggagatgctgaccgcatcgtgtactactaccatgatgctgatggccacttccacctgattgatggagacaagatcgccaccctcatcagcagcttcctgaaggagctgctggtggagatcggggagagcctgaacatcggcgtggtgcagacagcctatgccaacggcagcagcacccgctacctggaggaggtgatgaaggtgcctgtgtactgcaccaagacaggagtgaagcacctgcaccacaaggcccaggagtttgatattggagtgtactttgaggccaacggccacggcacagccctcttcagcacagctgtggagatgaagatcaagcagagcgctgagcagctggaggacaagaagaggaaggccgccaagatgctggagaacatcatcgacctcttcaaccaggccgctggagatgccatcagtgacatgctggtgattgaggccatcctggccctgaagggcctgactgtgcagcagtgggatgccctgtacacagacctgcccaaccggcagctgaaggtgcaggtggccgacagaagagtcatcagcaccacagatgctgagcggcaggccgtgaccccacctggcctgcaggaggccatcaatgacctggtgaagaagtacaagctgagccgggcctttgtgcggcccagcggcacagaagatgtggtgcgggtgtatgcagaggccgacagccaggagagcgctgaccacctggcccacgaggtgtccctggccgtgttccagctggccggcggcatcggggagcggccccagcccggctacaaggctgctgagaccacccacaacatcaacaatgcctttggacctggaacagccaatgagcacacagtgccctag

SEQ ID NO: 164029 - DNA, 720 bp, Artificial Sequence
  Description of Artificial Sequence: Synthetic coding sequence
atggagggcagccccatccctgtgctgactgtgcccacagccccctatgaggaccagaggcctgctgggggcggcggcctgcggcggcccaccggcctgtttgagggccagaggaactacctgcccaacttcatccagagcgtgctgagcagcattgacctgcgggaccggcagggctgcaccatggtggtgggcagtgatggccgctacttcagcaggacagccatcgagatcgtggtgcagatggccgccgccaacggcatcggccgcctcatcatcggccagaatggcatcctgagcaccccagctgtgtcctgcatcatcaggaagatcaaggccgccggcggcatcatcctgacagccagccactgccctgggggccctggaggagaatttggagtgaagttcaacgtggccaacggggtggagatcgtggaccctgtggacatctacctgaacctgctgcggaccatctttgacttccacgccatcaagggcctgctgaccggccccagccagctgaagatcagaattgatgccatgcacggcgtgatgggcccctacgtgaggaaggtgctgtgtgatgagctgggcgccccagccaacagcgccatcaactgtgtgcccctggaggactttggaggccagcacccagaccccaacctgacctacgccaccaccctgctggaggccatgaagggcggggagtatggcttctag

SEQ ID NO: 164030 - DNA, 1704 bp, Artificial Sequence
  Description of Artificial Sequence: Synthetic coding sequence
atggagggcagccccatccctgtgctgactgtgcccacagccccctatgaggaccagaggcctgctgggggcggcggcctgcggcggcccaccggcctgtttgagggccagaggaactacctgcccaacttcatccagagcgtgctgagcagcattgacctgcgggaccggcagggctgcaccatggtggtgggcagtgatggccgctacttcagcaggacagccatcgagatcgtggtgcagatggccgccgccaacggcatcggccgcctcatcatcggccagaatggcatcctgagcaccccagctgtgtcctgcatcatcaggaagatcaaggccgccggcggcatcatcctgacagccagccactgccctgggggccctggaggagaatttggagtgaagttcaacgtggccaacggcggccctgccccagatgtggtgtctgacaagatctaccagatcagcaagaccatcgaggagtatgccatctgcccagacctgagaattgacctgagccggctgggccggcaggagtttgacctggagaacaagttcaagcccttccgggtggagatcgtggaccctgtggacatctacctgaacctgctgcggaccatctttgacttccacgccatcaagggcctgctgaccggccccagccagctgaagatcagaattgatgccatgcatggagtgatgggcccctacgtgaggaaggtgctgtgtgatgagctgggcgccccagccaacagcgccatcaactgtgtgcccctggaggactttggaggccagcacccagaccccaacctgacctacgccaccaccctgctggaggccatgaagggcggggagtatggctttggagctgcctttgatgctgatggagaccgctacatgatcctgggccagaatggcttctttgtgagccccagcgacagcctggccatcatcgccgccaacctgagctgcatcccctacttccggcagatgggcgtgcggggcttcggccgctccatgcccacctccatggccctggacagagtggccaagtccatgaaggtgcctgtgtatgagaccccagctggctggaggttcttcagcaacctgatggattctggccgctgcaacctgtgtggggaggagagctttggcaccggcagtgaccacctgcgggagaaggatggcctgtgggccgtgctggtgtggctgagcatcatcgccgccaggaagcagagcgtggaggagatcgtgcgggaccactgggccaagtttggccgccactactactgccgctttgattatgagggcctggaccccaagaccacctactacatcatgagggacctggaggccctggtgacagacaagagcttcatcggccagcagtttgctgtgggcagccacgtgtacagcgtggccaagacagacagctttgaatatgtggaccctgtggatggcaccgtgaccaagaagcagggcctgcgcatcatcttcagtgatgccagccgcctcatcttccggctgagcagcagcagtggagtgcgggccaccctgcggctgtatgcagagagctatgaaagagaccccagcggccatgaccaggagccccaggccgtgctgagccccctgattgccatcgccctgaagatcagccagatccacgagaggacaggccggcggggccccaccgtcatcacctag

SEQ ID NO: 164031 - DNA, 1452 bp, Artificial Sequence
  Description of Artificial Sequence: Synthetic coding sequence
atggcccaggccgacatcgccctgattggcctggccgtgatgggccagaacctgatcctgaacatgaatgaccacggctttgtggtgtgtgccttcaacagaacagtgtccaaggtggatgacttcctggccaatgaggccaagggcaccaaggtggtgggcgcccagagcctgaaggagatggtgtccaagctgaagaagccccggcgcatcatcctgctggtgaaggccggccaggccgtggatgacttcatcgagaagctggtgcccctgctggacaccggggacatcatcattgatggcggcaacagcgagtacagagacaccacccggcgctgccgggacctgaaggccaagggcatcctgtttgtgggcagcggcgtgtctggaggagaggagggcgcccgctatggccccagcctgatgcctgggggcaacaaggaggcctggccccacatcaagaccatcttccagggcattgctgccaaggtgggcaccggggagccctgctgtgactgggtgggagatgagggcgccggccactttgtgaagatggtgcacaacggcatcgagtatggagacatgcagctgatctgtgaggcctaccacctgatgaaggatgtgctgggcatggcccaggatgagatggcccaggcctttgaggactggaacaagacagagctggacagcttcctgattgagatcacagccaacatcctgaagttccaggacacagatggcaagcacctgctgcccaagatccgggacagcgctggccagaagggcaccgggaagtggacagccatcagcgccctggagtatggagtgcctgtgaccctgattggagaggccgtgtttgcccgctgcctgagcagcctgaaggatgagcgcatccaggccagcaagaagctgaagggcccccagaagttccagtttgatggagacaagaagagcttcctggaggacatcaggaaggccctgtatgccagcaagatcatctcctatgcccagggcttcatgctgctgcggcaggccgccacagaatttggctggaccctgaactatggaggcatcgccctgatgtggaggggcggctgcatcatccgcagcgtcttcctgggcaagatcaaggatgcctttgacaggaaccctgagctgcagaacctgctgctggatgacttcttcaagtctgctgtggagaactgccaggacagctggaggagagctgtgtccactggagtgcaggccggcatccccatgccctgcttcaccacagccctgtccttctatgatggctacagacatgagatgctgcctgccagcctcatccaggcccagagggactactttggagcccacacctatgagctgctggccaagccaggccagttcatccacaccaactggacaggccacggcggcaccgtgagcagcagcagctacaatgcctag

SEQ ID NO: 164032 - DNA, 1413 bp, Artificial Sequence
  Description of Artificial Sequence: Synthetic coding sequence
atgggccagaacctgatcctgaacatgaatgaccacggctttgtggtgtgtgccttcaacagaacagtgtccaaggtggatgacttcctggccaatgaggccaagggcaccaaggtggtgggcgcccagagcctgaaggagatggtgtccaagctgaagaagccccggcgcatcatcctgctggtgaaggccggccaggccgtggatgacttcatcgagaagctggtgcccctgctggacacaggagacatcatcattgatggcggcaacagcgagtacagagacaccacccggcgctgccgggacctgaaggccaagggcatcctgtttgtgggcagcggcgtgtctggaggagaggagggcgcccgctatggccccagcctgatgcctgggggcaacaaggaggcctggccccacatcaagaccatcttccagggcattgctgccaaggtgggcactggagagccctgctgtgactgggtgggagatgaaggagctggccactttgtgaagatggtgcacaatggaattgaatatggagacatgcagctgatctgtgaggcctaccacctgatgaaggatgtgctgggcatggcccaggatgagatggcccaggcctttgaggactggaacaagacagagctggacagcttcctgattgagatcacagccaacatcctgaagttccaggacacagatggcaagcacctgctgcccaagatccgggacagcgctggccagaagggcaccgggaagtggacagccatcagcgccctggagtatggagtgcctgtgaccctcatcggggaggccgtgtttgcccgctgcctgagcagcctgaaggatgagcgcatccaggccagcaagaagctgaagggcccccagaagttccagtttgatggagacaagaagagcttcctggaggacatcaggaaggccctgtatgccagcaagatcatctcctatgcccagggcttcatgctgctgcggcaggccgccacagaatttggctggaccctgaactacggcggcatcgccctgatgtggaggggcggctgcatcatccgctctgtgttcctgggcaagatcaaggatgcctttgacagaaatcctgagctgcagaacctgctgctggatgacttcttcaagtctgctgtggagaactgccaggacagctggaggagagctgtgtccactggagtgcaggccggcatccccatgccctgcttcaccacagccctgtccttctatgatggctacagacatgagatgctgcctgccagcctcatccaggcccagagggactactttggagcccacacctatgagctgctggccaagccaggccagttcatccacaccaactggacaggccatggaggcaccgtgagcagcagcagctacaatgcctag

SEQ ID NO: 164033 - DNA, 1386 bp, Artificial Sequence
  Description of Artificial Sequence: Synthetic coding sequence
atggcccaggccgacatcgccctgattggcctggccgtgatgggccagaacctgatcctgaacatgaatgaccacggctttgtggtgtgtgccttcaacagaacagtgtccaaggtggatgacttcctggccaatgaggccaagggcaccaaggtggtgggcgcccagagcctgaaggagatggtgtccaagctgaagaagccccggcgcatcatcctgctggtgaaggccggccaggccgtggatgacttcatcgagaagctgcggcgctgccgggacctgaaggccaagggcatcctgtttgtgggcagcggcgtgtctggaggagaggagggcgcccgctatggccccagcctgatgcctgggggcaacaaggaggcctggccccacatcaagaccatcttccagggcattgctgccaaggtgggcaccggggagccctgctgtgactgggtgggagatgagggcgccggccactttgtgaagatggtgcacaacggcatcgagtatggagacatgcagctgatctgtgaggcctaccacctgatgaaggatgtgctgggcatggcccaggatgagatggcccaggcctttgaggactggaacaagacagagctggacagcttcctgattgagatcacagccaacatcctgaagttccaggacacagatggcaagcacctgctgcccaagatccgggacagcgctggccagaagggcaccgggaagtggacagccatcagcgccctggagtatggagtgcctgtgaccctgattggagaggccgtgtttgcccgctgcctgagcagcctgaaggatgagcgcatccaggccagcaagaagctgaagggcccccagaagttccagtttgatggagacaagaagagcttcctggaggacatcaggaaggccctgtatgccagcaagatcatctcctatgcccagggcttcatgctgctgcggcaggccgccacagaatttggctggaccctgaactatggaggcatcgccctgatgtggaggggcggctgcatcatccgcagcgtcttcctgggcaagatcaaggatgcctttgacaggaaccctgagctgcagaacctgctgctggatgacttcttcaagtctgctgtggagaactgccaggacagctggaggagagctgtgtccactggagtgcaggccggcatccccatgccctgcttcaccacagccctgtccttctatgatggctacagacatgagatgctgcctgccagcctcatccaggcccagagggactactttggagcccacacctatgagctgctggccaagccaggccagttcatccacaccaactggacaggccacggcggcaccgtgagcagcagcagctacaatgcctag

SEQ ID NO: 164034 - DNA, 1290 bp, Artificial Sequence
  Description of Artificial Sequence: Synthetic coding sequence
atgaccacagccctgtggagcgtgctgctgattggcctgagccccaagctgatgatctcctggcccatgaggcaggccgtggatgacttcatcgagaagctggtgcccctgctggacaccggggacatcatcattgatggcggcaacagcgagtacagagacaccacccggcgctgccgggacctgaaggccaagggcatcctgtttgtgggcagcggcgtgtctggaggagaggagggcgcccgctatggccccagcctgatgcctgggggcaacaaggaggcctggccccacatcaagaccatcttccagggcattgctgccaaggtgggcaccggggagccctgctgtgactgggtgggagatgagggcgccggccactttgtgaagatggtgcacaacggcatcgagtatggagacatgcagctgatctgtgaggcctaccacctgatgaaggatgtgctgggcatggcccaggatgagatggcccaggcctttgaggactggaacaagacagagctggacagcttcctgattgagatcacagccaacatcctgaagttccaggacacagatggcaagcacctgctgcccaagatccgggacagcgctggccagaagggcaccgggaagtggacagccatcagcgccctggagtatggagtgcctgtgaccctgattggagaggccgtgtttgcccgctgcctgagcagcctgaaggatgagcgcatccaggccagcaagaagctgaagggcccccagaagttccagtttgatggagacaagaagagcttcctggaggacatcaggaaggccctgtatgccagcaagatcatctcctatgcccagggcttcatgctgctgcggcaggccgccacagaatttggctggaccctgaactatggaggcatcgccctgatgtggaggggcggctgcatcatccgcagcgtcttcctgggcaagatcaaggatgcctttgacaggaaccctgagctgcagaacctgctgctggatgacttcttcaagtctgctgtggagaactgccaggacagctggaggagagctgtgtccactggagtgcaggccggcatccccatgccctgcttcaccacagccctgtccttctatgatggctacagacatgagatgctgcctgccagcctcatccaggcccagagggactactttggagcccacacctatgagctgctggccaagccaggccagttcatccacaccaactggacaggccacggcggcaccgtgagcagcagcagctacaatgcctag

SEQ ID NO: 164035 - DNA, 1500 bp, Artificial Sequence
  Description of Artificial Sequence: Synthetic coding sequence
atgaccttctggacccagatgttcttcctgctgcaggactgtgagggcctcatcgtgcgcagcgccaccaaggtgacagcagatgtgatcaatgctgctgagaagctgcaggtggtgggccgggccggcaccggggtggacaacgtggacctggaggccgccaccaggaagggcatcctggtgatgaacacccccaacggcaacagcctgtctgctgctgagctgacctgtggcatgatcatgtgcctggcccggcagatcccccaggccacagcctccatgaaggatggcaagtgggagaggaagaagttcatgggcacagagctgaatggcaagaccctgggcatcctgggcctgggccgcatcggccgggaggtggccaccaggatgcagagctttggcatgaagaccatcggctatgaccccatcatcagccctgaggtgtctgccagctttggagtgcagcagctgcccctggaggagatctggcccctgtgtgacttcatcaccgtgcacacccccctgctgcccagcaccaccggcctgctgaatgacaacacctttgcccagtgcaagaagggcgtgcgggtggtgaactgtgcccggggcggcatcgtggatgaaggagccctgctgcgggccctgcagagcggccagtgtgccggggccgccctggatgtgttcacagaggagcccccccgggaccgggccctggtggaccatgaaaatgtcatcagctgcccccacctgggcgccagcaccaaggaggcccagagccgctgtggggaggagattgctgtgcagtttgtggacatggtgaagggcaagagcctgactggagtggtgaatgcccaggccctgaccagcgccttcagcccccacaccaagccctggattggcctggccgaggccctgggcaccctgatgagggcctgggccggcagccccaagggcaccatccaggtgatcacccagggcaccagcctgaagaatgccggcaactgcctgagccctgctgtgattgtgggcctgctgaaggaggccagcaagcaggctgatgtgaacctggtgaatgccaagctgctggtgaaggaggccggcctgaatgtgaccaccagccacagccctgctgcccctggagagcagggctttggagagtgcctgctggccgtggccctggccggggccccctaccaggccgtgggcctggtgcagggcaccacccctgtgctgcagggcctgaatggagctgtgttccggcctgaggtgcccctgcggcgggacctgcccctgctgctcttccgcacccagaccagtgaccctgccatgctgcccaccatgattggcctgctggccgaggccggcgtgcggctgctgagctaccagaccagcctggtgtctgatggagagacctggcacgtgatgggcatcagcagcctgctgcccagcctggaggcctggaagcagcacgtgacagaggccttccagttccacttctag

SEQ ID NO: 164036 - DNA, 1602 bp, Artificial Sequence
  Description of Artificial Sequence: Synthetic coding sequence
atggcctttgccaacctgaggaaggtgctgatcagtgacagcctggacccctgctgcaggaagatcctgcaggacggcggcctgcaggtggtggagaagcagaacctgagcaaggaggagctgattgctgagctgcaggactgtgagggcctcatcgtgcgcagcgccaccaaggtgacagcagatgtgatcaatgctgctgagaagctgcaggtggtgggccgggccggcaccggggtggacaacgtggacctggaggccgccaccaggaagggcatcctggtgatgaacacccccaacggcaacagcctgtctgctgctgagctgacctgtggcatgatcatgtgcctggcccggcagatcccccaggccacagcctccatgaaggatggcaagtgggagaggaagaagttcatgggcacagagctgaatggcaagaccctgggcatcctgggcctgggccgcatcggccgggaggtggccaccaggatgcagagctttggcatgaagaccatcggctatgaccccatcatcagccctgaggtgtctgccagctttggagtgcagcagctgcccctggaggagatctggcccctgtgtgacttcatcaccgtgcacacccccctgctgcccagcaccaccggcctgctgaatgacaacacctttgcccagtgcaagaagggcgtgcgggtggtgaactgtgcccggggcggcatcgtggatgaaggagccctgctgcgggccctgcagagcggccagtgtgccggggccgccctggatgtgttcacagaggagcccccccgggaccgggccctggtggaccatgaaaatgtcatcagctgcccccacctgggcgccagcaccaaggaggcccagagccgctgtggggaggagattgctgtgcagtttgtggacatggtgaagggcaagagcctgactggagtggtgaatgcccaggccctgaccagcgccttcagcccccacaccaagccctggattggcctggccgaggccctgggcaccctgatgagggcctgggccggcagccccaagggcaccatccaggtgatcacccagggcaccagcctgaagaatgccggcaactgcctgagccctgctgtgattgtgggcctgctgaaggaggccagcaagcaggctgatgtgaacctggtgaatgccaagctgctggtgaaggaggccggcctgaatgtgaccaccagccacagccctgctgcccctggagagcagggctttggagagtgcctgctggccgtggccctggccggggccccctaccaggccgtgggcctggtgcagggcaccacccctgtgctgcagggcctgaatggagctgtgttccggcctgaggtgcccctgcggcgggacctgcccctgctgctcttccgcacccagaccagtgaccctgccatgctgcccaccatgattggcctgctggccgaggccggcgtgcggctgctgagctaccagaccagcctggtgtctgatggagagacctggcacgtgatgggcatcagcagcctgctgcccagcctggaggcctggaagcagcacgtgacagaggccttccagttccacttctag

SEQ ID NO: 164037 - DNA, 291 bp, Artificial Sequence
  Description of Artificial Sequence: Synthetic coding sequence
atgaagaccatcggctatgaccccatcatcagccctgaggtgtctgccagctttggagtgcagcagctgcccctggaggagatctggcccctgtgtgacttcatcaccgtgcacacccccctgctgcccagcaccaccggcctgctgaatgacaacacctttgcccagtgcaagaagggcgtgcgggtggtgaactgtgcccggggcggcatcgtggatgaaggagccctgctgcgggccctgcagagcggccagtgtgccggggccgccctggatgtgttcacagaatag

SEQ ID NO: 164038 - DNA, 1221 bp, Artificial Sequence
  Description of Artificial Sequence: Synthetic coding sequence
atgaaggatggcaagtgggagaggaagaagttcatgggcacagagctgaatggcaagaccctgggcatcctgggcctgggcagaattggccgggaggtggccaccaggatgcagagctttggcatgaagaccatcggctatgaccccatcatcagccctgaggtgtctgccagctttggagtgcagcagctgcccctggaggagatctggcccctgtgtgacttcatcaccgtgcacacccccctgctgcccagcaccaccggcctgctgaatgacaacacctttgcccagtgcaagaagggcgtgcgggtggtgaactgtgcccggggcggcatcgtggatgagggcgccctgctgcgggccctgcagagcggccagtgtgccggggccgccctggatgtgttcacagaggagcccccccgggaccgggccctggtggaccatgaaaatgtcatcagctgcccccacctgggcgccagcaccaaggaggcccagagccgctgtggggaggagattgctgtgcagtttgtggacatggtgaagggcaagagcctgactggagtggtgaatgcccaggccctgaccagcgccttcagcccccacaccaagccctggattggcctggccgaggccctgggcaccctgatgagggcctgggccggcagccccaagggcaccatccaggtgatcacccagggcaccagcctgaagaatgccggcaactgcctgagccctgctgtgattgtgggcctgctgaaggaggccagcaagcaggctgatgtgaacctggtgaatgccaagctgctggtgaaggaggccggcctgaatgtgaccaccagccacagccctgctgcccctggagagcagggctttggagaatgtctgctggccgtggccctggccggggccccctaccaggccgtgggcctggtgcagggcaccacccctgtgctgcagggcctgaatggagctgtgttccggcctgaggtgcccctgcggcgggacctgcccctgctgctcttccgcacccagaccagtgaccctgccatgctgcccaccatgattggcctgctggccgaggccggcgtgcggctgctgagctaccagaccagcctggtgtctgatggagagacctggcacgtgatgggcatcagcagcctgctgcccagcctggaggcctggaagcagcacgtgacagaggccttccagttccacttctag

SEQ ID NO: 164039 - DNA, 1254 bp, Artificial Sequence
  Description of Artificial Sequence: Synthetic coding sequence
atgagcctgagcaacaagctgaccctggacaagctggatgtgaagggcaagagggtggtgatgagggtggacttcaacgtgcccatgaagaacaaccagatcaccaacaaccagaggatcaaggctgctgtgcccagcatcaagttctgcctggacaatggagccaagtctgtggtgctgatgagccacctgggccgcccagatggagtgcccatgccagacaagtacagcctggagcctgtggccgtggagctgaagagcctgctgggcaaggatgtgctcttcctgaaggactgtgtgggccctgaggtggagaaggcctgtgccaacccagctgctggcagcgtcatcctgctggagaacctgcgcttccacgtggaggaggagggcaagggcaaggatgccagcggcaacaaggtgaaggccgagcccgccaagattgaggccttccgggccagcctgagcaagctgggagatgtgtatgtgaatgatgccttcggcacagcccaccgggcccacagctccatggtgggcgtgaacctgccccagaaggccggcggcttcctgatgaagaaggagctgaactactttgccaaggccctggagagccctgagcggcccttcctggccatcctgggcggggccaaggtggccgacaagatccagctgatcaacaacatgctggacaaggtgaatgagatgatcatcggcggcggcatggccttcaccttcctgaaggtgctgaacaacatggagatcggcaccagcctgtttgatgaggagggcgccaagatcgtgaaggacctgatgagcaaggccgagaagaatggagtgaagatcaccctgcctgtggactttgtgacagctgacaagtttgatgaaaatgccaagacaggccaggccaccgtggccagcggcatcccagctggctggatgggcctggactgtggccctgagagcagcaagaagtatgcagaggccgtgacccgggccaagcagatcgtgtggaatggacctgtgggcgtgtttgagtgggaggcctttgcccggggcaccaaggccctgatggatgaggtggtgaaggccaccagccggggctgcatcaccatcattggaggaggagacacagccacctgctgtgccaagtggaacacagaggacaaggtgagccacgtgtccactggaggaggagccagcctggagctgctggagggcaaggtgctgcccggggtggatgccctgagcaacatctag

SEQ ID NO: 164040 - DNA, 846 bp, Artificial Sequence
  Description of Artificial Sequence: Synthetic coding sequence
atgagcctgagcaacaagctgaccctggacaagctggatgtgaagggcaagagggtggtgatgagggtggacttcaacgtgcccatgaagaacaaccagatcaccaacaaccagaggatcaaggctgctgtgcccagcatcaagttctgcctggacaatggagccaagtctgtggtgctgatgagccacctgggccgcccagatggccggcccttcctggccatcctgggcggggccaaggtggccgacaagatccagctgatcaacaacatgctggacaaggtgaatgagatgatcatcggcggcggcatggccttcaccttcctgaaggtgctgaacaacatggagatcggcaccagcctgtttgatgaggagggcgccaagatcgtgaaggacctgatgagcaaggccgagaagaatggagtgaagatcaccctgcctgtggactttgtgacagctgacaagtttgatgaaaatgccaagacaggccaggccaccgtggccagcggcatcccagctggctggatgggcctggactgtggccctgagagcagcaagaagtatgcagaggccgtgacccgggccaagcagatcgtgtggaatggacctgtgggcgtgtttgagtgggaggcctttgcccggggcaccaaggccctgatggatgaggtggtgaaggccaccagccggggctgcatcaccatcattggaggaggagacacagccacctgctgtgccaagtggaacacagaggacaaggtgagccacgtgtccactggaggaggagccagcctggagctgctggagggcaaggtgctgcccggggtggatgccctgagcaacatctag

SEQ ID NO: 164041 - DNA, 729 bp, Artificial Sequence
  Description of Artificial Sequence: Synthetic coding sequence
atggtgggcgtgaacctgccccagaaggccggcggcttcctgatgaagaaggagctgaactactttgccaaggccctggagagccctgagcggcccttcctggccatcctgggcggggccaaggtggccgacaagatccagctgatcaacaacatgctggacaaggtgaatgagatgatcattggaggcggcatggccttcaccttcctgaaggtgctgaacaacatggagatcggcaccagcctgtttgatgaggagggcgccaagatcgtgaaggacctgatgagcaaggccgagaagaatggagtgaagatcaccctgcctgtggactttgtgacagctgacaagtttgatgaaaatgccaagacaggccaggccaccgtggccagcggcatcccagctggctggatgggcctggactgtggccctgagagcagcaagaagtatgcagaggccgtgacccgggccaagcagatcgtgtggaatggacctgtgggcgtgtttgagtgggaggcctttgcccggggcaccaaggccctgatggatgaggtggtgaaggccaccagccggggctgcatcaccatcatcggcggcggggacacagccacctgctgtgccaagtggaacacagaggacaaggtgagccacgtgtccactggaggaggagccagcctggagctgctggagggcaaggtgctgcccggggtggatgccctgagcaacatctag

SEQ ID NO: 164042 - DNA, 1170 bp, Artificial Sequence
  Description of Artificial Sequence: Synthetic coding sequence
atgaagaacaaccagatcaccaacaaccagaggatcaaggctgctgtgcccagcatcaagttctgcctggacaatggagccaagtctgtggtgctgatgagccacctgggccgcccagatggagtgcccatgccagacaagtacagcctggagcctgtggccgtggagctgaagagcctgctgggcaaggatgtgctcttcctgaaggactgtgtgggccctgaggtggagaaggcctgtgccaacccagctgctggcagcgtcatcctgctggagaacctgcgcttccacgtggaggaggagggcaagggcaaggatgccagcggcaacaaggtgaaggccgagcccgccaagattgaggccttccgggccagcctgagcaagctgggagatgtgtatgtgaatgatgccttcggcacagcccaccgggcccacagctccatggtgggcgtgaacctgccccagaaggccggcggcttcctgatgaagaaggagctgaactactttgccaaggccctggagagccctgagcggcccttcctggccatcctgggcggggccaaggtggccgacaagatccagctgatcaacaacatgctggacaaggtgaatgagatgatcatcggcggcggcatggccttcaccttcctgaaggtgctgaacaacatggagatcggcaccagcctgtttgatgaggagggcgccaagatcgtgaaggacctgatgagcaaggccgagaagaatggagtgaagatcaccctgcctgtggactttgtgacagctgacaagtttgatgaaaatgccaagacaggccaggccaccgtggccagcggcatcccagctggctggatgggcctggactgtggccctgagagcagcaagaagtatgcagaggccgtgacccgggccaagcagatcgtgtggaatggacctgtgggcgtgtttgagtgggaggcctttgcccggggcaccaaggccctgatggatgaggtggtgaaggccaccagccggggctgcatcaccatcattggaggaggagacacagccacctgctgtgccaagtggaacacagaggacaaggtgagccacgtgtccactggaggaggagccagcctggagctgctggagggcaaggtgctgcccggggtggatgccctgagcaacatctag

SEQ ID NO: 164043 - DNA, 1254 bp, Artificial Sequence
  Description of Artificial Sequence: Synthetic coding sequence
atgagcctgagcaagaagctgaccctggacaagctggatgtgcggggcaagagggtcatcatgagggtggacttcaacgtgcccatgaagaagaaccagatcaccaacaaccagaggatcaaggccagcatccccagcatcaagtactgcctggacaatggagccaaggctgtggtgctgatgagccacctgggccgcccagatggagtgcccatgccagacaagtacagcctggcccctgtggccgtggagctgaagagcctgctgggcaaggatgtgctcttcctgaaggactgtgtgggcgctgaggtggagaaggcctgtgccaacccagcccctggcagcgtcatcctgctggagaacctgcgcttccacgtggaggaggagggcaagggccaggaccccagcggcaagaagatcaaggccgagccagacaagattgaggccttccgggccagcctgagcaagctgggagatgtgtatgtgaatgatgccttcggcacagcccaccgggcccacagctccatggtgggcgtgaacctgccccacaaggccagcggcttcctgatgaagaaggagctggactactttgccaaggccctggagaaccctgtgcggcccttcctggccatcctgggcggggccaaggtggccgacaagatccagctgatcaagaacatgctggacaaggtgaatgagatgatcatcggcggcggcatggcctacaccttcctgaaggtgctgaacaacatggagattggagccagcctgtttgatgaggagggcgccaagatcgtgaaggacatcatggccaaggcccagaagaatggagtgcgcatcaccttccctgtggactttgtgactggagacaagtttgatgaaaatgcccaggtgggcaaggccaccgtggccagcggcatcagccctggctggatgggcctggactgtggccctgagagcaacaagaaccacgcccaggtggtggcccaggcccggctcatcgtgtggaatggccccctgggcgtgtttgagtgggatgcctttgccaagggcaccaaggccctgatggatgaaattgtgaaggccaccagcaagggctgcatcaccgtgattggaggaggagacacagccacctgctgtgccaagtggaacacagaggacaaggtgagccacgtgtccactggaggaggagccagcctggagctgctggagggcaagatcctgcccggggtggaggccctgagcaacatgtag

SEQ ID NO: 164044 - DNA, 765 bp, Artificial Sequence
  Description of Artificial Sequence: Synthetic coding sequence
atggccgcctacaagctggtgctgatcagacatggagagagcgcctggaacctggagaaccgcttcagcggctggtatgatgctgacctgagccctgctggccacgaggaggccaagagaggaggccaggccctgagagatgctggctatgaatttgacatctgcttcacctctgtgcagaagagggccatccgcaccctgtggacagtgctggatgccatcgaccagatgtggctgcctgtggtgaggacctggaggctgaatgaaagacactacggcggcctgaccggcctgaacaaggccgagacagctgccaagcatggagaggcccaggtgaagatctggaggaggagctatgatgtgcccccaccacccatggagccagaccaccccttctacagcaacatcagcaaggaccggcgctatgctgacctgacagaggaccagctgcccagctgtgagagcctgaaggacaccatcgcccgggccctgcccttctggaatgaggagatcgtgccccagatcaaggagggcaagagggtgctgattgctgcccacggcaacagcctgcggggcatcgtgaagcacctggagggcctgtctgaggaggccatcatggagctgaacctgcccaccggcatccccatcgtgtatgagctggacaagaacctgaagcccatcaagcccatgcagttcctgggagatgaggagaccgtgaggaaggccatggaggccgtggccgcccagggcaaggccaagaagtag

SEQ ID NO: 164045 - DNA, 435 bp, Artificial Sequence
  Description of Artificial Sequence: Synthetic coding sequence
atgcccctcatccgctgtggctgccatgatgtgcccccaccacccatggagccagaccaccccttctacagcaacatcagcaaggaccggcgctatgctgacctgacagaggaccagctgcccagctgtgagagcctgaaggacaccatcgcccgggccctgcccttctggaatgaggagatcgtgccccagatcaaggagggcaagagggtgctgattgctgcccacggcaacagcctgcggggcatcgtgaagcacctggagggcctgtctgaggaggccatcatggagctgaacctgcccaccggcatccccatcgtgtatgagctggacaagaacctgaagcccatcaagcccatgcagttcctgggagatgaggagaccgtgaggaaggccatggaggccgtggccgcccagggcaaggccaagaagtag

SEQ ID NO: 164046 - DNA, 762 bp, Artificial Sequence
  Description of Artificial Sequence: Synthetic coding sequence
atggccacccaccggctggtgatggtgagacatggagagagcacctggaaccaggagaaccgcttctgtggctggtttgatgctgagctgtctgagaagggcacagaggaggccaagagaggagccaaggccatcaaggatgccaagatggagtttgacatctgctacacctctgtgctgaagagggccatccgcaccctgtgggccatcctggatggaacagaccagatgtggctgcctgtggtgaggacctggaggctgaatgaaagacactacggcggcctgaccggcctgaacaaggccgagacagctgccaagcatggagaggagcaggtgaagatctggaggaggagctttgacatccccccaccacccatggatgagaagcacccctactacaacagcatcagcaaggagcggcgctatgccggcctgaagccaggagagctgcccacctgtgagagcctgaaggacaccatcgcccgggccctgcccttctggaatgaggagatcgtgccccagatcaaggccggcaagagggtgctgattgctgcccacggcaacagcctgcggggcatcgtgaagcacctggagggcatgtctgaccaggccatcatggagctgaacctgcccaccggcatccccatcgtgtatgagctgaacaaggagctgaagcccaccaagcccatgcagttcctgggagatgaggagaccgtgaggaaggccatggaggccgtggccgcccagggcaaggccaagtag

SEQ ID NO: 164047 - DNA, 765 bp, Artificial Sequence
  Description of Artificial Sequence: Synthetic coding sequence
atggccgcctacaagctggtgctgatcagacatggagagagcacctggaacctggagaaccgcttcagctgctggtatgatgctgacctgagccctgctggccacgaggaggccaagagaggaggccaggccctgagagatgctggctatgaatttgacatctgcctgacctctgtgcagaagagggtcatccgcaccctgtggacagtgctggatgccatcgaccagatgtggctgcctgtggtgaggacctggaggctgaatgaaagacactacggcggcctgaccggcctgaacaaggccgagacagctgccaagcatggagaggcccaggtgaagatctggaggaggagctatgatgtgcccccaccacccatggagccagaccaccccttctacagcaacatcagcaaggaccggcgctatgctgacctgacagaggaccagctgcccagctatgagagccccaaggacaccatcgcccgggccctgcccttctggaatgaggagatcgtgccccagatcaaggagggcaagagggtgctgattgctgcccacggcaacagcctgcagggcatcgccaagcacgtggagggcctgtctgaggaggccatcatggagctgaacctgcccaccggcatccccatcgtgtatgagctggacaagaacctgaagcccatcaagcccatgcagttcctgggagatgaggagaccgtgtgcaaggccattgaagctgtggccgcccagggcaaggccaagaagtag

SEQ ID NO: 164048 - DNA, 966 bp, Artificial Sequence
  Description of Artificial Sequence: Synthetic coding sequence
atggctgctgctgaggccggaggagatgatgcccgctgtgtgcggctgtctgctgagcgggcccaggccctgctggctgatgtggacaccctgctgtttgactgtgatggagtgctgtggagaggagaaacagctgtgcctggggcccctgaggccctgcgggccctgcgggcccggggcaagaggctgggcttcatcaccaacaacagcagcaagaccagggctgcctatgcagagaagctgcggcggctgggctttggaggccctgctggccctggggccagcctggaggtgtttggaacagcctactgcacagccctgtacctgcggcagaggctggccggggccccagcccccaaggcctacgtgctgggcagccctgccctggccgctgagctggaggccgtgggcgtggcctctgtgggcgtgggccctgagcccctgcagggcgagggccctggggactggctgcacgcccccctggagccagatgtgcgggctgtggtggtgggctttgacccccacttctcctacatgaagctgaccaaggccctgcgctacctgcagcagcccggctgcctgctggtgggcaccaacatggacaaccggctgcccctggagaatggccgcttcatcgccggcaccggctgcctggtgcgggctgtggagatggccgcccagaggcaggccgacatcatcggcaagcccagccgcttcatctttgactgtgtgtcccaggagtatggcatcaaccctgagaggacagtgatggtgggggaccggctggacacagacatcctgctgggcgccacctgtggcctgaagaccatcctgaccctgactggagtgtccaccctgggagatgtgaagaacaaccaggagagtgactgtgtgtccaagaagaagatggtgcctgacttctacgtggacagcattgctgacctgctgcctgccctgcagggctag

SEQ ID NO: 164049 - DNA, 378 bp, Artificial Sequence
  Description of Artificial Sequence: Synthetic coding sequence
atggctgtggccgacctggccctgatcccagatgtggacatcgacagtgatggagtcttcaagtatgtgctgatccgggtgcacagcgcccccaggtctggggccccagctgctgagagcaaggagatcgtgcggggctacaagtgggccgagtaccacgccgacatctatgacaaggtgtctggggacatgcagaagcagggctgtgactgtgagtgcctgggcggcggccgcatcagccaccagagccaggacaagaagatccacgtgtatggctacagcatggcctacggccctgcccagcacgccatcagcacagagaagatcaaggccaagtacccagactatgaggtgacctgggccaatgatggctactag

SEQ ID NO: 164050 - DNA, 375 bp, Artificial Sequence
  Description of Artificial Sequence: Synthetic coding sequence
atggctgtggccgacctggccctgatcccagatgtggacatcgacagtgatggagtcttcaagtatgtgctgatccgggtgcacagcgcccccaggtctggggccccagctgctgagagcaaggagatcgtgcggggctacaagtgggccgagtaccacgccgacatctatgacaaggtgtctggggacatgcagaagcagggctgtgactgtgagtgcctgggcggcggccgcatcagccaccagagccaggacaagaagatccacgtgtatggctacagcatgatgaggcccacctgtgtgcccctgggcgccagcggcccccgcatccaccaccagggcctgtggagctgcccagcccggcacttcaactag

SEQ ID NO: 164051 - DNA, 375 bp, Artificial Sequence; identical to SEQ ID NO: 164050
  Description of Artificial Sequence: Synthetic coding sequence

SEQ ID NO: 164052 - DNA, 1356 bp, Artificial Sequence
  Description of Artificial Sequence: Synthetic coding sequence
atggccacagatgacaagaccagccccaccctggacagcgccaatgacctgcccaggagccccaccagccccagccacctgacccacttcaagcccctgaccccagaccaggatgagccccccttcaagagcgcctacagcagctttgtgaacctcttccgcttcaacaaggagcgggcagagggcggccagggcgagcagcagcccctgagcggctcctggaccagcccccagctgcccagcaggacccagagcgtgcgcagccccaccccctacaagaagcagctgaatgaggagctgcagaggaggagcagcgccctgggggacctgcgggcctgcacctactgcaggaagatcgccctgtcctatgcccacagcacagacagcaacagcatcggggaggacctgaatgccctgagtgacagcgcctgcagcgtgtctgtgctggaccccagcgagcccaggacccctgtgggcagcaggaaggccagcaggaacatcttcctggaggatgacctggcctggcagagcctcatccacccagacagcagcaacacccccctgagcacccggctggtgtctgtgcaggaggatgctgggaagagccctgccaggaacagaagtgccagcatcaccaacctgagcctggacagaagtggcagccccatggtgcccagctatgagacctctgtgagcccccaggccaacagaacctacgtgaggacagagaccacagaagatgagaggaagatcctgctggacagcgtgcagctgaaggacctgtggaagaagatctgccaccacagcagcggcatggagttccaggaccaccgctactggctgcggacccaccccaactgcatcgtgggcaaggagctggtgaactggctgatcagaaatggccacatcgccacccgggcccaggccatcgccatcggccaggccatggtggatggccgctggctggactgtgtgagccaccacgaccagctgttcagagatgaatatgccctgtaccggcccctgcagagcacagagttcagcgagacccccagcccagacagcgacagcgtgaacagcgtggagggccacagcgagcccagctggttcaaggacatcaagtttgatgacagcgacacagagcagattgctgaggagggagatgacaacctggccaacagcgccagccccagcaagaggacctctgtgtcctccttccagagcacagtggacagcgacagcgctgccagcatcagcctgaatgtggagctggacaacgtgaacttccacatcaagaagcccagcaagtacccccacgtgcccccccaccctgctgaccagaagggcagaagatag

SEQ ID NO: 164053 - DNA, 1647 bp, Artificial Sequence
  Description of Artificial Sequence: Synthetic coding sequence
atggccacagatgacaagaccagccccaccctggacagcgccaatgacctgcccaggagccccaccagccccagccacctgacccacttcaagcccctgaccccagaccaggatgagccccccttcaagagcgcctacagcagctttgtgaacctcttccgcttcaacaaggagcgggcagagggcggccagggcgagcagcagcccctgagcggctcctggaccagcccccagctgcccagcaggacccagagcgtgcgcagccccaccccctacaagaagcagctgaatgaggagctgcagaggaggagcagcgccctggacaccaggaggaaggccgagcccacctttggaggccatgaccccaggacagctgtgcagctgcggagcctgagcacagtgctgaagaggctgaaggagatcatggagggcaagagccaggacagcgacctgaagcagtactggatgccagacagccagtgcaaggaatgttatgactgcagcgagaagttcaccaccttcagaagaagacaccactgccgcctgtgtggccagatcttctgcagccgctgctgcaaccaggagatccctgggaagttcatgggctacaccggggacctgcgggcctgcacctactgcaggaagatcgccctgtcctatgcccacagcacagacagcaacagcattggagaggacctgaatgccctgagtgacagcgcctgcagcgtgtctgtgctggaccccagcgagcccaggacccctgtgggcagcaggaaggccagcaggaacatcttcctggaggatgacctggcctggcagagcctcatccacccagacagcagcaacacccccctgagcacccggctggtgtctgtgcaggaggatgctgggaagagccctgccaggaacagaagtgccagcatcaccaacctgagcctggacaggagcggcagccccatggtgcccagctatgagacctctgtgagcccccaggccaacagaacctacgtgaggacagagaccacagaagatgagaggaagatcctgctggacagcgtgcagctgaaggacctgtggaagaagatctgccaccacagcagcggcatggagttccaggaccaccgctactggctgcggacccaccccaactgcatcgtgggcaaggagctggtgaactggctgatcagaaatggccacatcgccacccgggcccaggccatcgccatcggccaggccatggtggatggccgctggctggactgtgtgagccaccacgaccagctgttcagagatgaatatgccctgtaccggcccctgcagagcacagagttcagcgagacccccagcccagacagcgacagcgtgaacagcgtggagggccacagcgagcccagctggttcaaggacatcaagtttgatgacagcgacacagagcagattgctgaggagggagatgacaacctggccaacagcgccagccccagcaagaggacctctgtgagcagcttccagagcacagtggacagcgacagcgctgccagcatcagcctgaatgtggagctggacaacgtgaacttccacatcaagaagcccagcaagtacccccacgtgcccccccaccctgctgaccagaagggcagaagatag

SEQ ID NO: 164054 - DNA, 6297 bp, Artificial Sequence
  Description of Artificial Sequence: Synthetic coding sequence
atggccacagatgacaagaccagccccaccctggacagcgccaatgacctgcccaggagccccaccagccccagccacctgacccacttcaagcccctgaccccagaccaggatgagccccccttcaagagcgcctacagcagctttgtgaacctcttccgcttcaacaaggagcgggcagagggcggccagggcgagcagcagcccctgagcggctcctggaccagcccccagctgcccagcaggacccagagcgtgcgcagccccaccccctacaagaagcagctgaatgaggagctgcagaggaggagcagcgccctggacaccaggaggaaggccgagcccacctttggaggccatgaccccaggacagctgtgcagctgcggagcctgagcacagtgctgaagaggctgaaggagatcatggagggcaagagccaggacagcgacctgaagcagtactggatgccagacagccagtgcaaggaatgttatgactgcagcgagaagttcaccaccttcagaagaagacaccactgccgcctgtgtggccagatcttctgcagccgctgctgcaaccaggagatccctgggaagttcatgggctacaccggggacctgcgggcctgcacctactgcaggaagatcgccctgtcctatgcccacagcacagacagcaacagcattggagaggacctgaatgccctgagtgacagcgcctgcagcgtgtctgtgctggaccccagcgagcccaggacccctgtgggcagcaggaaggccagcaggaacatcttcctggaggatgacctggcctggcagagcctcatccacccagacagcagcaacacccccctgagcacccggctggtgtctgtgcaggaggatgctgggaagagccctgccaggaacagaagtgccagcatcaccaacctgagcctggacaggagcggcagccccatggtgcccagctatgagacctctgtgagcccccaggccaacagaacctacgtgaggacagagaccacagaagatgagaggaagatcctgctggacagcgtgcagctgaaggacctgtggaagaagatctgccaccacagcagcggcatggagttccaggaccaccgctactggctgcggacccaccccaactgcatcgtgggcaaggagctggtgaactggctgatcagaaatggccacatcgccacccgggcccaggccatcgccatcggccaggccatggtggatggccgctggctggactgtgtgagccaccacgaccagctgttcagagatgaatatgccctgtaccggcccctgcagagcacagagttcagcgagacccccagcccagacagcgacagcgtgaacagcgtggagggccacagcgagcccagctggttcaaggacatcaagtttgatgacagcgacacagagcagattgctgaggagggagatgacaacctggccaacagcgccagccccagcaagaggacctctgtgagcagcttccagagcacagtggacagcgacagcgctgccagcatcagcctgaatgtggagctggacaacgtgaacttccacatcaagaagcccagcaagtacccccacgtgcccccccaccctgctgaccagaaggagtacctgatcagtgacaccggcggccagcagctgagcatcagtgatgccttcatcaaggagagcctcttcaacagaagagtggaggagaagagcaaggagctgcccttcacccccctgggctggcaccacaacaacctggagctgctgcgggaggagaatggagagaagcaggccatggagcggctgctgagcgccaaccacaaccacatgatggccctgctgcagcagctgctgcacagcgacagcctgagcagctcctggagggacatcatcgtgtccctggtgtgccaggtggtgcagacagtgcggccagatgtgaagaaccaggatgatgacatggacatccggcagtttgtgcacatcaagaagatccctgggggcaagaagtttgacagcgtggtggtgaatggatttgtgtgcaccaagaacatcgcccacaagaagatgagcagctgcatcaagaaccccaagatcctgctgctgaagtgcagcattgagtacctgtaccgggaggagaccaagttcacctgcatcgaccccatcgtgctgcaggagcgggagttcctgaagaactacgtgcagagaattgtggatgtgcggcccaccctggtgctggtggagaagacagtgtccagaattgcccaggacatgctgctggagcacggcatcaccctggtgatcaacgtgaagagccaggtgctggagcgcatcagcaggatgacccagggcgacctggtgatgtccatggaccagctgctgaccaagccccacctgggcacctgccacaagttctacatgcagatcttccagctgcccaatgagcagaccaagaccctgatgttctttgagggctgcccccagcacctgggctgcaccatcaagctgcggggcggcagtgactatgagctggcccgggtgaaggagatcctgatcttcatgatctgtgtggcctaccacagccagctggagatctccttcctgatggatgaatttgccatgccacccaccctgatgcagaaccccagcttccacagcctgattgagggccggggccacgagggcgctgtgcaggagcagtatggaggcggcagcatcccctgggaccctgacatccccccagagagcctgccctgtgatgacagcagcctgctggagctgcgcatcgtgtttgagaagggggagcaggagaacaagaacctgccccaggccgtggcctctgtgaagcaccaggagcacagcaccacagcctgcccagctggcctgccctgtgccttctttgcccctgtgcctgagagcctgctgcccctgcctgtggatgaccagcaggatgccctgggcagcgagcagcctgagaccctgcagcagacagtggtgctgcaggaccccaagagccagatccgggccttccgggaccccctgcaggatgacaccggcctgtatgtgacagaggaggtgaccagcagcgaggacaagaggaagacctacagcctggccttcaagcaggagctgaaggatgtgatcctgtgcatcagccctgtgatcaccttccgggagcccttcctgctgacagagaagggcatgcgctgcagcacccgggactactttgctgagcaggtgtactggagccccctgctgaacaaggagttcaaggagatggagaacagaaggaagaagcagctgctgcgggacctgagcggcctgcagggcatgaatggcagcatccaggccaagagcatccaggtgctgcccagccatgagctggtgtccaccagaattgctgagcacctgggggacagccagagcctgggccgcatgctggccgactaccgggcccggggcggccgcatccagcccaagaacagcgacccctttgcccacagcaaggatgccagcagcaccagcagcggccagagcggcagcaagaatgaaggagatgaggagcggggcctcatcctgagtgatgctgtgtggagcaccaaggtggactgcctgaaccccatcaaccaccagaggctgtgtgtgctcttcagcagcagcagcgcccagagcagcaatgcccccagcgcctgtgtgagcccctggatcgtgaccatggagttctacggcaagaatgacctgaccctgggcatcttcctggagcgctactgcttccggcccagctaccagtgccccagcatgttctgtgacacccccatggtgcaccacatcagaagatttgtgcacggccagggctgtgtgcagatcatcctgaaggagctggacagccctgtgcccggctaccagcacaccatcctgacctacagctggtgccgcatctgcaagcaggtgacccctgtggtggccctgagcaatgaatcctggagcatgagctttgccaagtacctggagctgcgcttctacggccaccagtacacccggcgggccaatgctgagccctgtggccacagcatccaccacgactaccaccagtacttctcctacaaccagatggtggccagcttctcctacagccccatccggctgctggaggtgtgtgtgcccctgcccaagatcttcatcaagaggcaggcccccctgaaggtgtccctgctgcaggacctgaaggacttcttccagaaggtgtcccaggtgtatgtggccattgatgagcggctggccagcctgaagacagacaccttcagcaagacccgggaggagaagatggaggacatctttgcccagaaggagatggaggagggggagttcaagaactggattgagaagatgcaggcccggctgatgagcagctctgtggacaccccccagcagctgcagagcgtgtttgagagcctgattgccaagaagcagagcctgtgtgaggtgctgcaggcctggaacaaccggctgcaggacctcttccagcaggagaagggcaggaagaggcccagcgtgccccccagccctggccgcctgcggcagggcgaggagagcaagatcagcgccatggatgccagccccaggaacatcagccctggcctgcagaatggagagaaggaggaccgcttcctgaccaccctgagcagccagagcagcaccagcagcacccacctgcagctgcccaccccacctgaggtgatgtctgagcagagcgtgggcggccccccagagctggacacagccagcagcagtgaagatgtgtttgatggccacctgctgggcagcacagacagccaggtgaaggagaagagcaccatgaaggccatctttgccaacctgctgcccggcaacagctacaaccccatccccttcccctttgatcctgacaagcactacctgatgtatgaacatgagcgggtgcccatcgctgtgtgtgagaaggagcccagcagcatcatcgcctttgccctgagctgcaaggagtacagaaatgccctggaggagctgagcaaggccacccagtggaacagcgctgaggagggcctgcccaccaacagcaccagtgacagccggcccaagagcagcagccccatccggctgcctgagatgtctgggggccagaccaacagaaccacagaaacagagccccagcccaccaagaaggccagcggcatgctgtccttcttccggggcacagctgggaagagcccagacctgagcagccagaagcgggagaccctgcggggagctgacagcgcctactaccaggtgggccagacaggcaaggagggcacagagaaccagggcgtggagccccaggatgaggtggatggaggagacacccagaagaagcagctgatcaacccccacgtggagctgcagttcagtgatgccaatgccaagttctactgccgcctgtactatgctggggagttccacaagatgagggaggtgatcctggacagcagcgaggaggacttcatccgcagcctgagccacagcagcccctggcaggcccggggcggcaagagcggggccgccttctacgccacagaagatgaccgcttcatcctgaagcagatgccccggctggaggtgcagagcttcctggactttgccccccactacttcaactacatcaccaatgctgtgcagcagaagaggcccacagccctggccaagatcctgggcgtgtacagaattggctacaagaacagccagaacaacacagagaagaagctggacctgctggtgatggagaacctcttctacggcaggaagatggcccaggtgtttgacctgaagggcagcctgaggaacagaaatgtgaagacagacaccgggaaggagagctgtgatgtggtgctgctggatgagaacctgctgaagatggtgcgggacaaccccctgtacatccgcagccacagcaaggctgtgctgcggaccagcatccacagcgacagccacttcctgagcagccacctgatcatcgactacagcctgctggtgggcagagatgacaccagcaatgagctggtggtgggcatcatcgactacatccgcaccttcacctgggacaagaagctggagatggtggtgaagagcacaggcatcctgggcggccagggcaagatgcccaccgtggtgtccccagagctgtaccgcacccgcttctgtgaggccatggacaagtacttcctgatggtgcctgaccactggacaggcctgggcctgaactgctag

SEQ ID NO: 164055 - DNA, 3051 bp, Artificial Sequence
  Description of Artificial Sequence: Synthetic coding sequence
atggagttccaggaccaccgctactggctgcggacccaccccaactgcatcgtgggcaaggagctggtgaactggctgatcagaaatggccacatcgccacccgggcccaggccatcgccatcggccaggccatggtggatggccgctggctggactgtgtgagccaccacgaccagctgttcagagatgaatatgccctgtaccggcccctgcagagcacagagttcagcgagacccccagcccagacagcgacagcgtgaacagcgtggagggccacagcgagcccagctggttcaaggacatcaagtttgatgacagcgacacagagcagattgctgaggagggagatgacaacctggccaagtacctgatcagtgacaccggcggccagcagctgagcatcagtgatgccttcatcaaggagagcctcttcaacagaagagtggaggagaagagcaaggagctgcccttcacccccctgggctggcaccacaacaacctggagctgctgcgggaggagaatggagagaagcaggccatggagcggctgctgagcgccaaccacaaccacatgatggccctgctgcagcagctgctgcacagcgacagcctgagcagctcctggagggacatcatcgtgtccctggtgtgccaggtggtgcagacagtgcggccagatgtgaagaaccaggatgatgacatggacatccggcagtttgtgcacatcaagaagatccctgggggcaagaagtttgacagcgtggtggtgaatggatttgtgtgcaccaagaacatcgcccacaagaagatgagcagctgcatcaagaaccccaagatcctgctgctgaagtgcagcattgagtacctgtaccgggaggagaccaagttcacctgcatcgaccccatcgtgctgcaggagcgggagttcctgaagaactacgtgcagagaattgtggatgtgcggcccaccctggtgctggtggagaagacagtgtccagaattgcccaggacatgctgctggagcacggcatcaccctggtgatcaacgtgaagagccaggtgctggagcgcatcagcaggatgacccagggcgacctggtgatgtccatggaccagctgctgaccaagccccacctgggcacctgccacaagttctacatgcagatcttccagctgcccaatgagcagaccaagaccctgatgttctttgagggctgcccccagcacctgggctgcaccatcaagctgcggggcggcagtgactatgagctggcccgggtgaaggagatcctgatcttcatgatctgtgtggcctaccacagccagctggagatctccttcctgatggatgaatttgccatgccacccaccctgatgcagaaccccagcttccacagcctgattgagggccggggccacgagggcgctgtgcaggagcagtatggaggcggcagcatcccctgggaccctgacatccccccagagagcctgccctgtgatgacagcagcctgctggagctgcgcatcgtgtttgagaagggggagcaggagaacaagaacctgccccaggccgtggcctctgtgaagcaccaggagcacagcaccacagcctgcccagctggcctgccctgtgccttctttgcccctgtgcctgagagcctgctgcccctgcctgtggatgaccagcaggatgccctgggcagcgagcagcctgagaccctgcagcagacagtggtgctgcaggaccccaagagccagatccgggccttccgggaccccctgcaggatgacaccggcctgtatgtgacagaggaggtgaccagcagcgaggacaagaggaagacctacagcctggccttcaagcaggagctgaaggatgtgatcctgtgcatcagccctgtgatcaccttccgggagcccttcctgctgacagagaagggcatgcgctgcagcacccgggactactttgctgagcaggtgtactggagccccctgctgaacaaggagttcaaggagatggagaacagaaggaagaagcagctgctgcgggacctgagcggcctgcagggcatgaatggcagcatccaggccaagagcatccaggtgctgcccagccatgagctggtgtccaccagaattgctgagcacctgggggacagccagagcctgggccgcatgctggccgactaccgggcccggggcggccgcatccagcccaagaacagcgacccctttgcccacagcaaggatgccagcagcaccagcagcggccagagcggcagcaagaatgaaggagatgaggagcggggcctcatcctgagtgatgctgtgtggagcaccaaggtggactgcctgaaccccatcaaccaccagaggctgtgtgtgctcttcagcagcagcagcgcccagagcagcaatgcccccagcgcctgtgtgagcccctggatcgtgaccatggagttctacggcaagaatgacctgaccctgggcatcttcctggagcgctactgcttccggcccagctaccagtgccccagcatgttctgtgacacccccatggtgcaccacatcagaagatttgtgcacggccagggctgtgtgcagatcatcctgaaggagctggacagccctgtgcccggctaccagcacaccatcctgacctacagctggtgccgcatctgcaagcaggtgacccctgtggtggccctgagcaatgaatcctggagcatgagctttgccaagtacctggagctgcgcttctacggccaccagtacacccggcgggccaatgctgagccctgtggccacagcatccaccacgactaccaccagtacttctcctacaaccagatggtggccagcttctcctacagccccatccggctgctggaggtgtgtgtgcccctgcccaagatcttcatcaagaggcaggcccccctgaaggtgtccctgctgcaggacctgaaggacttcttccagaaggtgtcccaggtgtatgtggccattgatgagcggctggccagcctgaagacagacaccttctcctag

SEQ ID NO: 164056 - DNA, 522 bp, Artificial Sequence
  Description of Artificial Sequence: Synthetic coding sequence
atgaggccctggagcagccctgcccagctggtggccggggcccagcctgctggccgcggggaccccctgggcccccggcccatccccccaccccgcttccggcgggccagcagccagcgggagcccccctaccccaggcctgctgagcccgccctggagctggccggcagcaagtgccagcctgacaccccagctgccagcctgtgcccagctgacagccccagccagcaccgggtgatgcctcctggccctgcctcctgggccaacgtgggcagccggccccacacagtggccaatggacatgagctgtttgaggtgtctgaggagagagatgaggaggtggccgccttctgccacatgctggacatcctgcggagcggcagtgacatccaggactacttcctgaccggctacgtgtggagcgctgtgacccccagccctgagcacctgggagatgaggtgaacctgaaggtgacagtgctgtgtgaccggctgcaggaggccctgaccttcacctgctag

SEQ ID NO: 164057 - DNA, 4905 bp, Artificial Sequence
  Description of Artificial Sequence: Synthetic coding sequence
atgagcagcacccagggcaatggagagcactggaagagcctggagagcgtgggcatcagcaggaaggagctggccatggccgaggccctgcagatggagtatgatgccctgagccggctgcggcatgacaaggaggagaacagagccaagcagaatgctgaccccagcctcatctcctgggatgagcccggggtggacttctacagcaagccagctggccgcaggacagacctgaagctgctgcggggcctgagcggcagtgaccccaccctgaactacaacagcctgagcccccaggagggcccccccaaccacagcaccagccagggcccccagcccggcagtgacccctggcccaagggcagcctgagcggggactacctgtacatctttgatggcagtgatggaggagtgagcagcagccctggccctggggacatcgagggcagctgcaagaagctgagccccccacccctgcccccccgggccagcatctgggacaccccacccctgccccccaggaagggcagccccagcagcagcaagatcagccagcccagcgacatcaacaccttcagcctggtggagcagctgcccgggaagctgctggagcaccgcatcctggaggaggaggaggtgctgggcggcggcggccagggccgcctgctgggctctgtggactatgatggcatcaatgatgccatcacccggctgaacctgaagagcacctatgatgctgagatgctgagagatgccacccggggctggaaggagggccggggccccctggacttcagcaaggacaccagcggcaagcctgtggcccggagcaagaccatgccaccccaggtgccccccaggacctacgccagccgctatggcaacaggaagaatgccaccccaggcaagaacagacgcatctctgctgcccctgtgggcagccggccccacacagtggccaatggacatgagctgtttgaggtgtctgaggagagagatgaggaggtggccgccttctgccacatgctggacatcctgcggagcggcagtgacatccaggactacttcctgaccggctacgtgtggagcgctgtgacccccagccctgagcacctgggagatgaggtgaacctgaaggtgacagtgctgtgtgaccggctgcaggaggccctgaccttcacctgcaactgcagcagcacagtggacctgctgatctaccagaccctgtgctacacccatgatgacctgagaaatgtggatgtgggggactttgtgctgaagccctgtggcctggaggagttcctgcagaacaagcacgccctgggcagccatgagtacatccagtactgcaggaagtttgatattgacatccggctgcagctgatggagcagaaggtggtgcggagtgacctggccaggacagtgaatgatgaccagagccccagcaccctgaactacctggtgcacctgcaggagaggcctgtgaagcagaccatcagccggcaggccctgagcctgctgtttgacacctaccacaatgaggtggatgccttcctgctggctgatggagacttccccctgaaggctgacagagtggtgcagagcgtgaaggccatctgcaatgccctggccgctgtggagaccccagagatcaccagcgccctgaaccagctgcccccctgccccagcaggatgcagcccaagatccagaaggaccccagcgtgctggccgtgcgggagaaccgggagaaggtggtggaggccctgacagctgccatcctggacctggtggagctgtactgcaacaccttcaatgctgacttccagacagctgtgcccggcagcaggaagcatgacctggtgcaggaggcctgccactttgcccggagcctggccttcaccgtgtatgccacccaccgcatccccatcatctgggccaccagctatgaggacttctacctgagctgcagcctgagccacggcggcaaggagctgtgcagccccctgcagacccggcgggcccacttcagcaagtacctgttccacctgattgtgtgggaccagcagatctgcttccctgtgcaggtgaaccggctgccccgggagaccctgctgtgtgccaccctgtatgccctgcccatccccccacctggcagcagcagcgaggccaacaagcagaggagagtgcctgaggccctgggctgggtgaccacccccctcttcaacttccggcaggtgctgacctgtggcaggaagctgctgggcctgtggccagccacccaggagaaccccagcgcccgctggagcgcccccaacttccaccagcctgacagcgtcatcctgcagattgacttccccaccagcgcctttgacatcaagttcaccagccccccaggggacaagttcagccccaggtatgaatttggcagcctgcgggaggaggaccagaggaagctgaaggacatcatgcagaaggagagcctgtactggctgacagatgctgacaagaagaggctgtgggagaagcgctactactgccacagcgaggtgagcagcctgcccctggtgctggccagcgcccccagctgggagtgggcctgcctgcctgacatctacgtgctgctgaagcagtggacccacatgaaccaccaggatgccctgggcctgctgcacgccaccttcccagaccaggaggtgcggaggatggctgtgcagtggattggcagcctgagtgatgctgagctgctggactacctgccccagctggtgcaggccctgaagtatgagtgctacctggacagccccctggtgcgcttcctgctgaagagagctgtgtctgacctgcgggtgacccactacttcttctggctgctgaaggatggcctgaaggacagccagttcagcatccgctaccagtacctgctggccgccctgctgtgctgctgcggcaagggcctgcgggaggagttcaaccggcagtgctggctggtgaatgccctggccaagctggcccagcaggtgcgggaggccgcccccagcgcccggcagggcatcctgaggacaggcctggaggaggtgaagcagttctttgccctgaatggcagctgccgcctgcccctgagccccagcctgctggtgaagggcatcgtgccccgggactgcagctacttcaacagcaatgctgtgcccctgaagctgtccttccagaatgtggaccccctgggggagaacatccgggtcatcttcaagtgtggagatgacctgcggcaggacatgctgaccctgcagatgatccgcatcatgagcaagatctgggtgcaggagggcctggacatgaggatggtgatcttccgctgcttcagcacaggccggggccggggcatggtggagatgatccccaatgctgagaccctgaggaagatccaggtggagcacggcgtgacaggcagcttcaaggaccggcccctggccgactggctgcagaagcacaaccctggagaagatgaatatgagaaggctgtggagaacttcatctacagctgtgccggctgctgcgtggccacctacgtgctgggcatctgtgacagacacaatgacaacatcatgctgaagaccaccggccacatgttccacatcgactttggccgcttcctgggccacgcccagatgtttggaaacatcaagagggaccgggccccctttgtgttcaccagtgacatggcctacgtgatcaatggaggagacaagcccagcagccgcttccatgactttgtggacctgtgctgccaggcctacaacctgatcaggaagcacacccacctgttcctgaacctgctgggcctgatgctgagctgtggcatccctgagctgagtgacctggaggacctgaagtatgtgtatgatgccctgcggccccaggacacagaggccaatgccaccacctacttcaccaggctcatcgagagcagcctgggctctgtggccaccaagctgaacttcttcatccacaacctggcccagatgaagttcaccggcagtgatgaccggctgaccctgagctttgccagcaggacccacaccctgaagagcagcggccgcatcagtgatgtgttcctgtgcagacatgagaagatcttccaccccaacaagggctacatctacgtggtgaaggtgatgagggagaacacccatgaggccacctacatccagaggacctttgaggagttccaggagctgcacaacaagctgcggctgctcttccccagcagccacctgcccagcttccccagccgcttcgtcatcggccgcagcagaggagaggccgtggccgagcggcggcgggaggagctgaatggctacatctggcacctgattcatgcccctcctgaggtggccgagtgtgacctggtgtacaccttcttccaccccctgcccagagatgagaaggccatgggcaccagccctgcccccaagagcagtgatggcacctgggcccggcctgtgggcaaggtgggcggggaggtgaagctgagcatctcctacaagaacaacaagctgttcatcatggtgatgcacatccggggcctgcagctgctgcaggatggaaatgaccctgacccctacgtgaagatctacctgctgcctgacccccagaagaccaccaagaggaagaccaaggtggccaggaagacctgcaaccccacctacaatgagatgctggtgtatgatggcatccccaagggggacctgcagcagcgggagctgcagctgtctgtgctgtctgagcagggcttctgggagaatgtgctgctgggggaggtgaacatccggctgcgggagctggacctggcccaggagaagacaggctggtttgccctgggcagccgcagccacggcaccctgtag

SEQ ID NO: 164058 - DNA, 360 bp, Artificial Sequence
  Description of Artificial Sequence: Synthetic coding sequence
atgtttggaaacatcaagagggaccgggccccctttgtgttcaccagtgacatggcctacgtgatcaatggaggagacaagcccagcagccgcttccatgactttgtggacctgtgctgccaggcctacaacctgatcaggaagcacacccacctgttcctgaacctgctgggcctgatgctgagctgtggcatccctgagctgagtgacctggaggacctgaagtatgtgtatgatgccctgcggccccaggacacagaggccaatgccaccacctacttcaccagggtcatcctggcctctgtggtgggcggccgggagagcaagacctgcagcgctgtgagcagcagcggggactag

SEQ ID NO: 164059 - DNA, 396 bp, Artificial Sequence
  Description of Artificial Sequence: Synthetic coding sequence
atgagcagcacccagggcaatggagagcactggaagagcctggagagcgtgggcatcagcaggaaggagctggccatggccgaggccctgcagatggagtatgatgccctgagccggctgcggcatgacaaggaggagaacagagccaagcagaatgctgaccccagcctcatctcctgggatgagcccggggtggacttctacagcaagccagctggccgcaggacagacctgaagctgctgcggggcctgagcggcagtgaccccaccctgaactacaacagcctgagcccccaggagggcccccccaaccacagcaccagccagggcccccagcccggcagtgacccctggcccaagggcagcctgagcggggactacctgtacatcttctag

SEQ ID NO: 164060 - DNA, 4821 bp, Artificial Sequence
  Description of Artificial Sequence: Synthetic coding sequence
atgagcagcacccagggcaatggagagcactggaagagcctggagagcgtgggcatcagcaggaaggagctggccatggccgaggccctgcagatggagtatgatgccctgagccggctgcggcatgacaaggaggagaacagagccaagcagaatgctgaccccagcctcatctcctgggatgagcccggggtggacttctacagcaagccagctggccgcaggacagacctgaagctgctgcggggcctgagcggcagtgaccccaccctgaactacaacagcctgagcccccaggagggcccccccaaccacagcaccagccagggcccccagcccggcagtgacccctggcccaagggcagcctgagcggggactacctgtacatctttgatggcagtgatggaggagtgagcagcagccctggccctggggacatcgagggcagctgcaagaagctgagccccccacccctgcccccccgggccagcatctgggacaccccacccctgccccccaggaagggcagccccagcagcagcaagatcagccagcccagcgacatcaacaccttcagcctggtggagcagctgcccgggaagctgctggagcaccgcatcctggaggaggaggaggtgctgggcggcggcggccagggccgcctgctgggctctgtggactatgatggcatcaatgatgccatcacccggctgaacctgaagagcacctatgatgctgagatgctgagagatgccacccggggctggaaggagggccggggccccctggacttcagcaaggacaccagcggcaagcctgtggcccggagcaagaccatgccaccccaggtgccccccaggacctacgccagccgctatggcaacaggaagaatgccaccccaggcaagaacagacgcatctctgctgcccctgtgggcagccggccccacacagtggccaatggacatgagctgtttgaggtgtctgaggagagagatgaggaggtggccgccttctgccacatgctggacatcctgcggagcggcagtgacatccaggactacttcctgaccggctacgtgtggagcgctgtgacccccagccctgagcacctgggagatgaggtgaacctgaaggtgacagtgctgtgtgaccggctgcaggaggccctgaccttcacctgcaactgcagcagcacagtggacctgctgatctaccagaccctgtgctacacccatgatgacctgagaaatgtggatgtgggggactttgtgctgaagccctgtggcctggaggagttcctgcagaacaagcacgccctgggcagccatgagtacatccagtactgcaggaagtttgatattgacatccggctgcagctgatggagcagaaggtggtgcggagtgacctggccaggacagtgaatgatgaccagagccccagcaccctgaactacctggtgcacctgcaggagaggcctgtgaagcagaccatcagccggcaggccctgagcctgctgtttgacacctaccacaatgaggtggatgccttcctgctggctgatggagacttccccctgaaggctgacagagtggtgcagagcgtgaaggccatctgcaatgccctggccgctgtggagaccccagagatcaccagcgccctgaaccagctgcccccctgccccagcaggatgcagcccaagatccagaaggaccccagcgtgctggccgtgcgggagaaccgggagaaggtggtggaggccctgacagctgccatcctggacctggtggagctgtactgcaacaccttcaatgctgacttccagacagctgtgcccggcagcaggaagcatgacctggtgcaggaggcctgccactttgcccggagcctggccttcaccgtgtatgccacccaccgcatccccatcatctgggccaccagctatgaggacttctacctgagctgcagcctgagccacggcggcaaggagctgtgcagccccctgcagacccggcgggcccacttcagcaagtacctgttccacctgattgtgtgggaccagcagatctgcttccctgtgcaggtgaaccggctgccccgggagaccctgctgtgtgccaccctgtatgccctgcccatccccccacctggcagcagcagcgaggccaacaagcagaggagagtgcctgaggccctgggctgggtgaccacccccctcttcaacttccggcaggtgctgacctgtggcaggaagctgctgggcctgtggccagccacccaggagaaccccagcgcccgctggagcgcccccaacttccaccagcctgacagcgtcatcctgcagattgacttccccaccagcgcctttgacatcaagttcaccagccccccaggggacaagttcagccccaggtatgaatttggcagcctgcgggaggaggaccagaggaagctgaaggacatcatgcagaaggagagcctgtactggctgacagatgctgacaagaagaggctgtgggagaagcgctactactgccacagcgagtggacccacatgaaccaccaggatgccctgggcctgctgcacgccaccttcccagaccaggaggtgcggaggatggctgtgcagtggattggcagcctgagtgatgctgagctgctggactacctgccccagctggtgcaggccctgaagtatgagtgctacctggacagccccctggtgcgcttcctgctgaagagagctgtgtctgacctgcgggtgacccactacttcttctggctgctgaaggatggcctgaaggacagccagttcagcatccgctaccagtacctgctggccgccctgctgtgctgctgcggcaagggcctgcgggaggagttcaaccggcagtgctggctggtgaatgccctggccaagctggcccagcaggtgcgggaggccgcccccagcgcccggcagggcatcctgaggacaggcctggaggaggtgaagcagttctttgccctgaatggcagctgccgcctgcccctgagccccagcctgctggtgaagggcatcgtgccccgggactgcagctacttcaacagcaatgctgtgcccctgaagctgtccttccagaatgtggaccccctgggggagaacatccgggtcatcttcaagtgtggagatgacctgcggcaggacatgctgaccctgcagatgatccgcatcatgagcaagatctgggtgcaggagggcctggacatgaggatggtgatcttccgctgcttcagcacaggccggggccggggcatggtggagatgatccccaatgctgagaccctgaggaagatccaggtggagcacggcgtgacaggcagcttcaaggaccggcccctggccgactggctgcagaagcacaaccctggagaagatgaatatgagaaggctgtggagaacttcatctacagctgtgccggctgctgcgtggccacctacgtgctgggcatctgtgacagacacaatgacaacatcatgctgaagaccaccggccacatgttccacatcgactttggccgcttcctgggccacgcccagatgtttggaaacatcaagagggaccgggccccctttgtgttcaccagtgacatggcctacgtgatcaatggaggagacaagcccagcagccgcttccatgactttgtggacctgtgctgccaggcctacaacctgatcaggaagcacacccacctgttcctgaacctgctgggcctgatgctgagctgtggcatccctgagctgagtgacctggaggacctgaagtatgtgtatgatgccctgcggccccaggacacagaggccaatgccaccacctacttcaccaggctcatcgagagcagcctgggctctgtggccaccaagctgaacttcttcatccacaacctggcccagatgaagttcaccggcagtgatgaccggctgaccctgagctttgccagcaggacccacaccctgaagagcagcggccgcatcagtgatgtgttcctgtgcagacatgagaagatcttccaccccaacaagggctacatctacgtggtgaaggtgatgagggagaacacccatgaggccacctacatccagaggacctttgaggagttccaggagctgcacaacaagctgcggctgctcttccccagcagccacctgcccagcttccccagccgcttcgtcatcggccgcagcagaggagaggccgtggccgagcggcggcgggaggagctgaatggctacatctggcacctgattcatgcccctcctgaggtggccgagtgtgacctggtgtacaccttcttccaccccctgcccagagatgagaaggccatgggcaccagccctgcccccaagagcagtgatggcacctgggcccggcctgtgggcaaggtgggcggggaggtgaagctgagcatctcctacaagaacaacaagctgttcatcatggtgatgcacatccggggcctgcagctgctgcaggatggaaatgaccctgacccctacgtgaagatctacctgctgcctgacccccagaagaccaccaagaggaagaccaaggtggccaggaagacctgcaaccccacctacaatgagatgctggtgtatgatggcatccccaagggggacctgcagcagcgggagctgcagctgtctgtgctgtctgagcagggcttctgggagaatgtgctgctgggggaggtgaacatccggctgcgggagctggacctggcccaggagaagacaggctggtttgccctgggcagccgcagccacggcaccctgtag

SEQ ID NO: 164061 - DNA, 183 bp, Artificial Sequence
  Description of Artificial Sequence: Synthetic coding sequence
atgagcagcacccagggcaatggagagcactggaagagcctggagagcgtgggcatcagcaggaaggagctggccatggccgaggccctgcagatggagtatgatgccctgagccggctgcggcatgacaaggaggagaacagagccaagcagaatgctgaccccagcctcatctcctggtag

SEQ ID NO: 164062 - DNA, 522 bp, Artificial Sequence; identical to SEQ ID NO: 164056
  Description of Artificial Sequence: Synthetic coding sequence

SEQ ID NO: 164063 - DNA, 4338 bp, Artificial Sequence
  Description of Artificial Sequence: Synthetic coding sequence
atggcctacagctggcagacagaccccaaccccaatgaaagccatgagaagcagtatgagcaccaggagttcctgtttgtgaaccagccccacagcagcagccaggtgtccctgggctttgaccagatcgtggatgagatcagcggcaagatcccccactatgagagcgagattgatgagaacaccttctttgtgcccacagcccccaagtgggacagcacaggccacagcctgaatgaggcccaccagatcagcctgaatgagttcaccagcaagagccgggagctgtcctggcaccaggtgtccaaggccccagccatcggcttcagccccagcgtgctgcccaagccccagaacaccaacaaggaatgttcctggggcagccccatcggcaagcaccacggggctgatgacagccgcttcagcatcctggcccccagcttcaccagcctggacaagatcaacctggagaaggagctggagaatgaaaaccacaactaccacatcggctttgagagcagcatcccccccaccaacagcagcttcagcagtgacttcatgcccaaggaggagaacaagaggagcggccacgtgaacatcgtggagcccagcctgatgctgctgaagggcagcctgcagcccggcatgtgggagagcacctggcagaagaacatcgagagcatcggctgcagcatccagctggtggaggtgccccagagcagcaacaccagcctggccagcttctgcaacaaggtgaagaagatccgggagcgctaccacgccgcagatgtgaacttcaacagcggcaagatctggagcaccaccacagccttcccctaccagctgttcagcaagaccaagttcaacatccacatcttcatcgacaacagcacccagcccctgcacttcatgccctgtgccaactacctggtgaaggacctgattgctgagatcctgcacttctgcaccaatgaccagctgctgcccaaggaccacatcctgtctgtgtgtggcagcgaggagttcctgcagaatgaccactgcctgggcagccacaagatgttccagaaggacaagagcgtcatccagctgcacctgcagaagagccgggaggcccctgggaagctgagcaggaagcatgaggaggaccacagccagttctacctgaaccagctgctggagttcatgcacatctggaaggtgtcccggcagtgcctgctgaccctcatcagaaaatatgacttccacctgaagtacctgctgaagacccaggagaatgtgtacaacatcatcgaggaggtgaagaagatctgcagcgtgctgggctgtgtggagaccaagcagatcacagatgctgtgaatgagctgagcctcatcctgcagaggaaaggagagaacttctaccagagcagcgagaccagcgccaagggcctgattgagaaggtgaccacagagctgagcaccagcatctaccagctgatcaacgtgtactgcaacagcttctatgctgacttccagcctgtgaatgtgccccgctgcaccagctacctgaaccctggcctgcccagccacctgtccttcaccgtgtatgctgcccacaacatccctgagacctgggtgcaccgcatcaacttccccctggagatcaagagcctgccccgggagagcatgctgactgtgaagctgtttggaattgcctgtgccaccaacaatgccaacctgctggcctggacctgcctgcccctcttccccaaggagaagagcatcctgggctccatgctgttctccatgaccctgcagagcgagccccctgtggagatgatcaccccaggagtgtgggatgtgtcccagcccagccctgtgaccctgcagattgacttccctgccaccggctgggagtacatgaagccagattctgaagaaaatagaagcaacctggaggagcccctgaaggagtgcatcaagcacatcgcccggctgagccagaagcagacccccctgctgctgtctgaggagaagaagcgctacctgtggttctaccgcttctactgcaacaatgaaaactgcagcctgcccctggtgctgggcagcgcccctggctgggatgagaggacagtgtctgagatgcacaccatcctgcggcgctggaccttcagccagcccctggaggccctgggcctgctgaccagcagcttcccagaccaggagatcaggaaggtggccgtgcagcagctggacaacctgctgaatgatgagctgctggagtacctgccccagctggtgcaggccgtgaagtttgagtggaacctggagagccccctggtgcagctgctgctgcacaggagcctgcagagcatccaggtggcccaccggctgtactggctgctgaagaatgcagaaaatgaggcctacttcaagtcctggtaccagaagctgctggccgccctgcagttctgtgccggcaaggccctgaatgatgagttcagcaaggagcagaagctgatcaagatcctgggggacattggagagcgggtgaagagcgccagtgaccaccagaggcaggaggtgctgaagaaggagatcggccgcctggaggagttcttccaggatgtgaacacctgccacctgcccctgaacccagccctgtgcatcaagggcatcgaccatgatgcctgcagctacttcaccagcaatgccctgcccctgaagatcaccttcatcaatgccaaccccatgggcaagaacatcagcatcatcttcaaggctggagatgacctgcggcaggacatgctggtgctgcagctgatccaggtgatggacaacatctggctgcaggagggcctggacatgcagatgatcatctaccgctgcctgagcacaggcaaggaccagggcctggtgcagatggtgcctgatgctgtgaccctggccaagatccaccgccacagcggcctcatcggccccctgaaggagaacaccatcaagaagtggttcagccagcacaaccacctgaaggctgactatgagaaggccctgaggaacttcttctacagctgtgccggctggtgtgtggtgaccttcatcctgggcgtgtgtgacagacacaatgacaacatcatgctgaccaagagcggccacatgttccacatcgactttgggaagttcctgggccacgcccagaccttcggcggcatcaagagggaccgggcccccttcatcttcaccagcgagatggagtacttcatcacagaaggaggcaagaacccccagcacttccaggactttgtggagctgtgctgccgggcctacaacatcatcaggaagcacagccagctgctgctgaacctgctggagatgatgctgtatgccggcctgcctgagctgagcggcatccaggacctgaagtatgtgtacaacaacctgcggccccaggacacagacctggaggccaccagccacttcaccaagaagatcaaggagagcctggagtgcttccctgtgaagctgaacaacctgatccacaccctggcccagatgtctgccatcagccctgccaagagcaccagccagaccttcccccaggagagctgcctgctgagcaccaccaggagcattgagcgggccaccatcctgggcttcagcaagaagagcagcaacctgtacctgatccaggtgacccacagcaacaatgagaccagcctgacagagaagagctttgagcagttcagcaagctgcacagccagctgcagaagcagtttgccagcctgaccctgcctgagttcccccactggtggcacctgcccttcaccaacagcgaccaccggcgcttccgggacctgaaccactacatggagcagatcctgaatgtgtcccatgaggtgaccaacagcgactgtgtgctgtccttcttcctgtctgaggccgtgcagcagacagtggaggagagcagccctgtgtacctgggggagaagttcccagacaagaagcccaaggtgcagctggtgatctcctatgaagatgtgaagctgaccatcctggtgaagcacatgaagaacatccacctgcctgatggcagcgcccccagcgcccacgtggagttctacctgctgccctaccccagcgaggtgagaagaaggaagaccaagtctgtgcccaagtgcacagaccccacctacaatgaaattgtggtgtatgatgaggtgacagagctgcagggccacgtgctgatgctgattgtgaagagcaagacagtgtttgtgggcgccatcaacatccggctgtgcagcgtgcccctggacaaggagaagtggtaccccctgggcaacagcatcatctag

SEQ ID NO: 164064 - DNA, 4338 bp, Artificial Sequence; identical to SEQ ID NO: 164063
  Description of Artificial Sequence: Synthetic coding sequence

SEQ ID NO: 164065 - DNA, 4461 bp, Artificial Sequence
  Description of Artificial Sequence: Synthetic coding sequence
atggcctacagctggcagacagaccccaaccccaatgaaagccatgagaagcagtatgagcaccaggagttcctgtttgtgaaccagccccacagcagcagccaggtgtccctgggctttgaccagatcgtggatgagatcagcggcaagatcccccactatgagagcgagattgatgagaacaccttctttgtgcccacagcccccaagtgggacagcacaggccacagcctgaatgaggcccaccagatcagcctgaatgagttcaccagcaagagccgggagctgtcctggcaccaggtgtccaaggccccagccatcggcttcagccccagcgtgctgcccaagccccagaacaccaacaaggaatgttcctggggcagccccatcggcaagcaccacggggctgatgacagccgcttcagcatcctggcccccagcttcaccagcctggacaagatcaacctggagaaggagctggagaatgaaaaccacaactaccacatcggctttgagagcagcatcccccccaccaacagcagcttcagcagtgacttcatgcccaaggaggagaacaagaggagcggccacgtgaacatcgtggagcccagcctgatgctgctgaagggcagcctgcagcccggcatgtgggagagcacctggcagaagaacatcgagagcatcggctgcagcatccagctggtggaggtgccccagagcagcaacaccagcctggccagcttctgcaacaaggtgaagaagatccgggagcgctaccacgccgcagatgtgaacttcaacagcggcaagatctggagcaccaccacagccttcccctaccagctgttcagcaagaccaagttcaacatccacatcttcatcgacaacagcacccagcccctgcacttcatgccctgtgccaactacctggtgaaggacctgattgctgagatcctgcacttctgcaccaatgaccagctgctgcccaaggaccacatcctgtctgtgtgtggcagcgaggagttcctgcagaatgaccactgcctgggcagccacaagatgttccagaaggacaagagcgtcatccagctgcacctgcagaagagccgggaggcccctgggaagctgagcaggaagcatgaggaggaccacagccagttctacctgaaccagctgctggagttcatgcacatctggaaggtgtcccggcagtgcctgctgaccctcatcagaaaatatgacttccacctgaagtacctgctgaagacccaggagaatgtgtacaacatcatcgaggaggtgaagaagatctgcagcgtgctgggctgtgtggagaccaagcagatcacagatgctgtgaatgagctgagcctcatcctgcagaggaaaggagagaacttctaccagagcagcgagaccagcgccaagggcctgattgagaaggtgaccacagagctgagcaccagcatctaccagctgatcaacgtgtactgcaacagcttctatgctgacttccagcctgtgaatgtgccccgctgcaccagctacctgaaccctggcctgcccagccacctgtccttcaccgtgtatgctgcccacaacatccctgagacctgggtgcacagctacaaggccttctccttcacctgctggctgacctacgccggcaagaagctgtgccaggtgaggaactacagaaacatcccagacaagaagctgttcttcttcctggtgaactggaatgagaccatcaacttccccctggagatcaagagcctgccccgggagagcatgctgactgtgaagctgtttggcatcgcctgtgccaccaacaatgccaacctgctggcctggacctgcctgcccctcttccccaaggagaagagcatcctgggctccatgctgttctccatgaccctgcagagcgagccccctgtggagatgatcaccccaggagtgtgggatgtgtcccagcccagccctgtgaccctgcagattgacttccctgccaccggctgggagtacatgaagccagacagcgaggagaacagaagcaacctggaggagcccctgaaggagtgcatcaagcacatcgcccggctgagccagaagcagacccccctgctgctgtctgaggagaagaagcgctacctgtggttctaccgcttctactgcaacaatgaaaactgcagcctgcccctggtgctgggcagcgcccctggctgggatgagaggacagtgtctgagatgcacaccatcctgcggcgctggaccttcagccagcccctggaggccctgggcctgctgaccagcagcttcccagaccaggagatcaggaaggtggccgtgcagcagctggacaacctgctgaatgatgagctgctggagtacctgccccagctggtgcaggccgtgaagtttgagtggaacctggagagccccctggtgcagctgctgctgcacaggagcctgcagagcatccaggtggcccaccggctgtactggctgctgaagaatgcagaaaatgaggcctacttcaagtcctggtaccagaagctgctggccgccctgcagttctgtgccggcaaggccctgaatgatgagttcagcaaggagcagaagctgatcaagatcctgggggacatcggggagcgggtgaagagcgccagtgaccaccagaggcaggaggtgctgaagaaggagatcggccgcctggaggagttcttccaggatgtgaacacctgccacctgcccctgaacccagccctgtgcatcaagggcatcgaccatgatgcctgcagctacttcaccagcaatgccctgcccctgaagatcaccttcatcaatgccaaccccatgggcaagaacatcagcatcatcttcaaggctggagatgacctgcggcaggacatgctggtgctgcagctgatccaggtgatggacaacatctggctgcaggagggcctggacatgcagatgatcatctaccgctgcctgagcacaggcaaggaccagggcctggtgcagatggtgcctgatgctgtgaccctggccaagatccaccgccacagcggcctgattggccccctgaaggagaacaccatcaagaagtggttcagccagcacaaccacctgaaggctgactatgagaaggccctgaggaacttcttctacagctgtgccggctggtgtgtggtgaccttcatcctgggcgtgtgtgacagacacaatgacaacatcatgctgaccaagagcggccacatgttccacatcgactttgggaagttcctgggccacgcccagacctttggaggcatcaagagggaccgggcccccttcatcttcaccagcgagatggagtacttcatcacagagggcggcaagaacccccagcacttccaggactttgtggagctgtgctgccgggcctacaacatcatcaggaagcacagccagctgctgctgaacctgctggagatgatgctgtatgccggcctgcctgagctgagcggcatccaggacctgaagtatgtgtacaacaacctgcggccccaggacacagacctggaggccaccagccacttcaccaagaagatcaaggagagcctggagtgcttccctgtgaagctgaacaacctgatccacaccctggcccagatgtctgccatcagccctgccaagagcaccagccagaccttcccccaggagagctgcctgctgagcaccaccaggagcattgaaagagccaccatcctgggcttcagcaagaagagcagcaacctgtacctgatccaggtgacccacagcaacaatgagaccagcctgacagagaagagctttgagcagttcagcaagctgcacagccagctgcagaagcagtttgccagcctgaccctgcctgagttcccccactggtggcacctgcccttcaccaacagcgaccaccggcgcttccgggacctgaaccactacatggagcagatcctgaatgtgtcccatgaggtgaccaacagcgactgtgtgctgtccttcttcctgtctgaggccgtgcagcagacagtggaggagagcagccctgtgtacctgggggagaagttcccagacaagaagcccaaggtgcagctggtgatctcctatgaagatgtgaagctgaccatcctggtgaagcacatgaagaacatccacctgcctgatggcagcgcccccagcgcccacgtggagttctacctgctgccctaccccagcgaggtgagaagaaggaagaccaagtctgtgcccaagtgcacagaccccacctacaatgagatcgtggtgtatgatgaggtgacagagctgcagggccacgtgctgatgctgattgtgaagagcaagacagtgtttgtgggcgccatcaacatccggctgtgcagcgtgcccctggacaaggagaagtggtaccccctgggcaacagcatcatctag

SEQ ID NO: 164066 - DNA, 414 bp, Artificial Sequence
  Description of Artificial Sequence: Synthetic coding sequence
atgaccatggagaccctgcccaaggtgctggaggtggatgagaagagccctgaggccaaggacctgctgcccagccagacagccagcagcctgtgcatcagcagccgctctgagagcgtgtggaccaccacccccaggagcaactgggagatctacaggaagcccatcgtcatcatgtctgtgggcggggccatcctgctgtttggagtggtgatcacctgcctggcctacaccctgaagctgagtgacaagagcctgagcatcctgaagatggtgggccctggcttcctgagcctgggcctgatgatgctggtgtgtggcctggtgtgggtgcccatcatcaagaagaagcagaagcaccggcagaagagcaacttcctgcggagcctgaagagcttcttcctgaccaggtag

SEQ ID NO: 164067 - DNA, 414 bp, Artificial Sequence; identical to SEQ ID NO: 164066
  Description of Artificial Sequence: Synthetic coding sequence

SEQ ID NO: 164068 - DNA, 159 bp, Artificial Sequence
  Description of Artificial Sequence: Synthetic coding sequence
atggagaaggtgcagtacctgaccaggtctgccatcagaagagccagcaccatcgagatgccccagcaggcccggcagaagctgcagaacctcttcatcaacttctgcctgatcctgatctgcctgctgctgatctgcatcatcgtgatgctgctgtag

SEQ ID NO: 164069 - DNA, 1371 bp, Artificial Sequence
  Description of Artificial Sequence: Synthetic coding sequence
atgcctcctggcccctgggagagctgcttctgggtgggcggcctcatcctgtggctgtctgtgggcagcagtggagatgccccacccaccccccagcccaagtgtgccgacttccagagcgccaacctgtttgagggcacagacctgaaggtgcagttcctgctgtttgtgcccagcaaccccagctgtggccagctggtggagggcagcagtgacctgcagaacagcggcttcaatgccaccctgggcaccaagctgatcatccacggcttccgggtgctgggcaccaagcccagctggattgacaccttcatccgcaccctgctgcgggccaccaatgccaacgtgattgctgtggactggatctacggcagcactggagtgtacttctctgctgtgaagaatgtcatcaagctgagcctggagatcagcctcttcctgaacaagctgctggtgctgggcgtgtctgagagcagcatccacatcattggagtgtccctgggcgcccacgtgggcggcatggtgggccagctgtttggaggccagctgggccagatcaccggcctggaccctgctggccctgagtacacccgggcctctgtggaggagcggctggatgctggagatgccctgtttgtggaggccatccacacagacacagacaacctgggcatccgcatccctgtgggccacgtggactactttgtgaatggaggccaggaccagcccggctgccccaccttcttctacgccggctacagctacctgatctgtgaccacatgagagctgtgcacctgtacatcagcgccctggagaacagctgccccctgatggccttcccctgtgccagctacaaggccttcctggccggccgctgcctggactgcttcaaccccttcctgctgagctgccccagaattggcctggtggagcagggcggcgtgaagattgagcccctgcccaaggaggtgaaggtgtacctgctgaccaccagcagcgccccctactgcatgcaccacagcctggtggagttccacctgaaggagctgaggaacaaggacaccaacatcgaggtgaccttcctgagcagcaacatcaccagcagcagcaagatcaccatccccaagcagcagagatatggcaagggcatcatcgcccacgccaccccccagtgccagatcaaccaggtgaagttcaagttccagagcagcaacagagtgtggaagaaggacaggaccaccatcatcggcaagttctgcacagccctgctgcctgtgaatgaccgggagaagatggtgtgcctgcctgagcctgtgaacctgcaggcctctgtgacagtgtcctgtgacctgaagatcgcctgtgtgtag

SEQ ID NO: 164070 - DNA, 1323 bp, Artificial Sequence
  Description of Artificial Sequence: Synthetic coding sequence
atgcctcctggcccctgggagagctgcttctgggtgggcggcctcatcctgtggctgtctgtgggcagcagtggagatgccccacccaccccccagcccaagtgtgccgacttccagagcgccaacctgtttgagggcacagacctgaaggtgcagttcctgctgtttgtgcccagcaaccccagctgtggccagctggtggagggcagcagtgacctgcagaacagcggcttcaatgccaccctgggcaccaagctgatcatccacggcttccgggtgctgggcaccaagcccagctggattgacaccttcatccgcaccctgctgcgggccaccaatgccaacgtgattgctgtggactggatctacggcagcactggagtgtacttctctgctgtgaagaatgtgctgggcgtgtctgagagcagcatccacatcattggagtgtccctgggcgcccacgtgggcggcatggtgggccagctgtttggaggccagctgggccagatcaccggcctggaccctgctggccctgagtacacccgggcctctgtggaggagcggctggatgctggagatgccctgtttgtggaggccatccacacagacacagacaacctgggcatccgcatccctgtgggccacgtggactactttgtgaatggaggccaggaccagcccggctgccccaccttcttctacgccggctacagctacctgatctgtgaccacatgagagctgtgcacctgtacatcagcgccctggagaacagctgccccctgatggccttcccctgtgccagctacaaggccttcctggccggccgctgcctggactgcttcaaccccttcctgctgagctgccccagaattggcctggtggagcagggcggcgtgaagattgagcccctgcccaaggaggtgaaggtgtacctgctgaccaccagcagcgccccctactgcatgcaccacagcctggtggagttccacctgaaggagctgaggaacaaggacaccaacatcgaggtgaccttcctgagcagcaacatcaccagcagcagcaagatcaccatccccaagcagcagagatatggcaagggcatcatcgcccacgccaccccccagtgccagatcaaccaggtgaagttcaagttccagagcagcaacagagtgtggaagaaggacaggaccaccatcatcggcaagttctgcacagccctgctgcctgtgaatgaccgggagaagatggtgtgcctgcctgagcctgtgaacctgcaggcctctgtgacagtgtcctgtgacctgaagatcgcctgtgtgtag

SEQ ID NO: 164071 - DNA, 852 bp, Artificial Sequence
  Description of Artificial Sequence: Synthetic coding sequence
atggtgggccagctgtttggaggccagctgggccagatcaccggcctggaccctgctggccctgagtacacccgggcctctgtggaggagcggctggatgctggagatgccctgtttgtggaggccatccacacagacacagacaacctgggcatccgcatccctgtgggccacgtggactactttgtgaatggaggccaggaccagcccggctgccccaccttcttctacgccggctacagctacctgatctgtgaccacatgagagctgtgcacctgtacatcagcgccctggagaacagctgccccctgatggccttcccctgtgccagctacaaggccttcctggccggccgctgcctggactgcttcaaccccttcctgctgagctgcccccgcatcggcctggtggagcagggcggcgtgaagattgagcccctgcccaaggaggtgaaggtgtacctgctgaccaccagcagcgccccctactgcatgcaccacagcctggtggagttccacctgaaggagctgaggaacaaggacaccaacatcgaggtgaccttcctgagcagcaacatcaccagcagcagcaagatcaccatccccaagcagcagagatatggcaagggcatcatcgcccacgccaccccccagtgccagatcaaccaggtgaagttcaagttccagagcagcaacagagtgtggaagaaggacaggaccaccatcatcggcaagttctgcacagccctgctgcctgtgaatgaccgggagaagatggtgtgcctgcctgagcctgtgaacctgcaggcctctgtgacagtgtcctgtgacctgaagatcgcctgtgtgtag

SEQ ID NO: 164072 - DNA, 1656 bp, Artificial Sequence
  Description of Artificial Sequence: Synthetic coding sequence
atgaggacccggccccggccccggctgcggaggacagagaacttcctgacagctgtgcaccacggcaagaaggaggagaaggctgctgtggagcggcggcggctgcacgtgctgaaggccctgaagaagctgcgcatcgaggctgatgaggcccctgtggtggccgtgctgggcagcggcggcggcctgcgggcccacatcgcctgcctgggcgtgctgtctgagatgaaggagcagggcctgctggatgctgtgacctacctggccggcgtgtctggcagcacctgggccatcagcagcctgtacaccaatgatggagacatggaggccctggaggccgacctgaagcaccgcttcacccggcaggagtgggacctggccaagagcctgcagaagaccatccaggccgcccggtctgagaactacagcctgacagacttctgggcctacatggtgatcagcaagcagacccgggagctgcctgagagccacctgagcaacatgaagaagcctgtggaggagggcaccctgccctaccccatctttgctgccatcgacaatgacctgcagcccagctggcaggaggcccgggcccctgagacctggtttgagttcaccccccaccacgccggcttcagcgccctgggcgcctttgtgtccatcacccacttcggcagcaagttcaagaagggccgcctggtgaggacccaccctgagcgggacctgaccttcctgcggggcctgtggggcagcgccctgggcaacacagaggtgatccgggagtacatctttgaccagctgaggaacctgaccctgaagggcctgtggaggagagctgtggccaatgccaagagcatcggccacctgatctttgcccggctgctgcggctgcaggagagcagccagggcgagcaccccccaccagaagatgagggcggggagcctgagcacacctggctgacagagatgctggagaactggaccaggaccagcctggagaagcaggagcagccccatgaggaccctgagaggaagggcagcctgagcaacctgatggactttgtgaagaagacaggcatctgtgccagcaagtgggagtggggcaccacccacaacttcctgtacaagcatggaggcatccgggacaagatcatgagcagcaggaagcacctgcacctggtggatgctggcctggccatcaacacccccttccccctggtgctgccccccacccgggaggtgcacctgatcctgagctttgacttctctgctggggacccctttgagaccatccgggccaccacagactactgcagaagacacaagatccccttcccccaggtggaggaggccgagctggacctgtggagcaaggccccagccagctgctacatcctgaagggggagaccggccctgtggtgatgcacttccccctcttcaacattgatgcctgtggcggggacatcgaggcctggagcgacacctatgacaccttcaagctggccgacacctacaccctggatgtggtggtgctgctgctggccctggccaagaagaatgtgcgggagaacaagaagaagatcctgcgggagctgatgaatgtggccggcctgtactaccccaaggacagcgcccggagctgctgcctggcctag

SEQ ID NO: 164073 - DNA, 4392 bp, Artificial Sequence
  Description of Artificial Sequence: Synthetic coding sequence
atgctgctgagccccagcctgctgctgctgctgctgctgggcgccccccggggctgtgccgagggcgtggccgccgccctgaccccagagcggctgctggagtggcaggacaagggcatctttgtgatccagagcgagagcctgaagaagtgcatccaggccggcaagtctgtgctgaccctggagaactgcaagcaggccaacaagcacatgctgtggaagtgggtgagcaaccacggcctcttcaacatcggcggcagcggctgcctgggcctgaacttcagcgcccctgagcagcccctgagcctgtatgaatgtgacagcaccctggtgtccctgcgctggcgctgcaacaggaagatgatcaccggccccctgcagtacagcgtgcaggtggcccatgacaacacagtggtggccagcaggaagtacatccacaagtggatctcctatggcagcggcggcggggacatctgtgagtacctgcacaaggacctgcacaccatcaagggcaacacccacggcatgccctgcatgttccccttccagtacaaccaccagtggcaccatgaatgtacccgggagggccgggaggatgacctgctgtggtgtgccaccaccagccgctatgaaagagatgagaagtggggcttctgcccagaccccaccagcgctgaggtgggctgtgacaccatctgggagaaggacctgaacagccacatctgctaccagttcaacctgctgagcagcctgtcctggagcgaggcccacagcagctgccagatgcagggcggcaccctgctgagcatcacagatgaaacagaggagaacttcatccgggagcacatgagcagcaagacagtggaggtgtggatgggcctgaaccagctggatgagcacgccggctggcagtggagcgatggcacccccctgaactacctgaactggagccctgaggtgaactttgagccctttgtggaggaccactgcggcaccttcagcagcttcatgcccagcgcctggaggagccgggactgtgagagcaccctgccctacatctgcaagaagtacctgaaccacatcgaccatgaaattgtggagaaggatgcctggaagtactatgccacccactgtgagcccggctggaacccctacaacagaaactgctacaagctgcagaaggaggagaagacctggcatgaggccctgcggagctgccaggccgacaacagcgccctgattgacatcaccagcctggccgaggtggagttcctggtgaccctgctgggagatgaaaatgccagcgagacctggattggcctgagcagcaacaagatccctgtgtcctttgagtggagcaatgacagcagcgtcatcttcaccaactggcacaccctggagccccacatcttccccaacagaagccagctgtgtgtgtctgctgagcagagcgagggccactggaaggtgaagaactgtgaggagcggctcttctacatctgcaagaaggccggccacgtgctgagtgatgctgagagcggctgccaggagggctgggagcggcacggcggcttctgctacaagattgacacagtgctgcggagctttgaccaggccagcagcggctactactgccccccagccctggtgaccatcaccaacagatttgagcaggccttcatcaccagcctcatcagctctgtggtgaagatgaaggacagctacttctggatcgccctgcaggaccagaatgacaccggggagtacacctggaagcctgtgggccagaagccagagcctgtgcagtacacccactggaacacccaccagccccgctacagcggcggctgtgtggccatgaggggccgccaccccctgggccgctgggaggtgaagcactgccgccacttcaaggccatgagcctgtgcaagcagcctgtggagaaccaggagaaggccgagtatgaggagcgctggcccttccacccctgctacctggactgggagagcgagcccggcctggccagctgcttcaaggtgttccacagcgagaaggtgctgatgaagaggacctggagggaggccgaggccttctgtgaggagtttggagcccacctggccagctttgcccacatcgaggaggagaactttgtgaatgagctgctgcacagcaagttcaactggacagaggagcggcagttctggattggcttcaacaagaggaaccccctgaatgccggctcctgggagtggagcgacaggacccctgtggtgagcagcttcctggacaacacctactttggagaagatgccaggaactgtgctgtgtacaaggccaacaagaccctgctgcccctgcactgcggcagcaagcgggagtggatctgcaagatccccagagatgtgaagcccaagatccccttctggtaccagtatgatgtgccctggctgttctaccaggatgctgagtacctgttccacacctttgccagcgagtggctgaactttgaatttgtgtgctcctggctgcacagcgacctgctgaccatccacagcgcccacgagcaggagttcatccacagcaagatcaaggccctgagcaaatatggagcctcctggtggattggcctgcaggaggagcgggccaatgatgagttccgctggagagatggcacccctgtgatctaccagaactgggacaccggccgggagaggacagtgaacaaccagagccagagatgtggcttcatcagcagcatcaccggcctgtggggcagcgaggagtgcagcgtgtccatgcccagcatctgcaagaggaagaaggtgtggctgattgagaagaagaaggacacccccaagcagcacggcacctgccccaagggctggctgtacttcaactacaagtgcctgctgctgaacatccccaaggaccccagctcctggaagaactggacccacgcccagcacttctgtgccgaggagggcggcaccctggtggccattgaaagtgaggtggagcaggccttcatcaccatgaacctgtttggccagaccacctctgtgtggattggcctgcagaatgatgattatgagacctggctgaatggcaagcctgtggtgtacagcaactggagcccctttgacatcatcaacatccccagccacaacaccacagaggtgcagaagcacatccccctgtgtgccctgctgagcagcaaccccaacttccacttcaccgggaagtggtactttgaggactgtgggaaggagggctacggctttgtgtgtgagaagatgcaggacaccagcggccatggagtgaacaccagtgacatgtaccccatgcccaacaccctggagtatggcaacagaacctacaagatcatcaatgccaacatgacctggtatgctgccatcaagacctgcctgatgcacaaggcccagctggtgtccatcacagaccagtaccaccagagcttcctgactgtggtgctgaaccggctgggctacgcccactggattggcctcttcaccacagacaatggcctgaactttgactggagcgatggcaccaagagcagcttcaccttctggaaggatgaggagagcagcctgctgggggactgtgtgtttgctgacagcaatggccgctggcacagcacagcctgtgagagcttcctgcagggcgccatctgccacgtgcccccagagacccggcagagcgagcaccctgagctgtgcagcgagaccagcatcccctggatcaagttcaagagcaactgctacagcttcagcacagtgctggacagcatgagctttgaagctgcccacgagttctgcaagaaggagggcagcaacctgctgaccatcaaggatgaagcagaaaatgccttcctgctggaggagctgtttgccttcggcagctctgtgcagatggtgtggctgaatgcccagtttgatggcaacaatgagaccatcaagtggtttgatggcacccccacagaccagagcaactggggcatcaggaagccagacacagactacttcaagccccaccactgtgtggccctgcgcatccctgagggcctgtggcagctgagcccctgccaggagaagaagggcttcatctgcaagatggaggccgacatccacacagctgaggccctgcctgagaagggccccagccacagcatcatccccctggccgtggtgctgaccctcatcgtcatcgtggccatctgcaccctgtccttctgcatctacaagcacaacggcggcttcttccggcggctggccggcttcaggaacccctactacccagccaccaacttcagcacagtgtacctggaggagaacatcctgatcagtgacctggagaagagtgaccagtag

SEQ ID NO: 164074 - DNA, 3975 bp, Artificial Sequence
  Description of Artificial Sequence: Synthetic coding sequence
atgctgctgagccccagcctgctgctgctgctgctgctgggcgccccccggggctgtgccgagggcgtggccgccgccctgaccccagagcggctgctggagtggcaggacaagggcatctttgtgatccagagcgagagcctgaagaagtgcatccaggccggcaagtctgtgctgaccctggagaactgcaagcaggccaacaagcacatgctgtggaagtgggtgagcaaccacggcctcttcaacatcggcggcagcggctgcctgggcctgaacttcagcgcccctgagcagcccctgagcctgtatgaatgtgacagcaccctggtgtccctgcgctggcgctgcaacaggaagatgatcaccggccccctgcagtacagcgtgcaggtggcccatgacaacacagtggtggccagcaggaagtacatccacaagtggatctcctatggcagcggcggcggggacatctgtgagtacctgcacaaggacctgcacaccatcaagggcaacacccacggcatgccctgcatgttccccttccagtacaaccaccagtggcaccatgaatgtacccgggagggccgggaggatgacctgctgtggtgtgccaccaccagccgctatgaaagagatgagaagtggggcttctgcccagaccccaccagcgctgaggtgggctgtgacaccatctgggagaaggacctgaacagccacatctgctaccagttcaacctgctgagcagcctgtcctggagcgaggcccacagcagctgccagatgcagggcggcaccctgctgagcatcacagatgaaacagaggagaacttcatccgggagcacatgagcagcaagacagtggaggtgtggatgggcctgaaccagctggatgagcacgccggctggcagtggagcgatggcacccccctgaactacctgaactggagccctgaggtgaactttgagccctttgtggaggaccactgcggcaccttcagcagcttcatgcccagcgcctggaggagccgggactgtgagagcaccctgccctacatctgcaagaagtacctgaaccacatcgaccatgaaattgtggagaaggatgcctggaagtactatgccacccactgtgagcccggctggaacccctacaacagaaactgctacaagctgcagaaggaggagaagacctggcatgaggccctgcggagctgccaggccgacaacagcgccctgattgacatcaccagcctggccgaggtggagttcctggtgaccctgctgggagatgaaaatgccagcgagacctggattggcctgagcagcaacaagatccctgtgtcctttgagtggagcaatgacagcagcgtcatcttcaccaactggcacaccctggagccccacatcttccccaacagaagccagctgtgtgtgtctgctgagcagagcgagggccactggaaggtgaagaactgtgaggagcggctcttctacatctgcaagaaggccggccacgtgctgagtgatgctgagagcggctgccaggagggctgggagcggcacggcggcttctgctacaagattgacacagtgctgcggagctttgaccaggccagcagcggctactactgccccccagccctggtgaccatcaccaacagatttgagcaggccttcatcaccagcctcatcagctctgtggtgaagatgaaggacagctacttctggatcgccctgcaggaccagaatgacaccggggagtacacctggaagcctgtgggccagaagccagagcctgtgcagtacacccactggaacacccaccagccccgctacagcggcggctgtgtggccatgaggggccgccaccccctgggccgctgggaggtgaagcactgccgccacttcaaggccatgagcctgtgcaagcagcctgtggagaaccaggagaaggccgagtatgaggagcgctggcccttccacccctgctacctggactgggagagcgagcccggcctggccagctgcttcaaggtgttccacagcgagaaggtgctgatgaagaggacctggagggaggccgaggccttctgtgaggagtttggagcccacctggccagctttgcccacatcgaggaggagaactttgtgaatgagctgctgcacagcaagttcaactggacagaggagcggcagttctggattggcttcaacaagaggaaccccctgaatgccggctcctgggagtggagcgacaggacccctgtggtgagcagcttcctggacaacacctactttggagaagatgccaggaactgtgctgtgtacaaggccaacaagaccctgctgcccctgcactgcggcagcaagcgggagtggatctgcaagatccccagagatgtgaagcccaagatccccttctggtaccagtatgatgtgccctggctgttctaccaggatgctgagtacctgttccacacctttgccagcgagtggctgaactttgaatttgtgtgctcctggctgcacagcgacctgctgaccatccacagcgcccacgagcaggagttcatccacagcaagatcaaggccctgagcaaatatggagcctcctggtggattggcctgcaggaggagcgggccaatgatgagttccgctggagagatggcacccctgtgatctaccagaactgggacaccggccgggagaggacagtgaacaaccagagccagagatgtggcttcatcagcagcatcaccggcctgtggggcagcgaggagtgcagcgtgtccatgcccagcatctgcaagaggaagaaggtgtggctgattgagaagaagaaggacacccccaagcagcacggcacctgccccaagggctggctgtacttcaactacaagtgcctgctgctgaacatccccaaggaccccagctcctggaagaactggacccacgcccagcacttctgtgccgaggagggcggcaccctggtggccattgaaagtgaggtggagcaggccttcatcaccatgaacctgtttggccagaccacctctgtgtggattggcctgcagaatgatgattatgagacctggctgaatggcaagcctgtggtgtacagcaactggagcccctttgacatcatcaacatccccagccacaacaccacagaggtgcagaagcacatccccctgtgtgccctgctgagcagcaaccccaacttccacttcaccgggaagtggtactttgaggactgtgggaaggagggctacggctttgtgtgtgagaagatgcaggacaccagcggccatggagtgaacaccagtgacatgtaccccatgcccaacaccctggagtatggcaacagaacctacaagatcatcaatgccaacatgacctggtatgctgccatcaagacctgcctgatgcacaaggcccagctggtgtccatcacagaccagtaccaccagagcttcctgactgtggtgctgaaccggctgggctacgcccactggattggcctcttcaccacagacaatggcctgaactttgactggagcgatggcaccaagagcagcttcaccttctggaaggatgaggagagcagcctgctgggggactgtgtgtttgctgacagcaatggccgctggcacagcacagcctgtgagagcttcctgcagggcgccatctgccacgtgcccccagagacccggcagagcgagcaccctgagctgtgcagcgagaccagcatcccctggatcaagttcaagagcaactgctacagcttcagcacagtgctggacagcatgagctttgaagctgcccacgagttctgcaagaaggagggcagcaacctgctgaccatcaaggatgaagcagaaaatgccttcctgctggaggagctgtttgccttcggcagctctgtgcagatggtgtggctgaatgcccagtttgatggcaacagcaagtag

SEQ ID NO: 164075 - DNA, 1584 bp, Artificial Sequence
  Description of Artificial Sequence: Synthetic coding sequence
atgggcagcagcgaggtgtccatcatccctggcctgcagaaggaggagaaggctgctgtggagcggcggcggctgcacgtgctgaaggccctgaagaagctgcgcatcgaggctgatgaggcccctgtggtggccgtgctgggcagcggcggcggcctgcgggcccacatcgcctgcctgggcgtgctgtctgagatgaaggagcagggcctgctggatgctgtgacctacctggccggcgtgtctggcagcacctgggccatcagcagcctgtacaccaatgatggagacatggaggccctggaggccgacctgaagcaccgcttcacccggcaggagtgggacctggccaagagcctgcagaagaccatccaggccgcccggtctgagaactacagcctgacagacttctgggcctacatggtgatcagcaagcagacccgggagctgcctgagagccacctgagcaacatgaagaagcctgtggaggagggcaccctgccctaccccatctttgctgccatcgacaatgacctgcagcccagctggcaggaggcccgggcccctgagacctggtttgagttcaccccccaccacgccggcttcagcgccctgggcgcctttgtgtccatcacccacttcggcagcaagttcaagaagggccgcctggtgaggacccaccctgagcgggacctgaccttcctgcggggcctgtggggcagcgccctgggcaacacagaggtgatccgggagtacatctttgaccagctgaggaacctgaccctgaagggcctgtggaggagagctgtggccaatgccaagagcatcggccacctgatctttgcccggctgctgcggctgcaggagagcagccagggcgagcaccccccaccagaagatgagggcggggagcctgagcacacctggctgacagagatgctggagaactggaccaggaccagcctggagaagcaggagcagccccatgaggaccctgagaggaagggcagcctgagcaacctgatggactttgtgaagaagacaggcatctgtgccagcaagtgggagtggggcaccacccacaacttcctgtacaagcatggaggcatccgggacaagatcatgagcagcaggaagcacctgcacctggtggatgctggcctggccatcaacacccccttccccctggtgctgccccccacccgggaggtgcacctgatcctgagctttgacttctctgctggggacccctttgagaccatccgggccaccacagactactgcagaagacacaagatccccttcccccaggtggaggaggccgagctggacctgtggagcaaggccccagccagctgctacatcctgaagggggagaccggccctgtggtgatgcacttccccctcttcaacattgatgcctgtggcggggacatcgaggcctggagcgacacctatgacaccttcaagctggccgacacctacaccctggatgtggtggtgctgctgctggccctggccaagaagaatgtgcgggagaacaagaagaagatcctgcgggagctgatgaatgtggccggctag

SEQ ID NO: 164076 - DNA, 1626 bp, Artificial Sequence
  Description of Artificial Sequence: Synthetic coding sequence
atgggcagcagcgaggtgtccatcatccctggcctgcagaaggaggagaaggctgctgtggagcggcggcggctgcacgtgctgaaggccctgaagaagctgcgcatcgaggctgatgaggcccctgtggtggccgtgctgggcagcggcggcggcctgcgggcccacatcgcctgcctgggcgtgctgtctgagatgaaggagcagggcctgctggatgctgtgacctacctggccggcgtgtctggcagcacctgggccatcagcagcctgtacaccaatgatggagacatggaggccctggaggccgacctgaagcaccgcttcacccggcaggagtgggacctggccaagagcctgcagaagaccatccaggccgcccggtctgagaactacagcctgacagacttctgggcctacatggtgatcagcaagcagacccgggagctgcctgagagccacctgagcaacatgaagaagcctgtggaggagggcaccctgccctaccccatctttgctgccatcgacaatgacctgcagcccagctggcaggaggcccgggcccctgagacctggtttgagttcaccccccaccacgccggcttcagcgccctgggcgcctttgtgtccatcacccacttcggcagcaagttcaagaagggccgcctggtgaggacccaccctgagcgggacctgaccttcctgcggggcctgtggggcagcgccctgggcaacacagaggtgatccgggagtacatctttgaccagctgaggaacctgaccctgaagggcctgtggaggagagctgtggccaatgccaagagcatcggccacctgatctttgcccggctgctgcggctgcaggagagcagccagggcgagcaccccccaccagaagatgagggcggggagcctgagcacacctggctgacagagatgctggagaactggaccaggaccagcctggagaagcaggagcagccccatgaggaccctgagaggaagggcagcctgagcaacctgatggactttgtgaagaagacaggcatctgtgccagcaagtgggagtggggcaccacccacaacttcctgtacaagcatggaggcatccgggacaagatcatgagcagcaggaagcacctgcacctggtggatgctggcctggccatcaacacccccttccccctggtgctgccccccacccgggaggtgcacctgatcctgagctttgacttctctgctggggacccctttgagaccatccgggccaccacagactactgcagaagacacaagatccccttcccccaggtggaggaggccgagctggacctgtggagcaaggccccagccagctgctacatcctgaagggggagaccggccctgtggtgatgcacttccccctcttcaacattgatgcctgtggcggggacatcgaggcctggagcgacacctatgacaccttcaagctggccgacacctacaccctggatgtggtggtgctgctgctggccctggccaagaagaatgtgcgggagaacaagaagaagatcctgcgggagctgatgaatgtggccggcctgtactaccccaaggacagcgcccggagctgctgcctggcctag

SEQ ID NO: 164077 - DNA, 2457 bp, Artificial Sequence
  Description of Artificial Sequence: Synthetic coding sequence
atggagagcctgagccctgggggccccccaggccacccctaccagggcgaggccagcacctgctggcagctgactgtgcgggtgctggaggccaggaacctgcgctgggccgacctgctgtctgaggccgacccctacgtgatcctgcagctgagcacagcccctggcatgaagttcaagaccaagaccctgacagacaccagccaccctgtgtggaatgaggccttccgcttcctgatccagagccaggtgaagaatgtgctggagctgagcatctatgatgaagattctgtgacagaagatgacatctgcttcaaggtgctgtatgacatcagcgaggtgctgcccgggaagctgctgaggaagaccttcagccagagcccccagggcgaggaggagctggatgtggagttcctgatggaggagaccagtgacaggcctgagaacctgatcaccaacaaggtgattgtggcccgggagctgagctgcctggatgtgcacctggacagcacaggcagcacagctgtggtggccgaccaggacaagctggagctggagctggtgctgaagggcagctatgaggacacccagaccagcttcctgggcacagccagcgccttccgcttccactacatggccgccctggagacagagctgagcggccgcctgcggagcagccgcagcaatggctggaatggagacaacagcgctggctacctgactgtgcccctgcggcccctgaccatcggcaaggaggtgaccatggatgtgcctgccccaaatgcccctggggtgcggctgcagctgaaggccgagggctgcccagaggagctggccgtgcacctgggcttcaacctgtgtgccgaggagcaggccttcctgagcaggaggaagcaggtggtggccaaggccctgaagcaggccctgcagctggaccgggacctgcaggaggatgaggtgcctgtggtgggcatcatggccaccggcggcggggcccgggccatgaccagcctgtatggccacctgctggccctgcagaagctgggcctgctggactgtgtgacctacttcagcggcatcagcggcagcacctggaccatggcccacctgtatggagaccctgagtggagccagagggacctggagggccccatccgctatgcccgggagcacctggccaagagcaagctggaggtgttcagccctgagcggctggccagctacagaagagagctggagctgcgggcagagcagggccaccccaccacctttgtggacctgtgggccctggtgctggagagcatgctgcacggccaggtgatggaccagaagctgagcggccagagagctgccctggagcggggccagaaccccctgcccctgtacctgagcctgaatgtgaaggagaacaacctggagaccctggacttcaaggagtgggtggagttcagcccctatgaggtgggcttcctgaagtatggagcctttgtgcccccagagctgtttggcagcgagttcttcatgggccgcctgatgaggcgcatccctgagccccgcatctgcttcctggaggccatctggagcaacatcttcagcctgaacctgctggatgcctggtatgacctgaccagcagtggagagagctggaagcagcacatcaaggacaagaccaggagcctggagaaggagcccctgaccaccagcggcaccagcagccggctggaggcctcctggctgcagcctggaacagccctggcccaggccttcaagggcttcctgaccggccggcccctgcaccagaggagccccaacttcctgcagggcctgcagctgcaccaggactactgcagccacaaggacttcagcacctgggccgactaccagctggacagcatgcccagccagctgacccccaaggagccccggctgtgcctggtggatgctgcctacttcatcaacaccagcagccccagcatgttccggcccggccggcggctggacctgatcctgagctttgactacagcctgagcgccccctttgaggccctgcagcagacagagctgtactgccgggcccggggcctgcccttcccccgggtggagcccagcccccaggaccagcaccagccccgggagtgccacctgttcagtgaccctgcctgcccagaggcccccatcctgctgcacttccccctggtgaatgccagcttcaaggaccacagcgcccctggggtgcagaggagccctgctgagctgcagggcggccaggtggacctgaccggggccacctgcccctacaccctgagcaacatgacctacaaggaggaggactttgagcggctgctgcggctgagtgactacaacgtgcagaccagccagggcgccatcctgcaggccctgaggacagccctgaagcacaggaccctggaggcccggcccccccgggcccagacctag

SEQ ID NO: 164078 - DNA, 1326 bp, Artificial Sequence
  Description of Artificial Sequence: Synthetic coding sequence
atggtgccccccaagctgcacgtgctcttctgcctgtgtggctgcctggccgtggtgtacccctttgactggcagtacatcaaccctgtggcccacatgaagagcagcgcctgggtgaacaagatccaggtgctgatggccgccgccagctttggccagaccaagatccccagaggaaatggcccctacagcgtgggctgcacagacctgatgtttgaccacaccaacaagggcaccttcctgcggctgtactaccccagccaggacaatgaccggctggacaccctgtggatccccaacaaggagtacttctggggcctgagcaagttcctgggcacccactggctgatgggcaacatcctgcggctgctgtttggctccatgaccaccccagccaactggaacagccccctgcggcctggagagaagtaccccctggtggtgttcagccacggcctgggcgccttccgcaccctgtacagcgccatcggcatcgacctggccagccacggcttcatcgtggccgctgtggagcaccgggacagaagtgccagcgccacctactacttcaaggaccagagcgctgctgagatcggggacaagtcctggctgtacctgcggaccctgaagcaggaggaggagacccacatcagaaatgagcaggtgcggcagagggccaaggagtgcagccaggccctgagcctcatcctggacatcgaccacggcaagcctgtgaagaatgccctggacctgaagtttgacatggagcagctgaaggacagcattgaccgggagaagattgctgtgattggccacagctttggaggagccaccgtcatccagaccctgtctgaggaccagcgcttccgctgtggcatcgccctggatgcctggatgttccccctgggagatgaggtgtacagccgcatcccccagcccctcttcttcatcaacagcgagtacttccagtacccagccaacatcatcaagatgaagaagtgctacagcccagacaaggagaggaagatgatcaccatccggggctctgtgcaccagaactttgctgacttcacctttgccaccgggaagatcatcggccacatgctgaagctgaagggggacatcgacagcaatgtggccatcgacctgagcaacaaggccagcctggccttcctgcagaagcacctgggcctgcacaaggactttgaccagtgggactgcctgattgaaggagatgatgagaacctgatccctggcaccaacatcaacaccaccaaccagcacatcatgctgcagaacagcagcggcatcgagaagtacaactag

SEQ ID NO: 164079 - DNA, 1326 bp, Artificial Sequence; identical to SEQ ID NO: 164078
  Description of Artificial Sequence: Synthetic coding sequence

SEQ ID NO: 164080 - DNA, 660 bp, Artificial Sequence
  Description of Artificial Sequence: Synthetic coding sequence
atggctgctgccagctttggccagaccaagatccccagaggaaatggcccctacagcgtgggctgcacagacctgatgtttgaccacaccaacaagggcaccttcctgcggctgtactaccccagccaggacaatgaccggctggacaccctgtggatccccaacaaggagtacttctggggcctgagcaagttcctgggcacccactggctgatgggcaacatcctgcggctgctgtttggctccatgaccaccccagccaactggaacagccccctgcggcctggagagaagtaccccctggtggtgttcagccacggcctgggcgccttccgcaccctgtacagcgccatcggcatcgacctggccagccacggcttcatcgtggccgctgtggagcaccgggacagaagtgccagcgccacctactacttcaaggaccagagcgctgctgagattggagacaagtcctggctgtacctgcggaccctgaagcaggaggaggagacccacatcagaaatgagcaggtgcggcagagggccaaggaatgttcccaggccctgagcctcatcctggacatcgaccacggcaagcctgtgaagaatgccctggacctgaagtttgacatggagcagctgaaggtgtcctacaagaagtag

SEQ ID NO: 164081 - DNA, 414 bp, Artificial Sequence
  Description of Artificial Sequence: Synthetic coding sequence
atgaccaccccagccaactggaacagccccctgcggcctggagagaagtaccccctggtggtgttcagccacggcctgggcgccttccgcaccctgtacagcgccatcggcatcgacctggccagccacggcttcatcgtggccgctgtggagcaccgggacagaagtgccagcgccacctactacttcaaggaccagagcgctgctgagattggagacaagtcctggctgtacctgcggaccctgaagcaggaggaggagacccacatcagaaatgagcaggtgcggcagagggccaaggaatgttcccaggccctgagcctcatcctggacatcgaccacggcaagcctgtgaagaatgccctggacctgaagtttgacatggagcagctgaaggtgtcctacaagaagtag

SEQ ID NO: 164082 - DNA, 489 bp, Artificial Sequence
  Description of Artificial Sequence: Synthetic coding sequence
atgagggcccccatccctgagcccaagccaggggacctgattgagatcttccggcccttctaccgccactgggccatctacgtgggagatggctacgtggtgcacctggccccacccagcgaggtggccggggccggggccgcctctgtgatgtctgccctgacagacaaggccatcgtgaagaaggagctgctgtatgatgtggccggcagtgacaagtaccaggtgaacaacaagcatgatgacaagtacagccccctgccctgcagcaagatcatccagagagctgaggagctggtgggccaggaggtgctgtacaagctgaccagcgagaactgtgagcactttgtgaatgagctgcgctatggagtggcccggagtgaccaggtgagagatgtgatcatcgccgcctctgtggccggcatgggcctggccgccatgagcctcatcggcgtgatgttcagcaggaacaagaggcagaagcagtag

SEQ ID NO: 164083 - DNA, 489 bp, Artificial Sequence; identical to SEQ ID NO: 164082
  Description of Artificial Sequence: Synthetic coding sequence

SEQ ID NO: 164084 - DNA, 4377 bp, Artificial Sequence
  Description of Artificial Sequence: Synthetic coding sequence
atgggcctgcggcccggcatcttcctgctggagctgctgctgctgctgggccagggcaccccccagatccacaccagccccaggaagagcaccctggagggccagctgtggccagagaccctgaagaacagccccttcccctgcaaccccaacaagctgggcgtgaacatgcccagcaagtctgtgcacagcctgaagcccagcgacatcaagtttgtggccgccatcggcaacctggagatccccccagaccccggcactggagacctggagaagcaggactggacagagcggccccagcaggtgtgcatgggcgtgatgacagtgctgagtgacatcatccgctacttcagccccagcgtgcccatgcctgtgtgccacacaggcaagagggtcatcccccatgatggagctgaggacctgtggatccaggcccaggagctggtgaggaacatgaaggagaacctgcagctggacttccagtttgactggaagctgatcaacgtgttcttcagcaatgccagccagtgctacctgtgccccagcgcccagcagaatggcctggccgccggcggcgtggatgagctgatgggcgtgctggactacctgcagcaggaggtgccccgggcctttgtgaacctggtggacctgtctgaggtggccgaggtgtcccggcagtaccacggcacctggctgagccctgcccctgagccctgcaactgcagcgaggagaccacccggctggccaaggtggtgatgcagtggagctaccaggaggcctggaacagcctgctggccagcagccgctacagcgagcaggagagcttcaccgtggtgttccagcccttcttctatgagaccacccccagcctgcacagcgaggacccccggctgcaggacagcaccaccctggcctggcacctgtggaacaggatgatggagcctgctggggagaaggatgagcccctgtctgtgaagcacggccggcccatgaagtgccccagccaggagagcccctacctgttctcctacagaaacagcaactacctgacccggctgcagaagccccaggacaagctggaggtgcgggagggcgctgagatccgctgcccagacaaggaccccagcgacacagtgcccacctctgtgcaccggctgaagccagctgacatcaacgtcatcggggccctgggggacagcctgacagctggaaatggagctggcagcaccccaggaaatgtgctggatgtgctgacccagtaccggggcctgtcctggagcgtgggcggagatgagaacatcggcaccgtgaccaccctggccaacatcctgcgggagttcaaccccagcctgaagggcttctctgtgggcaccgggaaggagaccagccccaatgccttcctgaaccaggccgtggccggcggccgggcagaggacctgcctgtgcaggcccggcggctggtggacctgatgaagaatgacacccgcatccacttccaggaggactggaagatcatcaccctcttcatcggcggcaatgacctgtgtgacttctgcaatgacctggtgcactacagcccccagaacttcacagacaacatcggcaaggccctggacatcctgcatgctgaggtgccccgggcctttgtgaacctggtgacagtgctggagatcgtgaacctgcgggagctgtaccaggagaagaaggtgtactgccccaggatgatcctgcggagcctgtgcccctgtgtgctgaagtttgatgacaacagcacagagctggccaccctcatcgagttcaacaagaagttccaggagaagacccaccagctgattgagagcggccgctatgacacccgggaggacttcaccgtggtggtgcagcccttctttgaaaatgtggacatgcccaagaccagcgagggcctgcctgacaacagcttctttgccccagactgcttccacttcagcagcaagagccacagccgggccgccagcgccctgtggaacaacatgctggagcctgtgggccagaagaccaccaggcacaagtttgagaacaagatcaacatcacctgccccaaccaggtgcagcccttcctgcggacctacaagaacagcatgcagggccacggcacctggctgccctgccgggaccgggcccccagcgccctgcaccccacctctgtgcacgccctgcggcctgctgacatccaggtggtggccgccctgggggacagcctgacagctggaaatggcatcggcagcaagccagatgacctgcctgatgtgaccacccagtaccggggcctgagctacagcgctggaggagatggcagcctggagaatgtgaccaccctgcccaacatcctgcgggagttcaacagaaacctgaccggctatgctgtgggcactggagatgccaatgacaccaatgccttcctgaaccaggccgtgcctggggccaaggccgaggacctgatgagccaggtgcagaccctgatgcagaagatgaaggatgaccaccgggtgaacttccacgaggactggaaggtgatcaccgtgctgattggaggcagtgacctgtgtgactactgcacagacagcaacctgtacagcgctgccaactttgtgcaccacctgagaaatgccctggatgtgctgcaccgggaggtgccccgggtgctggtgaacctggtggacttcctgaaccccaccatcatgaggcaggtgttcctgggcaacccagacaagtgccctgtgcagcaggcctctgtgctgtgcaactgtgtgctgaccctgcgggagaacagccaggagctggcccggctggaggccttcagccgggcctaccgcagctccatgagggagctggtgggcagcggccgctatgacacccaggaggacttctctgtggtgctgcagcccttcttccagaacatccagctgcctgtgctggctgatggcctgcctgacaccagcttctttgccccagactgcatccaccccaaccagaagttccacagccagctggcccgggccctgtggaccaacatgctggagcccctgggcagcaagacagagaccctggacctgcgggcagagatgcccatcacctgccccacccagaatgagcccttcctgcggacccccaggaacagcaactacacctaccccatcaagccagccatcgagaactggggcagtgacttcctgtgcacagagtggaaggccagcaacagcgtgcccacctctgtgcaccagctgcggcctgctgacatcaaggtggtggccgccctgggggacagcctgaccacagctgtgggcgcccggcccaacaacagcagtgacctgcccacctcctggaggggcctgtcctggagcattggaggagatggcaacctggagacccacaccaccctgcccaacatcctgaagaagttcaacccctacctgctgggcttcagcaccagcacctgggagggcacagctggcctgaatgtggccgctgagggcgcccgggcccgggacatgcctgcccaggcctgggacctggtggagaggatgaagaacagcccagacatcaacctggagaaggactggaagctggtgaccctcttcatcggcgtgaatgacctgtgccactactgtgagaaccctgaggcccacctggccacagaatatgtgcagcacatccagcaggccctggacatcctgtctgaggagctgccccgggcctttgtgaatgtggtggaggtgatggagctggccagcctgtaccagggccagggcggcaaatgtgccatgctggccgcccagaacaactgcacctgcctgcggcacagccagagcagcctggagaagcaggagctgaagaaggtgaactggaacctgcagcacggcatcagcagcttctcctactggcaccagtacacccagagagaagattttgctgtggtggtgcagcccttcttccagaacaccctgacccccctgaatgaaagaggagacacagacctgaccttcttcagcgaggactgcttccacttcagtgaccggggccacgccgagatggccatcgccctgtggaacaacatgctggagcctgtgggcaggaagaccaccagcaacaacttcacccacagccgggccaagctgaagtgccccagccctgagagcccctacctgtacaccctgaggaacagccggctgctgcctgaccaggccgaggaggcccctgaggtgctgtactgggccgtgcctgtggccgccggcgtgggcctggtggtgggcatcattggaacagtggtgtggcgctgcagaagaggaggaagaagagaagatcctcccatgagcctgaggacagtggccctgtag

SEQ ID NO: 164085 - DNA, 1467 bp, Artificial Sequence
  Description of Artificial Sequence: Synthetic coding sequence
atggagcctgctggggagaaggatgagcccctgtctgtgaagcacggccggcccatgaagtgccccagccaggagagcccctacctgttctcctacagaaacagcaactacctgacccggctgcagaagccccaggacaagctggaggtgcgggagggcgctgagatccgctgcccagacaaggaccccagcgacacagtgcccacctctgtgcaccggctgaagccagctgacatcaacgtcatcggggccctgggggacagcctgacagctggaaatggagctggcagcaccccaggaaatgtgctggatgtgctgacccagtaccggggcctgtcctggagcgtgggcggagatgagaacatcggcaccgtgaccaccctggccaacatcctgcgggagttcaaccccagcctgaagggcttctctgtgggcaccgggaaggagaccagccccaatgccttcctgaaccaggccgtggccggcggccgggcagaggacctgcctgtgcaggcccggcggctggtggacctgatgaagaatgacacccgcatccacttccaggaggactggaagatcatcaccctcttcatcggcggcaatgacctgtgtgacttctgcaatgacctggtgcactacagcccccagaacttcacagacaacatcggcaaggccctggacatcctgcatgctgaggtgccccgggcctttgtgaacctggtgacagtgctggagatcgtgaacctgcgggagctgtaccaggagaagaaggtgtactgccccaggatgatcctgcggagcctgtgcccctgtgtgctgaagtttgatgacaacagcacagagctggccaccctcatcgagttcaacaagaagttccaggagaagacccaccagctgattgagagcggccgctatgacacccgggaggacttcaccgtggtggtgcagcccttctttgaaaatgtggacatgcccaagaccagcgagggcctgcctgacaacagcttctttgccccagactgcttccacttcagcagcaagagccacagccgggccgccagcgccctgtggaacaacatgctggagcctgtgggccagaagaccaccaggcacaagtttgagaacaagatcaacatcacctgccccaaccaggtgcagcccttcctgcggacctacaagaacagcatgcagggccacggcacctggctgccctgccgggaccgggcccccagcgccctgcaccccacctctgtgcacgccctgcggcctgctgacatccaggtggtggccgccctgggggacagcctgacagctggaaatggcatcggcagcaagccagatgacctgcctgatgtgaccacccagtaccggggcctgagctaccgggagagcaagccaggcttcctgagtgacagctgggtgtccaagagcaacaggaagtgcaccaggaaggcccccaacccctag

SEQ ID NO: 164086 - DNA, 4344 bp, Artificial Sequence
  Description of Artificial Sequence: Synthetic coding sequence
atgggcctgcggcccggcatcttcctgctggagctgctgctgctgctgggccagggcaccccccagatccacaccagccccaggaagagcaccctggagggccagctgtggccagagaccctgaagaacagccccttcccctgcaaccccaacaagctgggcgtgaacatgcccagcaagtctgtgcacagcctgaagcccagcgacatcaagtttgtggccgccatcggcaacctggagatccccccagaccccggcactggagacctggagaagcaggactggacagagcggccccagcaggtgtgcatgggcgtgatgacagtgctgagtgacatcatccgctacttcagccccagcgtgcccatgcctgtgtgccacacaggcaagagggtcatcccccatgatggagctgaggacctgtggatccaggcccaggagctggtgaggaacatgaaggagaacctgcagctggacttccagtttgactggaagctgatcaacgtgttcttcagcaatgccagccagtgctacctgtgccccagcgcccagcaggcccccagcctgagcacagtgctgctgagccagaatggcctggccgccggcggcgtggatgagctgatgggcgtgctggactacctgcagcaggaggtgccccgggcctttgtgaacctggtggacctgtctgaggtggccgaggtgtcccggcagtaccacggcacctggctgagccctgcccctgagccctgcaactgcagcgaggagaccacccggctggccaaggtggtgatgcagtggagctaccaggaggcctggaacagcctgctggccagcagccgctacagcgagcaggagagcttcaccgtggtgttccagcccttcttctatgagaccacccccagcctgcacagcgaggacccccggctgcaggacagcaccaccctggcctggcacctgtggaacaggatgatggagcctgctggggagaaggatgagcccctgtctgtgaagcacggccggcccatgaagtgccccagccaggagagcccctacctgttctcctacagaaacagcaactacctgacccggctgcagaagccccaggacaagctggaggtgcgggagggcgctgagatccgctgcccagacaaggaccccagcgacacagtgcccacctctgtgcaccggctgaagccagctgacatcaacgtgattggagccctgggggacagcctgacagctggaaatggagctggcagcaccccaggaaatgtgctggatgtgctgacccagtaccggggcctgtcctggagcgtgggcggagatgaaaatattggaacagtgaccaccctggccaacatcctgcgggagttcaaccccagcctgaagggcttctctgtgggcaccgggaaggagaccagccccaatgccttcctgaaccaggccgtggccggcggccgggcagaggacctgcctgtgcaggcccggcggctggtggacctgatgaagaatgacacccgcatccacttccaggaggactggaagatcatcaccctcttcatcggcggcaatgacctgtgtgacttctgcaatgacctggtgccccgggcctttgtgaacctggtgacagtgctggagatcgtgaacctgcgggagctgtaccaggagaagaaggtgtactgccccaggatgatcctgcggagcctgtgcccctgtgtgctgaagtttgatgacaacagcacagagctggccaccctgattgagttcaacaagaagttccaggagaagacccaccagctgattgaaagtggccgctatgacacccgggaggacttcaccgtggtggtgcagcccttctttgaaaatgtggacatgcccaagaccagcgagggcctgcctgacaacagcttctttgccccagactgcttccacttcagcagcaagagccacagcagagctgccagcgccctgtggaacaacatgctggagcctgtgggccagaagaccaccaggcacaagtttgagaacaagatcaacatcacctgccccaaccaggtgcagcccttcctgcggacctacaagaacagcatgcagggccacggcacctggctgccctgccgggaccgggcccccagcgccctgcaccccacctctgtgcacgccctgcggcctgctgacatccaggtggtggccgccctgggggacagcctgacagctggaaatggaattggcagcaagccagatgacctgcctgatgtgaccacccagtaccggggcctgagctacagcgctggaggagatggcagcctggagaatgtgaccaccctgcccaacatcctgcgggagttcaacagaaacctgaccggctatgctgtgggcactggagatgccaatgacaccaatgccttcctgaaccaggccgtgcctggggccaaggccgaggacctgatgagccaggtgcagaccctgatgcagaagatgaaggatgaccaccgggtgaacttccacgaggactggaaggtgatcaccgtgctgattggaggcagtgacctgtgtgactactgcacagacagcaacctgtacagcgctgccaactttgtgcaccacctgagaaatgccctggatgtgctgcaccgggaggtgccccgggtgctggtgaacctggtggacttcctgaaccccaccatcatgaggcaggtgttcctgggcaacccagacaagtgccctgtgcagcaggcctctgtgctgtgcaactgtgtgctgaccctgcgggagaacagccaggagctggcccggctggaggccttcagccgggcctaccgcagctccatgagggagctggtgggcagcggccgctatgacacccaggaggacttctctgtggtgctgcagcccttcttccagaacatccagctgcctgtgctggctgatggcctgcctgacaccagcttctttgccccagactgcatccaccccaaccagaagttccacagccagctggcccgggccctgtggaccaacatgctggagcccctgggcagcaagacagagaccctggacctgcgggcagagatgcccatcacctgccccacccagaatgagcccttcctgcggaccccaagaaacagcaactacacctaccccatcaagccagccatcgagaactggggcagtgacttcctgtgcacagagtggaaggccagcaacagcgtgcccacctctgtgcaccagctgcggcctgctgacatcaaggtggtggccgccctgggggacagcctgaccacagctgtgggcgcccggcccaacaacagcagtgacctgcccacctcctggaggggcctgtcctggagcattggaggagatggcaacctggagacccacaccaccctgcccaacatcctgaagaagttcaacccctacctgctgggcttcagcaccagcacctgggagggcacagctggcctgaatgtggccgctgagggcgcccgggcccgggacatgcctgcccaggcctgggacctggtggagaggatgaagaacagcccagacatcaacctggagaaggactggaagctggtgaccctcttcatcggcgtgaatgacctgtgccactactgtgaaaatcctgaggcccacctggccacagaatatgtgcagcacatccagcaggccctggacatcctgtctgaggagctgccccgggcctttgtgaatgtggtggaggtgatggagctggccagcctgtaccagggccagggcggcaaatgtgccatgctggccgcccagaacaactgcacctgcctgcggcacagccagagcagcctggagaagcaggagctgaagaaggtgaactggaacctgcagcacggcatcagcagcttctcctactggcaccagtacacccagcgggaggactttgctgtggtggtgcagcccttcttccagaacaccctgacccccctgaatgaaagaggagacacagacctgaccttcttcagcgaggactgcttccacttcagtgaccggggccatgctgagatggccatcgccctgtggaacaacatgctggagcctgtgggcaggaagaccaccagcaacaacttcacccacagccgggccaagctgaagtgccccagccctgagagcccctacctgtacaccctgaggaacagccggctgctgcctgaccaggccgaggaggcccctgaggtgctgtactgggccgtgcctgtggccgccggcgtgggcctggtggtgggcatcatcggcaccgtggtgtggcgctgccggcggggcggccggcgggaggacccccccatgagcctgaggacagtggccctgtag

SEQ ID NO: 164087 - DNA, 1272 bp, Artificial Sequence
  Description of Artificial Sequence: Synthetic coding sequence
atgcccatcacctgccccacccagaatgagcccttcctgcggaccccaagaaacagcaactacacctaccccatcaagccagccatcgagaactggggcagtgacttcctgtgcacagagtggaaggccagcaacagcgtgcccacctctgtgcaccagctgcggcctgctgacatcaaggtggtggccgccctgggggacagcctgaccacagctgtgggcgcccggcccaacaacagcagtgacctgcccacctcctggaggggcctgtcctggagcattggaggagatggcaacctggagacccacaccaccctgcccaacatcctgaagaagttcaacccctacctgctgggcttcagcaccagcacctgggagggcacagctggcctgaatgtggccgctgagggcgcccgggcccgggacatgcctgcccaggcctgggacctggtggagaggatgaagaacagcccagacatcaacctggagaaggactggaagctggtgaccctcttcatcggcgtgaatgacctgtgccactactgtgaaaatcctgaggcccacctggccacagaatatgtgcagcacatccagcaggccctggacatcctgtctgaggagctgccccgggcctttgtgaatgtggtggaggtgatggagctggccagcctgtaccagggccagggcggcaaatgtgccatgctggccgcccagaacaactgcacctgcctgcggcacagccagagcagcctggagaagcaggagctgaagaaggtgaactggaacctgcagcacggcatcagcagcttctcctactggcaccagtacacccagcgggaggactttgctgtggtggtgcagcccttcttccagaacaccctgacccccctgaatgaaagaggagacacagacctgaccttcttcagcgaggactgcttccacttcagtgaccggggccatgctgagatggccatcgccctgtggaacaacatgctggagcctgtgggcaggaagaccaccagcaacaacttcacccacagccgggccaagctgaagtgccccagccctgagagcccctacctgtacaccctgaggaacagccggctgctgcctgaccaggccgaggaggcccctgaggtgctgtactgggccgtgcctgtggccgccggcgtgggcctggtggtgggcatcatcggcaccgtggtgtggcgctgccggcggggcggccggcgggaggacccccccatgagcctgaggacagtggccctgtag

SEQ ID NO: 164088 - DNA, 3504 bp, Artificial Sequence
  Description of Artificial Sequence: Synthetic coding sequence
atggccggggcccagcccggggtgcacgccctgcagctggagcccccaacagtggtggagaccctgcggcggggcagcaagttcatcaagtgggatgaggagaagctgatgacagtggtgtctggccctgaccctgtgaacacagtgttcctgaacttcatggctgtgcaggatgacacagccaaggtgtggagcgaggagctgttcaagctggccatgaacatcctggcccagaatgccagcaggaacaccttcctgaggaaggcctacaccaagctgaagctgcaggtgaaccaggacggccgcatccctgtgaagaacatcctgaagatgttttctgctgacaagaagagggtggagacagccctggagagctgtggcctgaagttcaacagaagtgagagcatccggccagatgagttcagcctggagatctttgagcgcttcctgaacaagctgtgcctgcggccagacatcgacaagatcctgctggagatcggggccaagggcaagccctacctgaccctggagcagctgatggacttcatcaaccagaagcagagggacccccggctgaatgaggtgctgtacccacccctgcggcccagccaggcccggctgctgattgagaagtatgagcccaaccagcagttcctggagcgggaccagatgtccatggagggcttcagccgctacctgggcggggaggagaatggcatcctgcccctggaggccctggacctgagcacagacatgacccagcccctgagcgcctacttcatcaacagcagccacaacacctacctgacagctggccagctggccggcaccagctctgtggagatgtaccggcaggccctgctgtggggctgccgctgtgtggagctggatgtgtggaagggccggcccccagaggaggagcccttcatcacccacggcttcaccatgaccacagaggtgcccctgagagatgtgctggaggccatcgccgagacagccttcaagaccagcccctaccctgtgatcctgagctttgagaaccacgtggacagcgccaagcagcaggccaagatggccgagtactgccgcagcatctttggagatgccctgctgattgagcccctggacaagtaccccctggcccctggggtgcccctgcccagcccccaggacctgatgggccgcatcctggtgaagaacaagaagaggcaccggcccagcgctgggggcccagattctgctggcaggaagaggcccctggagcagagcaacagcgccctgtctgagagcagcgctgccacagagcccagcagcccccagctgggcagccccagcagtgacagctgccccggcctgagcaatggagaggaggtgggcctggagaagcccagcctggagccccagaagagcctgggagatgagggcctgaacagaggcccctacgtgctgggccctgctgacagagaagatgaggaggaggatgaggaggaggaggagcagacagaccccaagaagcccaccacagatgagggcacagccagcagcgaggtgaatgccacagaggagatgagcaccctggtgaactacatcgagcctgtgaagttcaagagctttgaggccgccaggaagaggaacaagtgctttgagatgagcagctttgtggagaccaaggccatggagcagctgaccaagagccccatggagtttgtggagtacaacaagcagcagctgagccgcatctaccccaagggcaccagggtggacagcagcaactacatgccccagctgttctggaatgtgggctgccagctggtggccctgaacttccagaccctggatgtggccatgcagctgaatgctggggtgtttgagtacaacggccgcagcggctacctgctgaagccagagttcatgagaagaccagacaagagctttgaccccttcacagaggtgattgtggatggcatcgtggccaatgccctgcgggtgaaggtgatcagcggccagttcctgagtgacaggaaggtgggcatctacgtggaggtggacatgtttggcctgcctgtggacaccaggaggaagtaccgcaccaggaccagccagggcaacagcttcaaccctgtgtgggatgaggagccctttgacttccccaaggtggtgctgcccaccctggccagcctgagaattgctgcctttgaggagggcggcaagtttgtgggccaccgcatcctgcctgtgtctgccatccgcagcggctaccactacgtgtgcctgagaaatgaggccaaccagcccctgtgcctgcctgccctgctgatctacacagaggccagtgactacatcccagatgaccaccaggactatgcagaggccctgatcaaccccatcaagcacgtgtccctgatggaccagagggcccggcagctggccgccctgattggagagagcgaggcccaggccggccaggagacctgccaggacacccagagccagcagctgggcagccagcccagcagcaaccccacccccagccccctggatgccagccccaggaggcctcctggccccaccaccagccctgccagcaccagcctgagcagccctggccagagagatgacctgattgccagcatcctgtctgaggtggcccccacccccctggatgagctgcggggccacaaggccctggtgaagctgcggagccggcaggagcgggacctgcgggagctgaggaagaagcaccagaggaaggctgtgaccctgacccggcggctgctggatggcctggcccaggcccaggccgagggccgctgccgcctgcggcctggggccctgggcggcgctgctgatgtggaggacaccaaggagggggaggatgaggccaagcgctaccaggagttccagaaccggcaggtgcagagcctgctggagctgcgggaggcccaggtggatgctgaggcccagaggcggctggagcacctgcggcaggccctgcagaggctgcgggaggtggtgctggatgccaacaccacccagttcaagaggctgaaggagatgaatgaaagagagaagaaggagctgcagaagatcctggacaggaagaggcacaacagcatcagcgaggccaagatgagggacaagcacaagaaggaggccgagctgacagagatcaacagaagacacatcacagaatctgtgaacagcatccggcggctggaggaggcccagaagcagagacatgaccggctggtggccggccagcagcaggtgctgcagcagctggccgaggaggagcccaagctgctggcccagctggcccaggagtgccaggagcagagggcccggctgccccaggagatcagaagaagcctgctgggggagatgcctgagggcctgggagatggccccctggtggcctgtgccagcaatggacatgcccctggcagcagcggccacctgagcggggctgacagcgagagccaggaggagaacacccagctgtag

SEQ ID NO: 164089 - DNA, 3651 bp, Artificial Sequence
  Description of Artificial Sequence: Synthetic coding sequence
atggccggggcccagcccggggtgcacgccctgcagctgaagcctgtgtgtgtgtctgacagcctgaagaagggcaccaagtttgtgaagtgggatgatgacagcaccatcgtgacccccatcatcctgaggacagacccccagggcttcttcttctactggacagaccagaacaaggagacagagctgctggacctgagcctggtgaaggatgcccgctgtggcagacatgccaaggcccccaaggaccccaagctgcgggagctgctggatgtgggcaacatcggccgcctggagcagaggatgatcaccgtggtgtatggccctgacctggtgaacatcagccacctgaacctggtggccttccaggaggaggtggccaaggagtggaccaatgaggtgttcagcctggccaccaacctgctggcccagaacatgagcagagatgccttcctggagaaggcctacaccaagctgaagctgcaggtgaccccagagggccgcatccccctgaagaacatctaccgcctcttctctgctgacaggaagagggtggagacagccctggaggcctgcagcctgcccagcagcagaaatgacagcatcccccaggaggacttcaccccagaggtgtacagagtcttcctgaacaacctgtgccccaggcctgagattgacaacatcttcagcgagtttggagccaagagcaagccctacctgactgtggaccagatgatggacttcatcaacctgaagcagagggacccccggctgaatgagatcctgtacccacccctgaagcaggagcaggtgcaggtgctgattgagaagtatgagcccaacaacagcctggccaggaagggccagatctctgtggatggcttcatgagatacctgagcggggaggagaatggagtggtgtccccagagaagctggacctgaatgaagacatgagccagcccctgagccactacttcatcaacagcagccacaacacctacctgacagctggccagctggccggcaacagctctgtggagatgtaccggcaggtgctgctgagcggctgccgctgtgtggagctggactgctggaagggccgcacagctgaggaggagcccgtcatcacccacggcttcaccatgaccacagagatctccttcaaggaggtgattgaggccatcgcagaatgtgccttcaagaccagccccttccccatcctgctgagctttgagaaccacgtggacagccccaagcagcaggccaagatggccgagtactgccgcctcatctttggagatgccctgctgatggagcccctggagaagtaccccctggagagcggcgtgcccctgcccagccccatggacctgatgtacaagatcctggtgaagaacaagaagaagagccacaagagcagcgagggcagcggcaagaagaagctgtctgagcaggccagcaacacctacagcgacagcagctccatgtttgagcccagcagccctggggccggggaggccgacacagaaagtgatgatgatgatgatgatgatgactgcaagaagagctccatggatgagggcacagctggcagcgaggccatggccacagaggagatgagcaacctggtgaactacatccagcctgtgaagtttgagagctttgagatcagcaagaagaggaacaagagctttgagatgagcagctttgtggagaccaagggcctggagcagctgaccaagagccctgtggagtttgtggagtacaacaagatgcagctgagccgcatctaccccaagggcaccagggtggacagcagcaactacatgccccagctgttctggaatgccggctgccagatggtggccctgaacttccagaccatggacctggccatgcagatcaacatgggcatgtatgagtacaacgggaagagcggctaccgcctgaagccagagttcatgaggaggccagacaagcactttgaccccttcacagagggcatcgtggatggcatcgtggccaacaccctgtctgtgaagatcatcagcggccagttcctgagtgacaagaaggtgggcacctacgtggaggtggacatgtttggcctgcctgtggacaccaggaggaaggccttcaagaccaagaccagccagggcaatgctgtgaaccctgtgtgggaggaggagcccatcgtgttcaagaaggtggtgctgcccaccctggcctgcctgagaattgctgtgtatgaggagggcggcaagttcatcggccaccgcatcctgcctgtgcaggccatccggcccggctaccactacatctgcctgagaaatgaaagaaaccagcccctgaccctgcctgctgtgtttgtgtacatcgaggtgaaggactatgtgcctgacacctatgcagatgtgattgaggccctgagcaaccccatccgctacgtgaacctgatggagcagagggccaagcagctggccgccctgaccctggaggatgaggaggaggtgaagaaggaggccgaccccggggagaccccatctgaggcccccagcgaggcccggaccaccccagcagaaaatggagtgaaccacaccaccaccctgacccccaagccacccagccaggccctgcacagccagcctgcccctggctctgtgaaggccccagccaagacagaagatctcatccagagcgtgctgacagaggtggaggcccagaccatcgaggagctgaagcagcagaagagctttgtgaagctgcagaagaagcactacaaggagatgaaggacctggtgaagaggcaccacaagaagaccacagacctgatcaaggagcacaccaccaagtacaatgagatccagaatgactacctgcggcggcgggccgccctggagaagagcgccaagaaggacagcaagaagaagtctgagcccagcagcccagaccacggcagcagcaccatcgagcaggacctggccgccctggatgctgagatgacccagaagctgattgacctgaaggacaagcagcagcagcagctgctgaacctgcggcaggagcagtactacagcgagaagtaccagaagcgggagcacatcaagctgctgatccagaagctgacagatgtggccgaggagtgccagaacaaccagctgaagaagctgaaggagatctgtgagaaggagaagaaggagctgaagaagaagatggacaagaagaggcaggagaagatcacagaggccaagagcaaggacaagagccagatggaggaggagaagacagagatgatccgcagctacatccaggaggtggtgcagtacatcaagaggctggaggaggcccagagcaagaggcaggagaagctggtggagaagcacaaggagatccggcagcagatcctggatgagaagcccaagctgcaggtggagctggagcaggagtaccaggacaagttcaagaggctgcccctggagatcctggagtttgtgcaggaggccatgaagggcaagatcagcgaggacagcaaccacggcagcgcccccctgagcctgagcagtgaccccgggaaggtgaaccacaagacccccagcagcgaggagctgggcggggacatccctgggaaggagtttgacacccccctgtag

SEQ ID NO: 164090 - DNA, 672 bp, Artificial Sequence
  Description of Artificial Sequence: Synthetic coding sequence
atgaggaggccagacaagcactttgaccccttcacagagggcatcgtggatggcatcgtggccaacaccctgtctgtgaagatcatcagcggccagttcctgagtgacaagaaggtgggcacctacgtggaggtggacatgtttggcctgcctgtggacaccaggaggaaggccttcaagaccaagaccagccagggcaatgctgtgaaccctgtgtgggaggaggagcccatcgtgttcaagaaggtggtgctgcccaccctggcctgcctgagaattgctgtgtatgaggagggcggcaagttcatcggccaccgcatcctgcctgtgcaggccatccggcccggctaccactacatctgcctgagaaatgaaagaaaccagcccctgaccctgcctgctgtgtttgtgtacatcgaggtgaaggactatgtgcctgacacctatgcagatgtgattgaggccctgagcaaccccatccgctacgtgaacctgatggagcagagggccaagcagctggccgccctgaccctggaggatgaggaggaggtgaagaaggagggcggcttcctgcatgatgagatcatgaggctgaccaggaacaccctggagaagctgatggccctgcccctgacccacgtggtgcccatccagagcaagatgctgtcctag

SEQ ID NO: 164091 - DNA, 3522 bp, Artificial Sequence
  Description of Artificial Sequence: Synthetic coding sequence
atggccggggcccagcccggggtgcacgccctgcagctgaagcctgtgtgtgtgtctgacagcctgaagaagggcaccaagtttgtgaagtgggatgatgacagcaccatcgtgacccccatcatcctgaggacagacccccagggcttcttcttctactggacagaccagaacaaggagacagagctgctggacctgagcctggtgaaggatgcccgctgtggcagacatgccaaggcccccaaggaccccaagctgcgggagctgctggatgtgggcaacatcggccgcctggagcagaggatgatcaccgtggtgtatggccctgacctggtgaacatcagccacctgaacctggtggccttccaggaggaggtggccaaggagtggaccaatgaggtgttcagcctggccaccaacctgctggcccagaacatgagcagagatgccttcctggagaaggcctacaccaagctgaagctgcaggtgaccccagagggccgcatccccctgaagaacatctaccgcctcttctctgctgacaggaagagggtggagacagccctggaggcctgcagcctgcccagcagcagaaatgacagcatcccccaggaggacttcaccccagaggtgtacagagtcttcctgaacaacctgtgccccaggcctgagattgacaacatcttcagcgagtttggagccaagagcaagccctacctgactgtggaccagatgatggacttcatcaacctgaagcagagggacccccggctgaatgagatcctgtacccacccctgaagcaggagcaggtgcaggtgctgattgagaagtatgagcccaacaacagcctggccaggaagggccagatctctgtggatggcttcatgagatacctgagcggggaggagaatggagtggtgtccccagagaagctggacctgaatgaagacatgagccagcccctgagccactacttcatcaacagcagccacaacacctacctgacagctggccagctggccggcaacagctctgtggagatgtaccggcaggtgctgctgagcggctgccgctgtgtggagctggactgctggaagggccgcacagctgaggaggagcccgtcatcacccacggcttcaccatgaccacagagatctccttcaaggaggtgattgaggccatcgcagaatgtgccttcaagaccagccccttccccatcctgctgagctttgagaaccacgtggacagccccaagcagcaggccaagatggccgagtactgccgcctcatctttggagatgccctgctgatggagcccctggagaagtaccccctggagagcggcgtgcccctgcccagccccatggacctgatgtacaagatcctggtgaagaacaagaagaagagccacaagagcagcgagggcagcggcaagaagaagctgtctgagcaggccagcaacacctacagcgacagcagctccatgtttgagcccagcagccctggggccggggaggccgacacagaaagtgatgatgatgatgatgatgatgactgcaagaagagctccatggatgagggcacagctggcagcgaggccatggccacagaggagatgagcaacctggtgaactacatccagcctgtgaagtttgagagctttgagatcagcaagaagaggaacaagagctttgagatgagcagctttgtggagaccaagggcctggagcagctgaccaagagccctgtggagtttgtggagtacaacaagatgcagctgagccgcatctaccccaagggcaccagggtggacagcagcaactacatgccccagctgttctggaatgccggctgccagatggtggccctgaacttccagaccatggacctggccatgcagatcaacatgggcatgtatgagtacaacgggaagagcggctaccgcctgaagccagagttcatgaggaggccagacaagcactttgaccccttcacagagggcatcgtggatggcatcgtggccaacaccctgtctgtgaagatcatcagcggccagttcctgagtgacaagaaggtgggcacctacgtggaggtggacatgtttggcctgcctgtggacaccaggaggaaggccttcaagaccaagaccagccagggcaatgctgtgaaccctgtgtgggaggaggagcccatcgtgttcaagaaggtggtgctgcccaccctggcctgcctgagaattgctgtgtatgaggagggcggcaagttcatcggccaccgcatcctgcctgtgcaggccatccggcccggctaccactacatctgcctgagaaatgaaagaaaccagcccctgaccctgcctgctgtgtttgtgtacatcgaggtgaaggactatgtgcctgacacctatgcagatgtgattgaggccctgagcaaccccatccgctacgtgaacctgatggagcagagggccaagcagctggccgccctgaccctggaggatgaggaggaggtgaagaaggaggccgaccccggggagaccccatctgaggcccccagcgaggcccggaccaccccagcagaaaatggagtgaaccacaccaccaccctgacccccaagccacccagccaggccctgcacagccagcctgcccctggctctgtgaaggccccagccaagacagaagatctcatccagagcgtgctgacagaggtggaggcccagaccatcgaggagctgaagcagcagaagagctttgtgaagctgcagaagaagcactacaaggagatgaaggacctggtgaagaggcaccacaagaagaccacagacctgatcaaggagcacaccaccaagtacaatgagatccagaatgactacctgcggcggcgggccgccctggagaagagcgccaagaaggacagcaagaagaagtctgagcccagcagcccagaccacggcagcagcaccatcgagcaggacctggccgccctggatgctgagatgacccagaagctgattgacctgaaggacaagcagcagcagcagctgctgaacctgcggcaggagcagtactacagcgagaagtaccagaagcgggagcacatcaagctgctgatccagaagctgacagatgtggccgaggagtgccagaacaaccagctgaagaagctgaaggagatctgtgagaaggagaagaaggagctgaagaagaagatggacaagaagaggcaggagaagatcacagaggccaagagcaaggacaagagccagatggaggaggagaagacagagatgatccgcagctacatccaggaggtggtgcagtacatcaagaggctggaggaggcccagagcaagaggcaggagaagctggtggagaagcacaaggagatccggcagcagatcctggatgagaagcccaagggggagggcagcagcagcttcctgtctgagacctgccacgaggaccccagcgtgagccccaacttcaccccacccaacccccaggccctgaagtggtag

SEQ ID NO: 164092 - DNA, 3522 bp, Artificial Sequence; identical to SEQ ID NO: 164091
  Description of Artificial Sequence: Synthetic coding sequence

SEQ ID NO: 164093 - DNA, 699 bp, Artificial Sequence
  Description of Artificial Sequence: Synthetic coding sequence
gctggggcccagcccggggtgcacgccctgcagctgaagcctgtgtgtgtgtctgacagcctgaagaagggcaccaagtttgtgaagtgggatgatgacagcaccatcgtgacccccatcatcctgaggacagacccccagggcttcttcttctactggacagaccagaacaaggagacagagctgctggacctgagcctggtgaaggatgcccgctgtggcagacatgccaaggcccccaaggaccccaagctgcgggagctgctggatgtgggcaacatcggccgcctggagcagaggatgatcaccgtggtgtatggccctgacctggtgaacatcagccacctgaacctggtggccttccaggaggaggtggccaaggagtggaccaatgaggtgttcagcctggccaccaacctgctggcccagaacatgagcagagatgccttcctggagaaggcctacaccaagctgaagctgcaggtgaccccagagggccgcatccccctgaagaacatctaccgcctcttctctgctgacaggaagagggtggagacagccctggaggcctgcagcctgcccagcagccgggtggagaaggccaatgaggccgccaagtctgagcagagctgtgggaaggccccacccaagcacttccacctgcacttcatcaagcagaacaagatgctggagccctag

SEQ ID NO: 164094 - DNA, 93 bp, Artificial Sequence
  Description of Artificial Sequence: Synthetic coding sequence
gaggaggcccagagcaagaggcaggagaagctggtggagaagcacaaggagatccggcagcagatcctggatgagaagcccaaggtgccctag

SEQ ID NO: 164095 - DNA, 591 bp, Artificial Sequence
  Description of Artificial Sequence: Synthetic coding sequence
atcatcagcggccagttcctgagtgacaagaaggtgggcacctacgtggaggtggacatgtttggcctgcctgtggacaccaggaggaaggccttcaagaccaagaccagccagggcaatgctgtgaaccctgtgtgggaggaggagcccatcgtgttcaagaaggtggtgctgcccaccctggcctgcctgagaattgctgtgtatgaggagggcggcaagttcatcggccaccgcatcctgcctgtgcaggccatccggcccggctaccactacatctgcctgagaaatgaaagaaaccagcccctgaccctgcctgctgtgtttgtgtacatcgaggtgaaggactatgtgcctgacacctatgcagatgtgattgaggccctgagcaaccccatccgctacgtgaacctgatggagcagagggccaagcagctggccgccctgaccctggaggatgaggaggaggtgaagaaggagggcggcttcctgcatgatgagatcatgaggctgaccaggaacaccctggagaagctgatggccctgcccctgacccacgtggtgcccatccagagcaagatgctgtcctag

SEQ ID NO: 164096 - DNA, 3411 bp, Artificial Sequence
  Description of Artificial Sequence: Synthetic coding sequence
acccaggaccccaagctgcgggagctgctggatgtgggcaacatcggccgcctggagcagaggatgatcaccgtggtgtatggccctgacctggtgaacatcagccacctgaacctggtggccttccaggaggaggtggccaaggagtggaccaatgaggtgttcagcctggccaccaacctgctggcccagaacatgagcagagatgccttcctggagaaggcctacaccaagctgaagctgcaggtgaccccagagggccgcatccccctgaagaacatctaccgcctcttctctgctgacaggaagagggtggagacagccctggaggcctgcagcctgcccagcagcagaaatgacagcatcccccaggaggacttcaccccagaggtgtacagagtcttcctgaacaacctgtgccccaggcctgagattgacaacatcttcagcgagtttggagccaagagcaagccctacctgactgtggaccagatgatggacttcatcaacctgaagcagagggacccccggctgaatgagatcctgtacccacccctgaagcaggagcaggtgcaggtgctgattgagaagtatgagcccaacaacagcctggccaggaagggccagatctctgtggatggcttcatgagatacctgagcggggaggagaatggagtggtgtccccagagaagctggacctgaatgaagacatgagccagcccctgagccactacttcatcaacagcagccacaacacctacctgacagctggccagctggccggcaacagctctgtggagatgtaccggcaggtgctgctgagcggctgccgctgtgtggagctggactgctggaagggccgcacagctgaggaggagcccgtcatcacccacggcttcaccatgaccacagagatctccttcaaggaggtgattgaggccatcgcagaatgtgccttcaagaccagccccttccccatcctgctgagctttgagaaccacgtggacagccccaagcagcaggccaagatggccgagtactgccgcctcatctttggagatgccctgctgatggagcccctggagaagtaccccctggagagcggcgtgcccctgcccagccccatggacctgatgtacaagatcctggtgaagaacaagaagaagagccacaagagcagcgagggcagcggcaagaagaagctgtctgagcaggccagcaacacctacagcgacagcagctccatgtttgagcccagcagccctggggccggggaggccgacacagaaagtgatgatgatgatgatgatgatgactgcaagaagagctccatggatgagggcacagctggcagcgaggccatggccacagaggagatgagcaacctggtgaactacatccagcctgtgaagtttgagagctttgagatcagcaagaagaggaacaagagctttgagatgagcagctttgtggagaccaagggcctggagcagctgaccaagagccctgtggagtttgtggagtacaacaagatgcagctgagccgcatctaccccaagggcaccagggtggacagcagcaactacatgccccagctgttctggaatgccggctgccagatggtggccctgaacttccagaccatggacctggccatgcagatcaacatgggcatgtatgagtacaacgggaagagcggctaccgcctgaagccagagttcatgaggaggccagacaagcactttgaccccttcacagagggcatcgtggatggcatcgtggccaacaccctgtctgtgaagatcatcagcggccagttcctgagtgacaagaaggtgggcacctacgtggaggtggacatgtttggcctgcctgtggacaccaggaggaaggccttcaagaccaagaccagccagggcaatgctgtgaaccctgtgtgggaggaggagcccatcgtgttcaagaaggtggtgctgcccaccctggcctgcctgagaattgctgtgtatgaggagggcggcaagttcatcggccaccgcatcctgcctgtgcaggccatccggcccggctaccactacatctgcctgagaaatgaaagaaaccagcccctgaccctgcctgctgtgtttgtgtacatcgaggtgaaggactatgtgcctgacacctatgcagatgtgattgaggccctgagcaaccccatccgctacgtgaacctgatggagcagagggccaagcagctggccgccctgaccctggaggatgaggaggaggtgaagaaggaggccgaccccggggagaccccatctgaggcccccagcgaggcccggaccaccccagcagaaaatggagtgaaccacaccaccaccctgacccccaagccacccagccaggccctgcacagccagcctgcccctggctctgtgaaggccccagccaagacagaagatctcatccagagcgtgctgacagaggtggaggcccagaccatcgaggagctgaagcagcagaagagctttgtgaagctgcagaagaagcactacaaggagatgaaggacctggtgaagaggcaccacaagaagaccacagacctgatcaaggagcacaccaccaagtacaatgagatccagaatgactacctgcggcggcgggccgccctggagaagagcgccaagaaggacagcaagaagaagtctgagcccagcagcccagaccacggcagcagcaccatcgagcaggacctggccgccctggatgctgagatgacccagaagctgattgacctgaaggacaagcagcagcagcagctgctgaacctgcggcaggagcagtactacagcgagaagtaccagaagcgggagcacatcaagctgctgatccagaagctgacagatgtggccgaggagtgccagaacaaccagctgaagaagctgaaggagatctgtgagaaggagaagaaggagctgaagaagaagatggacaagaagaggcaggagaagatcacagaggccaagagcaaggacaagagccagatggaggaggagaagacagagatgatccgcagctacatccaggaggtggtgcagtacatcaagaggctggaggaggcccagagcaagaggcaggagaagctggtggagaagcacaaggagatccggcagcagatcctggatgagaagcccaagctgcaggtggagctggagcaggagtaccaggacaagttcaagaggctgcccctggagatcctggagtttgtgcaggaggccatgaagggcaagatcagcgaggacagcaaccacggcagcgcccccctgagcctgagcagtgaccccgggaaggtgaaccacaagacccccagcagcgaggagctgggcggggacatccctgggaaggagtttgacacccccctgtag

SEQ ID NO: 164097 - DNA, 3282 bp, Artificial Sequence
  Description of Artificial Sequence: Synthetic coding sequence
acccaggaccccaagctgcgggagctgctggatgtgggcaacatcggccgcctggagcagaggatgatcaccgtggtgtatggccctgacctggtgaacatcagccacctgaacctggtggccttccaggaggaggtggccaaggagtggaccaatgaggtgttcagcctggccaccaacctgctggcccagaacatgagcagagatgccttcctggagaaggcctacaccaagctgaagctgcaggtgaccccagagggccgcatccccctgaagaacatctaccgcctcttctctgctgacaggaagagggtggagacagccctggaggcctgcagcctgcccagcagcagaaatgacagcatcccccaggaggacttcaccccagaggtgtacagagtcttcctgaacaacctgtgccccaggcctgagattgacaacatcttcagcgagtttggagccaagagcaagccctacctgactgtggaccagatgatggacttcatcaacctgaagcagagggacccccggctgaatgagatcctgtacccacccctgaagcaggagcaggtgcaggtgctgattgagaagtatgagcccaacaacagcctggccaggaagggccagatctctgtggatggcttcatgagatacctgagcggggaggagaatggagtggtgtccccagagaagctggacctgaatgaagacatgagccagcccctgagccactacttcatcaacagcagccacaacacctacctgacagctggccagctggccggcaacagctctgtggagatgtaccggcaggtgctgctgagcggctgccgctgtgtggagctggactgctggaagggccgcacagctgaggaggagcccgtcatcacccacggcttcaccatgaccacagagatctccttcaaggaggtgattgaggccatcgcagaatgtgccttcaagaccagccccttccccatcctgctgagctttgagaaccacgtggacagccccaagcagcaggccaagatggccgagtactgccgcctcatctttggagatgccctgctgatggagcccctggagaagtaccccctggagagcggcgtgcccctgcccagccccatggacctgatgtacaagatcctggtgaagaacaagaagaagagccacaagagcagcgagggcagcggcaagaagaagctgtctgagcaggccagcaacacctacagcgacagcagctccatgtttgagcccagcagccctggggccggggaggccgacacagaaagtgatgatgatgatgatgatgatgactgcaagaagagctccatggatgagggcacagctggcagcgaggccatggccacagaggagatgagcaacctggtgaactacatccagcctgtgaagtttgagagctttgagatcagcaagaagaggaacaagagctttgagatgagcagctttgtggagaccaagggcctggagcagctgaccaagagccctgtggagtttgtggagtacaacaagatgcagctgagccgcatctaccccaagggcaccagggtggacagcagcaactacatgccccagctgttctggaatgccggctgccagatggtggccctgaacttccagaccatggacctggccatgcagatcaacatgggcatgtatgagtacaacgggaagagcggctaccgcctgaagccagagttcatgaggaggccagacaagcactttgaccccttcacagagggcatcgtggatggcatcgtggccaacaccctgtctgtgaagatcatcagcggccagttcctgagtgacaagaaggtgggcacctacgtggaggtggacatgtttggcctgcctgtggacaccaggaggaaggccttcaagaccaagaccagccagggcaatgctgtgaaccctgtgtgggaggaggagcccatcgtgttcaagaaggtggtgctgcccaccctggcctgcctgagaattgctgtgtatgaggagggcggcaagttcatcggccaccgcatcctgcctgtgcaggccatccggcccggctaccactacatctgcctgagaaatgaaagaaaccagcccctgaccctgcctgctgtgtttgtgtacatcgaggtgaaggactatgtgcctgacacctatgcagatgtgattgaggccctgagcaaccccatccgctacgtgaacctgatggagcagagggccaagcagctggccgccctgaccctggaggatgaggaggaggtgaagaaggaggccgaccccggggagaccccatctgaggcccccagcgaggcccggaccaccccagcagaaaatggagtgaaccacaccaccaccctgacccccaagccacccagccaggccctgcacagccagcctgcccctggctctgtgaaggccccagccaagacagaagatctcatccagagcgtgctgacagaggtggaggcccagaccatcgaggagctgaagcagcagaagagctttgtgaagctgcagaagaagcactacaaggagatgaaggacctggtgaagaggcaccacaagaagaccacagacctgatcaaggagcacaccaccaagtacaatgagatccagaatgactacctgcggcggcgggccgccctggagaagagcgccaagaaggacagcaagaagaagtctgagcccagcagcccagaccacggcagcagcaccatcgagcaggacctggccgccctggatgctgagatgacccagaagctgattgacctgaaggacaagcagcagcagcagctgctgaacctgcggcaggagcagtactacagcgagaagtaccagaagcgggagcacatcaagctgctgatccagaagctgacagatgtggccgaggagtgccagaacaaccagctgaagaagctgaaggagatctgtgagaaggagaagaaggagctgaagaagaagatggacaagaagaggcaggagaagatcacagaggccaagagcaaggacaagagccagatggaggaggagaagacagagatgatccgcagctacatccaggaggtggtgcagtacatcaagaggctggaggaggcccagagcaagaggcaggagaagctggtggagaagcacaaggagatccggcagcagatcctggatgagaagcccaagggggagggcagcagcagcttcctgtctgagacctgccacgaggaccccagcgtgagccccaacttcaccccacccaacccccaggccctgaagtggtag

SEQ ID NO: 164098 - DNA, 3558 bp, Artificial Sequence
  Description of Artificial Sequence: Synthetic coding sequence
atgagcctgctgaaccctgtgctgctgccccccaaggtgaaggcctacctgagccagggcgagcgcttcatcaagtgggatgatgagaccaccgtggccagccctgtgatcctgcgggtggaccccaagggctactacctgtactggacctaccagagcaaggagatggagttcctggacatcaccagcatccgggacaccaggtttgggaagtttgccaagatgcccaagagccagaagctgagagatgtgttcaacatggacttcccagacaacagcttcctgctgaagaccctgactgtggtgtctggccctgacatggtggacctgaccttccacaactttgtgtcctacaaggaaaatgtgggcaaggcctgggccgaggatgtgctggccctggtgaagcaccccctgacagccaatgccagccgcagcaccttcctggacaagatcctggtgaagctgaagatgcagctgaacagcgagggcaagatccctgtgaagaacttcttccagatgtttcctgctgacaggaagagggtggaggccgccctgagcgcctgccacctgcccaagggcaagaatgatgccatcaaccctgaggacttccctgagcctgtgtacaagagcttcctgatgagcctgtgccccaggcctgagattgatgagatcttcaccagctaccacgccaaggccaagccctacatgaccaaggagcacctgaccaagttcatcaaccagaagcagagggacagccggctgaacagcctgctcttccccccagcccggccagaccaggtgcagggcctgattgacaagtatgagcccagcggcatcaatgcccagaggggccagctgagccctgagggcatggtgtggttcctgtgtggcccagaaaattctgtgctggcccaggacaagctgctgctgcaccacgacatgacccagcccctgaaccactacttcatcaacagcagccacaacacctacctgacagctggccagttcagcggcctgagcagcgctgagatgtaccggcaggtgctgctgagcggctgccgctgtgtggagctggactgctggaagggcaagcccccagatgaggagcccatcatcacccacggcttcaccatgaccacagacatcttcttcaaggaggccatcgaggccatcgccgagagcgccttcaagaccagcccctaccccatcatcctgagctttgagaaccacgtggacagcccccggcagcaggccaagatggccgagtactgcaggaccatctttggagacatgctgctgacagagcccctggagaagttccccctgaagccaggagtgcccctgcccagccctgaggacctgcggggcaagatcctgatcaagaacaagaagaaccagttcagcggccccaccagcagcagcaaggacacaggaggagaggccgagggcagcagcccccccagcgccccagctggggagggcaccgtgtgggccggggaggagggcacagagctggaggaggaggaggtggaggaggaggaggaggaggagagcggcaacctggatgaggaggagatcaagaagatgcagagtgatgagggcacagctggcctggaggtgacagcctatgaggagatgagcagcctggtgaactacatccagcccaccaagtttgtgtcctttgagttcagcgcccagaagaacagaagctatgtgatcagcagcttcacagagctgaaggcctatgacctgctgagcaaggcctctgtgcagtttgtggactacaacaagaggcagatgagccgcatctaccccaagggcaccaggatggacagcagcaactacatgccccagatgttctggaatgccggctgccagatggtggccctgaacttccagaccatggacctgcccatgcagcagaacatggctgtgtttgagttcaacggccagagcggctacctgctgaagcatgagttcatgaggaggccagacaagcagttcaaccccttctctgtggacagaattgatgtggtggtggccaccaccctgagcatcaccgtcatcagcggccagttcctgtctgagaggtctgtgaggacctacgtggaggtggagctgtttggcctgcccggggaccccaagaggcgctaccgcaccaagctgagccccagcaccaacagcatcaaccctgtgtggaaggaggagccctttgtgtttgagaagatcctgatgcctgagctggccagcctgcgggtggccgtgatggaggagggcaacaagttcctgggccaccgcatcatccccatcaatgccctgaacagcggctaccaccacctgtgcctgcacagcgagagcaacatgcccctgaccatgcctgccctcttcatcttcctggagatgaaggactacatccctggggcctgggccgacctgactgtggccctggccaaccccatcaagttcttcagcgcccatgacaccaagtctgtgaagctgaaggaggccatgggcggcctgcctgagaagcccttccccctggccagccctgtggccagccaggtgaatggagccctggcccccaccagcaatggcagccctgctgcccgggccggggcccgggaggaggccatgaaggaggccgctgagcccaggacagccagcctggaggagctgcgggagctgaagggcgtggtgaagctgcagaggagacatgagaaggagctgcgggagctggagcggcggggggcccggcgctgggaggagctgctgcagagaggagctgcccagctggccgagctgggccccccaggagtgggcggcgtgggcgcctgcaagctgggccctgggaagggcagcaggaagaagaggagcctgccccgggaggagagcgctggagctgcccctggagagggccctgagggcgtggatggccgggtgcgggagctgaaggaccggctggagctggagctgctgcggcagggcgaggagcagtatgaatgtgtgctgaagaggaaggagcagcacgtggccgagcagatcagcaagatgatggagctggcccgggagaagcaggccgctgagctgaaggccctgaaggagaccagtgaaaatgacaccaaggagatgaagaagaagctggagaccaagaggctggagcgcatccagggcatgaccaaggtgaccacagacaagatggcccaggagcggctgaagcgggagatcaacaacagccacatccaggaggtggtgcaggtgatcaagcagatgacagagaacctggagcggcaccaggagaagctggaggagaagcaggccgcctgcctggagcagatccgggagatggagaagcagttccagaaggaggccctggccgagtatgaggccaggatgaagggcctggaggccgaggtgaaggagagcgtgcgggcctgcctgcggacctgcttccccagcgaggccaaggacaagccagagcgggcctgtgaatgtcctcctgagctgtgtgagcaggaccccctgattgccaaggcagatgcccaggagagccggctgtag

SEQ ID NO: 164099 - DNA, 3546 bp, Artificial Sequence
  Description of Artificial Sequence: Synthetic coding sequence
atgagcctgctgaaccctgtgctgctgccccccaaggtgaaggcctacctgagccagggcgagcgcttcatcaagtgggatgatgagaccaccgtggccagccctgtgatcctgcgggtggaccccaagggctactacctgtactggacctaccagagcaaggagatggagttcctggacatcaccagcatccgggacaccaggtttgggaagtttgccaagatgcccaagagccagaagctgagagatgtgttcaacatggacttcccagacaacagcttcctgctgaagaccctgactgtggtgtctggccctgacatggtggacctgaccttccacaactttgtgtcctacaaggaaaatgtgggcaaggcctgggccgaggatgtgctggccctggtgaagcaccccctgacagccaatgccagccgcagcaccttcctggacaagatcctggtgaagctgaagatgcagctgaacagcgagggcaagatccctgtgaagaacttcttccagatgtttcctgctgacaggaagagggtggaggccgccctgagcgcctgccacctgcccaagggcaagaatgatgccatcaaccctgaggacttccctgagcctgtgtacaagagcttcctgatgagcctgtgccccaggcctgagattgatgagatcttcaccagctaccacgccaaggccaagccctacatgaccaaggagcacctgaccaagttcatcaaccagaagcagagggacagccggctgaacagcctgctcttccccccagcccggccagaccaggtgcagggcctgattgacaagtatgagcccagcggcatcaatgcccagaggggccagctgagccctgagggcatggtgtggttcctgtgtggcccagaaaattctgtgctggcccaggacaagctgctgctgcaccacgacatgacccagcccctgaaccactacttcatcaacagcagccacaacacctacctgacagctggccagttcagcggcctgagcagcgctgagatgtaccggcaggtgctgctgagcggctgccgctgtgtggagctggactgctggaagggcaagcccccagatgaggagcccatcatcacccacggcttcaccatgaccacagacatcttcttcaaggaggccatcgaggccatcgccgagagcgccttcaagaccagcccctaccccatcatcctgagctttgagaaccacgtggacagcccccggcagcaggccaagatggccgagtactgcaggaccatctttggagacatgctgctgacagagcccctggagaagttccccctgaagccaggagtgcccctgcccagccctgaggacctgcggggcaagatcctgatcaagaacaagaagaaccagttcagcggccccaccagcagcagcaaggacacaggaggagaggccgagggcagcagcccccccagcgccccagctgtgtgggccggggaggagggcacagagctggaggaggaggaggtggaggaggaggaggaggaggagagcggcaacctggatgaggaggagatcaagaagatgcagagtgatgagggcacagctggcctggaggtgacagcctatgaggagatgagcagcctggtgaactacatccagcccaccaagtttgtgtcctttgagttcagcgcccagaagaacagaagctatgtgatcagcagcttcacagagctgaaggcctatgacctgctgagcaaggcctctgtgcagtttgtggactacaacaagaggcagatgagccgcatctaccccaagggcaccaggatggacagcagcaactacatgccccagatgttctggaatgccggctgccagatggtggccctgaacttccagaccatggacctgcccatgcagcagaacatggctgtgtttgagttcaacggccagagcggctacctgctgaagcatgagttcatgaggaggccagacaagcagttcaaccccttctctgtggacagaattgatgtggtggtggccaccaccctgagcatcaccgtcatcagcggccagttcctgtctgagaggtctgtgaggacctacgtggaggtggagctgtttggcctgcccggggaccccaagaggcgctaccgcaccaagctgagccccagcaccaacagcatcaaccctgtgtggaaggaggagccctttgtgtttgagaagatcctgatgcctgagctggccagcctgcgggtggccgtgatggaggagggcaacaagttcctgggccaccgcatcatccccatcaatgccctgaacagcggctaccaccacctgtgcctgcacagcgagagcaacatgcccctgaccatgcctgccctcttcatcttcctggagatgaaggactacatccctggggcctgggccgacctgactgtggccctggccaaccccatcaagttcttcagcgcccatgacaccaagtctgtgaagctgaaggaggccatgggcggcctgcctgagaagcccttccccctggccagccctgtggccagccaggtgaatggagccctggcccccaccagcaatggcagccctgctgcccgggccggggcccgggaggaggccatgaaggaggccgctgagcccaggacagccagcctggaggagctgcgggagctgaagggcgtggtgaagctgcagaggagacatgagaaggagctgcgggagctggagcggcggggggcccggcgctgggaggagctgctgcagagaggagctgcccagctggccgagctgggccccccaggagtgggcggcgtgggcgcctgcaagctgggccctgggaagggcagcaggaagaagaggagcctgccccgggaggagagcgctggagctgcccctggagagggccctgagggcgtggatggccgggtgcgggagctgaaggaccggctggagctggagctgctgcggcagggcgaggagcagtatgaatgtgtgctgaagaggaaggagcagcacgtggccgagcagatcagcaagatgatggagctggcccgggagaagcaggccgctgagctgaaggccctgaaggagaccagtgaaaatgacaccaaggagatgaagaagaagctggagaccaagaggctggagcgcatccagggcatgaccaaggtgaccacagacaagatggcccaggagcggctgaagcgggagatcaacaacagccacatccaggaggtggtgcaggtgatcaagcagatgacagagaacctggagcggcaccaggagaagctggaggagaagcaggccgcctgcctggagcagatccgggagatggagaagcagttccagaaggaggccctggccgagtatgaggccaggatgaagggcctggaggccgaggtgaaggagagcgtgcgggcctgcctgcggacctgcttccccagcgaggccaaggacaagccagagcgggcctgtgaatgtcctcctgagctgtgtgagcaggaccccctgattgccaaggcagatgcccaggagagccggctgtag

SEQ ID NO: 164100 - DNA, 3705 bp, Artificial Sequence
  Description of Artificial Sequence: Synthetic coding sequence
atggccggggcccagcccggggtgcacgccctgcagctggagcccccaacagtggtggagaccctgcggcggggcagcaagttcatcaagtgggatgaggagaccagcagcaggaacctggtgaccctgcgggtggaccccaacggcttcttcctgtactggacaggccccaacatggaggtggacaccctggacatcagcagcatccgggacaccaggacaggccgctatgcccggctgcccaaggaccccaagatccgggaggtgctgggctttggaggcccagatgcccggctggaggagaagctgatgacagtggtgtctggccctgaccctgtgaacacagtgttcctgaacttcatggctgtgcaggatgacacagccaaggtgtggagcgaggagctgttcaagctggccatgaacatcctggcccagaatgccagcaggaacaccttcctgaggaaggcctacaccaagctgaagctgcaggtgaaccaggacggccgcatccctgtgaagaacatcctgaagatgttttctgctgacaagaagagggtggagacagccctggagagctgtggcctgaagttcaacagaagtgagagcatccggccagatgagttcagcctggagatctttgagcgcttcctgaacaagctgtgcctgcggccagacatcgacaagatcctgctggagattggagccaagggcaagccctacctgaccctggagcagctgatggacttcatcaaccagaagcagagggacccccggctgaatgaggtgctgtacccacccctgcggcccagccaggcccggctgctgattgagaagtatgagcccaaccagcagttcctggagcgggaccagatgtccatggagggcttcagccgctacctgggcggggaggagaatggcatcctgcccctggaggccctggacctgagcacagacatgacccagcccctgagcgcctacttcatcaacagcagccacaacacctacctgacagctggccagctggccggcaccagctctgtggagatgtaccggcaggccctgctgtggggctgccgctgtgtggagctggatgtgtggaagggccggcccccagaggaggagcccttcatcacccacggcttcaccatgaccacagaggtgcccctgagagatgtgctggaggccatcgccgagacagccttcaagaccagcccctaccctgtgatcctgagctttgaaaatcatgtggacagcgccaagcagcaggccaagatggccgagtactgccgcagcatctttggagatgccctgctgattgagcccctggacaagtaccccctggcccctggggtgcccctgcccagcccccaggacctgatgggccgcatcctggtgaagaacaagaagaggcaccggcccagcgctgggggccctgacagcgctggcaggaagaggcccctggagcagagcaacagcgccctgtctgagagcagcgctgccacagagcccagcagcccccagctgggcagccccagcagtgacagctgccccggcctgagcaatggagaggaggtgggcctggagaagcccagcctggagccccagaagagcctgggagatgagggcctgaacagaggcccctacgtgctgggccctgctgaccgggaggatgaggaggaggatgaggaggaggaggagcagacagaccccaagaagcccaccacagatgagggcacagccagcagcgaggtgaatgccacagaggagatgagcaccctggtgaactacatcgagcctgtgaagttcaagagctttgaagctgccaggaagagaaataaatgttttgagatgagcagctttgtggagaccaaggccatggagcagctgaccaagagccccatggagtttgtggagtacaacaagcagcagctgagccgcatctaccccaagggcaccagggtggacagcagcaactacatgccccagctgttctggaatgtgggctgccagctggtggccctgaacttccagaccctggatgtggccatgcagctgaatgctggggtgtttgagtacaacggccgcagcggctacctgctgaagccagagttcatgaggaggccagacaagagctttgaccccttcacagaggtgattgtggatggcatcgtggccaatgccctgcgggtgaaggtgatcagcggccagttcctgagtgacaggaaggtgggcatctacgtggaggtggacatgtttggcctgcctgtggacaccaggaggaagtaccgcaccaggaccagccagggcaacagcttcaaccctgtgtgggatgaggagccctttgacttccccaaggtggtgctgcccaccctggccagcctgagaattgctgcctttgaggagggcggcaagtttgtgggccaccgcatcctgcctgtgtctgccatccgcagcggctaccactacgtgtgcctgagaaatgaggccaaccagcccctgtgcctgcctgccctgctgatctacacagaggccagtgactacatcccagatgaccaccaggactatgcagaggccctgatcaaccccatcaagcacgtgtccctgatggaccagagggcccggcagctggccgccctgattggagagagcgaggcccaggccggccaggagacctgccaggacacccagagccagcagctgggcagccagcccagcagcaaccccacccccagccccctggatgccagcccccggcggcccccaggccccaccaccagccctgccagcaccagcctgagcagccctggccagagagatgacctgattgccagcatcctgtctgaggtggcccccacccccctggatgagctgcggggccacaaggccctggtgaagctgcggagccggcaggagcgggacctgcgggagctgaggaagaagcaccagaggaaggctgtgaccctgacccggcggctgctggatggcctggcccaggcccaggccgagggccgctgccgcctgcggcctggggccctgggcggcgctgctgatgtggaggacaccaaggagggagaagatgaggccaagcgctaccaggagttccagaaccggcaggtgcagagcctgctggagctgcgggaggcccaggtggatgctgaggcccagaggcggctggagcacctgcggcaggccctgcagaggctgcgggaggtggtgctggatgccaacaccacccagttcaagaggctgaaggagatgaatgaaagagagaagaaggagctgcagaagatcctggacaggaagaggcacaacagcatcagcgaggccaagatgagggacaagcacaagaaggaggccgagctgacagagatcaacagaagacacatcacagagagcgtgaacagcatccggcggctggaggaggcccagaagcagagacatgaccggctggtggccggccagcagcaggtgctgcagcagctggccgaggaggagcccaagctgctggcccagctggcccaggagtgccaggagcagagggcccggctgccccaggagatccgccgcagcctgctgggggagatgcctgagggcctgggagatggccccctggtggcctgtgccagcaatggccacgcccctggcagcagcggccacctgtctggagctgacagcgagagccaggaggagaacacccagctgtag

SEQ ID NO: 164101 - DNA, 3705 bp, Artificial Sequence; identical to SEQ ID NO: 164100
  Description of Artificial Sequence: Synthetic coding sequence

SEQ ID NO: 164102 - DNA, 3528 bp, Artificial Sequence
  Description of Artificial Sequence: Synthetic coding sequence
atggccaagccctatgagttcaactggcagaaggaggtgcccagcttcctgcaggagggcgctgtgtttgacagatatgaggaggagagctttgtgtttgagcccaactgcctcttcaaggtggatgaatttggcttcttcctgacctggaggtctgagggcaaggagggccaggtgctggagtgcagcctcatcaacagcatccgcagcggggccatccccaaggaccccaagatcctggccgccctggaggccgtgggcaagtcagaaaatgacctggagggcagaattgtgtgtgtgtgcagcggcacagacctggtgaacatctccttcacctacatggtggctgaaaatcctgaggtgaccaagcagtgggtggagggcctgcggagcatcatccacaacttccgggccaacaacgtgagccccatgacctgcctgaagaagcactggatgaagctggccttcatgaccaacaccaacgggaagatccctgtgcgcagcatcaccaggacctttgccagcggcaagacagagaaggtgatcttccaggccctgaaggagctgggcctgcccagcggcaagaatgatgaaattgagcccacagccttctcctatgagaagttctatgagctgacccagaagatctgccccaggacagacattgaagatctcttcaagaagatcaacggggacaagacagactacctgactgtggaccagctggtgtccttcctgaatgagcaccagagggacccccggctgaatgagatcctcttccccttctatgatgccaagagggccatgcagatcatcgagatgtatgagccagatgaggacctgaagaagaagggcctcatcagcagtgatggcttctgccgctacctgatgtctgatgaaaatgcccctgtgttcctggaccggctggagctgtaccaggagatggaccaccccctggcccactacttcatcagcagcagccacaacacctacctgaccggccggcagtttggaggcaagagctctgtggagatgtaccggcaggtgctgctggccggctgccgctgtgtggagctggactgctgggatggaaaaggagaggaccaggagcccatcatcacccacggcaaggccatgtgcacagacatcctcttcaaggatgtgatccaggccatcaaggagacagcctttgtgaccagcgagtaccctgtgatcctgagctttgagaaccactgcagcaagtaccagcagtacaagatgagcaagtactgtgaggacctgtttggagacctgctgctgaagcaggccctggagagccaccccctggagcccggccgggccctgcccagccccaatgacctgaagaggaagatcctgatcaagaacaagaggctgaagccagaggtggagaagaagcagctggaggccctgcgctccatgatggaggccggggagagcgccagccctgccaacatcctggaggatgacaatgaggaggagattgaatctgctgaccaggaggaggaggcccaccctgagttcaagtttggaaatgagctgtctgcagatgacctgggccacaaggaggccgtggccaacagcgtgaagaagggcctggtgacagtggaggatgagcaggcctggatggccagctacaagtatgtgggcgccaccaccaacatccacccctacctgagcaccatgatcaactatgcccagcctgtgaagttccagggcttccacgtggccgaggagaggaacatccactacaacatgagcagcttcaatgaatctgtgggcctgggctacctgaagacccacgccattgaatttgtgaactacaacaagaggcagatgagccgcatctaccccaagggcggccgggtggacagcagcaactacatgccccagatcttctggaatgccggctgccagatggtgtccctgaactaccagaccccagacctggccatgcagctgaaccagggcaagtttgagtacaacggcagctgtggctacctgctgaagccagacttcatgagaagaccagacaggacctttgaccccttcagcgagacccctgtggatggagtgattgctgccacctgcagcgtgcaggtgatcagcggccagttcctgagtgacaagaagattggcacctacgtggaggtggacatgtatggcctgcccacagacaccatcaggaaggagttccgcaccaggatggtgatgaacaacggcctgaaccctgtgtacaatgaggagagctttgtgttcaggaaggtgatcctgcctgacctggccgtgctgagaattgctgtgtatgatgacaacaacaagctgattggccagaggatcctgcccctggatggcctgcaggccggctaccgccacatcagcctgagaaatgaaggcaacaagcccctgagcctgcccaccatcttctgcaacatcgtgctgaagacctacgtgcctgatggctttggagacatcgtggatgccctgagtgaccccaagaagttcctgagcatcacagagaagagagctgaccagatgagggccatgggcatcgagaccagtgacattgctgatgtgcccagcgacaccagcaagaatgacaagaagggcaaggccaacacagccaaggccaacgtgaccccccagagcagcagcgagctgcggcccaccaccacagctgccctggccagcggcgtggaggccaagaagggcatcgagctgatcccccaggtgagaattgaggacctgaagcagatgaaggcctacctgaagcacctgaagaagcagcagaaggagctgaacagcctgaagaagaagcacgccaaggagcacagcaccatgcagaagctgcactgcacccaggtggacaagatcgtggcccagtatgacaaggagaagagcacccatgagaagatcctggagaaggccatgaagaagaagggcggcagcaactgcctggagatgaagaaggagacagagatcaagatccagaccctgaccagtgaccacaagagcaaggtgaaggagatcgtggcccagcacaccaaggagtggagcgagatgatcaacacccacagcgctgaggagcaggagatccgggacctgcacctgagccagcagtgtgagctgctgaagaagctgctgatcaatgcccacgagcagcagacccagcagctgaagctgagccatgaccgggagagcaaggagatgagggcccaccaggccaagatctccatggagaacagcaaggccatcagccaggacaagagcatcaagaacaaggccgagcgggagaggagagtgcgggagctgaacagcagcaacaccaagaagttcctggaggagaggaagaggctggccatgaagcagagcaaggagatggaccagctgaagaaggtgcagctggagcacctggagttcctggagaagcagaatgagcaggccaaggagatgcagcagatggtgaagctggaggccgagatggacagaagacctgccaccgtggtgtag

SEQ ID NO: 164103 - DNA, 3585 bp, Artificial Sequence
  Description of Artificial Sequence: Synthetic coding sequence
atggccaagccctatgagttcaactggcagaaggaggtgcccagcttcctgcaggagggcgctgtgtttgacagatatgaggaggagagctttgtgtttgagcccaactgcctcttcaaggtggatgaatttggcttcttcctgacctggaggtctgagggcaaggagggccaggtgctggagtgcagcctcatcaacagcatccgcagcggggccatccccaaggaccccaagatcctggccgccctggaggccgtgggcaagtcagaaaatgacctggagggcagaattgtgtgtgtgtgcagcggcacagacctggtgaacatctccttcacctacatggtggctgaaaatcctgaggtgaccaagcagtgggtggagggcctgcggagcatcatccacaacttccgggccaacaacgtgagccccatgacctgcctgaagaagcactggatgaagctggccttcatgaccaacaccaacgggaagatccctgtgcgcagcatcaccaggacctttgccagcggcaagacagagaaggtgatcttccaggccctgaaggagctgggcctgcccagcggcaagaatgatgaaattgagcccacagccttctcctatgagaagttctatgagctgacccagaagatctgccccaggacagacattgaagatctcttcaagaagatcaacggggacaagacagactacctgactgtggaccagctggtgtccttcctgaatgagcaccagagggacccccggctgaatgagatcctcttccccttctatgatgccaagagggccatgcagatcatcgagatgtatgagccagatgaggacctgaagaagaagggcctcatcagcagtgatggcttctgccgctacctgatgtctgatgaaaatgcccctgtgttcctggaccggctggagctgtaccaggagatggaccaccccctggcccactacttcatcagcagcagccacaacacctacctgaccggccggcagtttggaggcaagagctctgtggagatgtaccggcaggtgctgctggccggctgccgctgtgtggagctggactgctgggatggaaaaggagaggaccaggagcccatcatcacccacggcaaggccatgtgcacagacatcctcttcaaggatgtgatccaggccatcaaggagacagcctttgtgaccagcgagtaccctgtgatcctgagctttgagaaccactgcagcaagtaccagcagtacaagatgagcaagtactgtgaggacctgtttggagacctgctgctgaagcaggccctggagagccaccccctggagcccggccgggccctgcccagccccaatgacctgaagaggaagatcctgatcaagaacaagaggctgaagccagaggtggagaagaagcagctggaggccctgcgctccatgatggaggccggggagagcgccagccctgccaacatcctggaggatgacaatgaggaggagattgaatctgctgaccaggaggaggaggcccaccctgagttcaagtttggaaatgagctgtctgcagatgacctgggccacaaggaggccgtggccaacagcgtgaagaagggcctggtgacagtggaggatgagcaggcctggatggccagctacaagtatgtgggcgccaccaccaacatccacccctacctgagcaccatgatcaactatgcccagcctgtgaagttccagggcttccacgtggccgaggagaggaacatccactacaacatgagcagcttcaatgaatctgtgggcctgggctacctgaagacccacgccattgaatttgtgaactacaacaagaggcagatgagccgcatctaccccaagggcggccgggtggacagcagcaactacatgccccagatcttctggaatgccggctgccagatggtgtccctgaactaccagaccccagacctggccatgcagctgaaccagggcaagtttgagtacaacggcagctgtggctacctgctgaagccagacttcatgagaagaccagacaggacctttgaccccttcagcgagacccctgtggatggagtgattgctgccacctgcagcgtgcaggtgatcagcggccagttcctgagtgacaagaagattggcacctacgtggaggtggacatgtatggcctgcccacagacaccatcaggaaggagttccgcaccaggatggtgatgaacaacggcctgaaccctgtgtacaatgaggagagctttgtgttcaggaaggtgatcctgcctgacctggccgtgctgagaattgctgtgtatgatgacaacaacaagctgattggccagaggatcctgcccctggatggcctgcaggccggctaccgccacatcagcctgagaaatgaaggcaacaagcccctgagcctgcccaccatcttctgcaacatcgtgctgaagacctacgtgcctgatggctttggagacatcgtggatgccctgagtgaccccaagaagttcctgagcatcacagagaagagagctgaccagatgagggccatgggcatcgagaccagtgacattgctgatgtgcccagcgacaccagcaagaatgacaagaagggcaaggccaacacagccaaggccaacgtgaccccccagagcagcagcgagctgcggcccaccaccacagctgccctggccagcggcgtggaggccaagaagggcatcgagctgatcccccaggtgagaattgaggacctgaagcagatgaaggcctacctgaagcacctgaagaagcagcagaaggagctgaacagcctgaagaagaagcacgccaaggagcacagcaccatgcagaagctgcactgcacccaggtggacaagatcgtggcccagtatgacaaggagaagagcacccatgagaagatcctggagaaggccatgaagaagaagggcggcagcaactgcctggagatgaagaaggagacagagatcaagatccagaccctgaccagtgaccacaagagcaaggtgaaggagatcgtggcccagcacaccaaggagtggagcgagatgatcaacacccacagcgctgaggagcaggagatccgggacctgcacctgagccagcagtgtgagctgctgaagaagctgctgatcaatgcccacgagcagcagacccagcagctgaagctgagccatgaccgggagagcaaggagatgagggcccaccaggccaagatctccatggagaacagcaaggccatcagccaggacaagagcatcaagaacaaggccgagcgggagaggagagtgcgggagctgaacagcagcaacaccaagaagttcctggaggagaggaagaggctggccatgaagcagagcaaggagatggaccagctgaagaaggtgcagctggagcacctggagttcctggagaagcagaatgagcagctgctgaagagctgccacgctgtgtcccagacccagggcgagggagatgctgctgatggagaaattggcagcagagatggcccccagaccagcaacagctccatgaagctgcagaatgccaactag

SEQ ID NO: 164104 - DNA, 3564 bp, Artificial Sequence
  Description of Artificial Sequence: Synthetic coding sequence
atggccaagccctatgagttcaactggcagaaggaggtgcccagcttcctgcaggagggcgctgtgtttgacagatatgaggaggagagctttgtgtttgagcccaactgcctcttcaaggtggatgaatttggcttcttcctgacctggaggtctgagggcaaggagggccaggtgctggagtgcagcctcatcaacagcatccgcagcggggccatccccaaggaccccaagatcctggccgccctggaggccgtgggcaagtcagaaaatgacctggagggcagaattgtgtgtgtgtgcagcggcacagacctggtgaacatctccttcacctacatggtggctgaaaatcctgaggtgaccaagcagtgggtggagggcctgcggagcatcatccacaacttccgggccaacaacgtgagccccatgacctgcctgaagaagcactggatgaagctggccttcatgaccaacaccaacgggaagatccctgtgcgcagcatcaccaggacctttgccagcggcaagacagagaaggtgatcttccaggccctgaaggagctgggcctgcccagcggcaagaatgatgaaattgagcccacagccttctcctatgagaagttctatgagctgacccagaagatctgccccaggacagacattgaagatctcttcaagaagatcaacggggacaagacagactacctgactgtggaccagctggtgtccttcctgaatgagcaccagagggacccccggctgaatgagatcctcttccccttctatgatgccaagagggccatgcagatcatcgagatgtatgagccagatgaggacctgaagaagaagggcctcatcagcagtgatggcttctgccgctacctgatgtctgatgaaaatgcccctgtgttcctggaccggctggagctgtaccaggagatggaccaccccctggcccactacttcatcagcagcagccacaacacctacctgaccggccggcagtttggaggcaagagctctgtggagatgtaccggcaggtgctgctggccggctgccgctgtgtggagctggactgctgggatggaaaaggagaggaccaggagcccatcatcacccacggcaaggccatgtgcacagacatcctcttcaaggatgtgatccaggccatcaaggagacagcctttgtgaccagcgagtaccctgtgatcctgagctttgagaaccactgcagcaagtaccagcagtacaagatgagcaagtactgtgaggacctgtttggagacctgctgctgaagcaggccctggagagccaccccctggagcccggccgggccctgcccagccccaatgacctgaagaggaagatcctgatcaagaacaagaggctgaagccagaggtggagaagaagcagctggaggccctgcgctccatgatggaggccggggagagcgccagccctgccaacatcctggaggatgacaatgaggaggagattgaatctgctgaccaggaggaggaggcccaccctgagttcaagtttggaaatgagctgtctgcagatgacctgggccacaaggaggccgtggccaacagcgtgaagaaggccagtgatgacctggagcacgagaacaacaagaagggcctggtgacagtggaggatgagcaggcctggatggccagctacaagtatgtgggcgccaccaccaacatccacccctacctgagcaccatgatcaactatgcccagcctgtgaagttccagggcttccacgtggccgaggagaggaacatccactacaacatgagcagcttcaatgaatctgtgggcctgggctacctgaagacccacgccattgaatttgtgaactacaacaagaggcagatgagccgcatctaccccaagggcggccgggtggacagcagcaactacatgccccagatcttctggaatgccggctgccagatggtgtccctgaactaccagaccccagacctggccatgcagctgaaccagggcaagtttgagtacaacggcagctgtggctacctgctgaagccagacttcatgagaagaccagacaggacctttgaccccttcagcgagacccctgtggatggagtgattgctgccacctgcagcgtgcaggtgatcagcggccagttcctgagtgacaagaagattggcacctacgtggaggtggacatgtatggcctgcccacagacaccatcaggaaggagttccgcaccaggatggtgatgaacaacggcctgaaccctgtgtacaatgaggagagctttgtgttcaggaaggtgatcctgcctgacctggccgtgctgagaattgctgtgtatgatgacaacaacaagctgattggccagaggatcctgcccctggatggcctgcaggccggctaccgccacatcagcctgagaaatgaaggcaacaagcccctgagcctgcccaccatcttctgcaacatcgtgctgaagacctacgtgcctgatggctttggagacatcgtggatgccctgagtgaccccaagaagttcctgagcatcacagagaagagagctgaccagatgagggccatgggcatcgagaccagtgacattgctgatgtgcccagcgacaccagcaagaatgacaagaagggcaaggccaacacagccaaggccaacgtgaccccccagagcagcagcgagctgcggcccaccaccacagctgccctggccagcggcgtggaggccaagaagggcatcgagctgatcccccaggtgagaattgaggacctgaagcagatgaaggcctacctgaagcacctgaagaagcagcagaaggagctgaacagcctgaagaagaagcacgccaaggagcacagcaccatgcagaagctgcactgcacccaggtggacaagatcgtggcccagtatgacaaggagaagagcacccatgagaagatcctggagaaggccatgaagaagaagggcggcagcaactgcctggagatgaagaaggagacagagatcaagatccagaccctgaccagtgaccacaagagcaaggtgaaggagatcgtggcccagcacaccaaggagtggagcgagatgatcaacacccacagcgctgaggagcaggagatccgggacctgcacctgagccagcagtgtgagctgctgaagaagctgctgatcaatgcccacgagcagcagacccagcagctgaagctgagccatgaccgggagagcaaggagatgagggcccaccaggccaagatctccatggagaacagcaaggccatcagccaggacaagagcatcaagaacaaggccgagcgggagaggagagtgcgggagctgaacagcagcaacaccaagaagttcctggaggagaggaagaggctggccatgaagcagagcaaggagatggaccagctgaagaaggtgcagctggagcacctggagttcctggagaagcagaatgagcaggccaaggagatgcagcagatggtgaagctggaggccgagatggacagaagacctgccaccgtggtgtag

SEQ ID NO: 164105 - DNA, 3528 bp, Artificial Sequence; identical to SEQ ID NO: 164102
  Description of Artificial Sequence: Synthetic coding sequence

SEQ ID NO: 164106 - DNA, 3585 bp, Artificial Sequence; identical to SEQ ID NO: 164103
  Description of Artificial Sequence: Synthetic coding sequence

SEQ ID NO: 164107 - DNA, 342 bp, Artificial Sequence
  Description of Artificial Sequence: Synthetic coding sequence
atggccaagccctatgagttcaactggcagaaggaggtgcccagcttcctgcaggagggcgctgtgtttgacagatatgaggaggagagctttgtgtttgagcccaactgcctcttcaaggtggatgaatttggcttcttcctgacctggaggtctgagggcaaggagggccaggtgctggagtgcagcctcatcaacagcatccgcagcggggccatccccaaggaccccaagatcctggccgccctggaggccgtgggcaagtcagaaaatgacctggagggcagaattgtgtgtgtgtgcagcggcacagacctggtgaacatctccttcacctactag

SEQ ID NO: 164108 - DNA, 3072 bp, Artificial Sequence
  Description of Artificial Sequence: Synthetic coding sequence
cctgtgcgcagcatcaccaggacctttgccagcggcaagacagagaaggtgatcttccaggccctgaaggagctgggcctgcccagcggcaagaatgatgaaattgagcccacagccttctcctatgagaagttctatgagctgacccagaagatctgccccaggacagacattgaagatctcttcaagaagatcaacggggacaagacagactacctgactgtggaccagctggtgtccttcctgaatgagcaccagagggacccccggctgaatgagatcctcttccccttctatgatgccaagagggccatgcagatcatcgagatgtatgagccagatgaggacctgaagaagaagggcctcatcagcagtgatggcttctgccgctacctgatgtctgatgaaaatgcccctgtgttcctggaccggctggagctgtaccaggagatggaccaccccctggcccactacttcatcagcagcagccacaacacctacctgaccggccggcagtttggaggcaagagctctgtggagatgtaccggcaggtgctgctggccggctgccgctgtgtggagctggactgctgggatggaaaaggagaggaccaggagcccatcatcacccacggcaaggccatgtgcacagacatcctcttcaaggatgtgatccaggccatcaaggagacagcctttgtgaccagcgagtaccctgtgatcctgagctttgagaaccactgcagcaagtaccagcagtacaagatgagcaagtactgtgaggacctgtttggagacctgctgctgaagcaggccctggagagccaccccctggagcccggccgggccctgcccagccccaatgacctgaagaggaagatcctgatcaagaacaagaggctgaagccagaggtggagaagaagcagctggaggccctgcgctccatgatggaggccggggagagcgccagccctgccaacatcctggaggatgacaatgaggaggagattgaatctgctgaccaggaggaggaggcccaccctgagttcaagtttggaaatgagctgtctgcagatgacctgggccacaaggaggccgtggccaacagcgtgaagaaggccagtgatgacctggagcacgagaacaacaagaagggcctggtgacagtggaggatgagcaggcctggatggccagctacaagtatgtgggcgccaccaccaacatccacccctacctgagcaccatgatcaactatgcccagcctgtgaagttccagggcttccacgtggccgaggagaggaacatccactacaacatgagcagcttcaatgaatctgtgggcctgggctacctgaagacccacgccattgaatttgtgaactacaacaagaggcagatgagccgcatctaccccaagggcggccgggtggacagcagcaactacatgccccagatcttctggaatgccggctgccagatggtgtccctgaactaccagaccccagacctggccatgcagctgaaccagggcaagtttgagtacaacggcagctgtggctacctgctgaagccagacttcatgagaagaccagacaggacctttgaccccttcagcgagacccctgtggatggagtgattgctgccacctgcagcgtgcaggtgatcagcggccagttcctgagtgacaagaagattggcacctacgtggaggtggacatgtatggcctgcccacagacaccatcaggaaggagttccgcaccaggatggtgatgaacaacggcctgaaccctgtgtacaatgaggagagctttgtgttcaggaaggtgatcctgcctgacctggccgtgctgagaattgctgtgtatgatgacaacaacaagctgattggccagaggatcctgcccctggatggcctgcaggccggctaccgccacatcagcctgagaaatgaaggcaacaagcccctgagcctgcccaccatcttctgcaacatcgtgctgaagacctacgtgcctgatggctttggagacatcgtggatgccctgagtgaccccaagaagttcctgagcatcacagagaagagagctgaccagatgagggccatgggcatcgagaccagtgacattgctgatgtgcccagcgacaccagcaagaatgacaagaagggcaaggccaacacagccaaggccaacgtgaccccccagagcagcagcgagctgcggcccaccaccacagctgccctggccagcggcgtggaggccaagaagggcatcgagctgatcccccaggtgagaattgaggacctgaagcagatgaaggcctacctgaagcacctgaagaagcagcagaaggagctgaacagcctgaagaagaagcacgccaaggagcacagcaccatgcagaagctgcactgcacccaggtggacaagatcgtggcccagtatgacaaggagaagagcacccatgagaagatcctggagaaggccatgaagaagaagggcggcagcaactgcctggagatgaagaaggagacagagatcaagatccagaccctgaccagtgaccacaagagcaaggtgaaggagatcgtggcccagcacaccaaggagtggagcgagatgatcaacacccacagcgctgaggagcaggagatccgggacctgcacctgagccagcagtgtgagctgctgaagaagctgctgatcaatgcccacgagcagcagacccagcagctgaagctgagccatgaccgggagagcaaggagatgagggcccaccaggccaagatctccatggagaacagcaaggccatcagccaggacaagagcatcaagaacaaggccgagcgggagaggagagtgcgggagctgaacagcagcaacaccaagaagttcctggaggagaggaagaggctggccatgaagcagagcaaggagatggaccagctgaagaaggtgcagctggagcacctggagttcctggagaagcagaatgagcaggccaaggagatgcagcagatggtgaagctggaggccgagatggacagaagacctgccaccgtggtgtag

SEQ ID NO: 164109 - DNA, 183 bp, Artificial Sequence
  Description of Artificial Sequence: Synthetic coding sequence
atggccaagccctatgagttcaactggcagaaggaggtgcccagcttcctgcaggagggcgctgtgtttgacagatatgaggaggagagctttgtgtttgagcccaactgcctcttcaaggtggatgaatttggcttcttcctgacctggaggtctgagggcaaggagggccaggtgctgtag

SEQ ID NO: 164110 - DNA, 246 bp, Artificial Sequence
  Description of Artificial Sequence: Synthetic coding sequence
atggccaagccctatgagttcaactggcagaaggaggtgcccagcttcctgcaggagggcgctgtgtttgacagatatgaggaggagagctttgtgtttgagcccaactgcctcttcaaggtggatgaatttggcttcttcctgacctggaggtctgagggcaaggagggccaggtgctggagtgcagcctcatcaacagcatccgcagcggggccatccccaaggaccccaagatcctggcctag

SEQ ID NO: 164111 - DNA, 333 bp, Artificial Sequence
  Description of Artificial Sequence: Synthetic coding sequence
atggccaagccctatgagttcaactggcagaaggaggtgcccagcttcctgcaggagggcgctgtgtttgacagatatgaggaggagagctttgtgtttgagcccaactgcctcttcaaggtggatgaatttggcttcttcctgacctggaggtctgagggcaaggagggccaggtgctggagtgcagcctcatcaacagcatccgcagcggggccatccccaaggaccccaagatcctggccgccctggaggccgtgggcaagtcagaaaatgacctggagggcagaattgtgtgtgtgtgcagcggcacagacctggtgaacatctcctag

SEQ ID NO: 164112 - DNA, 2271 bp, Artificial Sequence
  Description of Artificial Sequence: Synthetic coding sequence
atggattctggccgggacttcctgaccctgcacggcctgcaggatgatgaggacctgcaggccctgctgaagggcagccagctgctgaaggtgaagagcagctcctggaggcgggagcgcttctacaagctgcaggaggactgcaagaccatctggcaggagagcaggaaggtgatgaggaccccagagagccagctgttcagcattgaggacatccaggaggtgaggatgggccacaggacagagggcctggagaagtttgccagagatgtgcctgaagatcgctgcttcagcatcgtgttcaaggaccagaggaacaccctggacctgattgcccccagccctgcagatgcccagcactgggtgctgggcctgcacaagatcatccaccacagcggctccatggaccagaggcagaagctgcagcactggatccacagctgcctgaggaaggctgacaagaacaaggacaacaagatgtccttcaaggagctgcagaacttcctgaaggagctgaacatccaggtggatgacagctatgccaggaagatcttcagagaatgtgaccacagccagacagacagcctggaggatgaggagattgaggccttctacaagatgctgacccagagggtggagattgacaggacctttgctgaggccgccggcagcggggagaccctgtctgtggaccagctggtgaccttcctgcagcaccagcagcgggaggaggccgccggccctgccctggccctgagcctgattgaaagatatgagcccagcgagacagccaaggcccagaggcagatgaccaaggatggcttcctgatgtacctgctgtctgcagatggcagcgccttcagcctggcccaccggcgggtgtaccaggacatgggccagcccctgagccactacctggtgagcagcagccacaacacctacctgctggaggaccagctggccggccccagcagcacagaggcctacatccgggccctgtgcaagggctgccgctgcctggagctggactgctgggatggccccaaccaggagcccatcatctaccacggctacaccttcaccagcaagatcctcttctgtgatgtgctgcgggccatccgggactatgccttcaaggccagcccctaccctgtgatcctgagcctggagaaccactgcaccctggagcagcagagggtgatggcccggcacctgcacgccatcctgggccccatgctgctgaaccggcccctggatggagtgaccaacagcctgcccagccctgagcagctgaagggcaagatcctgctgaagggcaagaagctgggcggcctgctgcccccaggaggagagggcggccctgaggccaccgtggtgtctgatgaagatgaagctgctgagatggaggatgaggccgtgcgcagccgggtgcagcacaagcccaaggaggacaagctgcggctggcccaggagctgagtgacatggtgatctactgcaagtctgtgcactttggaggcttcagcagccctggcaccccaggccaggccttctatgagatggccagcttctctgaaaatagagccctgcggctgctgcaggagagcggaaatggatttgtgcgccacaacgtgggccacctgagccgcatctacccagctggctggaggacagacagcagcaactacagccctgtggagatgtggaatggaggctgccagatcgtggccctgaacttccagaccccaggccctgagatggatgtgtaccagggccgcttccaggacaacggggcctgtggctacgtgctgaagccagccttcctgcgggaccccaacggcaccttcaacccccgggccctggcccagggcccctggtgggccaggaagaggctgaacatccgggtcatcagcggccagcagctgcccaaggtgaacaagaacaagaacagcatcgtggaccccaaggtgacagtggagatccatggagtgtccagagatgtggccagccggcagacagctgtgatcaccaacaacggcttcaacccctggtgggacacagaatttgcctttgaggtggtggtgcctgacctggccctgatccgcttcctggtggaggactatgatgccagcagcaagaatgacttcatcggccagagcaccatccccctgaacagcctgaagcagggctaccgccacgtgcacctgatgagcaagaatggagaccagcaccccagcgccaccctgtttgtgaagatcagcctgcaggactag

SEQ ID NO: 164113 - DNA, 2334 bp, Artificial Sequence
  Description of Artificial Sequence: Synthetic coding sequence
atgcagtgcctgggcatccgcagccgcagccgcagccgggagctgtacctgcaggagaggagcctgaaggtggccgccctgaatggccggcggctgggcctgcaggatgatgaggacctgcaggccctgctgaagggcagccagctgctgaaggtgaagagcagctcctggaggcgggagcgcttctacaagctgcaggaggactgcaagaccatctggcaggagagcaggaaggtgatgaggaccccagagagccagctgttcagcattgaggacatccaggaggtgaggatgggccacaggacagagggcctggagaagtttgccagagatgtgcctgaggaccgctgcttcagcatcgtgttcaaggaccagaggaacaccctggacctgattgcccccagccctgcagatgcccagcactgggtgctgggcctgcacaagatcatccaccacagcggctccatggaccagaggcagaagctgcagcactggatccacagctgcctgaggaaggctgacaagaacaaggacaacaagatgtccttcaaggagctgcagaacttcctgaaggagctgaacatccaggtggatgacagctatgccaggaagatcttccgggagtgtgaccacagccagacagacagcctggaggatgaggagattgaggccttctacaagatgctgacccagagggtggagattgacaggacctttgctgaggccgccggcagcggggagaccctgtctgtggaccagctggtgaccttcctgcagcaccagcagcgggaggaggccgccggccctgccctggccctgagcctcatcgagagatatgagcccagcgagacagccaaggcccagaggcagatgaccaaggatggcttcctgatgtacctgctgtctgcagatggcagcgccttcagcctggcccacagaagagtgtaccaggacatgggccagcccctgagccactacctggtgagcagcagccacaacacctacctgctggaggaccagctggccggccccagcagcacagaggcctacatccgggccctgtgcaagggctgccgctgcctggagctggactgctgggatggccccaaccaggagcccatcatctaccacggctacaccttcaccagcaagatcctcttctgtgatgtgctgcgggccatccgggactatgccttcaaggccagcccctaccctgtgatcctgagcctggagaaccactgcaccctggagcagcagagggtgatggcccggcacctgcacgccatcctgggccccatgctgctgaaccggcccctggatggagtgaccaacagcctgcccagccctgagcagctgaagggcaagatcctgctgaagggcaagaagctgggcggcctgctgcccccaggaggagagggcggccctgaggccaccgtggtgtctgatgaagatgaggccgctgagatggaggatgaagctgtgcgcagccgggtgcagcacaagcccaaggaggacaagctgcggctggcccaggagctgagtgacatggtgatctactgcaagtctgtgcactttggaggcttcagcagccctggcaccccaggccaggccttctatgagatggccagcttcagcgagaacagagccctgcggctgctgcaggagagcggaaatggatttgtgcgccacaacgtgggccacctgagccgcatctacccagctggctggaggacagacagcagcaactacagccctgtggagatgtggaatggaggctgccagatcgtggccctgaacttccagaccccaggccctgagatggatgtgtaccagggccgcttccaggacaatggagcctgtggctacgtgctgaagccagccttcctgcgggaccccaacggcaccttcaacccccgggccctggcccagggcccctggtgggccaggaagaggctgaacatccgggtcatcagcggccagcagctgcccaaggtgaacaagaacaagaacagcatcgtggaccccaaggtgacagtggagatccacggcgtgtccagagatgtggccagccggcagacagctgtgatcaccaacaacggcttcaacccctggtgggacacagaatttgcctttgaggtggtggtgcctgacctggccctgatccgcttcctggtggaggactatgatgccagcagcaagaatgacttcatcggccagagcaccatccccctgaacagcctgaagcagggctacagacatgtgcacctgatgagcaagaatggagaccagcaccccagcgccaccctgtttgtgaagatcagcctgcaggactag

SEQ ID NO: 164114 - DNA, 6909 bp, Artificial Sequence
  Description of Artificial Sequence: Synthetic coding sequence
atgaccagcgaggagatgacagcctctgtgctgatccctgtgacccagaggaaggtggtgtctgcccagagcgctgctgatgagagcagcgagaaggtgtctgacatcaacatcagcaaggcccacacagtgagaagaagtggagagaccagccacaccatcagccagctgaacaagctgaaggaggagcccagcggcagcaacctgcccaagatcctgagcatcgcccgggagaagatcgtgtctgatgagaacagcaatgagaagtgctgggagaagatcatgccagacagcgccaagaacctgaacatcaactgcaacaacatcctgaggaaccaccagcacggcctgccccagaggcagttctatgagatgtacaacagcgtggccgaggaggacctgtgcctggagaccggcatccccagccccctggagaggaaggtgtttcctggcatccagctggagctggaccggcccagcatgggcatcagccccctgggcaaccagagcgtcatcattgaaacaggccgggcccacccagacagcagaagagctgtgttccacttccactatgaggtggacaggaggatgtctgacaccttctgcaccctgtctgagaacctgatcctggatgactgtggcaactgtgtgcccctgcccggcggggaggagaagcagaagaagaactacgtggcctacacctgcaagctgatggagctggccaagaactgtgacaacaagaatgagcagctgcagtgtgaccactgtgacaccctgaatgacaagtacttctgctttgagggcagctgtgagaaggtggacatggtgtacagcggggacagcttctgcaggaaggacttcacagacagccaggccgccaagaccttcctgagccactttgaggacttcccagacaactgtgatgatgtggaggaggatgccttcaagagcaagaaggagaggagcaccctgctggtgcggcgcttctgcaagaatgaccgggaggtgaagaagtctgtgtacacaggcacccgggccatcgtgaggaccctgcccagcggccacatcggcctgacagcctggagctacatcgaccagaagagaaatggccccctgctgccctgtggccgggtgatggagccccccagcacagtggagatccggcaggacggcagccagaggctgtctgaggcccagtggtaccccatctacaatgctgtgcggcgggaggagacagaaaatacagtgggcagcctgctgcacttcctgaccaagctgcctgccagcgagacagcccacggccgcatctctgtgggcccctgcctgaagcagtgtgtgcgggacacagtgtgtgagtaccgggccaccctgcagaggaccagcatcagccagtacatcaccggcagcctgctggaggccaccaccagcctgggcgcccggagcggcctgctgagcacctttggaggcagcactggaaggatgatgctgaaggagcggcagcccggccccagcgtggccaacagcaatgccctgcccagcagcagcgctggcatcagcaaggagctgattgacctgcagcccctcatccagtttcctgaggaggtggccagcatcctgatggagcaggagcagaccatctaccgccgggtgctgcctgtggactacctgtgcttcctgacccgggacctgggcaccccagagtgccagagcagcctgccctgcctgaaggccagcatcagcgccagcatcctgaccacccagaatggagagcacaatgccctggaggacctggtgatgaggttcaatgaggtgtcctcctgggtgacctggctgatcctgacagctggctccatggaggagaagcgggaggtgttctcctacctggtgcacgtggccaagtgctgctggaacatgggcaactacaatgctgtgatggagttcctggccggcctgcggagcaggaaggtgctgaagatgtggcagttcatggaccagagcgacatcgagaccatgaggagcctgaaggatgccatggcccagcacgagagcagctgtgagtacaggaaggtggtgacccgggccctgcacatccctggctgcaaggtggtgcccttctgtggggtcttcctgaaggagctgtgtgaggtgctggatggagccagcggcctgatgaagctgtgcccccgctacaacagccaggaggagaccctggagtttgtggccgactacagcggccaggacaacttcctgcagagggtgggccagaatggcctgaagaacagcgagaaggagagcacagtgaacagcatcttccaggtgatccgcagctgcaacagaagcctggagacagatgaggaggacagccccagcgagggcaacagcagcaggaagagcagcctgaaggacaagagccgctggcagttcatcatcggggacctgctggacagcgacaatgacatctttgagcagagcaaggagtatgacagccacggcagcgaggacagccagaaggcctttgaccatggaacagagctgatcccctggtacgtgctgagcatccaggctgatgtgcaccagttcctgctgcagggcgccaccgtcatccactatgaccaggacacccacctgagcgcccgctgcttcctgcagctgcagcctgacaacagcaccctgacctgggtgaagcccaccacagccagccctgccagcagcaaggccaagctgggcgtgctgaacaacacagctgagcccgggaagttccccctgctgggcaatgccggcctgagcagcctgacagagggcgtgctggacctgtttgctgtgaaggctgtgtacatgggccaccctggcatcgacatccacacagtgtgtgtgcagaacaagctgggctccatgttcctgtctgagaccggggtgaccctgctgtatggcctgcagaccacagacaaccggctgctgcactttgtggcccccaagcacacagccaagatgctgttcagcggcctgctggagctgaccagggctgtgaggaagatgaggaagttcccagaccagaggcagcagtggctgaggaagcagtatgtgtccctgtaccaggaggatggccgctatgagggccccaccctggcccatgctgtggagctgtttggaggccgccgctggagcgccaggaaccccagccctggcaccagcgccaagaatgctgagaagcccaacatgcagaggaacaacaccctgggcatcagcaccaccaagaagaagaagaagatcctgatgagaggagagagcggggaggtgacagatgatgagatggccaccaggaaggccaagatgcacaaggagtgccgcagccgcagcggcagtgacccccaggacatcaatgagcaggaggagagcgaggtgaatgccatcgccaacccccccaaccccctgcccagcagaagagcccacagcctgaccacagctggcagccccaacctggccgccggcaccagcagccccatccggcctgtgagcagccctgtgctgagcagcagcaacaagagccccagcagcgcctggagcagcagctcctggcacggccgcatcaagggcggcatgaagggcttccagagcttcatggtgtctgacagcaacatgagctttgtggagtttgtggagctgttcaagagcttctctgtgcgcagcaggaaggacctgaaggacctgtttgatgtgtatgctgtgccctgcaacagaagtggcagcgagagcgcccccctgtacaccaacctgaccattgatgagaacaccagtgacctgcagcctgacctggacctgctgaccagaaatgtgtctgacctgggcctcttcatcaagagcaagcagcagctgagtgacaaccagaggcagatcagtgatgccatcgccgccgccagcatcgtgaccaacggcaccggcatcgagagcaccagcctgggcatcttcggcgtgggcatcctgcagctgaatgacttcctggtgaactgccagggcgagcactgcacctatgatgagatcctgagcatcatccagaagtttgagcccagcatctccatgtgccaccagggcctgatgagctttgagggctttgcccgcttcctgatggacaaggagaactttgccagcaagaatgatgagagccaggagaacatcaaggagctgcagctgcccctgagctactactacatcgagagcagccacaacacctacctgaccggccaccagctgaagggggagagctctgtggagctgtacagccaggtgctgctgcagggctgccgctctgtggagctggactgctgggatggagatgatggcatgcccatcatctaccacggccacaccctgaccaccaagatccccttcaaggaggtggtggaggccatcgacagaagtgccttcatcaacagcgacctgcccatcatcatcagcattgagaaccactgcagcctgccccagcagaggaagatggccgagatcttcaagacagtgtttggagagaagctggtgaccaagttcctgtttgaaacagacttcagtgatgaccccatgctgcccagcccagaccagctgaggaagaaggtgctgctgaagaacaagaagctgaaggcccaccagacccctgtggacatcctgaagcagaaggcccaccagctggcctccatgcaggtgcaggcctacaacggcggcaatgccaaccccaggcctgccaacaatgaggaggaggaggatgaggaggatgaatatgactatgactatgagagcctgagtgatgacaacatcctggaggacaggcctgagaacaagagctgcaatgacaagctgcagtttgagtacaatgaggagatccccaagaggatcaagaaggctgacaacagcgcctgcaacaagggcaaggtgtatgacatggagctgggggaggagttctacctggaccagaacaagaaggagagccggcagatcgcccctgagctgagtgacctggtgatctactgccaggccgtgaagtttcctggcctgagcaccctgaatgccagcggcagcagccggggcaaggagaggaagagcaggaagagcatctttggaaacaaccctggccgcatgagccctggagaaacagccagcttcaacaagaccagcggcaagagcagctgtgagggcatccggcagacctgggaggagagcagcagccccctgaaccccaccaccagcctgagcgccatcatccgcacccccaagtgctaccacatcagcagcctgaatgaaaatgctgccaagaggctgtgccgccgctacagccagaagctgacccagcacacagcctgccagctgctgcggacctacccagctgccaccagaattgacagcagcaaccccaaccccctgatgttctggctgcacggcatccagctggtggccctgaactaccagacagatgacctgcccctgcacctgaatgctgccatgtttgaggccaatggaggctgcggctacgtgctgaagccccctgtgctgtgggacaagaactgccccatgtaccagaagttcagccccctggagcgggacctggacagcatggaccctgctgtgtacagcctgaccatcgtgtctggccagaatgtgtgccccagcaacagcatgggcagcccctgcatcgaggtggatgtgctgggcatgcccctggacagctgccacttccgcaccaagcccatccacaggaacaccctgaaccccatgtggaatgagcagttcctgttccacgtgcactttgaggacctggtgttcctgcgctttgctgtggtggagaacaacagcagcgctgtgacagcccagaggatcatccccctgaaggccctgaagaggggctaccgccacctgcagctgaggaacctgcacaatgaggtgctggagatcagcagcctcttcatcaacagcaggaggatggaggagaacagcagcggcaacaccatgtctgccagctccatgttcaacacagaggagaggaagtgcctgcagacccaccgggtgacagtgcatggagtgcccggccctgagcccttcaccgtcttcaccatcaatggaggcaccaaggccaagcagctgctgcagcagatcctgaccaatgagcaggacatcaagcctgtgaccacagactacttcctgatggaggagaagtacttcatcagcaaggagaagaatgaatgtaggaagcagcccttccagagggccatcggccctgaggaggagatcatgcagatcctgagctcctggttccctgaggagggctacatgggcagaattgtgctgaagacccagcaggagaacctggaggagaagaacatcgtgcaggatgacaaggaggtgatcctgagcagcgaggaggagagcttctttgtgcaggtgcatgatgtgtccccagagcagcccaggacagtcatcaaggccccccgggtgtccacagcccaggatgtgatccagcagaccctgtgcaaggccaagtacagctacagcatcctgagcaaccccaaccccagcgactatgtgctgctggaggaggtggtgaaggacaccaccaacaagaagaccaccacccccaagagcagccagagggtgctgctggaccaggagtgtgtgttccaggcccagagcaagtggaagggggccggcaagttcatcctgaagctgaaggagcaggtgcaggccagccgggaggacaagaagaagggcatcagctttgccagcgagctgaagaagctgaccaagagcaccaagcagccccggggcctgaccagccccagccagctgctgaccagcgagagcatccagaccaaggaggagaagcctgtgggcggcctgagcagcagtgacaccatggactaccggcagtag

SEQ ID NO: 164115 - DNA, 5985 bp, Artificial Sequence
  Description of Artificial Sequence: Synthetic coding sequence
atggtgtctgagggcagcgctgctggccgggactttgctggcatggaggaggtgcggcagctgcacgtgcgcttctgcaagggcatcaagatctggcaccaggcctggttcctgtgcagcctgctgggccgggagccccaggagcgggaggccggctgccagctgtggctgtgcaccctgtctgctgtgctgaaggtgggctggctgttccccctgtctgaggtgcccaacttcaccctgctgaaggatggctgcggctgctggaggctgaaggaggaccagatctacaatgctgtgcggcgggaggagacagaaaatacagtgggcagcctgctgcacttcctgaccaagctgcctgccagcgagacagcccacggccgcatctctgtgggcccctgcctgaagcagtgtgtgcgggacacagtgtgtgagtaccgggccaccctgcagaggaccagcatcagccagtacatcaccggcagcctgctggaggccaccaccagcctgggcgcccggagcggcctgctgagcacctttggaggcagcactggaaggatgatgctgaaggagcggcagcccggccccagcgtggccaacagcaatgccctgcccagcagcagcgctggcatcagcaaggagctgattgacctgcagcccctcatccagtttcctgaggaggtggccagcatcctgatggagcaggagcagaccatctaccgccgggtgctgcctgtggactacctgtgcttcctgacccgggacctgggcaccccagagtgccagagcagcctgccctgcctgaaggccagcatcagcgccagcatcctgaccacccagaatggagagcacaatgccctggaggacctggtgatgaggttcaatgaggtgtcctcctgggtgacctggctgatcctgacagctggctccatggaggagaagcgggaggtgttctcctacctggtgcacgtggccaagtgctgctggaacatgggcaactacaatgctgtgatggagttcctggccggcctgcggagcaggaaggtgctgaagatgtggcagttcatggaccagagcgacatcgagaccatgaggagcctgaaggatgccatggcccagcacgagagcagctgtgagtacaggaaggtggtgacccgggccctgcacatccctggctgcaaggtggtgcccttctgtggggtcttcctgaaggagctgtgtgaggtgctggatggagccagcggcctgatgaagctgtgcccccgctacaacagccaggaggagaccctggagtttgtggccgactacagcggccaggacaacttcctgcagagggtgggccagaatggcctgaagaacagcgagaaggagagcacagtgaacagcatcttccaggtgatccgcagctgcaacagaagcctggagacagatgaggaggacagccccagcgagggcaacagcagcaggaagagcagcctgaaggacaagagccgctggcagttcatcatcggggacctgctggacagcgacaatgacatctttgagcagagcaaggagtatgacagccacggcagcgaggacagccagaaggcctttgaccatggaacagagctgatcccctggtacgtgctgagcatccaggctgatgtgcaccagttcctgctgcagggcgccaccgtcatccactatgaccaggacacccacctgagcgcccgctgcttcctgcagctgcagcctgacaacagcaccctgacctgggtgaagcccaccacagccagccctgccagcagcaaggccaagctgggcgtgctgaacaacacagctgagcccgggaagttccccctgctgggcaatgccggcctgagcagcctgacagagggcgtgctggacctgtttgctgtgaaggctgtgtacatgggccaccctggcatcgacatccacacagtgtgtgtgcagaacaagctgggctccatgttcctgtctgagaccggggtgaccctgctgtatggcctgcagaccacagacaaccggctgctgcactttgtggcccccaagcacacagccaagatgctgttcagcggcctgctggagctgaccagggctgtgaggaagatgaggaagttcccagaccagaggcagcagtggctgaggaagcagtatgtgtccctgtaccaggaggatggccgctatgagggccccaccctggcccatgctgtggagctgtttggaggccgccgctggagcgccaggaaccccagccctggcaccagcgccaagaatgctgagaagcccaacatgcagaggaacaacaccctgggcatcagcaccaccaagaagaagaagaagatcctgatgagaggagagagcggggaggtgacagatgatgagatggccaccaggaaggccaagatgcacaaggagtgccgcagccgcagcggcagtgacccccaggacatcaatgagcaggaggagagcgaggtgaatgccatcgccaacccccccaaccccctgcccagcagaagagcccacagcctgaccacagctggcagccccaacctggccgccggcaccagcagccccatccggcctgtgagcagccctgtgctgagcagcagcaacaagagccccagcagcgcctggagcagcagctcctggcacggccgcatcaagggcggcatgaagggcttccagagcttcatggtgtctgacagcaacatgagctttgtggagtttgtggagctgttcaagagcttctctgtgcgcagcaggaaggacctgaaggacctgtttgatgtgtatgctgtgccctgcaacagaagtggcagcgagagcgcccccctgtacaccaacctgaccattgatgagaacaccagtgacctgcagcctgacctggacctgctgaccagaaatgtgtctgacctgggcctcttcatcaagagcaagcagcagctgagtgacaaccagaggcagatcagtgatgccatcgccgccgccagcatcgtgaccaacggcaccggcatcgagagcaccagcctgggcatcttcggcgtgggcatcctgcagctgaatgacttcctggtgaactgccagggcgagcactgcacctatgatgagatcctgagcatcatccagaagtttgagcccagcatctccatgtgccaccagggcctgatgagctttgagggctttgcccgcttcctgatggacaaggagaactttgccagcaagaatgatgagagccaggagaacatcaaggagctgcagctgcccctgagctactactacatcgagagcagccacaacacctacctgaccggccaccagctgaagggggagagctctgtggagctgtacagccaggtgctgctgcagggctgccgctctgtggagctggactgctgggatggagatgatggcatgcccatcatctaccacggccacaccctgaccaccaagatccccttcaaggaggtggtggaggccatcgacagaagtgccttcatcaacagcgacctgcccatcatcatcagcattgagaaccactgcagcctgccccagcagaggaagatggccgagatcttcaagacagtgtttggagagaagctggtgaccaagttcctgtttgaaacagacttcagtgatgaccccatgctgcccagcccagaccagctgaggaagaaggtgctgctgaagaacaagaagctgaaggcccaccagacccctgtggacatcctgaagcagaaggcccaccagctggcctccatgcaggtgcaggcctacaacggcggcaatgccaaccccaggcctgccaacaatgaggaggaggaggatgaggaggatgaatatgactatgactatgagagcctgagtgatgacaacatcctggaggacaggcctgagaacaagagctgcaatgacaagctgcagtttgagtacaatgaggagatccccaagaggatcaagaaggctgacaacagcgcctgcaacaagggcaaggtgtatgacatggagctgggggaggagttctacctggaccagaacaagaaggagagccggcagatcgcccctgagctgagtgacctggtgatctactgccaggccgtgaagtttcctggcctgagcaccctgaatgccagcggcagcagccggggcaaggagaggaagagcaggaagagcatctttggaaacaaccctggccgcatgagccctggagaaacagccagcttcaacaagaccagcggcaagagcagctgtgagggcatccggcagacctgggaggagagcagcagccccctgaaccccaccaccagcctgagcgccatcatccgcacccccaagtgctaccacatcagcagcctgaatgaaaatgctgccaagaggctgtgccgccgctacagccagaagctgacccagcacacagcctgccagctgctgcggacctacccagctgccaccagaattgacagcagcaaccccaaccccctgatgttctggctgcacggcatccagctggtggccctgaactaccagacagatgacctgcccctgcacctgaatgctgccatgtttgaggccaatggaggctgcggctacgtgctgaagccccctgtgctgtgggacaagaactgccccatgtaccagaagttcagccccctggagcgggacctggacagcatggaccctgctgtgtacagcctgaccatcgtgtctggccagaatgtgtgccccagcaacagcatgggcagcccctgcatcgaggtggatgtgctgggcatgcccctggacagctgccacttccgcaccaagcccatccacaggaacaccctgaaccccatgtggaatgagcagttcctgttccacgtgcactttgaggacctggtgttcctgcgctttgctgtggtggagaacaacagcagcgctgtgacagcccagaggatcatccccctgaaggccctgaagaggggctaccgccacctgcagctgaggaacctgcacaatgaggtgctggagatcagcagcctcttcatcaacagcaggaggatggaggagaacagcagcggcaacaccatgtctgccagctccatgttcaacacagaggagaggaagtgcctgcagacccaccgggtgacagtgcatggagtgcccggccctgagcccttcaccgtcttcaccatcaatggaggcaccaaggccaagcagctgctgcagcagatcctgaccaatgagcaggacatcaagcctgtgaccacagactacttcctgatggaggagaagtacttcatcagcaaggagaagaatgaatgtaggaagcagcccttccagagggccatcggccctgaggaggagatcatgcagatcctgagctcctggttccctgaggagggctacatgggcagaattgtgctgaagacccagcaggagaacctggaggagaagaacatcgtgcaggatgacaaggaggtgatcctgagcagcgaggaggagagcttctttgtgcaggtgcatgatgtgtccccagagcagcccaggacagtcatcaaggccccccgggtgtccacagcccaggatgtgatccagcagaccctgtgcaaggccaagtacagctacagcatcctgagcaaccccaaccccagcgactatgtgctgctggaggaggtggtgaaggacaccaccaacaagaagaccaccacccccaagagcagccagagggtgctgctggaccaggagtgtgtgttccaggcccagagcaagtggaagggggccggcaagttcatcctgaagctgaaggagcaggtgcaggccagccgggaggacaagaagaagggcatcagctttgccagcgagctgaagaagctgaccaagagcaccaagcagccccggggcctgaccagccccagccagctgctgaccagcgagagcatccagaccaaggaggagaagcctgtgggcggcctgagcagcagtgacaccatggactaccggcagtag

SEQ ID NO: 164116 - DNA, 6939 bp, Artificial Sequence
  Description of Artificial Sequence: Synthetic coding sequence
atgaccagcgaggagatgacagcctctgtgctgatccctgtgacccagaggaaggtggtgtctgcccagagcgctgctgatgagagcagcgagaaggtgtctgacatcaacatcagcaaggcccacacagtgagaagaagtggagagaccagccacaccatcagccagctgaacaagctgaaggaggagcccagcggcagcaacctgcccaagatcctgagcatcgcccgggagaagatcgtgtctgatgagaacagcaatgagaagtgctgggagaagatcatgccagacagcgccaagaacctgaacatcaactgcaacaacatcctgaggaaccaccagcacggcctgccccagaggcagttctatgagatgtacaacagcgtggccgaggaggacctgtgcctggagaccggcatccccagccccctggagaggaaggtgtttcctggcatccagctggagctggaccggcccagcatgggcatcagccccctgggcaaccagagcgtcatcattgaaacaggccgggcccacccagacagcagaagagctgtgttccacttccactatgaggtggacaggaggatgtctgacaccttctgcaccctgtctgagaacctgatcctggatgactgtggcaactgtgtgcccctgcccggcggggaggagaagcagaagaagaactacgtggcctacacctgcaagctgatggagctggccaagaactgtgacaacaagaatgagcagctgcagtgtgaccactgtgacaccctgaatgacaagtacttctgctttgagggcagctgtgagaaggtggacatggtgtacagcggggacagcttctgcaggaaggacttcacagacagccaggccgccaagaccttcctgagccactttgaggacttcccagacaactgtgatgatgtggaggaggatgccttcaagagcaagaaggagaggagcaccctgctggtgcggcgcttctgcaagaatgaccgggaggtgaagaagtctgtgtacacaggcacccgggccatcgtgaggaccctgcccagcggccacatcggcctgacagcctggagctacatcgaccagaagagaaatggccccctgctgccctgtggccgggtgatggagccccccagcacagtggagatccggcaggacggcagccagaggctgtctgaggcccagtggtaccccatctacaatgctgtgcggcgggaggagacagaaaatacagtgggcagcctgctgcacttcctgaccaagctgcctgccagcgagacagcccacggccgcatctctgtgggcccctgcctgaagcagtgtgtgcgggacacagtgtgtgagtaccgggccaccctgcagaggaccagcatcagccagtacatcaccggcagcctgctggaggccaccaccagcctgggcgcccggagcggcctgctgagcacctttggaggcagcactggaaggatgatgctgaaggagcggcagcccggccccagcgtggccaacagcaatgccctgcccagcagcagcgctggcatcagcaaggagctgattgacctgcagcccctcatccagtttcctgaggaggtggccagcatcctgatggagcaggagcagaccatctaccgccgggtgctgcctgtggactacctgtgcttcctgacccgggacctgggcaccccagagtgccagagcagcctgccctgcctgaaggccagcatcagcgccagcatcctgaccacccagaatggagagcacaatgccctggaggacctggtgatgaggttcaatgaggtgtcctcctgggtgacctggctgatcctgacagctggctccatggaggagaagcgggaggtgttctcctacctggtgcacgtggccaagtgctgctggaacatgggcaactacaatgctgtgatggagttcctggccggcctgcggagcaggaaggtgctgaagatgtggcagttcatggaccagagcgacatcgagaccatgaggagcctgaaggatgccatggcccagcacgagagcagctgtgagtacaggaaggtggtgacccgggccctgcacatccctggctgcaaggtggtgcccttctgtggggtcttcctgaaggagctgtgtgaggtgctggatggagccagcggcctgatgaagctgtgcccccgctacaacagccaggaggagaccctggagtttgtggccgactacagcggccaggacaacttcctgcagagggtgggccagaatggcctgaagaacagcgagaaggagagcacagtgaacagcatcttccaggtgatccgcagctgcaacagaagcctggagacagatgaggaggacagccccagcgagggcaacagcagcaggaagagcagcctgaaggacaagagccgctggcagttcatcatcggggacctgctggacagcgacaatgacatctttgagcagagcaaggagtatgacagccacggcagcgaggacagccagaaggcctttgaccatggaacagagctgatcccctggtacgtgctgagcatccaggctgatgtgcaccagttcctgctgcagggcgccaccgtcatccactatgaccaggacacccacctgagcgcccgctgcttcctgcagctgcagcctgacaacagcaccctgacctgggtgaagcccaccacagccagccctgccagcagcaaggccaagctgggcgtgctgaacaacacagctgagcccgggaagttccccctgctgggcaatgccggcctgagcagcctgacagagggcgtgctggacctgtttgctgtgaaggctgtgtacatgggccaccctggcatcgacatccacacagtgtgtgtgcagaacaagctgggctccatgttcctgtctgagaccggggtgaccctgctgtatggcctgcagaccacagacaaccggctgctgcactttgtggcccccaagcacacagccaagatgctgttcagcggcctgctggagctgaccagggctgtgaggaagatgaggaagttcccagaccagaggcagcagtggctgaggaagcagtatgtgtccctgtaccaggaggatggccgctatgagggccccaccctggcccatgctgtggagctgtttggaggccgccgctggagcgccaggaaccccagccctggcaccagcgccaagaatgctgagaagcccaacatgcagaggaacaacaccctgggcatcagcaccaccaagaagaagaagaagatcctgatgagaggagagagcggggaggtgacagatgatgagatggccaccaggaaggccaagatgcacaaggagtgccgcagccgcagcggcagtgacccccaggacatcaatgagcaggaggagagcgaggtgaatgccatcgccaacccccccaaccccctgcccagcagaagagcccacagcctgaccacagctggcagccccaacctggccgccggcaccagcagccccatccggcctgtgagcagccctgtgctgagcagcagcaacaagagccccagcagcgcctggagcagcagctcctggcacggccgcatcaagggcggcatgaagggcttccagagcttcatggtgtctgacagcaacatgagctttgtggagtttgtggagctgttcaagagcttctctgtgcgcagcaggaaggacctgaaggacctgtttgatgtgtatgctgtgccctgcaacagaagtggcagcgagagcgcccccctgtacaccaacctgaccattgatgagaacaccagtgacctgcagcctgacctggacctgctgaccagaaatgtgtctgacctgggcctcttcatcaagagcaagcagcagctgagtgacaaccagaggcagatcagtgatgccatcgccgccgccagcatcgtgaccaacggcaccggcatcgagagcaccagcctgggcatcttcggcgtgggcatcctgcagctgaatgacttcctggtgaactgccagggcgagcactgcacctatgatgagatcctgagcatcatccagaagtttgagcccagcatctccatgtgccaccagggcctgatgagctttgagggctttgcccgcttcctgatggacaaggagaactttgccagcaagaatgatgagagccaggagaacatcaaggagctgcagctgcccctgagctactactacatcgagagcagccacaacacctacctgaccggccaccagctgaagggggagagctctgtggagctgtacagccaggtgctgctgcagggctgccgctctgtggagctggactgctgggatggagatgatggcatgcccatcatctaccacggccacaccctgaccaccaagatccccttcaaggaggtggtggaggccatcgacagaagtgccttcatcaacagcgacctgcccatcatcatcagcattgagaaccactgcagcctgccccagcagaggaagatggccgagatcttcaagacagtgtttggagagaagctggtgaccaagttcctgtttgaaacagacttcagtgatgaccccatgctgcccagcccagaccagctgaggaagaaggtgctgctgaagaacaagaagctgaaggcccaccagacccctgtggacatcctgaagcagaaggcccaccagctggcctccatgcaggtgcaggcctacaacggcggcaatgccaaccccaggcctgccaacaatgaggaggaggaggatgaggaggatgaatatgactatgactatgagagcctgagtgatgacaacatcctggaggacaggcctgagaacaagagctgcaatgacaagctgcagtttgagtacaatgaggagatccccaagaggatcaagaaggctgacaacagcgcctgcaacaagggcaaggtgtatgacatggagctgggggaggagttctacctggaccagaacaagaaggagagccggcagatcgcccctgagctgagtgacctggtgatctactgccaggccgtgaagtttcctggcctgagcaccctgaatgccagcggcagcagccggggcaaggagaggaagagcaggaagagcatctttggaaacaaccctggccgcatgagccctggagaaacagccagcttcaacaagaccagcggcaagagcagctgtgagggcatccggcagacctgggaggagagcagcagccccctgaaccccaccaccagcctgagcgccatcatccgcacccccaagtgctaccacatcagcagcctgaatgaaaatgctgccaagaggctgtgccgccgctacagccagaagctgacccagcacacagcctgccagctgctgcggacctacccagctgccaccagaattgacagcagcaaccccaaccccctgatgttctggctgcacggcatccagctggtggccctgaactaccagacagatgacctgcccctgcacctgaatgctgccatgtttgaggccaatggaggctgcggctacgtgctgaagccccctgtgctgtgggacaagaactgccccatgtaccagaagttcagccccctggagcgggacctggacagcatggaccctgctgtgtacagcctgaccatcgtgtctggccagaatgtgtgccccagcaacagcatgggcagcccctgcatcgaggtggatgtgctgggcatgcccctggacagctgccacttccgcaccaagcccatccacaggaacaccctgaaccccatgtggaatgagcagttcctgttccacgtgcactttgaggacctggtgttcctgcgctttgctgtggtggagaacaacagcagcgctgtgacagcccagaggatcatccccctgaaggccctgaagaggggctaccgccacctgcagctgaggaacctgcacaatgaggtgctggagatcagcagcctcttcatcaacagcaggaggatggaggagaacagcagcggcaacaccatgtctgccagctccatgttcaacacagaggagaggaagtgcctgcagacccaccgggtgacagtgcatggagtgcccggccctgagcccttcaccgtcttcaccatcaatggaggcaccaaggccaagcagctgctgcagcagatcctgaccaatgagcaggacatcaagcctgtgaccacagactacttcctgatggaggagaagtacttcatcagcaaggagaagaatgaatgtaggaagcagcccttccagagggccatcggccctgaggaggagatcatgcagatcctgagctcctggttccctgaggagggctacatgggcagaattgtgctgaagacccagcaggagaacctggaggagaagaacatcgtgcaggatgacaaggaggtgatcctgagcagcgaggaggagagcttctttgtgcaggtgcatgatgtgtccccagagcagcccaggacagtcatcaaggccccccgggtgtccacagcccaggatgtgatccagcagaccctgtgcaaggccaagtacagctacagcatcctgagcaaccccaaccccagcgactatgtgctgctggaggaggtggtgaaggacaccaccaacaagaagaccaccacccccaagagcagccagagggtgctgctggaccaggagtgtgtgttccaggcccagagcaagtggaagggggccggcaagttcatcctgaagctgaaggagcaggtgcaggccagccgggaggacaagaagaagggcatcagctttgccagcgagctgaagaagctgaccaagagcaccaagcagccccggggcctgaccagccccagccagctgctgaccagcgagagcatccagaccaaggaggagaagcctgtgggcggcctgagcagcagtgacaccatggactaccggcaggtgaagatcttcaagcaggaggtgaaggagtag

SEQ ID NO: 164117 - DNA, 5985 bp, Artificial Sequence; identical to SEQ ID NO: 164115
  Description of Artificial Sequence: Synthetic coding sequence

SEQ ID NO: 164118 - DNA, 4968 bp, Artificial Sequence
  Description of Artificial Sequence: Synthetic coding sequence
atgtctgtgatgcagagcggcacccagatgatcaagctgaagaggggcaccaagggcctggtgcggctcttctacctggatgagcacaggacccggctgcgctggaggcccagcaggaagtctgagaaggccaagatcctgattgacagcatctacaaggtgacagagggccggcagagcgagatcttccaccggcaggccgagggcaactttgaccccagctgctgcttcaccatctaccacggcaaccacatggagagcctggacctgatcaccagcaaccctgaggaggcccggacctggatcaccggcctgaagtacctgatggccggcatcagtgatgaggacagcctggccaagaggcagaggacccatgaccagtgggtgaagcagacctttgaggaggccgacaagaatggagatggcctgctgaacatcgaggagatccaccagctgatgcacaagctgaatgtgaacctgcccaggaggaaggtgcggcagatgttccaggaggccgacacagatgagaaccagggcaccctgacctttgaggagttctgtgtgttctacaagatgatgagcctgcggcgggacctgtacctgctgctgctgagctacagcgacaagaaggaccacctgactgtggaggagctggcccagttcctgaaggtggagcagaagatgaacaacgtgaccacagactactgcctggacatcatcaagaagtttgaggtgtctgaggagaacaaggtgaagaatgtgctgggcatcgagggcttcaccaacttcatgaggagccctgcctgtgacatcttcaaccccctgcaccacgaggtgtaccaggacatggaccagcccctgtgcaactactacatcgccagcagccacaacacctacctgactggagaccagctgctgagccagagcaaggtggacatgtatgcccgggtgctgcaggagggctgccgctgtgtggaggtggactgctgggatggcccagatggagagcctgtggtgcaccacggctacaccctgaccagcaagatcctcttcagagatgtggtggagaccatcaacaagcacgcctttgtgaagaatgagttccctgtgatcctgagcattgagaaccactgcagcatccagcagcagaggaagatcgcccagtacctgaagggcatctttggagacaagctggacctgagctctgtggacacaggagagtgcaagcagctgcccagcccccagagcctgaagggcaagatcctggtgaagggcaagaagctgccctaccacctgggagatgatgctgaggagggggaggtgtctgatgaggacagcgcagatgaaattgaagatgagtgcaagttcaagctgcactacagcaatggcaccacagagcaccaggtggagagcttcatcaggaagaagctggagagcctgctgaaggagagccagatccgggacaaggaggaccctgacagcttcaccgtgcgggccctgctgaaggccacccatgagggcctgaatgcccacctgaagcagagcccagatgtgaaggagagcggcaagaagagccacggccgcagcctgatgaccaactttgggaagcacaagaagaccaccaagagccgcagcaagagctacagcacagatgatgaggaggacacccagcagagcacaggcaaggagggcggccagctgtaccgcctgggcagaagaaggaagaccatgaagctgtgccgggagctgagtgacctggtggtgtacaccaacagcgtggccgcccaggacatcgtggatgatggcaccactggaaatgtgctgtccttcagcgagacccgggcccaccaggtggtgcagcagaagtctgagcagttcatgatctacaaccagaagcagctgacccgcatctaccccagcgcctacagaattgacagcagcaacttcaaccccctgccctactggaatgccggctgccagctggtggccctgaactaccagagcgagggccgcatgatgcagctgaacagagccaagttcaaggccaatggaaactgtggctacgtgctgaagccccagcagatgtgcaagggcaccttcaaccccttcagcggggaccccctgcctgccaaccccaagaagcagctgatcctgaaggtgatcagcggccagcagctgcccaagcccccagacagcatgtttggagacagaggagagatcatcgacccctttgtggaggtggagatcatcggcctgcctgtggactgctgcaaggaccagaccagggtggtggatgacaatggcttcaaccctgtgtgggaggagaccctgaccttcaccgtgcacatgcctgagatcgccctggtgcgcttcctggtgtgggaccatgaccccatcggccgggactttgtgggccagaggacagtgaccttcagcagcctggtgcccggctaccgccacgtgtacctggagggcctgacagaggccagcatctttgtgcacatcaccatcaatgagatctacggcaagaaccggcagctgcagggcctgaagggcctcttcaacaagaaccccaggcacagcagcagcgagaacaacagccactacgtgaggaagaggagcattggagaccgcatcctgcggaggacagccagcgccccagccaagggcaggaagaagagcaagatgggcttccaggagatggtggagatcaaggacagcgtgtctgaggccacccgggaccaggatggagtgctgcggaggaccaccaggagcctgcaggcccggcctgtgtccatgcctgtggacaggaacctgctgggcgccctgagcctgcctgtgtctgaaacagccaaggacatcgagggcaaggagaacagcctggccgaggacaaggatggccgcaggaagggcaaggccagcatcaaggacccccacttcctgaacttcaacaagaagctgagcagcagcagcagcgccctgctgcacaaggacaccagccagggcgacaccatcgtgtccacagcccacatgtctgtgactggagagcagctgggcatgagcagcccccggggcggccgcaccaccagcaatgccaccagcaactgccaggagaacccctgccccagcaagagcctgagccccaagcagcacctggccccagaccctgtggtgaaccccacccaggacctgcatggagtgaagatcaaggagaagggcaaccctgaggactttgtggagggcaagagcatcctgagcggctctgtgctgagccacagcaacctggagatcaagaacctggagggcaacagaggcaagggccgggccgccaccagcttcagcctgagtgatgtgtccatgctgtgcagcgacatcccagacctgcacagcacagccatcctgcaggagagcgtcatcagccacctgattgacaacgtgaccctgaccaatgaaaatgagcccggcagcagcatcagcgccctgattggccagtttgatgagaccaacaaccaggccctgactgtggtgagccacctgcacaacacctctgtgatgagcggccactgccccctgcccagcctgggcctgaagatgcccatcaagcacggcttctgcaagggcaagagcaagagcagcttcctgtgcagcagccctgagctgattgccctgagcagcagcgagaccaccaagcacgccaccaacacagtgtatgagaccacctgcacccccatcagcaagaccaagccagatgatgacctgagcagcaaggccaagacagctgccctggagagcaacctgcccggcagccccaacaccagccggggctggctgcccaagagccccaccaagggggaggactgggagaccctgaagagctgcagccctgccagcagcccagacctgaccctggaggatgtgattgctgaccccaccctgtgcttcaacagcggggagagcagcctggtggagattgatggagagagcgagaacctgagcctgaccacctgtgagtacagaagagagggcaccagccagctggccagccccctgaagctgaagtacaaccagggcgtggtggagcacttccagaggggcctgagaaatggctactgcaaggagaccctgcggcccagcgtgcctgagatcttcaacaacatccaggatgtgaagacccagagcatctcctacctggcctaccagggcgccggctttgtgcacaaccacttcagtgacagtgatgccaagatgttccagacctgtgtgccccagcagagcagcgcccaggacatgcacgtgcctgtgcccaagcagctggcccacctgcccctgcctgccctgaagctgcccagcccctgcaagagcaagagcctgggggacctgaccagtgaagatattgcctgcaactttgagagcaagtaccagtgcatcagcaagagctttgtgaccaccggcatccgggacaagaagggcgtgacagtgaagaccaagagcctggagcccattgatgccctgacagagcagctgaggaagctggtgtcctttgaccaggaggacaactgccaggtgctgtacagcaagcaggatgccaaccagctgccccgggccctggtgaggaagctgagcagccgcagccagagccgggtgagaaatattgccagccgggccaaggagaagcaggaggccaacaagcagaaggtgcccaaccccagcaatggagctggggtggtgctgaggaacaagcccagcgcccccaccccagctgtgaacagacacagcacaggcagctacatcgccggctacctgaagaacaccaagggcggcggcctggagggccggggcatccctgagggcgcctgcacagccctgcactacggccacgtggaccagttctgcagcgacaacagcgtgctgcagacagagcccagcagtgatgacaagccagagatctacttcctgctgcggctgtag

SEQ ID NO: 164119 - DNA, 5082 bp, Artificial Sequence
  Description of Artificial Sequence: Synthetic coding sequence
atggctgacctggaggtgtacaagaacctgagccctgagaaggtggagcgctgcatgtctgtgatgcagagcggcacccagatgatcaagctgaagaggggcaccaagggcctggtgcggctcttctacctggatgagcacaggacccggctgcgctggaggcccagcaggaagtctgagaaggccaagatcctgattgacagcatctacaaggtgacagagggccggcagagcgagatcttccaccggcaggccgagggcaactttgaccccagctgctgcttcaccatctaccacggcaaccacatggagagcctggacctgatcaccagcaaccctgaggaggcccggacctggatcaccggcctgaagtacctgatggccggcatcagtgatgaggacagcctggccaagaggcagaggacccatgaccagtgggtgaagcagacctttgaggaggccgacaagaatggagatggcctgctgaacatcgaggagatccaccagctgatgcacaagctgaatgtgaacctgcccaggaggaaggtgcggcagatgttccaggaggccgacacagatgagaaccagggcaccctgacctttgaggagttctgtgtgttctacaagatgatgagcctgcggcgggacctgtacctgctgctgctgagctacagcgacaagaaggaccacctgactgtggaggagctggcccagttcctgaaggtggagcagaagatgaacaacgtgaccacagactactgcctggacatcatcaagaagtttgaggtgtctgaggagaacaaggtgaagaatgtgctgggcatcgagggcttcaccaacttcatgaggagccctgcctgtgacatcttcaaccccctgcaccacgaggtgtaccaggacatggaccagcccctgtgcaactactacatcgccagcagccacaacacctacctgactggagaccagctgctgagccagagcaaggtggacatgtatgcccgggtgctgcaggagggctgccgctgtgtggaggtggactgctgggatggcccagatggagagcctgtggtgcaccacggctacaccctgaccagcaagatcctcttcagagatgtggtggagaccatcaacaagcacgcctttgtgaagaatgagttccctgtgatcctgagcattgagaaccactgcagcatccagcagcagaggaagatcgcccagtacctgaagggcatctttggagacaagctggacctgagctctgtggacacaggagagtgcaagcagctgcccagcccccagagcctgaagggcaagatcctggtgaagggcaagaagctgccctaccacctgggagatgatgctgaggagggggaggtgtctgatgaggacagcgcagatgaaattgaagatgagtgcaagttcaagctgcactacagcaatggcaccacagagcaccaggtggagagcttcatcaggaagaagctggagagcctgctgaaggagagccagatccgggacaaggaggaccctgacagcttcaccgtgcgggccctgctgaaggccacccatgagggcctgaatgcccacctgaagcagagcccagatgtgaaggagagcggcaagaagagccacggccgcagcctgatgaccaactttgggaagcacaagaagaccaccaagagccgcagcaagagctacagcacagatgatgaggaggacacccagcagagcacaggcaaggagggcggccagctgtaccgcctgggcagaagaaggaagaccatgaagctgtgccgggagctgagtgacctggtggtgtacaccaacagcgtggccgcccaggacatcgtggatgatggcaccactggaaatgtgctgtccttcagcgagacccgggcccaccaggtggtgcagcagaagtctgagcagttcatgatctacaaccagaagcagctgacccgcatctaccccagcgcctacagaattgacagcagcaacttcaaccccctgccctactggaatgccggctgccagctggtggccctgaactaccagagcgagggccgcatgatgcagctgaacagagccaagttcaaggccaatggaaactgtggctacgtgctgaagccccagcagatgtgcaagggcaccttcaaccccttcagcggggaccccctgcctgccaaccccaagaagcagctgatcctgaaggtgatcagcggccagcagctgcccaagcccccagacagcatgtttggagacagaggagagatcatcgacccctttgtggaggtggagatcatcggcctgcctgtggactgctgcaaggaccagaccagggtggtggatgacaatggcttcaaccctgtgtgggaggagaccctgaccttcaccgtgcacatgcctgagatcgccctggtgcgcttcctggtgtgggaccatgaccccatcggccgggactttgtgggccagaggacagtgaccttcagcagcctggtgcccggctaccgccacgtgtacctggagggcctgacagaggccagcatctttgtgcacatcaccatcaatgagatctacggcaagtggagccccctcatcctgaaccccagctacaccatcctgcacttcctgggcgccaccaagaaccggcagctgcagggcctgaagggcctcttcaacaagaaccccaggcacagcagcagcgagaacaacagccactacgtgaggaagaggagcattggagaccgcatcctgcggaggacagccagcgccccagccaagggcaggaagaagagcaagatgggcttccaggagatggtggagatcaaggacagcgtgtctgaggccacccgggaccaggatggagtgctgcggaggaccaccaggagcctgcaggcccggcctgtgtccatgcctgtggacaggaacctgctgggcgccctgagcctgcctgtgtctgaaacagccaaggacatcgagggcaaggagaacagcctggccgaggacaaggatggccgcaggaagggcaaggccagcatcaaggacccccacttcctgaacttcaacaagaagctgagcagcagcagcagcgccctgctgcacaaggacaccagccagggcgacaccatcgtgtccacagcccacatgtctgtgactggagagcagctgggcatgagcagcccccggggcggccgcaccaccagcaatgccaccagcaactgccaggagaacccctgccccagcaagagcctgagccccaagcagcacctggccccagaccctgtggtgaaccccacccaggacctgcatggagtgaagatcaaggagaagggcaaccctgaggactttgtggagggcaagagcatcctgagcggctctgtgctgagccacagcaacctggagatcaagaacctggagggcaacagaggcaagggccgggccgccaccagcttcagcctgagtgatgtgtccatgctgtgcagcgacatcccagacctgcacagcacagccatcctgcaggagagcgtcatcagccacctgattgacaacgtgaccctgaccaatgaaaatgagcccggcagcagcatcagcgccctgattggccagtttgatgagaccaacaaccaggccctgactgtggtgagccacctgcacaacacctctgtgatgagcggccactgccccctgcccagcctgggcctgaagatgcccatcaagcacggcttctgcaagggcaagagcaagagcagcttcctgtgcagcagccctgagctgattgccctgagcagcagcgagaccaccaagcacgccaccaacacagtgtatgagaccacctgcacccccatcagcaagaccaagccagatgatgacctgagcagcaaggccaagacagctgccctggagagcaacctgcccggcagccccaacaccagccggggctggctgcccaagagccccaccaagggggaggactgggagaccctgaagagctgcagccctgccagcagcccagacctgaccctggaggatgtgattgctgaccccaccctgtgcttcaacagcggggagagcagcctggtggagattgatggagagagcgagaacctgagcctgaccacctgtgagtacagaagagagggcaccagccagctggccagccccctgaagctgaagtacaaccagggcgtggtggagcacttccagaggggcctgagaaatggctactgcaaggagaccctgcggcccagcgtgcctgagatcttcaacaacatccaggatgtgaagacccagagcatctcctacctggcctaccagggcgccggctttgtgcacaaccacttcagtgacagtgatgccaagatgttccagacctgtgtgccccagcagagcagcgcccaggacatgcacgtgcctgtgcccaagcagctggcccacctgcccctgcctgccctgaagctgcccagcccctgcaagagcaagagcctgggggacctgaccagtgaagatattgcctgcaactttgagagcaagtaccagtgcatcagcaagagctttgtgaccaccggcatccgggacaagaagggcgtgacagtgaagaccaagagcctggagcccattgatgccctgacagagcagctgaggaagctggtgtcctttgaccaggaggacaactgccaggtgctgtacagcaagcaggatgccaaccagctgccccgggccctggtgaggaagctgagcagccgcagccagagccgggtgagaaatattgccagccgggccaaggagaagcaggaggccaacaagcagaaggtgcccaaccccagcaatggagctggggtggtgctgaggaacaagcccagcgcccccaccccagctgtgaacagacacagcacaggcagctacatcgccggctacctgaagaacaccaagggcggcggcctggagggccggggcatccctgagggcgcctgcacagccctgcactacggccacgtggaccagttctgcagcgacaacagcgtgctgcagacagagcccagcagtgatgacaagccagagatctacttcctgctgcggctgtag

SEQ ID NO: 164120 - DNA, 4968 bp, Artificial Sequence; identical to SEQ ID NO: 164118
  Description of Artificial Sequence: Synthetic coding sequence

SEQ ID NO: 164121 - DNA, 3009 bp, Artificial Sequence
  Description of Artificial Sequence: Synthetic coding sequence
atggctgacctggaggtgtacaagaacctgagccctgagaaggtggagcgctgcatgtctgtgatgcagagcggcacccagatgatcaagctgaagaggggcaccaagggcctggtgcggctcttctacctggatgagcacaggacccggctgcgctggaggcccagcaggaagtctgagaaggccaagatcctgattgacagcatctacaaggtgacagagggccggcagagcgagatcttccaccggcaggccgagggcaactttgaccccagctgctgcttcaccatctaccacggcaaccacatggagagcctggacctgatcaccagcaaccctgaggaggcccggacctggatcaccggcctgaagtacctgatggccggcatcagtgatgaggacagcctggccaagaggcagaggacccatgaccagtgggtgaagcagacctttgaggaggccgacaagaatggagatggcctgctgaacatcgaggagatccaccagctgatgcacaagctgaatgtgaacctgcccaggaggaaggtgcggcagatgttccaggaggccgacacagatgagaaccagggcaccctgacctttgaggagttctgtgtgttctacaagatgatgagcctgcggcgggacctgtacctgctgctgctgagctacagcgacaagaaggaccacctgactgtggaggagctggcccagttcctgaaggtggagcagaagatgaacaacgtgaccacagactactgcctggacatcatcaagaagtttgaggtgtctgaggagaacaaggtgaagaatgtgctgggcatcgagggcttcaccaacttcatgaggagccctgcctgtgacatcttcaaccccctgcaccacgaggtgtaccaggacatggaccagcccctgtgcaactactacatcgccagcagccacaacacctacctgactggagaccagctgctgagccagagcaaggtggacatgtatgcccgggtgctgcaggagggctgccgctgtgtggaggtggactgctgggatggcccagatggagagcctgtggtgcaccacggctacaccctgaccagcaagatcctcttcagagatgtggtggagaccatcaacaagcacgcctttgtgaagaatgagttccctgtgatcctgagcattgagaaccactgcagcatccagcagcagaggaagatcgcccagtacctgaagggcatctttggagacaagctggacctgagctctgtggacacaggagagtgcaagcagctgcccagcccccagagcctgaagggcaagatcctggtgaagggcaagaagctgccctaccacctgggagatgatgctgaggagggggaggtgtctgatgaggacagcgcagatgaaattgaagatgagtgcaagttcaagctgcactacagcaatggcaccacagagcaccaggtggagagcttcatcaggaagaagctggagagcctgctgaaggagagccagatccgggacaaggaggaccctgacagcttcaccgtgcgggccctgctgaaggccacccatgagggcctgaatgcccacctgaagcagagcccagatgtgaaggagagcggcaagaagagccacggccgcagcctgatgaccaactttgggaagcacaagaagaccaccaagagccgcagcaagagctacagcacagatgatgaggaggacacccagcagagcacaggcaaggagggcggccagctgtaccgcctgggcagaagaaggaagaccatgaagctgtgccgggagctgagtgacctggtggtgtacaccaacagcgtggccgcccaggacatcgtggatgatggcaccactggaaatgtgctgtccttcagcgagacccgggcccaccaggtggtgcagcagaagtctgagcagttcatgatctacaaccagaagcagctgacccgcatctaccccagcgcctacagaattgacagcagcaacttcaaccccctgccctactggaatgccggctgccagctggtggccctgaactaccagagcgagggccgcatgatgcagctgaacagagccaagttcaaggccaatggaaactgtggctacgtgctgaagccccagcagatgtgcaagggcaccttcaaccccttcagcggggaccccctgcctgccaaccccaagaagcagctgatcctgaaggtgatcagcggccagcagctgcccaagcccccagacagcatgtttggagacagaggagagatcatcgacccctttgtggaggtggagatcatcggcctgcctgtggactgctgcaaggaccagaccagggtggtggatgacaatggcttcaaccctgtgtgggaggagaccctgaccttcaccgtgcacatgcctgagatcgccctggtgcgcttcctggtgtgggaccatgaccccatcggccgggactttgtgggccagaggacagtgaccttcagcagcctggtgcccggctaccgccacgtgtacctggagggcctgacagaggccagcatctttgtgcacatcaccatcaatgagatctacggcaagtggagccccctcatcctgaaccccagctacaccatcctgcacttcctgggcgccaccaagaaccggcagctgcagggcctgaagggcctcttcaacaagaaccccaggcacagcagcagcgagaacaacagccactacgtgaggaagaggagcattggagaccgcatcctgcggaggacagccagcgccccagccaagggcaggaagaagagcaagatgggcttccaggagatggtggagatcaaggacagcgtgtctgaggccacccgggaccaggatggagtgctgcggaggaccaccaggagcctgcaggcccggcctgtgtccatgcctgtggacaggaacctgctgggcgccctgagcctgcctgtgtctgaaacagccaaggacatcgagggcaaggagaacagcctggtgcagatctag

SEQ ID NO: 164122 - DNA, 4968 bp, Artificial Sequence; identical to SEQ ID NO: 164118
  Description of Artificial Sequence: Synthetic coding sequence

SEQ ID NO: 164123 - DNA, 3045 bp, Artificial Sequence
  Description of Artificial Sequence: Synthetic coding sequence
atggctgacctggaggtgtacaagaacctgagccctgagaaggtggagcgctgcatgtctgtgatgcagagcggcacccagatgatcaagctgaagaggggcaccaagggcctggtgcggctcttctacctggatgagcacaggacccggctgcgctggaggcccagcaggaagtctgagaaggccaagatcctgattgacagcatctacaaggtgacagagggccggcagagcgagatcttccaccggcaggccgagggcaactttgaccccagctgctgcttcaccatctaccacggcaaccacatggagagcctggacctgatcaccagcaaccctgaggaggcccggacctggatcaccggcctgaagtacctgatggccggcatcagtgatgaggacagcctggccaagaggcagaggacccatgaccagtgggtgaagcagacctttgaggaggccgacaagaatggagatggcctgctgaacatcgaggagatccaccagctgatgcacaagctgaatgtgaacctgcccaggaggaaggtgcggcagatgttccaggaggccgacacagatgagaaccagggcaccctgacctttgaggagttctgtgtgttctacaagatgatgagcctgcggcgggacctgtacctgctgctgctgagctacagcgacaagaaggaccacctgactgtggaggagctggcccagttcctgaaggtggagcagaagatgaacaacgtgaccacagactactgcctggacatcatcaagaagtttgaggtgtctgaggagaacaaggtgaagaatgtgctgggcatcgagggcttcaccaacttcatgaggagccctgcctgtgacatcttcaaccccctgcaccacgaggtgtaccaggacatggaccagcccctgtgcaactactacatcgccagcagccacaacacctacctgactggagaccagctgctgagccagagcaaggtggacatgtatgcccgggtgctgcaggagggctgccgctgtgtggaggtggactgctgggatggcccagatggagagcctgtggtgcaccacggctacaccctgaccagcaagatcctcttcagagatgtggtggagaccatcaacaagcacgcctttgtgaagaatgagttccctgtgatcctgagcattgagaaccactgcagcatccagcagcagaggaagatcgcccagtacctgaagggcatctttggagacaagctggacctgagctctgtggacacaggagagtgcaagcagctgcccagcccccagagcctgaagggcaagatcctggtgaagggcaagaagctgccctaccacctgggagatgatgctgaggagggggaggtgtctgatgaggacagcgcagatgaaattgaagatgagtgcaagttcaagctgcactacagcaatggcaccacagagcaccaggtggagagcttcatcaggaagaagctggagagcctgctgaaggagagccagatccgggacaaggaggaccctgacagcttcaccgtgcgggccctgctgaaggccacccatgagggcctgaatgcccacctgaagcagagcccagatgtgaaggagagcggcaagaagagccacggccgcagcctgatgaccaactttgggaagcacaagaagaccaccaagagccgcagcaagagctacagcacagatgatgaggaggacacccagcagagcacaggcaaggagggcggccagctgtaccgcctgggcagaagaaggaagaccatgaagctgtgccgggagctgagtgacctggtggtgtacaccaacagcgtggccgcccaggacatcgtggatgatggcaccactggaaatgtgctgtccttcagcgagacccgggcccaccaggtggtgcagcagaagtctgagcagttcatgatctacaaccagaagcagctgacccgcatctaccccagcgcctacagaattgacagcagcaacttcaaccccctgccctactggaatgccggctgccagctggtggccctgaactaccagagcgagggccgcatgatgcagctgaacagagccaagttcaaggccaatggaaactgtggctacgtgctgaagccccagcagatgtgcaagggcaccttcaaccccttcagcggggaccccctgcctgccaaccccaagaagcagctgatcctgaaggtgatcagcggccagcagctgcccaagcccccagacagcatgtttggagacagaggagagatcatcgacccctttgtggaggtggagatcatcggcctgcctgtggactgctgcaaggaccagaccagggtggtggatgacaatggcttcaaccctgtgtgggaggagaccctgaccttcaccgtgcacatgcctgagatcgccctggtgcgcttcctggtgtgggaccatgaccccatcggccgggactttgtgggccagaggacagtgaccttcagcagcctggtgcccggctaccgccacgtgtacctggagggcctgacagaggccagcatctttgtgcacatcaccatcaatgagatctacggcaagaaccggcagctgcagggcctgaagggcctcttcaacaagaaccccaggcacagcagcagcgagaacaacagccactacgtgaggaagaggagcattggagaccgcatcctgcggaggacagccagcgccccagccaagggcaggaagaagagcaagatgggcttccaggagatggtggagatcaaggacagcgtgtctgaggccacccgggaccaggatggagtgctgcggaggaccaccaggagcctgcaggcccggcctgtgtccatgcctgtggacaggaacctgctgggcgccctgagcctgcctgtgtctgaaacagccaaggacatcgagggcaaggagaacagcctggacagcagcttctgccggcccacagagcaggccaaggccgagatgtgcaaggtgcccttcccccggcagctggagtgtgtgatgaagatggagatcagcgagacctag

SEQ ID NO: 164124 - DNA, 3507 bp, Artificial Sequence
  Description of Artificial Sequence: Synthetic coding sequence
atgttccgggaggccgacacagatgaccaccagggcaccctgggctttgaggagttctgtgccttctacaagatgatgagcacccggcgggacctgtacctgctgatgctgacctacagcaaccacaaggaccacctggatgctgccagcctgcagcgcttcctgcaggtggagcagaagatggccggcgtgaccctggagagctgccaggacatcatcgagcagtttgagccctgcccagagaacaagagcaagggcctgctgggcattgatggcttcaccaactacaccaggagccctgctggggacatcttcaaccctgagcaccaccacgtgcaccaggacatgacccagcccctgagccactacttcatcaccagcagccacaacacctacctggtgggggaccagctgatgagccagagccgggtggacatgtatgcctgggtgctgcaggccggctgccgctgtgtggaggtggactgctgggatggcccagatggagagcccatcgtgcaccacggctacaccctgaccagcaagatcctcttcaaggatgtgattgagaccatcaacaagtatgccttcatcaagaatgagtaccctgtgatcctgagcattgagaaccactgcagcgtcatccagcagaagaagatggcccagtacctgacagacatcctgggggacaagctggacctgagctctgtgtccagtgaagatgccaccaccctgcccagcccccagatgctgaagggcaagatcctggtgaagggcaagaagctgcctgccaacatcagtgaagatgctgaggagggggaggtgtctgatgaagattctgcagatgaaattgatgatgactgcaagctgctgaatggagatgccagcaccaacaggaagagggtggagaacacagccaagaggaagctggacagcctcatcaaggagagcaagatccgggactgtgaggaccccaacaacttctctgtgtccaccctgagccccagcggcaagctgggcaggaagagcaaggccgaggaggatgtggagagcggggaggatgctggggccagcagaagaaatggccgcctggtggtgggcagcttcagcaggaggaagaagaagggcagcaagctgaagaaggccgcctctgtggaggagggagatgagggccaggacagccctgggggccagagcagaggagccacccggcagaagaagaccatgaagctgagccgggccctgagtgacctggtgaagtacaccaagtctgtggccacccatgacatcgagatggaggccgccagctcctggcaggtgtcctccttcagcgagaccaaggcccaccagatcctgcagcagaagccagcccagtacctgcgcttcaaccagcagcagctgagccgcatctaccccagcagctacagagtggacagcagcaactacaacccccagcccttctggaatgccggctgccagatgggcgtcttcaaccccaacagcgaggaccccctgcccggccagctgaagaagcagctggtgctgcgcatcatcagcggccagcagctgcccaagccccgggacagcatgctgggggacagaggagagatcatcgacccctttgtggaggtggagatcatcggcctgcctgtggactgcagccgggagcagaccagggtggtggatgacaatggcttcaaccccacctgggaggagaccctggtgttcatggtgcacatgcctgagatcgccctggtgcgcttcctggtgtgggaccatgaccccatcggccgggacttcatcggccagaggaccctggccttcagctccatgatgcctggctaccgccacgtgtacctggagggcatggaggaggccagcatctttgtgcacgtggccgtgtctgacatcagcggcaaggtgaagcaggccctgggcctgaagggcctcttcctgcggggccccaagccaggcagcctggacagccatgctgctggccggcccccagcccggcccagcgtgtcccagaggatcctgcggaggacagccagcgcccccaccaagagccagaagccaggaagaagaggcttccctgagctggtgctgggcacccgggacaccggcagcaaaggagtggctgatgatgtggtgcccccaggccctggccctgcccctgaggccccagcccaggagggccctggcagcggcagcccccgggacacccggcccctgagcacccagaggcccctgccccccctgtgcagcctggagaccatcgccgaggagcccgcccctggccctggccccccacctcctgctgctgtgcccaccagcagcagccagggccggcccccctaccccactggacctggggccaacgtggccagccccctggaggacacagaggagccccgggacagccggccccggccctgcaatggagagggcgctgggggcgcctatgaaagagcccctggcagccagacagatggccgcagccagcccaggaccctgggccacctgcctgtgatccggcgggtgaagtctgagggccaggtgcccacagagcccctgggcggctggaggcccctggccgcccccttccctgccccagctgtgtacagtgatgccactggaagtgaccccctgtggcagaggctggagccctgtggccaccgggacagcgtgagcagcagcagctccatgagcagcagtgacaccgtcatcgacctgagcctgcccagcctgggcctgggccgcagccgggagaacctggccggggcccacatgggccgcctgcccccccggccccacagcgccagcgctgcccggccagacctgccccctgtgaccaagagcaagagcaaccccaacctgcgggccaccggccagaggcctcccatcccagatgagctgcagcccaggagcctggcccccaggatggccggcctgcccttccggcccccctggggctgcctgagcctggtgggcgtgcaggactgccctgtggccgccaagagcaagagcctgggggacctgacagcagatgactttgcccccagctttgaaggaggcagccggcggctgagccacagcctgggcctgcccggcggcaccaggagagtgtctggccctggggtgagaagagacaccctgacagagcagctgcgctggctgactgtgttccagcaggccggggacatcaccagccccaccagcctgggccctgctggggagggcgtggccggcggccctggctttgtgcggcgcagcagcagccgcagccacagccgggtgcgggccatcgccagccgggcccggcaggcccaggagcggcagcagaggctgcagggcctgggccggcagggccccccagaggaggagcggggcaccccagagggcgcctgcagcgtgggccacgagggctctgtggatgccccagcccccagcaagggggccctgggccctgccagcgctgctgctgagaacctggtgctgctgcggctgtag

SEQ ID NO: 164125 - DNA, 1500 bp, Artificial Sequence
  Description of Artificial Sequence: Synthetic coding sequence
atgggcgccatgcaggagggcatgcagatggtgaagctgcggggcggcagcaagggcctggtgcgcttctactacctggatgagcacaggagctgcatccgctggaggcccagcaggaagaatgagaaggccaagatcagcattgacagcatccaggaggtgtctgagggccggcagagcgaggtgttccagcgctacccagatggcagcttcatcatcgacccctttgtggaggtggagatcatcggcctgcctgtggactgcagccgggagcagaccagggtggtggatgacaatggcttcaaccccacctgggaggagaccctggtgttcatggtgcacatgcctgagatcgccctggtgcgcttcctggtgtgggaccatgaccccatcggccgggacttcatcggccagaggaccctggccttcagctccatgatgcctggctaccgccacgtgtacctggagggcatggaggaggccagcatctttgtgcacgtggccgtgtctgacatcagcggcaaggtgaagcaggccctgggcctgaagggcctcttcctgcggggccccaagccaggcagcctggacagccatgctgctggccggcccccagcccggcccagcgtgtcccagaggatcctgcggaggacagccagcgcccccaccaagagccagaagccaggaagaagaggcttccctgagctggtgctgggcacccgggacaccggcagcaaaggagtggctgatgatgtggtgcccccaggccctggccctgcccctgaggccccagcccaggagggccctggcagcggcagcccccggggcaaggccccagctgctgtggccgagaagagccctgtgcgggtgcggcccccccgggtgctggatggccctggccctgctggcatggccgccacctgcatgaagtgtgtggtgggcagctgtgccggcgtgaacacaggaggcctgcagcgggagcggccccccagccctggccctgccagccggcaggccgccatccggcagcagccccgggcccgggctgacagcctgggcgccccctgctgcggcctggacccccacgccatccctggccgcagccgggaggcccccaagggccctggggcctggaggcagggccctgggggcagcggctccatgagcagtgacagcagcagcccagacagccctggcatccctgagaggagcccccgctggccagagggcgcctgccggcagcccggggccctgcagggcgagatgtctgccctgtttgcccagaagctggaggagatccgcagcaagagccccatgttttctgctgggaagcccctgctgccctgtgtggtgctgccccacgcccctggcatggccggccctggcagccctgctgctgccagcgcctggacagtgagcccccgggtgctggtgctggtggccctgtacccctggcactgcctgcggggcaccctgctgccctggctggcctgtggcccctag

SEQ ID NO: 164126 - DNA, 3177 bp, Artificial Sequence
  Description of Artificial Sequence: Synthetic coding sequence
atggccggcatcagtgatgaggacagcctggcccggcggcagaggacccgggaccagtggctgaagcagacctttgatgaggccgacaagaatggagatggcagcctgagcatcggggaggtgctgcagctgctgcacaagctgaatgtgaacctgccccggcagagggtgaagcagatgttccgggaggccgacacagatgaccaccagggcaccctgggctttgaggagttctgtgccttctacaagatgatgagcacccggcgggacctgtacctgctgatgctgacctacagcaaccacaaggaccacctggatgctgccagcctgcagcgcttcctgcaggtggagcagaagatggccggcgtgaccctggagagctgccaggacatcatcgagcagtttgagccctgcccagagaacaagagcaagggcctgctgggcattgatggcttcaccaactacaccaggagccctgctggggacatcttcaaccctgagcaccaccacgtgcaccaggacatgacccagcccctgagccactacttcatcaccagcagccacaacacctacctggtgggggaccagctgatgagccagagccgggtggacatgtatgcctgggtgctgcaggccggctgccgctgtgtggaggtggactgctgggatggcccagatggagagcccatcgtgcaccacggctacaccctgaccagcaagatcctcttcaaggatgtgattgagaccatcaacaagtatgccttcatcaagaatgagtaccctgtgatcctgagcattgagaaccactgcagcgtcatccagcagaagaagatggcccagtacctgacagacatcctgggggacaagctggacctgagctctgtgtccagtgaagatgccaccaccctgcccagcccccagatgctgaagggcaagatcctggtgaagggcaagaagctgcctgccaacatcagtgaagatgctgaggagggggaggtgtctgatgaggacagcgcagatgaaattgatgatgactgcaagctgctgaatggagatgccagcaccaacaggaagagggtggagaacacagccaagaggaagctggacagcctcatcaaggagagcaagatccgggactgtgaggaccccaacaacttctctgtgtccaccctgagccccagcggcaagctgggcaggaagagcaaggccgaggaggatgtggagagcggagaagatgctggggccagcagaagaaatggccgcctggtggtgggcagcttcagcaggaggaagaagaagggcagcaagctgaagaaggccgcctctgtggaggagggagatgagggccaggacagccctgggggccagagcagaggagccacccggcagaagaagaccatgaagctgagccgggccctgagtgacctggtgaagtacaccaagtctgtggccacccatgacatcgagatggaggccgccagctcctggcaggtgagcagcttcagcgagaccaaggcccaccagatcctgcagcagaagccagcccagtacctgcgcttcaaccagcagcagctgagccgcatctaccccagcagctacagagtggacagcagcaactacaacccccagcccttctggaatgccggctgccagatggtggccctgaactaccagagcgagggccgcatgctgcagctgaacagagccaagttcagcgccaacggcggctgcggctacgtgctgaagccaggctgcatgtgccagggcgtcttcaaccccaacagcgaggaccccctgcccggccagctgaagaagcagctggtgctgcgcatcatcagcggccagcagctgcccaagccccgggacagcatgctgggggacagaggagagatcatcgacccctttgtggaggtggagatcatcggcctgcctgtggactgcagccgggagcagaccagggtggtggatgacaatggcttcaaccccacctgggaggagaccctggtgttcatggtgcacatgcctgagatcgccctggtgcgcttcctggtgtgggaccatgaccccatcggccgggacttcatcggccagaggaccctggccttcagctccatgatgcctggctacagacatgtgtacctggagggcatggaggaggccagcatctttgtgcacgtggccgtgtctgacatcagcggcaaggtgaagcaggccctgggcctgaagggcctcttcctgcggggccccaagccaggcagcctggacagccacgccgccggccggcccccagcccggcccagcgtgtcccagaggatcctgcggaggacagccagcgcccccaccaagagccagaagccaggccggcggggcttccctgagctggtgctgggcacccgggacaccggcagcaagggcgtggctgatgatgtggtgcccccaggccctggccctgcccctgaggccccagcccaggagggccctggcagcggcagcccccggggcaaggccccagctgctgtggccgagaagagccctgtgcgggtgcggcccccccgggtgctggatggccctggccctgctggcatggccgccacctgcatgaagtgtgtggtgggcagctgtgccggcgtgaacacaggaggcctgcagcgggagaggcctcccagccctggccctgccagccggcaggccgccatccggcagcagccccgggcccgggctgacagcctgggcgccccctgctgcggcctggacccccacgccatccctggccgcagccgggaggcccccaagggccctggggcctggaggcagggccctgggggcagcggctccatgagcagtgacagcagcagcccagacagccctggcatccctgagaggagcccccgctggccagagggcgcctgccggcagcccggggccctgcagggcgagatgtctgccctgtttgcccagaagctggaggagatccgcagcaagagccccatgttttctgctgggaagcccctgctgccctgtgtggtgctgccccacgcccctggcatggccggccctggcagccctgctgctgccagcgcctggacagtgagcccccgggtgctggtgctggtggccctgtacccctggcactgcctgcggggcaccctgctgccctggctggcctgtggcccctag

SEQ ID NO: 164127 - DNA, 1494 bp, Artificial Sequence
  Description of Artificial Sequence: Synthetic coding sequence
atgggcgccatgcaggagggcatgcagatggtgaagctgcggggcggcagcaagggcctggtgcgcttctactacctggatgagcacaggagctgcatccgctggaggcccagcaggaagaatgagaaggccaagatcagcattgacagcatccaggaggtgtctgagggccggcagagcgaggtgttccagcgctacccagatggcagctttgacccctttgtggaggtggagatcatcggcctgcctgtggactgcagccgggagcagaccagggtggtggatgacaatggcttcaaccccacctgggaggagaccctggtgttcatggtgcacatgcctgagatcgccctggtgcgcttcctggtgtgggaccatgaccccatcggccgggacttcatcggccagaggaccctggccttcagctccatgatgcctggctaccgccacgtgtacctggagggcatggaggaggccagcatctttgtgcacgtggccgtgtctgacatcagcggcaaggtgaagcaggccctgggcctgaagggcctcttcctgcggggccccaagccaggcagcctggacagccatgctgctggccggcccccagcccggcccagcgtgtcccagaggatcctgcggaggacagccagcgcccccaccaagagccagaagccaggaagaagaggcttccctgagctggtgctgggcacccgggacaccggcagcaaaggagtggctgatgatgtggtgcccccaggccctggccctgcccctgaggccccagcccaggagggccctggcagcggcagcccccggggcaaggccccagctgctgtggccgagaagagccctgtgcgggtgcggcccccccgggtgctggatggccctggccctgctggcatggccgccacctgcatgaagtgtgtggtgggcagctgtgccggcgtgaacacaggaggcctgcagcgggagcggccccccagccctggccctgccagccggcaggccgccatccggcagcagccccgggcccgggctgacagcctgggcgccccctgctgcggcctggacccccacgccatccctggccgcagccgggaggcccccaagggccctggggcctggaggcagggccctgggggcagcggctccatgagcagtgacagcagcagcccagacagccctggcatccctgagaggagcccccgctggccagagggcgcctgccggcagcccggggccctgcagggcgagatgtctgccctgtttgcccagaagctggaggagatccgcagcaagagccccatgttttctgctgggaagcccctgctgccctgtgtggtgctgccccacgcccctggcatggccggccctggcagccctgctgctgccagcgcctggacagtgagcccccgggtgctggtgctggtggccctgtacccctggcactgcctgcggggcaccctgctgccctggctggcctgtggcccctag

SEQ ID NO: 164128 - DNA, 4251 bp, Artificial Sequence
  Description of Artificial Sequence: Synthetic coding sequence
atgagcggcccctggcccagcccagacagcaggaccaagggcaccgtggcctggctggccgaggtgctgctgtgggtgggcggctctgtggtgctgagcagcgagtggcagctgggccccctggtggagcgctgcatgggcgccatgcaggagggcatgcagatggtgaagctgcggggcggcagcaagggcctggtgcgcttctactacctggatgagcacaggagctgcatccgctggaggcccagcaggaagaatgagaaggccaagatcagcattgacagcatccaggaggtgtctgagggccggcagagcgaggtgttccagcgctacccagatggcagctttgaccccaactgctgcttcagcatctaccacggcagccaccgggagagcctggacctggtgtccaccagcagcgaggtggcccggacctgggtgacaggcctgcgctacctgatggccggcatcagtgatgaggacagcctggcccggcggcagaggacccgggaccagtggctgaagcagacctttgatgaagctgacaagaatggagatggcagcctgagcattggagaggtgctgcagctgctgcacaagctgaatgtgaacctgccccggcagagggtgaagcagatgttccgggaggccgacacagatgaccaccagggcaccctgggctttgaggagttctgtgccttctacaagatgatgagcacccggcgggacctgtacctgctgatgctgacctacagcaaccacaaggaccacctggatgctgccagcctgcagcgcttcctgcaggtggagcagaagatggccggcgtgaccctggagagctgccaggacatcatcgagcagtttgagccctgcccagagaacaagagcaagggcctgctgggcattgatggcttcaccaactacaccaggagccctgctggggacatcttcaaccctgagcaccaccacgtgcaccaggacatgacccagcccctgagccactacttcatcaccagcagccacaacacctacctggtgggggaccagctgatgagccagagccgggtggacatgtatgcctgggtgctgcaggccggctgccgctgtgtggaggtggactgctgggatggcccagatggagagcccatcgtgcaccacggctacaccctgaccagcaagatcctcttcaaggatgtgattgagaccatcaacaagtatgccttcatcaagaatgagtaccctgtgatcctgagcattgagaaccactgcagcgtcatccagcagaagaagatggcccagtacctgacagacatcctgggggacaagctggacctgagctctgtgtccagtgaagatgccaccaccctgcccagcccccagatgctgaagggcaagatcctggtgaagggcaagaagctgcctgccaacatcagtgaagatgctgaggagggggaggtgtctgatgaagattctgcagatgaaattgatgatgactgcaagctgctgaatggagatgccagcaccaacaggaagagggtggagaacacagccaagaggaagctggacagcctcatcaaggagagcaagatccgggactgtgaggaccccaacaacttctctgtgtccaccctgagccccagcggcaagctgggcaggaagagcaaggccgaggaggatgtggagagcggggaggatgctggggccagcagaagaaatggccgcctggtggtgggcagcttcagcaggaggaagaagaagggcagcaagctgaagaaggccgcctctgtggaggagggagatgagggccaggacagccctgggggccagagcagaggagccacccggcagaagaagaccatgaagctgagccgggccctgagtgacctggtgaagtacaccaagtctgtggccacccatgacatcgagatggaggccgccagctcctggcaggtgtcctccttcagcgagaccaaggcccaccagatcctgcagcagaagccagcccagtacctgcgcttcaaccagcagcagctgagccgcatctaccccagcagctacagagtggacagcagcaactacaacccccagcccttctggaatgccggctgccagatggtggccctgaactaccagagcgagggccgcatgctgcagctgaacagagccaagttcagcgccaatggaggctgcggctacgtgctgaagccaggctgcatgtgccagggcgtcttcaaccccaacagcgaggaccccctgcccggccagctgaagaagcagctggtgctgcgcatcatcagcggccagcagctgcccaagccccgggacagcatgctgggggacagaggagagatcatcgacccctttgtggaggtggagatcatcggcctgcctgtggactgcagccgggagcagaccagggtggtggatgacaatggcttcaaccccacctgggaggagaccctggtgttcatggtgcacatgcctgagatcgccctggtgcgcttcctggtgtgggaccatgaccccatcggccgggacttcatcggccagaggaccctggccttcagctccatgatgcctggctaccgccacgtgtacctggagggcatggaggaggccagcatctttgtgcacgtggccgtgtctgacatcagcggcaaggtgaagcaggccctgggcctgaagggcctcttcctgcggggccccaagccaggcagcctggacagccatgctgctggccggcccccagcccggcccagcgtgtcccagaggatcctgcggaggacagccagcgcccccaccaagagccagaagccaggaagaagaggcttccctgagctggtgctgggcacccgggacaccggcagcaaaggagtggctgatgatgtggtgcccccaggccctggccctgcccctgaggccccagcccaggagggccctggcagcggcagcccccgggacacccggcccctgagcacccagaggcccctgccccccctgtgcagcctggagaccatcgccgaggagcccgcccctggccctggccccccacctcctgctgctgtgcccaccagcagcagccagggccggcccccctaccccactggacctggggccaacgtggccagccccctggaggacacagaggagccccgggacagccggccccggccctgcaatggagagggcgctgggggcgcctatgaaagagcccctggcagccagacagatggccgcagccagcccaggaccctgggccacctgcctgtgatccggcgggtgaagtctgagggccaggtgcccacagagcccctgggcggctggaggcccctggccgcccccttccctgccccagctgtgtacagtgatgccactggaagtgaccccctgtggcagaggctggagccctgtggccaccgggacagcgtgagcagcagcagctccatgagcagcagtgacaccgtcatcgacctgagcctgcccagcctgggcctgggccgcagccgggagaacctggccggggcccacatgggccgcctgcccccccggccccacagcgccagcgctgcccggccagacctgccccctgtgaccaagagcaagagcaaccccaacctgcgggccaccggccagaggcctcccatcccagatgagctgcagcccaggagcctggcccccaggatggccggcctgcccttccggcccccctggggctgcctgagcctggtgggcgtgcaggactgccctgtggccgccaagagcaagagcctgggggacctgacagcagatgactttgcccccagctttgaaggaggcagccggcggctgagccacagcctgggcctgcccggcggcaccaggagagtgtctggccctggggtgagaagagacaccctgacagagcagctgcgctggctgactgtgttccagcaggccggggacatcaccagccccaccagcctgggccctgctggggagggcgtggccggcggccctggctttgtgcggcgcagcagcagccgcagccacagccgggtgcgggccatcgccagccgggcccggcaggcccaggagcggcagcagaggctgcagggcctgggccggcagggccccccagaggaggagcggggcaccccagagggcgcctgcagcgtgggccacgagggctctgtggatgccccagcccccagcaagggggccctgggccctgccagcgctgctgctgagaacctggtgctgctgcggctgtag

SEQ ID NO: 164129 - DNA, 4143 bp, Artificial Sequence
  Description of Artificial Sequence: Synthetic coding sequence
atgagcggcccctggcccagcccagacagcaggaccaagggcaccgtggcctggctggccgaggtgctgctgtgggtgggcggctctgtggtgctgagcagcgagtggcagctgggccccctggtggagcgctgcatgggcgccatgcaggagggcatgcagatggtgaagctgcggggcggcagcaagggcctggtgcgcttctactacctggatgagcacaggagctgcatccgctggaggcccagcaggaagaatgagaaggccaagatcagcattgacagcatccaggaggtgtctgagggccggcagagcgaggtgttccagcgctacccagatggcagctttgaccccaactgctgcttcagcatctaccacggcagccaccgggagagcctggacctggtgtccaccagcagcgaggtggcccggacctgggtgacaggcctgcgctacctgatggccggcatcagtgatgaggacagcctggcccggcggcagaggacccgggaccagtggctgaagcagacctttgatgaagctgacaagaatggagatggcagcctgagcattggagaggtgctgcagctgctgcacaagctgaatgtgaacctgccccggcagagggtgaagcagatgttccgggaggccgacacagatgaccaccagggcaccctgggctttgaggagttctgtgccttctacaagatgatgagcacccggcgggacctgtacctgctgatgctgacctacagcaaccacaaggaccacctggatgctgccagcctgcagcgcttcctgcaggtggagcagaagatggccggcgtgaccctggagagctgccaggacatcatcgagcagtttgagccctgcccagagaacaagagcaagggcctgctgggcattgatggcttcaccaactacaccaggagccctgctggggacatcttcaaccctgagcaccaccacgtgcaccaggacatgacccagcccctgagccactacttcatcaccagcagccacaacacctacctggtgggggaccagctgatgagccagagccgggtggacatgtatgcctgggtgctgcaggccggctgccgctgtgtggaggtggactgctgggatggcccagatggagagcccatcgtgcaccacggctacaccctgaccagcaagatcctcttcaaggatgtgattgagaccatcaacaagtatgccttcatcaagaatgagtaccctgtgatcctgagcattgagaaccactgcagcgtcatccagcagaagaagatggcccagtacctgacagacatcctgggggacaagctggacctgagctctgtgtccagtgaagatgccaccaccctgcccagcccccagatgctgaagggcaagatcctggtgaagggcaagaagctgcctgccaacatcagtgaagatgctgaggagggggaggtgtctgatgaagattctgcagatgaaattgatgatgactgcaagctgctgaatggagatgccagcaccaacaggaagagggtggagaacacagccaagaggaagctggacagcctcatcaaggagagcaagatccgggactgtgaggaccccaacaacttctctgtgtccaccctgagccccagcggcaagctgggcaggaagagcaaggccgaggaggatgtggagagcggggaggatgctggggccagcagaagaaatggccgcctggtggtgggcagcttcagcaggaggaagaagaagggcagcaagctgaagaaggccgcctctgtggaggagggagatgagggccaggacagccctgggggccagagcagaggagccacccggcagaagaagaccatgaagctgagccgggccctgagtgacctggtgaagtacaccaagtctgtggccacccatgacatcgagatggaggccgccagctcctggcaggtgtcctccttcagcgagaccaaggcccaccagatcctgcagcagaagccagcccagtacctgcgcttcaaccagcagcagctgagccgcatctaccccagcagctacagagtggacagcagcaactacaacccccagcccttctggaatgccggctgccagatgggcgtcttcaaccccaacagcgaggaccccctgcccggccagctgaagaagcagctggtgctgcgcatcatcagcggccagcagctgcccaagccccgggacagcatgctgggggacagaggagagatcatcgacccctttgtggaggtggagatcatcggcctgcctgtggactgcagccgggagcagaccagggtggtggatgacaatggcttcaaccccacctgggaggagaccctggtgttcatggtgcacatgcctgagatcgccctggtgcgcttcctggtgtgggaccatgaccccatcggccgggacttcatcggccagaggaccctggccttcagctccatgatgcctggctaccgccacgtgtacctggagggcatggaggaggccagcatctttgtgcacgtggccgtgtctgacatcagcggcaaggtgaagcaggccctgggcctgaagggcctcttcctgcggggccccaagccaggcagcctggacagccatgctgctggccggcccccagcccggcccagcgtgtcccagaggatcctgcggaggacagccagcgcccccaccaagagccagaagccaggaagaagaggcttccctgagctggtgctgggcacccgggacaccggcagcaaaggagtggctgatgatgtggtgcccccaggccctggccctgcccctgaggccccagcccaggagggccctggcagcggcagcccccgggacacccggcccctgagcacccagaggcccctgccccccctgtgcagcctggagaccatcgccgaggagcccgcccctggccctggccccccacctcctgctgctgtgcccaccagcagcagccagggccggcccccctaccccactggacctggggccaacgtggccagccccctggaggacacagaggagccccgggacagccggccccggccctgcaatggagagggcgctgggggcgcctatgaaagagcccctggcagccagacagatggccgcagccagcccaggaccctgggccacctgcctgtgatccggcgggtgaagtctgagggccaggtgcccacagagcccctgggcggctggaggcccctggccgcccccttccctgccccagctgtgtacagtgatgccactggaagtgaccccctgtggcagaggctggagccctgtggccaccgggacagcgtgagcagcagcagctccatgagcagcagtgacaccgtcatcgacctgagcctgcccagcctgggcctgggccgcagccgggagaacctggccggggcccacatgggccgcctgcccccccggccccacagcgccagcgctgcccggccagacctgccccctgtgaccaagagcaagagcaaccccaacctgcgggccaccggccagaggcctcccatcccagatgagctgcagcccaggagcctggcccccaggatggccggcctgcccttccggcccccctggggctgcctgagcctggtgggcgtgcaggactgccctgtggccgccaagagcaagagcctgggggacctgacagcagatgactttgcccccagctttgaaggaggcagccggcggctgagccacagcctgggcctgcccggcggcaccaggagagtgtctggccctggggtgagaagagacaccctgacagagcagctgcgctggctgactgtgttccagcaggccggggacatcaccagccccaccagcctgggccctgctggggagggcgtggccggcggccctggctttgtgcggcgcagcagcagccgcagccacagccgggtgcgggccatcgccagccgggcccggcaggcccaggagcggcagcagaggctgcagggcctgggccggcagggccccccagaggaggagcggggcaccccagagggcgcctgcagcgtgggccacgagggctctgtggatgccccagcccccagcaagggggccctgggccctgccagcgctgctgctgagaacctggtgctgctgcggctgtag

SEQ ID NO: 164130 - DNA, 2136 bp, Artificial Sequence
  Description of Artificial Sequence: Synthetic coding sequence
tgagccctgaactaccagagcgagggccgcatgctgcagctgaacagagccaagttcagcgccaacggcggctgcggctacgtgctgaagccaggctgcatgtgccagggcgtcttcaaccccaacagcgaggaccccctgcccggccagctgaagaagcagctggtgctgcgcatcatcagcggccagcagctgcccaagccccgggacagcatgctgggggacagaggagagatcatcgacccctttgtggaggtggagatcatcggcctgcctgtggactgcagccgggagcagaccagggtggtggatgacaatggcttcaaccccacctgggaggagaccctggtgttcatggtgcacatgcctgagatcgccctggtgcgcttcctggtgtgggaccatgaccccatcggccgggacttcatcggccagaggaccctggccttcagctccatgatgcctggctacagacatgtgtacctggagggcatggaggaggccagcatctttgtgcacgtggccgtgtctgacatcagcggcaaggtgaagcaggccctgggcctgaagggcctcttcctgcggggccccaagccaggcagcctggacagccacgccgccggccggcccccagcccggcccagcgtgtcccagaggatcctgcggaggacagccagcgcccccaccaagagccagaagccaggccggcggggcttccctgagctggtgctgggcacccgggacaccggcagcaagggcgtggctgatgatgtggtgcccccaggccctggccctgcccctgaggccccagcccaggagggccctggcagcggcagcccccgggacacccggcccctgagcacccagaggcccctgccccccctgtgcagcctggagaccatcgccgaggagcccgcccctggccctggccccccacctcctgctgctgtgcccaccagcagcagccagggccggcccccctaccccaccggccctggggccaacgtggccagccccctggaggacacagaggagccccgggacagccggccccggccctgcaatggagagggcgccggcggggcctatgagcgggcccctggcagccagacagatggccgcagccagcccaggaccctgggccacctgcccgtcatcagaagagtgaagtctgagggccaggtgcccacagagcccctgggcggctggaggcccctggccgcccccttccctgccccagctgtgtacagtgatgccaccggcagtgaccccctgtggcagaggctggagccctgtggccaccgggacagcgtgagcagcagcagctccatgagcagcagtgacacagtgattgacctgagcctgcccagcctgggcctgggccgcagccgggagaacctggccggggcccacatgggccgcctgcccccccggccccacagcgccagcgctgcccggccagacctgccccctgtgaccaagagcaagagcaaccccaacctgcgggccaccggccagaggcctcccatcccagatgagctgcagcccaggagcctggcccccaggatggccggcctgcccttccggcccccctggggctgcctgagcctggtgggcgtgcaggactgccctgtggccgccaagagcaagagcctgggggacctgacagcagatgactttgcccccagctttgagggcggcagccggcggctgagccacagcctgggcctgcccggcggcacccggcgggtgtctggccctggggtgcggcgggacaccctgacagagcagctgcgctggctgaccgtcttccagcaggccggggacatcaccagccccaccagcctgggccctgctggggagggcgtggccggcggccctggctttgtgagaagaagcagcagccgcagccacagccgggtgcgggccatcgccagccgggcccggcaggcccaggagcggcagcagaggctgcagggcctgggccggcagggccccccagaggaggagcggggcaccccagagggcgcctgcagcgtgggccacgagggctctgtggatgccccagcccccagcaaaggagccctgggccctgccagcgctgctgctgagaacctggtgctgctgcggctgtag

SEQ ID NO: 164131 - DNA, 3390 bp, Artificial Sequence
  Description of Artificial Sequence: Synthetic coding sequence
atggaggagcccggccccccaggcggcctgagccaggaccaggtggagcgctgcatgggcgccatgcaggagggcatgcagatggtgaagctgcggggcggcagcaagggcctggtgcgcttctactacctggatgagcacaggagctgcatccgctggaggcccagcaggaagaatgagaaggccaagatcagcattgacagcatccaggaggtgtctgagggccggcagagcgaggtgttccagcgctacccagatggcagctttgaccccaactgctgcttcagcatctaccacggcagccaccgggagagcctggacctggtgtccaccagcagcgaggtggcccggacctgggtgacaggcctgcgctacctgatggccggcatcagtgatgaggacagcctggcccggcggcagaggacccgggaccagtggctgaagcagacctttgatgaggccgacaagaatggagatggcagcctgagcatcggggaggtgctgcagctgctgcacaagctgaatgtgaacctgccccggcagagggtgaagcagatgttccgggaggccgacacagatgaccaccagggcaccctgggctttgaggagttctgtgccttctacaagatgatgagcacccggcgggacctgtacctgctgatgctgacctacagcaaccacaaggaccacctggatgctgccagcctgcagcgcttcctgcaggtggagcagaagatggccggcgtgaccctggagagctgccaggacatcatcgagcagtttgagccctgcccagagaacaagagcaagggcctgctgggcattgatggcttcaccaactacaccaggagccctgctggggacatcttcaaccctgagcaccaccacgtgcaccaggacatgacccagcccctgagccactacttcatcaccagcagccacaacacctacctggtgggggaccagctgatgagccagagccgggtggacatgtatgcctgggtgctgcaggccggctgccgctgtgtggaggtggactgctgggatggcccagatggagagcccatcgtgcaccacggctacaccctgaccagcaagatcctcttcaaggatgtgattgagaccatcaacaagtatgccttcatcaagaatgagtaccctgtgatcctgagcattgagaaccactgcagcgtcatccagcagaagaagatggcccagtacctgacagacatcctgggggacaagctggacctgagctctgtgtccagtgaagatgccaccaccctgcccagcccccagatgctgaagggcaagatcctggtgaagggcaagaagctgcctgccaacatcagtgaagatgctgaggagggggaggtgtctgatgaggacagcgcagatgaaattgatgatgactgcaagctgctgaatggagatgccagcaccaacaggaagagggtggagaacacagccaagaggaagctggacagcctcatcaaggagagcaagatccgggactgtgaggaccccaacaacttctctgtgtccaccctgagccccagcggcaagctgggcaggaagagcaaggccgaggaggatgtggagagcggagaagatgctggggccagcagaagaaatggccgcctggtggtgggcagcttcagcaggaggaagaagaagggcagcaagctgaagaaggccgcctctgtggaggagggagatgagggccaggacagccctgggggccagagcagaggagccacccggcagaagaagaccatgaagctgagccgggccctgagtgacctggtgaagtacaccaagtctgtggccacccatgacatcgagatggaggccgccagctcctggcaggtgagcagcttcagcgagaccaaggcccaccagatcctgcagcagaagccagcccagtacctgcgcttcaaccagcagcagctgagccgcatctaccccagcagctacagagtggacagcagcaactacaacccccagcccttctggaatgccggctgccagatggtggccctgaactaccagagcgagggccgcatgctgcagctgaacagagccaagttcagcgccaacggcggctgcggctacgtgctgaagccaggctgcatgtgccagggcgtcttcaaccccaacagcgaggaccccctgcccggccagctgaagaagcagctggtgctgcgcatcatcagcggccagcagctgcccaagccccgggacagcatgctgggggacagaggagagatcatcgacccctttgtggaggtggagatcatcggcctgcctgtggactgcagccgggagcagaccagggtggtggatgacaatggcttcaaccccacctgggaggagaccctggtgttcatggtgcacatgcctgagatcgccctggtgcgcttcctggtgtgggaccatgaccccatcggccgggacttcatcggccagaggaccctggccttcagctccatgatgcctggctacagacatgtgtacctggagggcatggaggaggccagcatctttgtgcacgtggccgtgtctgacatcagcggcaaggtgaagcaggccctgggcctgaagggcctcttcctgcggggccccaagccaggcagcctggacagccacgccgccggccggcccccagcccggcccagcgtgtcccagaggatcctgcggaggacagccagcgcccccaccaagagccagaagccaggccggcggggcttccctgagctggtgctgggcacccgggacaccggcagcaagggcgtggctgatgatgtggtgcccccaggccctggccctgcccctgaggccccagcccaggagggccctggcagcggcagcccccggggcaaggccccagctgctgtggccgagaagagccctgtgcgggtgcggcccccccgggtgctggatggccctggccctgctggcatggccgccacctgcatgaagtgtgtggtgggcagctgtgccggcgtgaacacaggaggcctgcagcgggagaggcctcccagccctggccctgccagccggcaggccgccatccggcagcagccccgggcccgggctgacagcctgggcgccccctgctgcggcctggacccccacgccatccctggccgcagccgggaggcccccaagggccctggggcctggaggcagggccctgggggcagcggctccatgagcagtgacagcagcagcccagacagccctggcatccctgagaggagcccccgctggccagagggcgcctgccggcagcccggggccctgcagggcgagatgtctgccctgtttgcccagaagctggaggagatccgcagcaagagccccatgttttctgctgtgaggaactag

SEQ ID NO: 164132 - DNA, 1827 bp, Artificial Sequence
  Description of Artificial Sequence: Synthetic coding sequence
atggagatgcgctggttcctgagcaagatccaggatgacttccggggcggcaagatcaacctggagaagacccagaggctgctggagaagctggacatccgctgcagctacatccacgtgaagcagatcttcaaggacaatgaccggctgaagcagggccgcatcaccatcgaggagttccgggccatctaccgcatcatcacccaccgggaggagatcatcgagatcttcaacacctacagcgagaacaggaagatcctgctggccagcaacctggcccagttcctgacccaggagcagtatgctgctgagatgagcaaggccatcgcctttgagatcatccagaagtatgagcccatcgaggaggtgaggaaggcccaccagatgagcctggagggcttcacccgctacatggacagccgggagtgcctgctcttcaagaatgaatgtaggaaggtgtaccaggacatgacccaccccctgaatgactacttcatcagcagcagccacaacacctacctggtgtctgaccagctgctgggccccagcgacctgtggggctacgtgtctgccctggtgaagggctgccgctgcctggagattgactgctgggatggagcccagaatgaacctgtggtgtaccacggctacaccctgaccagcaagctgctcttcaagacagtcatccaggccatccacaagtatgccttcatgaccagtgactaccctgtggtgctgagcctggagaaccactgcagcacagcccagcaggaggtgatggctgacaacctgcaggccaccttcggggagagcctgctgagtgacatgctggatgacttcccagacaccctgcccagccctgaggccctgaagttcaagatcctggtgaagaacaagaagattggcaccctgaaggagacccatgagaggaaaggaagtgacaagagaggagacaaccaggacaaggagaccggggtgaagaagctgcccggggtgatgctgttcaagaagaagaagaccaggaagctgaagatcgccctggccctgagtgacctggtgatctacaccaaggccgagaagttcaagagcttccagcacagccggctgtaccagcagttcaatgaaaacaacagcattggagagacccaggccaggaagctgagcaagctgcgggtgcatgagttcatcttccacaccaggaagttcatcacccgcatctaccccaaggccaccagggctgacagcagcaacttcaacccccaggagttctggaacatcggctgccagatggtggccctgaacttccagaccccaggcctgcccatggacctgcagaatggcaagttcctggacaatggaggcagcggctacatcctgaagccccacttcctgcgggagagcaagagctacttcaaccccagcaacatcaaggagggcatgcccatcaccctgaccatccgcctcatcagcggcatccagctgcccctgacccacagcagcagcaacaagggggacagcctggtgatcatcgaggtgtttggagtgcccaatgaccagatgaagcagcagaccagggtcatcaagaagaatgccttcagcccccgctggaatgagaccttcaccttcatcatccacgtgcctgagctggccctgatccgctttgtggtggagggccagggcctgattgctggaaatgagttcctgggccagtacaccctgcccctgctgtgcatgaacaagggctaccgccgcatccccctcttcagcaggatgggagagagcctggagcccgccagcctgtttgtgtatgtgtggtacgtgaggtag

SEQ ID NO: 164133 - DNA, 1242 bp, Artificial Sequence
  Description of Artificial Sequence: Synthetic coding sequence
atgcgctggttcctgagcaagatccaggatgacttccggggcggcaagatcaacctggagaagacccagaggctgctggagaagctggacatccgctgcagctacatccacgtgaagcagatcttcaagaccagtgactaccctgtggtgctgagcctggagaaccactgcagcacagcccagcaggaggtgatggctgacaacctgcaggccacctttggagagagcctgctgagtgacatgctggatgacttcccagacaccctgcccagccctgaggccctgaagttcaagatcctggtgaagaacaagaagattggcaccctgaaggagacccatgagaggaagggcagtgacaagagaggagacaaccaggacaaggagactggagtgaagaagctgcccggggtgatgctgttcaagaagaagaagaccaggaagctgaagatcgccctggccctgagtgacctggtgatctacaccaaggccgagaagttcaagagcttccagcacagccggctgtaccagcagttcaatgaaaacaacagcatcggggagacccaggccaggaagctgagcaagctgcgggtgcatgagttcatcttccacaccaggaagttcatcacccgcatctaccccaaggccaccagggctgacagcagcaacttcaacccccaggagttctggaacatcggctgccagatggtggccctgaacttccagaccccaggcctgcccatggacctgcagaatggcaagttcctggacaatggaggcagcggctacatcctgaagccccacttcctgcgggagagcaagagctacttcaaccccagcaacatcaaggagggcatgcccatcaccctgaccatccgcctcatcagcggcatccagctgcccctgacccacagcagcagcaacaagggggacagcctggtgatcatcgaggtgtttggagtgcccaatgaccagatgaagcagcagaccagggtcatcaagaagaatgccttcagcccccgctggaatgagaccttcaccttcatcatccacgtgcctgagctggccctgatccgctttgtggtggagggccagggcctgattgctggaaatgagttcctgggccagtacaccctgcccctgctgtgcatgaacaagggctaccgccgcatccccctcttcagcaggatgggagagagcctggagcccgccagcctgtttgtgtatgtgtggtacgtgaggtag

SEQ ID NO: 164134 - DNA, 1821 bp, Artificial Sequence
  Description of Artificial Sequence: Synthetic coding sequence
atgcgctggttcctgagcaagatccaggatgacttccggggcggcaagatcaacctggagaagacccagaggctgctggagaagctggacatccgctgcagctacatccacgtgaagcagatcttcaaggacaatgaccggctgaagcagggccgcatcaccatcgaggagttccgggccatctaccgcatcatcacccaccgggaggagatcatcgagatcttcaacacctacagcgagaacaggaagatcctgctggccagcaacctggcccagttcctgacccaggagcagtatgctgctgagatgagcaaggccatcgcctttgagatcatccagaagtatgagcccatcgaggaggtgaggaaggcccaccagatgagcctggagggcttcacccgctacatggacagccgggagtgcctgctcttcaagaatgaatgtaggaaggtgtaccaggacatgacccaccccctgaatgactacttcatcagcagcagccacaacacctacctggtgtctgaccagctgctgggccccagcgacctgtggggctacgtgtctgccctggtgaagggctgccgctgcctggagattgactgctgggatggagcccagaatgaacctgtggtgtaccacggctacaccctgaccagcaagctgctcttcaagacagtcatccaggccatccacaagtatgccttcatgaccagtgactaccctgtggtgctgagcctggagaaccactgcagcacagcccagcaggaggtgatggctgacaacctgcaggccaccttcggggagagcctgctgagtgacatgctggatgacttcccagacaccctgcccagccctgaggccctgaagttcaagatcctggtgaagaacaagaagattggcaccctgaaggagacccatgagaggaaaggaagtgacaagagaggagacaaccaggacaaggagaccggggtgaagaagctgcccggggtgatgctgttcaagaagaagaagaccaggaagctgaagatcgccctggccctgagtgacctggtgatctacaccaaggccgagaagttcaagagcttccagcacagccggctgtaccagcagttcaatgaaaacaacagcattggagagacccaggccaggaagctgagcaagctgcgggtgcatgagttcatcttccacaccaggaagttcatcacccgcatctaccccaaggccaccagggctgacagcagcaacttcaacccccaggagttctggaacatcggctgccagatggtggccctgaacttccagaccccaggcctgcccatggacctgcagaatggcaagttcctggacaatggaggcagcggctacatcctgaagccccacttcctgcgggagagcaagagctacttcaaccccagcaacatcaaggagggcatgcccatcaccctgaccatccgcctcatcagcggcatccagctgcccctgacccacagcagcagcaacaagggggacagcctggtgatcatcgaggtgtttggagtgcccaatgaccagatgaagcagcagaccagggtcatcaagaagaatgccttcagcccccgctggaatgagaccttcaccttcatcatccacgtgcctgagctggccctgatccgctttgtggtggagggccagggcctgattgctggaaatgagttcctgggccagtacaccctgcccctgctgtgcatgaacaagggctaccgccgcatccccctcttcagcaggatgggagagagcctggagcccgccagcctgtttgtgtatgtgtggtacgtgaggtag

SEQ ID NO: 164135 - DNA, 1248 bp, Artificial Sequence
  Description of Artificial Sequence: Synthetic coding sequence
atggagatgcgctggttcctgagcaagatccaggatgacttccggggcggcaagatcaacctggagaagacccagaggctgctggagaagctggacatccgctgcagctacatccacgtgaagcagatcttcaagaccagtgactaccctgtggtgctgagcctggagaaccactgcagcacagcccagcaggaggtgatggctgacaacctgcaggccacctttggagagagcctgctgagtgacatgctggatgacttcccagacaccctgcccagccctgaggccctgaagttcaagatcctggtgaagaacaagaagattggcaccctgaaggagacccatgagaggaagggcagtgacaagagaggagacaaccaggacaaggagactggagtgaagaagctgcccggggtgatgctgttcaagaagaagaagaccaggaagctgaagatcgccctggccctgagtgacctggtgatctacaccaaggccgagaagttcaagagcttccagcacagccggctgtaccagcagttcaatgaaaacaacagcatcggggagacccaggccaggaagctgagcaagctgcgggtgcatgagttcatcttccacaccaggaagttcatcacccgcatctaccccaaggccaccagggctgacagcagcaacttcaacccccaggagttctggaacatcggctgccagatggtggccctgaacttccagaccccaggcctgcccatggacctgcagaatggcaagttcctggacaatggaggcagcggctacatcctgaagccccacttcctgcgggagagcaagagctacttcaaccccagcaacatcaaggagggcatgcccatcaccctgaccatccgcctcatcagcggcatccagctgcccctgacccacagcagcagcaacaagggggacagcctggtgatcatcgaggtgtttggagtgcccaatgaccagatgaagcagcagaccagggtcatcaagaagaatgccttcagcccccgctggaatgagaccttcaccttcatcatccacgtgcctgagctggccctgatccgctttgtggtggagggccagggcctgattgctggaaatgagttcctgggccagtacaccctgcccctgctgtgcatgaacaagggctaccgccgcatccccctcttcagcaggatgggagagagcctggagcccgccagcctgtttgtgtatgtgtggtacgtgaggtag

SEQ ID NO: 164136 - DNA, 1212 bp, Artificial Sequence
  Description of Artificial Sequence: Synthetic coding sequence
atggacagcagagaatgtctgctcttcaagaatgaatgtaggaaggtgtaccaggacatgacccaccccctgaatgactacttcatcagcagcagccacaacacctacctggtgtctgaccagctgctgggccccagcgacctgtggggctacgtgtctgccctggtgaagggctgccgctgcctggagattgactgctgggatggagcccagaatgaacctgtggtgtaccacggctacaccctgaccagcaagctgctcttcaagacagtcatccaggccatccacaagtatgccttcatgaccagtgactaccctgtggtgctgagcctggagaaccactgcagcacagcccagcaggaggtgatggctgacaacctgcaggccacctttggagagagcctgctgagtgacatgctggatgacttcccagacaccctgcccagccctgaggccctgaagttcaagatcctggtgaagaacaagaagattggcaccctgaaggagacccatgagaggaagggcagtgacaagagaggagacaaccaggacaaggagactggagtgaagaagctgcccggggtgatgctgttcaagaagaagaagaccaggaagctgaagatcgccctggccctgagtgacctggtgatctacaccaaggccgagaagttcaagagcttccagcacagccggctgtaccagcagttcaatgaaaacaacagcatcggggagacccaggccaggaagctgagcaagctgcgggtgcatgagttcatcttccacaccaggaagttcatcacccgcatctaccccaaggccaccagggctgacagcagcaacttcaacccccaggagttctggaacatcggctgccagatggtggccctgaacttccagaccccaggcctgcccatggacctgcagaatggcaagttcctggacaatggaggcagcggctacatcctgaagccccacttcctgcgggagagcaagagctacttcaaccccagcaacatcaaggagggcatgcccatcaccctgaccatccgcctcatcagcggcatccagctgcccctgacccacagcagcagcaacaagggggacagcctggtgatcatcgaggtgtttggagtgcccaatgaccagatgaagcagcagaccagggtcatcaagaagaatggccagggcaacatggtgatcatcccagcctag

SEQ ID NO: 164137 - DNA, 3387 bp, Artificial Sequence
  Description of Artificial Sequence: Synthetic coding sequence
atggctgactgtgtgcggggctgggccgctgtgggcggggccctgcccaccagccctggccccagcctgggcgccaagggggccctgaaggccggcgtgggagaagatggagtgggcggcggccgcctggtgcacggccgggcccgctatgacagcggcggcgtgtccaatggagactgcagcctgggcgtgtctggagatgaggcccgggccagccccacccggggcccccggggcgtggccctggcccccaccccatctgctgtggtgtgcaccctgccccgggagagcaagccaggcggcctgccccggcgcagcagcatcatcaaggatggcaccaagcagaagcgggagaggaagaagacagtgtccttcagctccatgcccacagagaagaagatcagcagcgccagtgactgcatcaacagcatggtggagggcagcgagctgaagaaggtgcgcagcaacagccgcatctaccaccgctacttcctgctggatgctgacatgcagagcctgcgctgggagcccagcaagaaggacagcgagaaggccaagattgacatcaagagcatcaaggaggtgaggacaggcaagaacacagacatcttccgcagcaatggcatcagtgaccagatcagcgaggactgtgccttcagcgtcatctatggagaaaattatgagagcctggacctggtggccaacagcgcagatgtggccaacatctgggtgacaggcctgcgctacctgatctcctatggcaagcacaccctggacatgctggagagcagccaggacaacatgaggacctcctgggtgtcccagatgttcagcgagattgatgtggacaacctgggccacatcaccctgtgcaatgctgtgcagtgcatccggaacctgaaccctggcctgaagaccagcaagattgagctgaagttcaaggagctgcacaagagcaaggacaaggccggcacagaggtgaccaaggaggagttcatcgaggtgttccacgagctgtgcaccaggcctgagatctacttcctgctggtgcagttcagcagcaacaaggagttcctggacaccaaggacctgatgatgttcctggaggccgagcagggcgtggcccacatcaatgaggagatcagcctggagatcatccacaagtatgagcccagcaaggagggccaggagaagggctggctgagcattgatggcttcaccaactacctgatgagcccagactgctacatctttgatcctgagcacaagaaggtgtgccaggacatgaagcagcccctgagccactacttcatcaacagcagccacaacacctacctgattgaggaccagttccggggccccagcgacatcaccggctacatccgggccctgaagatgggctgccgctctgtggagctggatgtgtgggatggccctgacaatgaacctgtgatctacacaggccacaccatgaccagccagatcgtgttccgctctgtgattgacatcatcaacaagtatgccttctttgccagcgagtaccccctcatcctgtgcctggagaaccactgcagcatcaagcagcagaaggtgatggtgcagcacatgaagaagctgctgggggacaagctgtacaccaccagccccaacgtggaggagagctacctgcccagcccagatgtgctgaagggcaagatcctgatcaaggccaagaagctgagcagcaactgcagcggcgtggagggagatgtgacagatgaagatgagggcgctgagatgagccagaggatgggcaaggagaacatggagcagcccaacaacgtgcctgtgaagcgcttccagctgtgcaaggagctgtctgagctggtgtccatctgcaagtctgtgcagttcaaggagttccaggtgtccttccaggtgcagaagtactgggaggtgtgcagcttcaatgaggtgctggccagcaaatatgccaatgaaaatcctggggactttgtgaactacaacaagcgcttcctggcccgggtcttccccagccccatgagaattgacagcagcaacatgaacccccaggacttctggaagtgtggctgccagatcgtggccatgaacttccagaccccaggcctgatgatggacctgaacatcggctggttccggcagaatggaaactgtggctacgtgctgcggcctgccatcatgagggaggaggtgtccttcttcagcgccaacaccaaggacagcgtgcctggggtgagcccccagctgctgcacatcaagatcatcagcggccagaacttccccaagcccaagggcagcggggccaagggagatgtggtggacccctacgtgtatgtggagatccacggcatcccagctgactgtgccgagcagaggaccaagacagtgcaccagaatggagatgcccccatctttgatgagagctttgagttccagatcaacctgcctgagctggccatggtgcgctttgtggtgctggatgatgactacatcggagatgagttcatcggccagtacaccatcccctttgaatgtctgcagacaggctacagacatgtgcccctgcagagcctgaccggggaggtgctggcccacgccagcctgtttgtgcacgtggccatcaccaacagaagaggaggcggcaagccccacaagaggggcctgtctgtgaggaagggcaagaagagccgggagtatgccagcctgcggaccctgtggatcaagacagtggatgaggtgttcaagaatgcccagccccccatcagagatgccacagacctgcgggagaacatgcagaatgctgtggtgtccttcaaggagctgtgtggcctgagctctgtggccaacctgatgcagtgcatgctggccgtgagcccccgcttcctgggccctgacaacacccccctggtggtgctgaacctgtctgagcagtaccccaccatggagctgcagggcatcgtgcctgaggtgctgaagaagatcgtgaccacctatgacatgatgatccagagcctgaaggccctgattgaaaatgctgatgctgtgtatgagaagatcgtgcactgccagaaggccgccatggagttccacgagcacctgcacagcatcggcaccaaggagggcctgaaggagaggaagctgcagaaggctgtggagagcttcacctggaacatcaccatcctgaagggccaggccgacctgctgaagtatgccaagaatgagaccctggagaacctgaagcagatccactttgctgctgtgtcctgtggcctgaacaagccaggcacagaaaatgctgatgtgcagaagccccggcgcagcctggaggtgattcctgagaaggccaatgatgagaccggggagtag

SEQ ID NO: 164138 - DNA, 2883 bp, Artificial Sequence
  Description of Artificial Sequence: Synthetic coding sequence
atgcccacagagaagaagatcagcagcgccagtgactgcatcaacagcatggtggagggcagcgagctgaagaaggtgcgcagcaacagccgcatctaccaccgctacttcctgctggatgctgacatgcagagcctgcgctgggagcccagcaagaaggacagcgagaaggccaagattgacatcaagagcatcaaggaggtgaggacaggcaagaacacagacatcttccgcagcaatggcatcagtgaccagatcagcgaggactgtgccttcagcgtcatctacggggagaactatgagagcctggacctggtggccaacagcgcagatgtggccaacatctgggtgacaggcctgcgctacctgatctcctatggcaagcacaccctggacatgctggagagcagccaggacaacatgaggacctcctgggtgtcccagatgttttctgaaattgatgtggacaacctgggccacatcaccctgtgcaatgctgtgcagtgcatccggaacctgaaccctggcctgaagaccagcaagattgagctgaagttcaaggagctgcacaagagcaaggacaaggccggcacagaggtgaccaaggaggagttcatcgaggtgttccacgagctgtgcaccaggcctgagatctacttcctgctggtgcagttcagcagcaacaaggagttcctggacaccaaggacctgatgatgttcctggaggccgagcagggcgtggcccacatcaatgaggagatcagcctggagatcatccacaagtatgagcccagcaaggagggccaggagaagggctggctgagcattgatggcttcaccaactacctgatgagcccagactgctacatctttgatcctgagcacaagaaggtgtgccaggacatgaagcagcccctgagccactacttcatcaacagcagccacaacacctacctgattgaggaccagttccggggccccagcgacatcaccggctacatccgggccctgaagatgggctgccgctctgtggagctggatgtgtgggatggccctgacaatgagcccgtcatctacacaggccacaccatgaccagccagatcgtgttccgcagcgtcatcgacatcatcaacaagtatgccttctttgccagcgagtaccccctcatcctgtgcctggagaaccactgcagcatcaagcagcagaaggtgatggtgcagcacatgaagaagctgctgggggacaagctgtacaccaccagccccaacgtggaggagagctacctgcccagcccagatgtgctgaagggcaagatcctgatcaaggccaagaagctgagcagcaactgcagcggcgtggagggagatgtgacagatgaagatgaaggagctgagatgagccagaggatgggcaaggagaacatggagcagcccaacaacgtgcctgtgaagcgcttccagctgtgcaaggagctgtctgagctggtgtccatctgcaagtctgtgcagttcaaggagttccaggtgtccttccaggtgcagaagtactgggaggtgtgcagcttcaatgaggtgctggccagcaaatatgccaatgaaaatcctggggactttgtgaactacaacaagcgcttcctggcccgggtcttccccagccccatgagaattgacagcagcaacatgaacccccaggacttctggaagtgtggctgccagatcgtggccatgaacttccagaccccaggcctgatgatggacctgaacatcggctggttccggcagaatggaaactgtggctacgtgctgcggcctgccatcatgagggaggaggtgtccttcttcagcgccaacaccaaggacagcgtgcctggggtgagcccccagctgctgcacatcaagatcatcagcggccagaacttccccaagcccaagggcagcggggccaagggagatgtggtggacccctacgtgtatgtggagatccacggcatcccagctgactgtgccgagcagaggaccaagacagtgcaccagaatggagatgcccccatctttgatgagagctttgagttccagatcaacctgcctgagctggccatggtgcgctttgtggtgctggatgatgactacatcggagatgagttcatcggccagtacaccatcccctttgagtgcctgcagacaggctaccgccacgtgcccctgcagagcctgactggagaggtgctggcccacgccagcctgtttgtgcacgtggccatcaccaacagaagaggaggcggcaagccccacaagaggggcctgtctgtgaggaagggcaagaagagccgggagtatgccagcctgcggaccctgtggatcaagacagtggatgaggtgttcaagaatgcccagccccccatcagagatgccacagacctgcgggagaacatgcagaatgctgtggtgtccttcaaggagctgtgtggcctgagctctgtggccaacctgatgcagtgcatgctggccgtgagcccccgcttcctgggccctgacaacacccccctggtggtgctgaacctgtctgagcagtaccccaccatggagctgcagggcatcgtgcctgaggtgctgaagaagatcgtgaccacctatgacatgatgatccagagcctgaaggccctgattgaaaatgctgatgctgtgtatgagaagatcgtgcactgccagaaggccgccatggagttccacgagcacctgcacagcatcggcaccaaggagggcctgaaggagaggaagctgcagaaggctgtggagagcttcacctggaacatcaccatcctgaagatcaggaagacaggccgccgcagcatctttgtgccccagacccccatcatggtgtag

SEQ ID NO: 164139 - DNA, 3006 bp, Artificial Sequence
  Description of Artificial Sequence: Synthetic coding sequence
atgcccacagagaagaagatcagcagcgccagtgactgcatcaacagcatggtggagggcagcgagctgaagaaggtgcgcagcaacagccgcatctaccaccgctacttcctgctggatgctgacatgcagagcctgcgctgggagcccagcaagaaggacagcgagaaggccaagattgacatcaagagcatcaaggaggtgaggacaggcaagaacacagacatcttccgcagcaatggcatcagtgaccagatcagcgaggactgtgccttcagcgtcatctacggggagaactatgagagcctggacctggtggccaacagcgcagatgtggccaacatctgggtgacaggcctgcgctacctgatctcctatggcaagcacaccctggacatgctggagagcagccaggacaacatgaggacctcctgggtgtcccagatgttttctgaaattgatgtggacaacctgggccacatcaccctgtgcaatgctgtgcagtgcatccggaacctgaaccctggcctgaagaccagcaagattgagctgaagttcaaggagctgcacaagagcaaggacaaggccggcacagaggtgaccaaggaggagttcatcgaggtgttccacgagctgtgcaccaggcctgagatctacttcctgctggtgcagttcagcagcaacaaggagttcctggacaccaaggacctgatgatgttcctggaggccgagcagggcgtggcccacatcaatgaggagatcagcctggagatcatccacaagtatgagcccagcaaggagggccaggagaagggctggctgagcattgatggcttcaccaactacctgatgagcccagactgctacatctttgatcctgagcacaagaaggtgtgccaggacatgaagcagcccctgagccactacttcatcaacagcagccacaacacctacctgattgaggaccagttccggggccccagcgacatcaccggctacatccgggccctgaagatgggctgccgctctgtggagctggatgtgtgggatggccctgacaatgagcccgtcatctacacaggccacaccatgaccagccagatcgtgttccgcagcgtcatcgacatcatcaacaagtatgccttctttgccagcgagtaccccctcatcctgtgcctggagaaccactgcagcatcaagcagcagaaggtgatggtgcagcacatgaagaagctgctgggggacaagctgtacaccaccagccccaacgtggaggagagctacctgcccagcccagatgtgctgaagggcaagatcctgatcaaggccaagaagctgagcagcaactgcagcggcgtggagggagatgtgacagatgaagatgaaggagctgagatgagccagaggatgggcaaggagaacatggagcagcccaacaacgtgcctgtgaagcgcttccagctgtgcaaggagctgtctgagctggtgtccatctgcaagtctgtgcagttcaaggagttccaggtgtccttccaggtgcagaagtactgggaggtgtgcagcttcaatgaggtgctggccagcaaatatgccaatgaaaatcctggggactttgtgaactacaacaagcgcttcctggcccgggtcttccccagccccatgagaattgacagcagcaacatgaacccccaggacttctggaagtgtggctgccagatcgtggccatgaacttccagaccccaggcctgatgatggacctgaacatcggctggttccggcagaatggaaactgtggctacgtgctgcggcctgccatcatgagggaggaggtgtccttcttcagcgccaacaccaaggacagcgtgcctggggtgagcccccagctgctgcacatcaagatcatcagcggccagaacttccccaagcccaagggcagcggggccaagggagatgtggtggacccctacgtgtatgtggagatccacggcatcccagctgactgtgccgagcagaggaccaagacagtgcaccagaatggagatgcccccatctttgatgagagctttgagttccagatcaacctgcctgagctggccatggtgcgctttgtggtgctggatgatgactacatcggagatgagttcatcggccagtacaccatcccctttgagtgcctgcagacaggctaccgccacgtgcccctgcagagcctgactggagaggtgctggcccacgccagcctgtttgtgcacgtggccatcaccaacagaagaggaggcggcaagccccacaagaggggcctgtctgtgaggaagggcaagaagagccgggagtatgccagcctgcggaccctgtggatcaagacagtggatgaggtgttcaagaatgcccagccccccatcagagatgccacagacctgcgggagaacatgcagaatgctgtggtgtccttcaaggagctgtgtggcctgagctctgtggccaacctgatgcagtgcatgctggccgtgagcccccgcttcctgggccctgacaacacccccctggtggtgctgaacctgtctgagcagtaccccaccatggagctgcagggcatcgtgcctgaggtgctgaagaagatcgtgaccacctatgacatgatgatccagagcctgaaggccctgattgaaaatgctgatgctgtgtatgagaagatcgtgcactgccagaaggccgccatggagttccacgagcacctgcacagcatcggcaccaaggagggcctgaaggagaggaagctgcagaaggctgtggagagcttcacctggaacatcaccatcctgaagggccaggccgacctgctgaagtatgccaagaatgagaccctggagaacctgaagcagatccactttgctgctgtgtcctgtggcctgaacaagccaggcacagaaaatgctgatgtgcagaagcccaggaggagcctggaggtgattcctgagaaggccaatgatgaaacaggagagtag

SEQ ID NO: 164140 - DNA, 3006 bp, Artificial Sequence; identical to SEQ ID NO: 164139
  Description of Artificial Sequence: Synthetic coding sequence

SEQ ID NO: 164141 - DNA, 2802 bp, Artificial Sequence
  Description of Artificial Sequence: Synthetic coding sequence
atgacagccaccccagagagcctcttccccactggagatgagctggacagcagccagctgcagatggagagtgatgaggtggacaccctgaaggagggggaggaccctgctgacaggatgcaccccttcctggccatctatgagctgcagagcctgaaggtgcaccccctggtgtttgcccctggggtgcctgtgacagcccaggtggtgggcacagagcgctacaccagcggcagcaaggtgggcacctgcaccctgtacagcgtgcggctgacccatggagacttctcctggaccaccaagaagaagtaccgccacttccaggagctgcaccgggacctgctgcggcacaaggtgctgatgagcctgctgcccctggccaggtttgctgtggcctacagccctgccagagatgctggcaaccgggagatgcccagcctgccccgggccggccctgagggcagcaccaggcatgctgccagcaagcagaagtacctggagaactacctgaaccggctgctgaccatgtccttctacagaaactaccacgccatgacagagttcctggaggtgtcccagctgtccttcatcccagacctgggcaggaagggcctggagggcatgatcaggaagaggtctgggggccaccgggtgcccggcctgacctgctgcggccgggaccaggtgtgctaccgctggagcaagcgctggctggtggtgaaggacagcttcctgctgtacatgtgcctggagaccggggccatcagctttgtgcagctgtttgatcctggctttgaggtgcaggtgggcaagaggagcacagaggcccggcatggagtgagaattgacaccagccacaggagcctcatcctgaagtgcagcagctaccggcaggcccgctggtgggcccaggagatcacagagctggcccagggccctggccgggacttcctgcagctgcacagacatgacagctatgccccacccaggcctggcaccctggcccgctggtttgtgaatggagctggctactttgctgctgtggctgatgccatcctgcgggcccaggaggagatcttcatcacagactggtggctgagccctgaggtgtacctgaagaggcctgcccacagtgatgactggaggctggacatcatgctgaagaggaaggccgaggagggcgtgcgggtgtccatcctgctcttcaaggaggtggagctggccctgggcatcaacagcggctacagcaagagggccctgatgctgctgcaccccaacatcaaggtgatgaggcacccagaccaggtgaccctgtgggcccaccacgagaagctgctggtggtggaccaggtggtggccttcctgggcggcctggacctggcctacggccgctgggatgacctgcactaccgcctgacagacctgggggacagcagcgagagcgctgccagccagccccccacccccaggccagacagccctgccaccccagacctgagccacaaccagttcttctggctgggcaaggactacagcaacctgatcaccaaggactgggtgcagctggaccggccctttgaggacttcatcgaccgggagaccacccccaggatgccctggagagatgtgggcgtggtggtgcacggcctgcctgcccgggacctggcccggcacttcatccagcgctggaacttcaccaagaccaccaaggccaagtacaagacccccacctacccctacctgctgcccaagagcaccagcacagccaaccagctgcccttcaccctgcccggcggccagtgcaccaccgtgcaggtgctgcggtctgtggaccgctggagcgctggcaccctggagaacagcatcctgaatgcctacctgcacaccatccgggagagccagcacttcctgtacatcgagaaccagttcttcatcagctgcagtgatggccgcacagtgctgaacaaggtgggagatgaaattgtggaccgcatcctgaaggcccacaagcagggctggtgctacagagtgtatgtgctgctgcccctgctgcccggctttgaaggagacatcagcactggaggcggcaacagcatccaggccatcctgcacttcacctaccgcaccctgtgccgcggggagtacagcatcctgcaccggctgaaggccgccatgggcacagcctggagggactacatcagcatctgtggcctgcggacccatggagagctgggcggccaccctgtgtctgagctgatctacatccacagcaaggtgctgattgctgatgacagaactgtcatcatcggcagcgccaacatcaatgacaggagcctgctgggcaagagggacagcgagctggccgtgctgattgaggacacagaaacagagcccagcctgatgaatggagctgagtaccaggccggccgctttgccctgagcctgaggaagcactgcttcggggtcatcctgggcgccaacaccaggccagacctggacctgcgggaccccatctgtgatgacttcttccagctgtggcaggacatggccgagagcaatgccaacatctatgagcagatcttccgctgcctgcccagcaatgccaccaggagcctgcggaccctgcgggagtatgtggccgtggagcccctggccaccgtgtccccacccctggcccggtctgagctgacccaggtgcagggccacctggtgcacttccccctgaagttcctggaggatgagagcctgctgccccccctgggcagcaaggagggcatgatccccctggaggtgtggacctag

SEQ ID NO: 164142 - DNA, 2769 bp, Artificial Sequence
  Description of Artificial Sequence: Synthetic coding sequence
atgacagccaccccagagagcctcttccccactggagatgagctggacagcagccagctgcagatggagagtgatgaggtggacaccctgaaggagggggaggaccctgctgacaggatgcaccccttcctggccatctatgagctgcagagcctgaaggtgcaccccctggtgtttgcccctggggtgcctgtgacagcccaggtggtgggcacagagcgctacaccagcggcagcaaggtgggcacctgcaccctgtacagcgtgcggctgacccatggagacttctcctggaccaccaagaagaagtaccgccacttccaggagctgcaccgggacctgctgcggcacaaggtgctgatgagcctgctgcccctggccaggtttgctgtggcctacagccctgccagagatgctggcaaccgggagatgcccagcctgccccgggccggccctgagggcagcaccaggcatgctgccagcaagcagaagtacctggagaactacctgaaccggctgctgaccatgtccttctacagaaactaccacgccatgacagagttcctggaggtgtcccagctgtccttcatcccagacctgggcaggaagggcctggagggcatgatcaggaagaggtctgggggccaccgggtgcccggcctgacctgctgcggccgggaccaggtgtgctaccgctggagcaagcgctggctggtggtgaaggacagcttcctgctgtacatgtgcctggagaccggggccatcagctttgtgcagctgtttgatcctggctttgaggtgcaggtgggcaagaggagcacagaggcccggcatggagtgagaattgacaccagccacaggagcctcatcctgaagtgcagcagctaccggcaggcccgctggtgggcccaggagatcacagagctggcccagggccctggccgggacttcctgcagctgcacagacatgacagctatgccccacccaggcctggcaccctggcccgctggtttgtgaatggagctggctactttgctgctgtggctgatgccatcctgcgggcccaggaggagatcttcatcacagactggtggctgagccctgaggtgtacctgaagaggcctgcccacagtgatgactggaggctggacatcatgctgaagaggaaggccgaggagggcgtgcgggtgtccatcctgctcttcaaggaggtggagctggccctgggcatcaacagcggctacagcaagagggccctgatgctgctgcaccccaacatcaaggtgatgaggcacccagaccaggtgaccctgtgggcccaccacgagaagctgctggtggtggaccaggtggtggccttcctgggcggcctggacctggcctacggccgctgggatgacctgcactaccgcctgacagacctgggggacagcagcgagagcgctgccagccagccccccacccccaggccagacagccctgccaccccagacctgagccacaaccagttcttctggctgggcaaggactacagcaacctgatcaccaaggactgggtgcagctggaccggccctttgaggacttcatcgaccgggagaccacccccaggatgccctggagagatgtgggcgtggtggtgcacggcctgcctgcccgggacctggcccggcacttcatccagcgctggaacttcaccaagaccaccaaggccaagtacaagacccccacctacccctacctgctgcccaagagcaccagcacagccaaccagctgcccttcaccctgcccggcggccagtgcaccaccgtgcaggtgctgcggtctgtggaccgctggagcgctggcaccctggagaacagcatcctgaatgcctacctgcacaccatccgggagagccagcacttcctgtacatcgagaaccagttcttcatcagctgcagtgatggccgcacagtgctgaacaaggtgggagatgaaattgtggaccgcatcctgaaggcccacaagcagggctggtgctacagagtgtatgtgctgctgcccctgctgcccggctttgaaggagacatcagcactggaggcggcaacagcatccaggccatcctgcacttcacctaccgcaccctgtgccgcggggagtacagcatcctgcaccggctgaaggccgccatgggcacagcctggagggactacatcagcatctgtggcctgcggacccatggagagctgggcggccaccctgtgtctgagctgatctacatccacagcaaggtgctgattgctgatgacagaactgtcatcatcggcagcgccaacatcaatgacaggagcctgctgggcaagagggacagcgagctggccgtgctgattgaggacacagaaacagagcccagcctgatgaatggagctgagtaccaggccggcagcgtcatcctgggcgccaacaccaggccagacctggacctgcgggaccccatctgtgatgacttcttccagctgtggcaggacatggccgagagcaatgccaacatctatgagcagatcttccgctgcctgcccagcaatgccaccaggagcctgcggaccctgcgggagtatgtggccgtggagcccctggccaccgtgagcccccccctggcccggtctgagctgacccaggtgcagggccacctggtgcacttccccctgaagttcctggaggatgagagcctgctgccccccctgggcagcaaggagggcatgatccccctggaggtgtggacctag

SEQ ID NO: 164143 - DNA, 957 bp, Artificial Sequence
  Description of Artificial Sequence: Synthetic coding sequence
atggacaagcagaacagccagatgaatgccagccaccctgagaccaacctgcctgtgggctacccaccccagtacccacccacagccttccagggccccccaggctacagcggctacccaggcccccaggtgtcctacccacctcctcctgctggccacagcggccctggccctgctggcttccctgtgcccaaccagcctgtgtacaaccagcctgtgtacaaccagcctgtgggcgctgctggggtgccctggatgcctgccccccagccccccctgaactgccccccaggcctggagtacctgagccagattgaccagatcctgatccaccagcagatcgagctgctggaggtgctgactggatttgagaccaacaacaagtatgagatcaagaacagctttggccagagggtgtactttgctgctgaggacacagactgctgcaccaggaactgctgcggccccagccggcccttcaccctgcgcatcatcgacaacatgggccaggaggtgatcaccctggagcggcccctgcgctgcagcagctgctgctgcccctgctgcctgcaggagattgagatccaggcccctcctggggtgcccatcggctacgtgatccagacctggcacccctgcctgcccaagttcaccatccagaatgagaagagagaagatgtgctgaagatcagcggcccctgtgtggtgtgcagctgctgcggagatgtggactttgagatcaagagcctggatgagcagtgtgtggtgggcaagatcagcaagcactggacaggcatcctgcgggaggccttcacagatgctgacaactttggcatccagttccccctggacctggatgtgaagatgaaggctgtgatgattggagcctgcttcctgattgacttcatgttctttgagagcacaggcagccaggagcagaagtctggagtgtggtag

SEQ ID NO: 164144 - DNA, 93 bp, Artificial Sequence
  Description of Artificial Sequence: Synthetic coding sequence
atgaaggctgtgatgattggagcctgcttcctgattgacttcatgttctttgagagcacaggcagccaggagcagaagtctggagtgtggtag

SEQ ID NO: 164145 - DNA, 750 bp, Artificial Sequence
  Description of Artificial Sequence: Synthetic coding sequence
atggacaagcagaacagccagatgaatgccagccaccctgagaccaacctgcctgtgggctacccaccccagtacccacccacagccttccagggccccccaggctacagcggctacccaggcccccaggtgtcctacccacctcctcctgctggccacagcggccctggccctgctggcttccctgtgcccaaccagcctgtgtacaaccagcctgtgtacaaccagcctgtgggcgctgctggggtgccctggatgcctgccccccagccccccctgaactgccccccaggcctggagtacctgagccagattgaccagatcctgatccaccagcagatcgagctgctggaggtgctgactggatttgagaccaacaacaagtatgagatcaagaacagctttggccagagggtgtactttgctgctgaggacacagactgctgcaccaggaactgctgcggccccagccggcccttcaccctgcgcatcatcgacaacatgggccaggaggtgatcaccctggagcggcccctgcgctgcagcagctgctgctgcccctgctgcctgcaggagattgagatccaggcccctcctggggtgcccatcggctacgtgatccagacctggcacccctgcctgcccaagttcaccatccagaatgagaagagagaagatgtgctgaagatcagcggcccctgtgtggtgtgcagctgctgcggagatgtggactttgagatcaagagctag

SEQ ID NO: 164146 - DNA, 675 bp, Artificial Sequence
  Description of Artificial Sequence: Synthetic coding sequence
atgcctgcccctcctccacccctgaactgccccccaggcctggagtacctgagccagattgacatgatcctgatccaccagcagatcgagctgctggaggtgctcttctcctttgagagcagcaacatgtatgagatcaagaacagctttggccagaggatctactttgctgctgaggacaccaacttctgcatccggaactgctgcggccgcagccggcccttcaccctgcgcatcacagacaacgtgggccgggaggtgatcaccctggagcggcccctgcgctgcaactgctgctgctgcccctgctgcctgcaggagattgagatccaggcccctcctggggtgcctgtgggctacgtgacccagacctggcacccctgcctgaccaagttcaccatcaagaaccagaagcgggaggatgtgctgaagatcagcggcccctgcatcgtgtgcagctgcatcgccggcgtggactttgagatcaccagcctggatgagcagatcgtggtgggccgcatcagcaagcactggagcggcttcctgcgggaggccttcacagatgctgacaactttggcatccagttcccccgggacctggatgtgaagatgaaggctgtgatgattggagcctgcttcctgattgactacatgttctttgagaggaccaggtag

SEQ ID NO: 164147 - DNA, 486 bp, Artificial Sequence
  Description of Artificial Sequence: Synthetic coding sequence
atgcctgcccctcctccacccctgaactgccccccaggcctggagtacctgagccagattgacatgatcctgatccaccagcagatcgagctgctggaggtgctcttctcctttgagagcagcaacatgtatgagatcaagaacagctttggccagaggatctactttgctgctgaggacaccaacttctgcatccggaactgctgcggccgcagccggcccttcaccctgcgcatcacagacaacgtgggccgggaggtgatcaccctggagcggcccctgcgctgcaactgctgctgctgcccctgctgcctgcaggagattgagatccaggcccctcctggggtgcctgtgggctacgtgacccagacctggcacccctgcctgaccaagttcaccatcaagaaccagaagcgggaggatgtgctgaagatcagcggcccctgcatcgtgtgcagctgcatcgccggcgtggactttgaatag

SEQ ID NO: 164148 - DNA, 894 bp, Artificial Sequence
  Description of Artificial Sequence: Synthetic coding sequence
atgaggtcctggaacagcctcttctgcctgaacagcagcaggcctcctggccacatcgtgtaccccaagcaccaggccggccacacaggcaagcaggccgaccacctgggcagccaggccttctacccaggccggcagcacgactacctggtgcccccagctggaacagctggcatccctgtgcagaaccagcccggccggcctgagggcgtgccctggatgcctgcccctcctccacccctgaactgccccccaggcctggagtacctgagccagattgacatgatcctgatccaccagcagatcgagctgctggaggtgctcttctcctttgagagcagcaacatgtatgagatcaagaacagctttggccagaggatctactttgctgctgaggacaccaacttctgcatccggaactgctgcggccgcagccggcccttcaccctgcgcatcacagacaacgtgggccgggaggtgatcaccctggagcggcccctgcgctgcaactgctgctgctgcccctgctgcctgcaggagattgagatccaggcccctcctggggtgcctgtgggctacgtgacccagacctggcacccctgcctgaccaagttcaccatcaagaaccagaagagagaagatgtgctgaagatcagcggcccctgcatcgtgtgcagctgcatcgccggcgtggactttgagatcaccagcctggatgagcagatcgtggtgggccgcatcagcaagcactggagcggcttcctgcgggaggccttcacagatgctgacaactttggcatccagttcccccgggacctggatgtgaagatgaaggctgtgatgattggagcctgcttcctgattgactacatgttctttgagaggaccaggtag

SEQ ID NO: 164149 - DNA, 951 bp, Artificial Sequence
  Description of Artificial Sequence: Synthetic coding sequence
gtgtctgcccacctgcgcttcttcctggccatcatcctgcgggacagcggcctgtgggccgagtggaggatgaagcccttccagatccacctgcccggccccccaggccacatcgtgtaccccaagcaccaggccggccacacaggcaagcaggccgaccacctgggcagccaggccttctacccaggccggcagcacgactacctggtgcccccagctggaacagctggcatccctgtgcagaaccagcccggccggcctgagggcgtgccctggatgcctgcccctcctccacccctgaactgccccccaggcctggagtacctgagccagattgacatgatcctgatccaccagcagatcgagctgctggaggtgctcttctcctttgagagcagcaacatgtatgagatcaagaacagctttggccagaggatctactttgctgctgaggacaccaacttctgcatccggaactgctgcggccgcagccggcccttcaccctgcgcatcacagacaacgtgggccgggaggtgatcaccctggagcggcccctgcgctgcaactgctgctgctgcccctgctgcctgcaggagattgagatccaggcccctcctggggtgcctgtgggctacgtgacccagacctggcacccctgcctgaccaagttcaccatcaagaaccagaagcgggaggatgtgctgaagatcagcggcccctgcatcgtgtgcagctgcatcgccggcgtggactttgagatcaccagcctggatgagcagatcgtggtgggccgcatcagcaagcactggagcggcttcctgcgggaggccttcacagatgctgacaactttggcatccagttcccccgggacctggatgtgaagatgaaggctgtgatgattggagcctgcttcctgattgactacatgttctttgagaggaccaggtag

SEQ ID NO: 164150 - DNA, 888 bp, Artificial Sequence
  Description of Artificial Sequence: Synthetic coding sequence
atggccggctacctgccccccaagggctacgcccccagccccccaccaccctaccctgtgaccccaggctacccagagcccgccctgcaccctggccctggccaggcccctgtgcctgcccaggtgcctgccccagcccctggctttgccctcttccccagccctggccctgtggccctgggcagcgctgcccccttcctgcccctgcccggggtgcccagcggcctggagttcctggtgcagattgaccagatcctgatccaccagaaggccgagcgggtggagaccttcctgggctgggagacctgcaacagatatgagctgcggagcggggccggccagcccctgggccaggccgctgaggagagcaactgctgtgcccggctgtgctgcggggcccggcggcccctgcgggtgcggctggccgaccccggggaccgggaggtgctgcggctgctgcggcccctgcactgcggctgcagctgctgcccctgtggcctgcaggagatggaggtgcaggcccctcctggcaccaccatcggccacgtgctgcagacctggcaccccttcctgcccaagttcagcatccaggatgctgaccggcagacagtgctgcgggtggtgggcccctgctggacctgtggctgcggcacagacaccaactttgaggtgaagaccagagatgagagccgctctgtgggccgcatcagcaagcagtggggcggcctggtgcgggaggccctgacagatgctgatgactttggcctgcagttccccctggacctggatgtgcgggtgaaggctgtgctgctgggcgccaccttcctgattgactacatgttctttgagaagaggggcggggccggccccagcgctgtgaccagctag

SEQ ID NO: 164151 - DNA, 672 bp, Artificial Sequence
  Description of Artificial Sequence: Synthetic coding sequence
atggccggctacctgccccccaagggctacgcccccagccccccaccaccctaccctgtgaccccaggctacccagagcccgccctgcaccctggccctggccaggcccctgtgcctgcccaggtgcctgccccagcccctggctttgccctcttccccagccctggccctgtggccctgggcagcgctgcccccttcctgcccctgcccggggtgcccagcggcctggagttcctggtgcagattgaccagatcctgatccaccagaaggccgagcgggtggagaccttcctgggctggaggcctgtgattggcatgaactgtgccctgggccctggcagcccctgggtgcggcggccccggcgggccacagctgcccctgtgtgtgctgtggccccagctggccgctgtgtgtctgcctggcccaccccaggcaccgtgcgctgctgcgtgtgcagcgcccgctgcaccgtggccgctgctgctgcccctgtggccagccgccgctggaagtaccgcctgcaccaggccccacccctggccacctgctaccggcccggcatccccagcagccccagcagccccagcaggatgcccatcgcccggcagagctgtgagtggtggggccctgctggccctgtggccgtggcccagacccccaccctgaggtag

SEQ ID NO: 164152 - DNA, 888 bp, Artificial Sequence; identical to SEQ ID NO: 164150
  Description of Artificial Sequence: Synthetic coding sequence

SEQ ID NO: 164153 - DNA, 888 bp, Artificial Sequence; identical to SEQ ID NO: 164150
  Description of Artificial Sequence: Synthetic coding sequence

SEQ ID NO: 164154 - DNA, 990 bp, Artificial Sequence
  Description of Artificial Sequence: Synthetic coding sequence
atgtctggagtggtgcccacagcccctgagcagcctgctggggagatggagaaccagaccaagcccccagaccccaggccagatgcccctcctgagtacaacagccacttcctgcccggccccccaggcacagctgtgcccccacccaccggctacccaggcggcctgcccatgggctactacagcccccagcagcccagcaccttccccctgtaccagcctgtgggcggcatccaccctgtgcgctaccagcccgggaagtaccccatgcccaaccagagcgtgcccatcacctggatgcctggccccacccccatggccaactgccccccaggcctggagtacctggtgcagctggacaacatccacgtgctgcagcactttgagcccctggagatgatgacctgctttgagaccaacaacagatatgacatcaagaacaacagcgaccagatggtgtacatcgtgacagaggacacagatgacttcaccagaaatgcctaccgcaccctgcggccctttgtgctgcgggtgacagactgcatgggccgggagatcatgaccatgcagaggcccttccgctgcacctgctgctgcttctgctgccccagcgcccggcaggagctggaggtgcagtgccccccaggagtgaccatcggctttgtggccgagcactggaacctgtgcagagctgtgtacagcatccagaatgagaagaaggaaaatgtgatgagggtgcggggcccctgcagcacctacggctgcggcagtgacagcgtgtttgaggtgaagagcctggatggcatcagcaacatcggcagcatcatcaggaagtggaatggcctgctgagcgccatggctgatgctgaccactttgacatccacttccccctggacctggatgtgaagatgaaggccatgatctttggagcctgcttcctgattgacttcatgtactttgagaggagccccccccagaggagcaggtag

SEQ ID NO: 164155 - DNA, 720 bp, Artificial Sequence
  Description of Artificial Sequence: Synthetic coding sequence
atgtctggagtggtgcccacagcccctgagcagcctgctggggagatggagaaccagaccaagcccccagaccccaggccagatgcccctcctgagtacaacagccacttcctgcccggccccccaggcacagctgtgcccccacccaccggctacccaggcggcctgcccatgggctactacagcccccagcagcccagcaccttccccctgtaccagcctgtgggcggcatccaccctgtgcgctaccagcccgggaagtaccccatgcccaaccagagcgtgcccatcacctggatgcctggccccacccccatggccaactgccccccaggcctggagtacctggtgcagctggaggtgcagtgccccccaggagtgaccatcggctttgtggccgagcactggaacctgtgcagagctgtgtacagcatccagaatgagaagaaggaaaatgtgatgagggtgcggggcccctgcagcacctacggctgcggcagtgacagcgtgtttgaggtgaagagcctggatggcatcagcaacatcggcagcatcatcaggaagtggaatggcctgctgagcgccatggctgatgctgaccactttgacatccacttccccctggacctggatgtgaagatgaaggccatgatctttggagcctgcttcctgattgacttcatgtactttgagaggagccccccccagaggagcaggtag

SEQ ID NO: 164156 - DNA, 990 bp, Artificial Sequence; identical to SEQ ID NO: 164154
  Description of Artificial Sequence: Synthetic coding sequence

SEQ ID NO: 164157 - DNA, 789 bp, Artificial Sequence
  Description of Artificial Sequence: Synthetic coding sequence
atgtctggagtggtgcccacagcccctgagcagcctgctggggagatggagaaccagaccaagcccccagaccccaggccagatgcccctcctgagtacaacagccacttcctgcccggccccccaggcacagctgtgcccccacccaccggctacccaggcggcctgcccatgggctactacagcccccagcagcccagcaccttccccctgtaccagcctgtgggcggcatccaccctgtgcgctaccagcccgggaagtaccccatgcccaaccagagcgtgcccatcacctggatgcctggccccacccccatggccaactgccccccaggcctggagtacctggtgcagctggacaacatccacgtgctgcagcactttgagcccctggagatgatgacctgctttgagaccaacaacagatatgacatcaagaacaacagcgaccagatggtgtacatcgtgacagaggacacagatgacttcaccagaaatgcctaccgcaccctgcggccctttgtgctgcgggtgacagactgcatgggccgggagatcatgaccatgcagaggcccttccgctgcacctgctgctgcttctgctgccccagcgcccggcaggagctggaggtgcagtgccccccaggagtgaccatcggctttgtggccgagcactggaacctgtgcagagctgtgtacagcatccagaatgagaagaaggaaaatgtgatgagggtgcggggcccctgcagcacctacggctgcggcagtgacagcgtgtttgaatag

SEQ ID NO: 164158 - DNA, 627 bp, Artificial Sequence
  Description of Artificial Sequence: Synthetic coding sequence
atgtctggagtggtgcccacagcccctgagcagcctgctggggagatggagaaccagaccaagcccccagaccccaggccagatgcccctcctgagtacaacagccacttcctgcccggccccccaggcacagctgtgcccccacccaccggctacccaggcggcctgcccatgggctactacagcccccagcagcccagcaccttccccctgtaccagcctgtgggcggcatccaccctgtgcgctaccagcccgggaagtaccccatgcccaaccagagcgtgcccatcacctggatgcctggccccacccccatggccaactgccccccaggcctggagtacctggtgcagctggacaacatccacgtgctgcagcactttgagcccctggagatgatgacctgctttgagaccaacaacagatatgacatcaagaacaacagcgaccagatggtgtacatcgtgacagaggacacagatgacttcaccagaaatgcctaccgcaccctgcggccctttgtgctgcgggtgacagactgcatgggccgggagatcatgaccatgcagaggcccttccgctgcacctgctgctgcttctgctgccccagcgcccggcaggagtag

SEQ ID NO: 164159 - DNA, 429 bp, Artificial Sequence
  Description of Artificial Sequence: Synthetic coding sequence
atgtctggagtggtgcccacagcccctgagcagcctgctggggagatggagaaccagaccaagcccccagaccccaggccagatgcccctcctgagtacaacagccacttcctgcccggccccccaggcacagctgtgcccccacccaccggctacccaggcggcctgcccatgggctactacagcccccagcagcccagcaccttccccctgtaccagcctgtgggcggcatccaccctgtgcgctaccagcccgggaagtaccccatgcccaaccagagcgtgcccatcacctggatgcctggccccacccccatggccaactgccccccaggcctggagtacctggtgcagctggacaacatccacgtgctgcagcactttgagcccctggagatgatgacctgctttgagaccaacaacagatag

SEQ ID NO: 164160 - DNA, 990 bp, Artificial Sequence; identical to SEQ ID NO: 164154
  Description of Artificial Sequence: Synthetic coding sequence

SEQ ID NO: 164161 - DNA, 297 bp, Artificial Sequence
  Description of Artificial Sequence: Synthetic coding sequence
atgtctggagtggtgcccacagcccctgagcagcctgctggggagatggagaaccagaccaagcccccagaccccaggccagatgcccctcctgagtacaacagccacttcctgcccggccccccaggcacagctgtgcccccacccaccggctacccaggcggcctgcccatgggctactacagcccccagcagcccagcaccttccccctgtaccagcctgtgggcggcatccaccctgtgcgctaccagcccgggaagtaccccatgcccaaccagagcgtgcccatcacctag

SEQ ID NO: 164162 - DNA, 675 bp, Artificial Sequence
  Description of Artificial Sequence: Synthetic coding sequence
atggagaaccagaccaagcccccagaccccaggccagatgcccctcctgagtacaacagccacttcctgcccggccccccaggcacagctgtgcccccacccaccggctacccaggcggcctgcccatgggctactacagcccccagcagcccagcaccttccccctgtaccagcctgtgggcggcatccaccctgtgcgctaccagcccgggaagtaccccatgcccaaccagagcgtgcccatcacctggatgcctggccccacccccatggccaactgccccccaggcctggagtacctggtgcagctggaggtgcagtgccccccaggagtgaccatcggctttgtggccgagcactggaacctgtgcagagctgtgtacagcatccagaatgagaagaaggaaaatgtgatgagggtgcggggcccctgcagcacctacggctgcggcagtgacagcgtgtttgaggtgaagagcctggatggcatcagcaacatcggcagcatcatcaggaagtggaatggcctgctgagcgccatggctgatgctgaccactttgacatccacttccccctggacctggatgtgaagatgaaggccatgatctttggagcctgcttcctgattgacttcatgtactttgagaggagccccccccagaggagcaggtag

SEQ ID NO: 164163 - DNA, 1326 bp, Artificial Sequence
  Description of Artificial Sequence: Synthetic coding sequence
atggccctgtttggagccctcttcctggccctgctggccggggcccatgctgagttccctggctgcaagatccgggtgaccagcaaggccctggagctggtgaagcaggagggcctgcgcttcctggagcaggagctggagaccatcaccatcccagacctgcggggcaaggagggccacttctactacaacatcagcgaggtgaaggtgacagagctgcagctgaccagcagcgagctggacttccagccccagcaggagctgatgctgcagatcaccaatgccagcctgggcctgcgcttccggcggcagctgctgtactggttcctgaaggtgtatgacttcctgagcaccttcatcaccagcggcatgaggttcctgctgaaccagcagatctgccctgtgctgtaccacgccggcaccgtgctgctgaacagcctgctggacacagtgcctgtgcgcagctctgtggatgagctggtgggcatcgactacagcctgatgaaggaccctgtggccagcaccagcaacctggacatggacttccggggggccttcttccccctgacagagaggaactggagcctgcccaacagagctgtggagccccagctgcaggaggaggagaggatggtgtatgtggccttcagcgagttcttctttgattctgccatggagagctacttccgggccggggccctgcagctgctgctggtgggggacaaggtgccccatgacctggacatgctgctgcgggccacctacttcggcagcatcgtgctgctgagccctgctgtgattgacagccccctgaagctggagctgcgggtgctggccccaccccgctgcaccatcaagcccagcggcaccaccatctctgtgacagcctctgtgaccatcgccctggtgcccccagaccagcctgaggtgcagctgagctccatgaccatggatgcccggctgagcgccaagatggccctgcggggcaaggccctgcggacccagctggacctgcggcgcttccgcatctacagcaaccacagcgccctggagagcctggccctgatccccctgcaggcccccctgaagaccatgctgcagatcggcgtgatgcccatgctgaatgaaagaacctggaggggcgtgcagatccccctgcctgagggcatcaactttgtgcatgaggtggtgaccaaccacgccggcttcctgaccatcggggctgacctgcactttgccaagggcctgcgggaggtgattgagaagaacagaccagcagatgtgcgggccagcacagcccccacccccagcacagctgctgtgtag

SEQ ID NO: 164164 - DNA, 1482 bp, Artificial Sequence
  Description of Artificial Sequence: Synthetic coding sequence
atggccctgtttggagccctcttcctggccctgctggccggggcccatgctgagttccctggctgcaagatccgggtgaccagcaaggccctggagctggtgaagcaggagggcctgcgcttcctggagcaggagctggagaccatcaccatcccagacctgcggggcaaggagggccacttctactacaacatcagcgaggtgaaggtgacagagctgcagctgaccagcagcgagctggacttccagccccagcaggagctgatgctgcagatcaccaatgccagcctgggcctgcgcttccggcggcagctgctgtactggttcttctatgatggcggctacatcaatgccagcgctgagggcgtgtccatcagaacaggcctggagctgagccgggaccctgctggccgcatgaaggtgtccaatgtgtcctgccaggcctctgtgtccaggatgcatgctgcctttggaggcaccttcaagaaggtgtatgacttcctgagcaccttcatcaccagcggcatgaggttcctgctgaaccagcagatctgccctgtgctgtaccacgccggcaccgtgctgctgaacagcctgctggacacagtgcctgtgcgcagctctgtggatgagctggtgggcatcgactacagcctgatgaaggaccctgtggccagcaccagcaacctggacatggacttccggggggccttcttccccctgacagagaggaactggagcctgcccaacagagctgtggagccccagctgcaggaggaggagaggatggtgtatgtggccttcagcgagttcttctttgattctgccatggagagctacttccgggccggggccctgcagctgctgctggtgggggacaaggtgccccatgacctggacatgctgctgcgggccacctacttcggcagcatcgtgctgctgagccctgctgtgattgacagccccctgaagctggagctgcgggtgctggccccaccccgctgcaccatcaagcccagcggcaccaccatctctgtgacagcctctgtgaccatcgccctggtgcccccagaccagcctgaggtgcagctgagctccatgaccatggatgcccggctgagcgccaagatggccctgcggggcaaggccctgcggacccagctggacctgcggcgcttccgcatctacagcaaccacagcgccctggagagcctggccctgatccccctgcaggcccccctgaagaccatgctgcagatcggcgtgatgcccatgctgaatgaaagaacctggaggggcgtgcagatccccctgcctgagggcatcaactttgtgcatgaggtggtgaccaaccacgccggcttcctgaccatcggggctgacctgcactttgccaagggcctgcgggaggtgattgagaagaacagaccagcagatgtgcgggccagcacagcccccacccccagcacagctgctgtgtag

SEQ ID NO: 164165 - DNA, 1482 bp, Artificial Sequence; identical to SEQ ID NO: 164164
  Description of Artificial Sequence: Synthetic coding sequence

SEQ ID NO: 164166 - DNA, 1542 bp, Artificial Sequence
  Description of Artificial Sequence: Synthetic coding sequence
atgggcctgagcggcagtgacaacagctgtgaccccaccccacctcctggccccctggccatggccctgtttggagccctcttcctggccctgctggccggggcccatgctgagttccctggctgcaagatccgggtgaccagcaaggccctggagctggtgaagcaggagggcctgcgcttcctggagcaggagctggagaccatcaccatcccagacctgcggggcaaggagggccacttctactacaacatcagcgaggtgaaggtgacagagctgcagctgaccagcagcgagctggacttccagccccagcaggagctgatgctgcagatcaccaatgccagcctgggcctgcgcttccggcggcagctgctgtactggttcttctatgatggcggctacatcaatgccagcgctgagggcgtgtccatcagaacaggcctggagctgagccgggaccctgctggccgcatgaaggtgtccaatgtgtcctgccaggcctctgtgtccaggatgcatgctgcctttggaggcaccttcaagaaggtgtatgacttcctgagcaccttcatcaccagcggcatgaggttcctgctgaaccagcagatctgccctgtgctgtaccacgccggcaccgtgctgctgaacagcctgctggacacagtgcctgtgcgcagctctgtggatgagctggtgggcatcgactacagcctgatgaaggaccctgtggccagcaccagcaacctggacatggacttccggggggccttcttccccctgacagagaggaactggagcctgcccaacagagctgtggagccccagctgcaggaggaggagaggatggtgtatgtggccttcagcgagttcttctttgattctgccatggagagctacttccgggccggggccctgcagctgctgctggtgggggacaaggtgccccatgacctggacatgctgctgcgggccacctacttcggcagcatcgtgctgctgagccctgctgtgattgacagccccctgaagctggagctgcgggtgctggccccaccccgctgcaccatcaagcccagcggcaccaccatctctgtgacagcctctgtgaccatcgccctggtgcccccagaccagcctgaggtgcagctgagctccatgaccatggatgcccggctgagcgccaagatggccctgcggggcaaggccctgcggacccagctggacctgcggcgcttccgcatctacagcaaccacagcgccctggagagcctggccctgatccccctgcaggcccccctgaagaccatgctgcagatcggcgtgatgcccatgctgaatgaaagaacctggaggggcgtgcagatccccctgcctgagggcatcaactttgtgcatgaggtggtgaccaaccacgccggcttcctgaccatcggggctgacctgcactttgccaagggcctgcgggaggtgattgagaagaacagaccagcagatgtgcgggccagcacagcccccacccccagcacagctgctgtgtag

SEQ ID NO: 164167 - DNA, 1218 bp, Artificial Sequence
  Description of Artificial Sequence: Synthetic coding sequence
atgctgcagatcaccaatgccagcctgggcctgcgcttccggcggcagctgctgtactggttcttctatgatggcggctacatcaatgccagcgctgagggcgtgtccatcagaacaggcctggagctgagccgggaccctgctggccgcatgaaggtgtccaatgtgtcctgccaggcctctgtgtccaggatgcatgctgcctttggaggcaccttcaagaaggtgtatgacttcctgagcaccttcatcaccagcggcatgaggttcctgctgaaccagcagatctgccctgtgctgtaccacgccggcaccgtgctgctgaacagcctgctggacacagtgcctgtgcgcagctctgtggatgagctggtgggcatcgactacagcctgatgaaggaccctgtggccagcaccagcaacctggacatggacttccggggggccttcttccccctgacagagaggaactggagcctgcccaacagagctgtggagccccagctgcaggaggaggagaggatggtgtatgtggccttcagcgagttcttctttgattctgccatggagagctacttccgggccggggccctgcagctgctgctggtgggggacaaggtgccccatgacctggacatgctgctgcgggccacctacttcggcagcatcgtgctgctgagccctgctgtgattgacagccccctgaagctggagctgcgggtgctggccccaccccgctgcaccatcaagcccagcggcaccaccatctctgtgacagcctctgtgaccatcgccctggtgcccccagaccagcctgaggtgcagctgagctccatgaccatggatgcccggctgagcgccaagatggccctgcggggcaaggccctgcggacccagctggacctgcggcgcttccgcatctacagcaaccacagcgccctggagagcctggccctgatccccctgcaggcccccctgaagaccatgctgcagatcggcgtgatgcccatgctgaatgaaagaacctggaggggcgtgcagatccccctgcctgagggcatcaactttgtgcatgaggtggtgaccaaccacgccggcttcctgaccatcggggctgacctgcactttgccaagggcctgcgggaggtgattgagaagaacagaccagcagatgtgcgggccagcacagcccccacccccagcacagctgctgtgtag

SEQ ID NO: 164168 - DNA, 1197 bp, Artificial Sequence
  Description of Artificial Sequence: Synthetic coding sequence
atggccctgtttggagccctcttcctggccctgctggccggggcccatgctgagttccctggctgcaagatccgggtgaccagcaaggccctggagctggtgaagcaggagggcctgcgcttcctggagcaggagctggagaccatcaccatcccagacctgcggggcaaggagggccacttctactacaacatcagcgagaaggtgtatgacttcctgagcaccttcatcaccagcggcatgaggttcctgctgaaccagcagatctgccctgtgctgtaccacgccggcaccgtgctgctgaacagcctgctggacacagtgcctgtgcgcagctctgtggatgagctggtgggcatcgactacagcctgatgaaggaccctgtggccagcaccagcaacctggacatggacttccggggggccttcttccccctgacagaaagaaactggagcctgcccaacagagctgtggagccccagctgcaggaggaggagaggatggtgtatgtggccttcagcgagttcttctttgacagcgccatggagagctacttccgggccggggccctgcagctgctgctggtgggggacaaggtgccccatgacctggacatgctgctgcgggccacctacttcggcagcatcgtgctgctgagccctgctgtgattgacagccccctgaagctggagctgcgggtgctggccccaccccgctgcaccatcaagcccagcggcaccaccatctctgtgacagcctctgtgaccatcgccctggtgcccccagaccagcctgaggtgcagctgagctccatgaccatggatgcccggctgagcgccaagatggccctgcggggcaaggccctgcggacccagctggacctgcggcgcttccgcatctacagcaaccacagcgccctggagagcctggccctgatccccctgcaggcccccctgaagaccatgctgcagattggagtgatgcccatgctgaatgaaagaacctggaggggcgtgcagatccccctgcctgagggcatcaactttgtgcatgaggtggtgaccaaccacgccggcttcctgaccatcggggctgacctgcactttgccaagggcctgcgggaggtgattgagaagaacagaccagcagatgtgcgggccagcacagcccccacccccagcacagctgctgtgtag

SEQ ID NO: 164169 - DNA, 2343 bp, Artificial Sequence
  Description of Artificial Sequence: Synthetic coding sequence
atggccccctacagcctgctggtgacccggctgcagaaggccctgggcgtgcggcagtaccacgtggcctctgtgctgtgccagagggccaaggtggccatgagccactttgagcccaatgagtacatccactatgacctgctggagaagaacatcaacatcgtgaggaagaggctgaaccggcccctgaccctgtctgagaagatcgtgtatggccacctggatgatcctgccagccaggagattgaaagaggcaagagctacctgcggctgcggccagacagagtggccatgcaggatgccacagcccagatggccatgctgcagttcatcagcagcggcctgagcaaggtggccgtgcccagcaccatccactgtgaccacctgattgaggcccaggtgggcggggagaaggacctgcggcgggccaaggacatcaaccaggaggtgtacaacttcctggccacagctggggccaagtatggagtgggcttctggaagccaggcagcggcatcatccaccagatcatcctggagaactatgcctacccaggagtgctgctgattggaacagacagccacaccccaaatggaggcggcctgggcggcatctgcatcggcgtgggcggcgcagatgctgtggatgtgatggccggcatcccctgggagctgaagtgccccaaggtgattggagtgaagctgaccggcagcctgagcggctggagcagccccaaggatgtgatcctgaaggtggccggcatcctgactgtgaagggcggcactggagccatcgtggagtaccacggccctggggtggacagcatcagctgcaccggcatggccaccatctgcaacatgggcgctgagatcggggccaccacctctgtgttcccctacaaccacaggatgaagaagtacctgagcaagacaggaagagaagatattgccaacctggctgatgagttcaaggaccacctggtgcctgaccccggctgccactatgaccagctgattgagatcaacctgtctgagctgaagccccacatcaatggccccttcaccccagacctggcccaccctgtggccgaggtgggcaaggtggccgagaaggagggctggcccctggacatccgggtgggcctcatcggcagctgcaccaacagcagctatgaggacatgggccgctctgctgctgtggccaagcaggccctggcccacggcctgaagtgcaagagccagttcaccatcaccccaggcagcgagcagatccgggccaccatcgagagagatggctacgcccagatcctgcgggacctgggcggcatcgtgctggccaatgcctgtggcccctgcatcggccagtgggacaggaaggacatcaagaagggggagaagaacaccatcgtgaccagctacaacagaaacttcaccggcagaaatgatgccaaccctgagacccacgcctttgtgaccagccctgagatcgtgacagccctggccatcgccggcaccctgaagttcaaccctgagacagactacctgactggaacagatggcaagaagttccggctggaggccccagatgctgatgagctgcccaagggggagtttgatcctggccaggacacctaccagcacccccccaaggacagcagcggccagcacgtggatgtgagccccaccagccagaggctgcagctgctggagccctttgacaagtgggatggcaaggacctggaggacctgcagatcctgatcaaggtgaagggcaagtgcaccacagaccacatctctgctgctggcccctggctgaagttccggggccacctggacaacatcagcaacaacctgctgattggagccatcaacattgaaaatggcaaggccaacagcgtgagaaatgctgtgacccaggagtttggacctgtgcctgacacagcccgctactacaagaagcacggcatccgctgggtggtgattggagatgaaaattatggagagggcagcagccgggagcacgccgccctggagcccaggcacctgggcggccgggccatcatcaccaagagctttgcccgcatccacgagaccaacctgaagaagcagggcctgctgcccctgacctttgctgaccctgctgactacaacaagatccaccctgtggacaagctgaccatccagggcctgaaggacttcacccctgggaagcccctgaagtgcatcatcaagcaccccaacggcacccaggagaccatcctgctgaaccacaccttcaatgagacccagatcgagtggttccgggccggcagcgccctgaacaggatgaaggagctgcagcagtag

SEQ ID NO: 164170 - DNA, 741 bp, Artificial Sequence
  Description of Artificial Sequence: Synthetic coding sequence
atggccgcccctggccctgccctgtgcctgtttgatgtggatggcaccctgacagccccccggcagaagatcaccaaggagatggatgacttcctgcagaagctgcggcagaagatcaagattggagtggtgggcggcagtgactttgagaaggtgcaggagcagctgggcaatgatgtggtggagaagtatgactatgtgtttcctgaaaatggcctggtggcctacaaggatggcaagctgctgtgccggcagaacatccagagccacctgggggaggccctgatccaggacctgatcaactactgcctgagctacatcgccaagatcaagctgcccaagaagaggggcaccttcatcgagttcagaaatggcatgctgaatgtgagccccatcggccgcagctgcagccaggaggagcgcatcgagttctatgagctggacaagaaggagaacatccggcagaagtttgtggccgacctgaggaaggagtttgctgggaagggcctgaccttcagcatcggcggccagatcagctttgatgtgtttcctgatggctgggacaagcgctactgcctgcggcacgtggagaatgatggctacaagaccatctacttctttggagacaagaccatgcctggaggaaatgaccacgagatcttcacagaccccaggaccatgggctacagcgtgacagcccctgaggacacccggcgcatctgtgagctgctcttctcctag

SEQ ID NO: 164171 - DNA, 366 bp, Artificial Sequence
  Description of Artificial Sequence: Synthetic coding sequence
atgctgaatgtgagccccatcggccgcagctgcagccaggaggagagaattgagttctatgagctggacaagaaggagaacatccggcagaagtttgtggccgacctgaggaaggagtttgctgggaagggcctgaccttcagcattggaggccagatcagctttgatgtgtttcctgatggctgggacaagcgctactgcctgcggcacgtggagaatgatggctacaagaccatctacttcttcggggacaagaccatgcctggaggaaatgaccacgagatcttcacagaccccaggaccatgggctacagcgtgacagcccctgaggacacccggcgcatctgtgagctgctcttctcctag

SEQ ID NO: 164172 - DNA, 492 bp, Artificial Sequence
  Description of Artificial Sequence: Synthetic coding sequence
atgatgaacatccagagccacctgggggaggccctgatccaggacctgatcaactactgcctgagctacatcgccaagatcaagctgcccaagaagaggggcaccttcatcgagttcagaaatggcatgctgaatgtgagccccatcggccgcagctgcagccaggaggagagaattgagttctatgagctggacaagaaggagaacatccggcagaagtttgtggccgacctgaggaaggagtttgctgggaagggcctgaccttcagcattggaggccagatcagctttgatgtgtttcctgatggctgggacaagcgctactgcctgcggcacgtggagaatgatggctacaagaccatctacttcttcggggacaagaccatgcctggaggaaatgaccacgagatcttcacagaccccaggaccatgggctacagcgtgacagcccctgaggacacccggcgcatctgtgagctgctcttctcctag

SEQ ID NO: 164173 - DNA, 579 bp, Artificial Sequence
  Description of Artificial Sequence: Synthetic coding sequence
atggcccccctgggcggggccccccggctggtgctgctcttcagcggcaagaggaagagcggcaaggactttgtgacagaggccctgcagagccggctgggcgcagatgtgtgtgctgtgctgcggctgagcggccccctgaaggagcagtatgcccaggagcacggcctgaacttccagaggctgctggacaccagcacctacaaggaggccttcaggaaggacatgatccgctggggcgaggagaagaggcaggccgaccccggcttcttctgcaggaagatcgtggagggcatcagccagcccatctggctggtgtctgacacccggcgggtgtctgacatccagtggttccgggaggcctacggggctgtgacccagacagtgcgggtggtggccctggagcagagccggcagcagaggggctgggtgttcaccccaggagtggatgatgctgagagtgaatgtggcctggacaactttggagactttgactgggtgattgaaaatcatggagtggagcagaggctggaggagcagctggagaacctgattgagttcatccgcagccggctgtag

SEQ ID NO: 164174 - DNA, 615 bp, Artificial Sequence
  Description of Artificial Sequence: Synthetic coding sequence
atggagcccaaggccagctgcccagctgctgcccccctgatggagaggaagttccacgtgctggtgggcgtgactggatctgtggccgccctgaagctgcccctgctggtgtccaagctgctggacatccctggcctggaggtggccgtggtgaccacagagcgggccaagcacttctacagcccccaggacatccctgtgaccctgtacagtgatgctgatgagtgggagatctggaagagcagaagtgaccctgtgctgcacatcgacctgcggcgctgggccgacctgctgctggtggcccccctggatgccaacaccctgggcaaggtggccagcggcatctgtgacaacctgctgacctgtgtgatgagggcctgggacaggagcaagcccctgctcttctgcccagccatgaacacagccatgtgggagcaccccatcacagcccagcaggtggaccagctgaaggccttcggctacgtggagatcccctgtgtggccaagaagctggtgtgtggagatgagggcctgggcgccatggccgaggtgggcaccatcgtggacaaggtgaaggaggtgctcttccagcacagcggcttccagcagagctag

SEQ ID NO: 164175 - DNA, 171 bp, Artificial Sequence
  Description of Artificial Sequence: Synthetic coding sequence
atggccgagatggaccctgtggccgagttcccccagcccccaggggccgcccgctgggccgaggccctgctgcgctgcttcacctggctgcggctgtgccagatctccatgttcctgagcctgaagtgcctgaacaccaggagcagccacctgggcgcccactgcaggtag

SEQ ID NO: 164176 - DNA, 642 bp, Artificial Sequence
  Description of Artificial Sequence: Synthetic coding sequence
atggccgagatggaccctgtggccgagttcccccagcccccaggggccgcccgctgggccgaggtgatggccaggtttgctgcccggctgggcgcccagggcagaagagtggtgctggtgaccagcggcggcaccaaggtgcccctggaggcccggcctgtgcgcttcctggacaacttcagcagcggccggcggggggccaccagcgctgaggccttcctggccgccggctacggcgtgctcttcctgtaccgggcccggagcgccttcccctatgcccaccgcttccccccccagacctggctgagcgccctgcggcccagcggccctgccctgagcggcctgctgagcctggaggccgaggagaatgccctgcccggctttgctgaggccctgcggagctaccaggaggccgctgctgctggcaccttcctggccgtggagttcaccaccctggccgactacctgcacctgctgcaggccgccgcccaggccctgaaccccctgggccccagcgccatgttctacctggccgctgctgtgtctgacttctacgtgcctgtgtctgagatgcctgagcacaagatccagagcagcggcggccccctgcaggtgatgggcgccagcctgcctgagatctag

SEQ ID NO: 164177 - DNA, 936 bp, Artificial Sequence
  Description of Artificial Sequence: Synthetic coding sequence
atggccgagatggaccctgtggccgagttcccccagcccccaggggccgcccgctgggccgaggtgatggccaggtttgctgcccggctgggcgcccagggcagaagagtggtgctggtgaccagcggcggcaccaaggtgcccctggaggcccggcctgtgcgcttcctggacaacttcagcagcggccggcggggggccaccagcgctgaggccttcctggccgccggctacggcgtgctcttcctgtaccgggcccggagcgccttcccctatgcccaccgcttccccccccagacctggctgagcgccctgcggcccagcggccctgccctgagcggcctgctgagcctggaggccgaggagaatgccctgcccggctttgctgaggccctgcggagctaccaggaggccgctgctgctggcaccttcctggccgtggagttcaccaccctggccgactacctgcacctgctgcaggccgccgcccaggccctgaaccccctgggccccagcgccatgttctacctggccgctgctgtgtctgacttctacgtgcctgtgtctgagatgcctgagcacaagatccagagcagcggcggccccctgcagatcaccatgaagatggtgcccaagctgctgagccccctggtgaaggactgggcccccaaggccttcatcatctccttcaagctggagacagatcctgccatcgtcatcaacagagccaggaaggccctggagatctaccagcaccaggtggtggtggccaacatcctggagagccggcagagctttgtgttcatcgtgaccaaggacagcgagaccaagctgctgctgtctgaggaggagattgaaaaaggagtggagattgaggagaagatcgtggacaacctgcagagccgccacacagccttcatcggggacaggaactag

SEQ ID NO: 164178 - DNA, 417 bp, Artificial Sequence
  Description of Artificial Sequence: Synthetic coding sequence
atgttctacctggccgctgctgtgtctgacttctacgtgcctgtgtctgagatgcctgagcacaagatccagagcagcggcggccccctgcagatcaccatgaagatggtgcccaagctgctgagccccctggtgaaggactgggcccccaaggccttcatcatctccttcaagctggagacagatcctgccatcgtcatcaacagagccaggaaggccctggagatctaccagcaccaggtggtggtggccaacatcctggagagccggcagagctttgtgttcatcgtgaccaaggacagcgagaccaagctgctgctgtctgaggaggagattgagaagggcgtggagattgaggagaagatcgtggacaacctgcagagccgccacacagccttcatcggggacagaaattag

SEQ ID NO: 164179 - DNA, 417 bp, Artificial Sequence; identical to SEQ ID NO: 164178
  Description of Artificial Sequence: Synthetic coding sequence

SEQ ID NO: 164180 - DNA, 393 bp, Artificial Sequence
  Description of Artificial Sequence: Synthetic coding sequence
atggccgagtatggcaccctgctgcaggacctgaccaacaacatcaccctggaggacctggagcagctgaagagcgcctgcaaggaggacatccccagcgagaagtctgaggagatcaccactggaagtgcctggttctccttcctggagagccacaacaagctggacaaggacaacctgagctacatcgagcacatctttgagatcagcagaagaccagacctgctgaccatggtggtggactaccgcaccagggtgctgaagatcagcgaggaggatgagctggacaccaagctgacccgcatccccagcgccaagaagtacaaggacatcatccggcagcccagcgaggaggagatcatcaagctggcccccccacccaagaaggcctag

SEQ ID NO: 164181 - DNA, 456 bp, Artificial Sequence
  Description of Artificial Sequence: Synthetic coding sequence
atggaggatgagggcaacaagctgtgccaggccccaccctggccaggccagaccagccctgtgatggccgagtatggcaccctgctgcaggacctgaccaacaacatcaccctggaggacctggagcagctgaagagcgcctgcaaggaggacatccccagcgagaagtctgaggagatcaccaccggcagcgcctggttctccttcctggagagccacaacaagctggacaaggacaacctgagctacatcgagcacatctttgagatcagccggcggccagacctgctgaccatggtggtggactaccgcaccagggtgctgaagatcagtgaagaagatgagctggacaccaagctgacccgcatccccagcgccaagaagtacaaggacatcatccggcagcccagcgaggaggagatcatcaagctggcccccccacccaagaaggcctag

SEQ ID NO: 164182 - DNA, 327 bp, Artificial Sequence
  Description of Artificial Sequence: Synthetic coding sequence
atggccgagtatggcaccctgctgcaggacctgaccaacaacatcaccctggaggacctggagcagctgaagagcgcctgcaaggaggacatccccagcgagaagaacaacctgagctacatcgagcacatctttgagatcagcagaagaccagacctgctgaccatggtggtggactaccgcaccagggtgctgaagatcagcgaggaggatgagctggacaccaagctgacccgcatccccagcgccaagaagtacaaggacatcatccggcagcccagcgaggaggagatcatcaagctggcccccccacccaagaaggcctag

SEQ ID NO: 164183 - DNA, 1554 bp, Artificial Sequence
  Description of Artificial Sequence: Synthetic coding sequence
atggagctggaggagctgggcatccgggaggagtgtggggtgtttggctgcatcgccagcggggagtggcccacccagctggatgtgccccacgtgatcaccctgggcctggtgggcctgcagcaccggggccaggagagcgctggcatcgtgaccagtgatggcagctctgtgcccaccttcaagagccacaagggcatgggcctggtgaaccacgtgttcacagaggacaacctgaagaagctgtatgtgagcaacctgggcatcggccacaccaggtatgccaccactggaaaatgtgagctggagaactgccagccctttgtggtggagaccctgcacggcaagattgctgtggcccacaacggggagctggtgaatgctgcccggctgaggaagaagctgctgcggcacggcatcggcctgagcaccagcagtgacagcgagatgatcacccagctgctggcctacaccccaccccaggagcaggatgacaccccagactgggtggcccgcatcaagaacctgatgaaggaggcccccacagcctacagcctgctgatcatgcacagagatgtgatctatgctgtgcgggacccctacggcaaccggcccctgtgcatcggccgcctcatccctgtgtctgacatcaatgacaaggagaagaagaccagcgagacagagggctgggtggtgagcagcgagagctgcagcttcctgagcatcggggcccgctactaccgggaggtgctgcccggggagatcgtggagatcagccgccacaacgtgcagaccctggacatcatcagccgctctgagggcaaccctgtggccttctgcatctttgaatatgtgtactttgcccggccagacagcatgtttgaggaccagatggtgtacacagtgcgctaccgctgtggccagcagctggccatcgaggcccctgtggatgctgacctggtgtccacagtgcctgagagcgccaccccagctgccctggcctatgctggaaaatgtggcctgccctacgtggaggtgctgtgcaagaaccgctacgtgggccgcaccttcatccagcccaacatgaggctgcggcagctgggcgtggccaagaagtttggagtgctgagtgacaacttcaagggcaagagaattgtgctggtggatgacagcatcgtgcggggcaacaccatcagccccatcatcaagctgctgaaggagagcggggccaaggaggtgcacatccgggtggccagcccccccatcaagtacccctgcttcatgggcatcaacatccccaccaaggaggagctgattgccaacaagccagagtttgaccacctggccgagtacctgggcgccaacagcgtggtgtacctgtctgtggagggcctggtgtcctctgtgcaggagggcatcaagttcaagaagcagaaggagaagaagcatgacatcatgatccaggagaatggaaatggcctggagtgctttgagaagagcggccactgcacagcctgcctgaccgggaagtaccctgtggagctggagtggtag

SEQ ID NO: 164184 - DNA, 657 bp, Artificial Sequence
  Description of Artificial Sequence: Synthetic coding sequence
atggagctgctgatcatgatcaatgcctgcaagatcgccagcgccagccgggtgacagctgtgatcccctgcttcccctatgcccggcaggacaagaaggacaagggcttctttgacatccctgtggacaacctgtatgcagagcctgctgtgctgaagtggatccgggagaacatcagcgagtggaggaactgcaccatcgtgtccccagatgctgggggcgccaagagggtgaccagcattgctgaccggctgaatgtggactttgccctgatccacaaggagaggaagaaggccaatgaggtggacaggatggtgctggtgggagatgtgaaggacagagtggccatcctggtggatgacatggctgacacctgtggcaccatctgccacgccgctgacaagctgctgtctgctggggccaccagggtgtatgccatcctgacccacggcatcttcagcggccctgccatcagccgcatcaacaatgcctgctttgaggccgtggtggtgaccaacaccatcccccaggaggacaagatgaagcactgcagcaagatccaggtgattgacatctccatgatcctggccgaggccatccggaggacccacaatggagagagcgtgtcctacctgttcagccacgtgcccctgtag

SEQ ID NO: 164185 - DNA, 507 bp, Artificial Sequence
  Description of Artificial Sequence: Synthetic coding sequence
atgcccaacatcaagatcttcagcggcagcagccaccaggacctgagccagaagattgctgaccggctgggcctggagctgggcaaggtggtgaccaagaagttcagcaaccaggagacctgtgtggagatcggggagagcgtgagaggagaagatgtgtacatcgtgcagagcggctgtggggagatcaatgacaacctgatggagctgctgatcatgatcaatgcctgcaagatcgccagcgccagccgggtgacagctgtgatcccctgcttcccctatgcccggcaggacaagaaggacaagagccgggcccccatcagcgccaagctggtggccaacatgctgtctgtggccggggctgaccacatcatcaccatggacctgcacgccagccagatccaggtgtctgtggaggccaagtactggtgcctgaagggcggcaggaagggcctgatgatgctgaagacagctgagaagcccaagatcatgcccaagtacatctag

SEQ ID NO: 164186 - DNA, 756 bp, Artificial Sequence
  Description of Artificial Sequence: Synthetic coding sequence
atggagctgctgatcatgatcaatgcctgcaagatcgccagcgccagccgggtgacagctgtgatcccctgcttcccctatgcccggcaggacaagaaggacaagagccgggcccccatcagcgccaagctggtggccaacatgctgtctgtggccggggctgaccacatcatcaccatggacctgcacgccagccagatccagggcttctttgacatccctgtggacaacctgtatgcagagcctgctgtgctgaagtggatccgggagaacatcagcgagtggaggaactgcaccatcgtgtccccagatgctggaggagccaagagggtgaccagcattgctgaccggctgaatgtggactttgccctgatccacaaggagaggaagaaggccaatgaggtggacaggatggtgctggtgggagatgtgaaggacagagtggccatcctggtggatgacatggctgacacctgtggcaccatctgccacgccgctgacaagctgctgtctgctggggccaccagggtgtatgccatcctgacccacggcatcttcagcggccctgccatcagccgcatcaacaatgcctgctttgaagctgtggtggtgaccaacaccatcccccaggaggacaagatgaagcactgcagcaagatccaggtgattgacatctccatgatcctggccgaggccatccggaggacccacaacggggagagcgtgtcctacctgttcagccacgtgcccctgtag

SEQ ID NO: 164187 - DNA, 957 bp, Artificial Sequence
  Description of Artificial Sequence: Synthetic coding sequence
atgcccaacatcaagatcttcagcggcagcagccaccaggacctgagccagaagattgctgaccggctgggcctggagctgggcaaggtggtgaccaagaagttcagcaaccaggagacctgtgtggagatcggggagagcgtgagaggagaagatgtgtacatcgtgcagagcggctgtggggagatcaatgacaacctgatggagctgctgatcatgatcaatgcctgcaagatcgccagcgccagccgggtgacagctgtgatcccctgcttcccctatgcccggcaggacaagaaggacaagagccgggcccccatcagcgccaagctggtggccaacatgctgtctgtggccggggctgaccacatcatcaccatggacctgcacgccagccagatccagggcttctttgacatccctgtggacaacctgtatgcagagcctgctgtgctgaagtggatccgggagaacatcagcgagtggaggaactgcaccatcgtgtccccagatgctgggggcgccaagagggtgaccagcattgctgaccggctgaatgtggactttgccctgatccacaaggagaggaagaaggccaatgaggtggacaggatggtgctggtgggagatgtgaaggacagagtggccatcctggtggatgacatggctgacacctgtggcaccatctgccacgccgctgacaagctgctgtctgctggggccaccagggtgtatgccatcctgacccacggcatcttcagcggccctgccatcagccgcatcaacaatgcctgctttgaggccgtggtggtgaccaacaccatcccccaggaggacaagatgaagcactgcagcaagatccaggtgattgacatctccatgatcctggccgaggccatccggaggacccacaatggagagagcgtgtcctacctgttcagccacgtgcccctgtag

SEQ ID NO: 164188 - DNA, 957 bp, Artificial Sequence; identical to SEQ ID NO: 164187
  Description of Artificial Sequence: Synthetic coding sequence

SEQ ID NO: 164189 - DNA, 957 bp, Artificial Sequence
  Description of Artificial Sequence: Synthetic coding sequence
acccccaacatcaagatcttcagcggcagcagccaccaggacctgagccagaagattgctgaccggctgggcctggagctgggcaaggtggtgaccaagaagttcagcaaccaggagacctgtgtggagattgatgaatctgtgagaggagaagatgtgtacatcgtgcagagcggctgtggggagatcaatgacagcctgatggagctgctgatcatgatcaatgcctgcaagatcgccagcgccagccgggtgacagctgtgatcccctgcttcccctatgcccggcaggacaagaaggacaagagccgcagccccatcagcgccaagctggtggccaacatgctgagcattgctggagctgaccacatcatcaccatggacctgcacgccagccagatccagggcttctttgacatccctgtggacaacctgtatgcagagcccaccgtgctgaagtggatccgggagaacatccctgagtggaagaactgcatcatcgtgtccccagatgctgggggcgccaagagggtgaccagcattgctgaccagctgaatgtggactttgccctgatccacaaggagaggaagaaggccaatgaggtggactgcatcgtgctggtgggagatgtgaatgacagagtggccatcctggtggatgacatggctgacacctgtgtgaccatctgcctggccgctgacaagctgctgtctgctggggccaccagggtgtatgccatcctgacccacggcatcttcagcggccctgccatcagccgcatcaacacagcctgctttgaggccgtggtggtgaccaacaccatcccccaggatgagaagatgaagcactgcagcaagatccgggtcatcgacatctccatgatcctggccgaggccatccggaggacccacaatggagagagcgtgtcctacctgttcagccacgtgcccctgtag

SEQ ID NO: 164190 - DNA, 957 bp, Artificial Sequence
  Description of Artificial Sequence: Synthetic coding sequence
atgcccaacatcgtgctcttcagcggcagcagccaccaggacctgagccagagggtggccgaccggctgggcctggagctgggcaaggtggtgaccaagaagttcagcaaccaggagacctctgtggagatcggggagagcgtgagaggagaagatgtgtacatcatccagagcggctgtggggagatcaatgacaacctgatggagctgctgatcatgatcaatgcctgcaagatcgccagcagcagccgggtgacagctgtgatcccctgcttcccctatgcccggcaggacaagaaggacaagagccgggcccccatcagcgccaagctggtggccaacatgctgtctgtggccggggctgaccacatcatcaccatggacctgcacgccagccagatccagggcttctttgacatccctgtggacaacctgtatgcagagcctgctgtgctgcagtggatcagagaaaatattgctgagtggaagaactgcatcatcgtgtccccagatgctgggggcgccaagagggtgaccagcattgctgaccggctgaatgtggagtttgccctgatccacaaggagaggaagaaggccaatgaggtggacaggatggtgctggtgggagatgtgaaggacagagtggccatcctggtggatgacatggctgacacctgtggcaccatctgccacgccgctgacaagctgctgtctgctggggccaccaaggtgtatgccatcctgacccacggcatcttcagcggccctgccatcagccgcatcaacaatgctgcctttgaggccgtggtggtgaccaacaccatcccccaggaggacaagatgaagcactgcaccaagatccaggtgattgacatctccatgatcctggccgaggccatccggaggacccacaatggagagagcgtgtcctacctgttcagccacgtgcccctgtag

SEQ ID NO: 164191 - DNA, 966 bp, Artificial Sequence
  Description of Artificial Sequence: Synthetic coding sequence
atgcccaacatcgtgctcttcagcggcagcagccaccaggacctgagccagagggtggccgaccggctgggcctggagctgggcaaggtggtgaccaagaagttcagcaaccaggagacctctgtggagatcggggagagcgtgagaggagaagatgtgtacatcatccagagcggctgtggggagatcaatgacaacctgatggagctgctgatcatgatcaatgcctgcaagatcgccagcagcagccgggtgacagctgtgatcccctgcttcccctatgcccggcaggacaagaaggacaaggtgggggagagccgggcccccatcagcgccaagctggtggccaacatgctgtctgtggccggggctgaccacatcatcaccatggacctgcacgccagccagatccagggcttctttgacatccctgtggacaacctgtatgcagagcctgctgtgctgcagtggatccgggagaacattgctgagtggaagaactgcatcatcgtgtccccagatgctggaggagccaagagggtgaccagcattgctgaccggctgaatgtggagtttgccctgatccacaaggagaggaagaaggccaatgaggtggacaggatggtgctggtgggagatgtgaaggacagagtggccatcctggtggatgacatggctgacacctgtggcaccatctgccacgccgctgacaagctgctgtctgctggggccaccaaggtgtatgccatcctgacccacggcatcttcagcggccctgccatcagccgcatcaacaatgctgcctttgaagctgtggtggtgaccaacaccatcccccaggaggacaagatgaagcactgcaccaagatccaggtgattgacatctccatgatcctggccgaggccatccggaggacccacaacggggagagcgtgtcctacctgttcagccacgtgcccctgtag

SEQ ID NO: 164192 - DNA, 849 bp, Artificial Sequence
  Description of Artificial Sequence: Synthetic coding sequence
atggagctgctgatcatggcctatgccctgaagacagcctgtgccaggaacatcattggagtcatcccctacttcccctacagcaagcagagcaagatgaggaagaggggcagcatcgtgtgcaagctgctggcctccatgctggccaaggccggcctgacccacatcatcaccatggacctgcaccagaaggagatccagggcttcttctccttccctgtggacaacctgcgggccagccccttcctgctgcagtacatccaggaggagatccccaactacagaaatgctgtgattgtggccaagagcccagatgctgccaagagggcccagagctatgcagagcggctgcggctgggcctggccgtcatccatggagaggcccagtgcacagagctggacatggatgatggccgccacagcccccccatggtgaagaatgccaccgtgcaccctggcctggagctgcccctgatgatggccaaggagaagccacccatcaccgtggtgggagatgtgggcggcagaattgccatcatcgtggatgacatcattgatgatgtggagagctttgtggccgctgctgagatcctgaaggagcggggggcctacaagatctacgtgatggccacccacggcatcctgtctgctgaggccccccggctgattgaggagagctctgtggatgaggtggtggtgaccaacacagtgccccatgaggtgcagaagctgcagtgccccaagatcaagacagtggacatcagcctcatcctgtctgaggccatccgccgcatccacaatggagagagcatggcctacctgttcaggaacatcaccgtggatgactag

SEQ ID NO: 164193 - DNA, 1158 bp, Artificial Sequence
  Description of Artificial Sequence: Synthetic coding sequence
atgcccaagaagctgctgctgctgcccccacccagcgccagcagcgccttccgggtgccccgggcccggcctgtgcccccaccagccatgaatgctgccaggacaggctacagagtcttcagcgccaacagcacagctgcctgcacagagctggccaagaggatcacagagcggctgggcgctgagctgggcaagtctgtggtgtaccaggagaccaatggagagaccagggtggagatcaaggagagcgtgcggggccaggacatcttcatcatccagaccatccccagagatgtgaacacagctgtgatggagctgctgatcatggcctatgccctgaagacagcctgtgccaggaacatcatcggggtcatcccctacttcccctacagcaagcagagcaagatgaggaagaggggcagcatcgtgtgcaagctgctggcctccatgctggccaaggccggcctgacccacatcatcaccatggacctgcaccagaaggagatccagggcttcttctccttccctgtggacaacctgcgggccagccccttcctgctgcagtacatccaggaggagatccccaactacagaaatgctgtgattgtggccaagagcccagatgctgccaagagggcccagagctatgcagagcggctgcggctgggcctggccgtcatccacggggaggcccagtgcacagagctggacatggatgatggccgccacagcccccccatggtgaagaatgccaccgtgcaccctggcctggagctgcccctgatgatggccaaggagaagccacccatcaccgtggtgggagatgtgggcggccgcatcgccatcatcgtggatgacatcattgatgatgtggagagctttgtggccgctgctgagatcctgaaggagcggggggcctacaagatctacgtgatggccacccacggcatcctgtctgctgaggcccccaggctcatcgaggagagctctgtggatgaggtggtggtgaccaacacagtgccccatgaggtgcagaagctgcagtgccccaagatcaagacagtggacatcagcctcatcctgtctgaggccatccgccgcatccacaacggggagagcatggcctacctgttcaggaacatcaccgtggatgactag

SEQ ID NO: 164194 - DNA, 1110 bp, Artificial Sequence
  Description of Artificial Sequence: Synthetic coding sequence
atgttctgtgtgaccccacctgagctggagaccaagatgaacatcaccaagggcggcctggtgctcttcagcgccaacagcaacagcagctgcatggagctgagcaagaagattgctgagcggctgggcgtggagatgggcaaggtgcaggtgtaccaggagcccaaccgggagaccagggtgcagatccaggagagcgtgcggggcaaggatgtgttcatcatccagacagtgtccaaggatgtgaacaccaccatcatggagctgctgatcatggtgtatgcctgcaagaccagctgtgccaagagcatcattggagtcatcccctacttcccctacagcaagcagtgcaagatgaggaagaggggcagcatcgtgtccaagctgctggcctccatgatgtgcaaggccggcctgacccacctgatcaccatggacctgcaccagaaggagatccagggcttcttcaacatccctgtggacaacctgcgggccagccccttcctgctgcagtacatccaggaggagatcccagactacagaaatgctgtgattgtggccaagagccctgccagcgccaagagggcccagagctttgctgagcggctgcggctgggcattgctgtgattcatggagaggcccaggatgctgagagtgacctggtggatggccgccacagcccccccatggtgcgctctgtggccgccatccaccccagcctggagatccccatgctgatccccaaggagaagccacccatcaccgtggtgggagatgtgggcggccgcatcgccatcatcgtggatgacatcattgatgatgtggacagcttcctggccgctgctgagaccctgaaggagcggggggcctacaagatctttgtgatggccacccacggcctgctgagcagtgatgccccccggcgcatcgaggagagcgccattgatgaggtggtggtgaccaacaccatcccccatgaggtgcagaagctgcagtgccccaagatcaagacagtggacatctccatgatcctgtctgaggccatccgccgcatccacaacggggagagcatgagctacctgttcagaaatattggcctggatgactag

SEQ ID NO: 164195 - DNA, 1110 bp, Artificial Sequence; identical to SEQ ID NO: 164194
  Description of Artificial Sequence: Synthetic coding sequence

SEQ ID NO: 164196 - DNA, 807 bp, Artificial Sequence
  Description of Artificial Sequence: Synthetic coding sequence
atgttctgtgtgaccccacctgagctggagaccaagatgaacatcaccaagggcggcctggtgctcttcagcgccaacagcaacagcagctgcatggagctgagcaagaagattgctgagcggctgggcgtggagatgggcaaggtgcaggtgtaccaggagcccaaccgggagaccagggtgcagatccaggagagcgtgcggggcaaggatgtgttcatcatccagacagtgtccaaggatgtgaacaccaccatcatggagctgctgatcatggtgtatgcctgcaagaccagctgtgccaagagcatcattggagtcatcccctacttcccctacagcaagcagtgcaagatgaggaagaggggcagcatcgtgtccaagctgctggcctccatgatgtgcaaggccggcctgacccacctgatcaccatggacctgcaccagaaggagatccagggcttcttcaacatccctgtggacaacctgcgggccagccccttcctgctgcagtacatccaggaggagatcccagactacagaaatgctgtgattgtggccaagagccctgccagcgccaagagggcccagagctttgctgagcggctgcggctgggcattgctgtgattcatggagaggcccaggatgctgagagtgacctggtggatggccgccacagcccccccatggtgcgctctgtggccgccatccaccccagcctggagatccccatgctgatccccaaggagaagccacccatcaccgtggtgggagatgtgggcggccgcatcgccatcatcgtgtag

SEQ ID NO: 164197 - DNA, 585 bp, Artificial Sequence
  Description of Artificial Sequence: Synthetic coding sequence
atgttctgtgtgaccccacctgagctggagaccaagatgaacatcaccaagggcggcctggtgctcttcagcgccaacagcaacagcagctgcatggagctgagcaagaagattgctgagcggctgggcgtggagatgggcaaggtgcaggtgtaccaggagcccaaccgggagaccagggtgcagatccaggagagcgtgcggggcaaggatgtgttcatcatccagacagtgtccaaggatgtgaacaccaccatcatggagctgctgatcatggtgtatgcctgcaagaccagctgtgccaagagcatcattggagtcatcccctacttcccctacagcaagcagtgcaagatgaggaagaggggcagcatcgtgtccaagctgctggcctccatgatgtgcaaggccggcctgacccacctgatcaccatggacctgcaccagaaggagatccagggcttcttcaacatccctgtggacaacctgcgggccagccccttcctgctgcagtacatccaggaggagatcccagactacagaaatgctgtgattgtggccaagagccctgccagcgccaagtag

SEQ ID NO: 164198 - DNA, 990 bp, Artificial Sequence
  Description of Artificial Sequence: Synthetic coding sequence
atgttctgtgtgaccccacctgagctggagaccaagatgaacatcaccaagggcggcctggtgctcttcagcgccaacagcaacagcagctgcatggagctgagcaagaagattgctgaagatgtgaacaccaccatcatggagctgctgatcatggtgtatgcctgcaagaccagctgtgccaagagcatcattggagtcatcccctacttcccctacagcaagcagtgcaagatgaggaagaggggcagcatcgtgtccaagctgctggcctccatgatgtgcaaggccggcctgacccacctgatcaccatggacctgcaccagaaggagatccagggcttcttcaacatccctgtggacaacctgcgggccagccccttcctgctgcagtacatccaggaggagatcccagactacagaaatgctgtgattgtggccaagagccctgccagcgccaagagggcccagagctttgctgagcggctgcggctgggcattgctgtgattcatggagaggcccaggatgctgagagtgacctggtggatggccgccacagcccccccatggtgcgctctgtggccgccatccaccccagcctggagatccccatgctgatccccaaggagaagccacccatcaccgtggtgggagatgtgggcggccgcatcgccatcatcgtggatgacatcattgatgatgtggacagcttcctggccgctgctgagaccctgaaggagcggggggcctacaagatctttgtgatggccacccacggcctgctgagcagtgatgccccccggcgcatcgaggagagcgccattgatgaggtggtggtgaccaacaccatcccccatgaggtgcagaagctgcagtgccccaagatcaagacagtggacatctccatgatcctgtctgaggccatccgccgcatccacaacggggagagcatgagctacctgttcagaaatattggcctggatgactag

SEQ ID NO: 164199 - DNA, 531 bp, Artificial Sequence
  Description of Artificial Sequence: Synthetic coding sequence
atgttctgtgtgaccccacctgagctggagaccaagatgaacatcaccaagggcggcctggtgctcttcagcgccaacagcaacagcagctgcatggagctgagcaagaagattgctgagcggctgggcgtggagatgggcaaggtgcaggtgtaccaggagcccaaccgggagaccagggtgcagatccaggagagcgtgcggggcaaggatgtgttcatcatccagacagtgtccaaggatgtgaacaccaccatcatggagctgctgatcatggtgtatgcctgcaagaccagctgtgccaagagcatcattggagtcatcccctacttcccctacagcaagcagtgcaagatgaggaagaggggcagcatcgtgtccaagctgctggcctccatgatgtgcaaggccggcctgacccacctgatcaccatggacctgcaccagaaggagatccagggcttcttcaacatccctgtggacaacctgcgggccagccccttcctgctgcagtacatccaggaggagtag

SEQ ID NO: 164200 - DNA, 735 bp, Artificial Sequence
  Description of Artificial Sequence: Synthetic coding sequence
atgttctgtgtgaccccacctgagctggagaccaagatgaacatcaccaagggcggcctggtgctcttcagcgccaacagcaacagcagctgcatggagctgagcaagaagattgctgagcggctgggcgtggagatgggcaaggtgcaggtgtaccaggagcccaaccgggagaccagggtgcagatccaggagagcgtgcggggcaaggatgtgttcatcatccagacagtgtccaaggatgtgaacaccaccatcatggagctgctgatcatggtgtatgcctgcaagaccagctgtgccaagagcatcattggagtcatcccctacttcccctacagcaagcagtgcaagatgaggaagaggggcagcatcgtgtccaagctgctggcctccatgatgtgcaaggccggcctgacccacctgatcaccatggacctgcaccagaaggagatccagggcttcttcaacatccctgtggacaacctgcgggccagccccttcctgctgcagtacatccaggaggagatcccagactacagaaatgctgtgattgtggccaagagccctgccagcgccaagagggcccagagctttgctgagcggctgcggctgggcattgctgtgattcatggagaggcccaggatgctgagagtgacctggtggatggccgccacagcccccccatggtgcgctctgtggccgccatccaccccagcctggagatcccctag

SEQ ID NO: 164201 - DNA, 135 bp, Artificial Sequence
  Description of Artificial Sequence: Synthetic coding sequence
atgttctgtgtgaccccacctgagctggagaccaagatgaacatcaccaagggcggcctggtgctcttcagcgccaacagcaacagcagctgcatggagctgagcaagaagattgctgagcggctgggcgtgtag

SEQ ID NO: 164202 - DNA, 807 bp, Artificial Sequence; identical to SEQ ID NO: 164196
  Description of Artificial Sequence: Synthetic coding sequence

SEQ ID NO: 164203 - DNA, 423 bp, Artificial Sequence
  Description of Artificial Sequence: Synthetic coding sequence
atgttctgtgtgaccccacctgagctggagaccaagatgaacatcaccaagggcggcctggtgctcttcagcgccaacagcaacagcagctgcatggagctgagcaagaagattgctgagcggctgggcgtggagatgggcaaggtgcaggtgtaccaggagcccaaccgggagaccagggtgcagatccaggagagcgtgcggggcaaggatgtgttcatcatccagacagtgtccaaggatgtgaacaccaccatcatggagctgctgatcatggtgtatgcctgcaagaccagctgtgccaagagcatcattggagtcatcccctacttcccctacagcaagcagtgcaagatgaggaagaggggcagcatcgtgtccaagctgctggcctccatgatgtgcaaggccggcctgacctag

SEQ ID NO: 164204 - DNA, 807 bp, Artificial Sequence; identical to SEQ ID NO: 164196
  Description of Artificial Sequence: Synthetic coding sequence

SEQ ID NO: 164205 - DNA, 852 bp, Artificial Sequence
  Description of Artificial Sequence: Synthetic coding sequence
atggagctgctgatcatggtgtatgcctgcaagaccagctgtgccaagagcatcattggagtcatcccctacttcccctacagcaagcagtgcaagatgaggaagaggggcagcatcgtgtccaagctgctggcctccatgatgtgcaaggccggcctgacccacctgatcaccatggacctgcaccagaaggagatccagggcttcttcaacatccctgtggacaacctgcgggccagccccttcctgctgcagtacatccaggaggagatcccagactacagaaatgctgtgattgtggccaagagccctgccagcgccaagagggcccagagctttgctgagcggctgcggctgggcattgctgtgattcatggagaggcccaggatgctgagagtgacctggtggatggccgccacagcccccccatggtgcgctctgtggccgccatccaccccagcctggagatccccatgctgatccccaaggagaagccacccatcaccgtggtgggagatgtgggcggccgcatcgccatcatcgtggatgacatcattgatgatgtggacagcttcctggccgctgctgagaccctgaaggagcggggggcctacaagatctttgtgatggccacccacggcctgctgagcagtgatgccccccggcgcatcgaggagagcgccattgatgaggtggtggtgaccaacaccatcccccatgaggtgcagaagctgcagtgccccaagatcaagacagtggacatctccatgatcctgtctgaggccatccgccgcatccacaacggggagagcatgagctacctgttcagaaatattggcctggatgactag

SEQ ID NO: 164206 - DNA, 963 bp, Artificial Sequence
  Description of Artificial Sequence: Synthetic coding sequence
atgttctgtgtgaccccacctgagctggagaccaagatgaacatcaccaagggcggcctggtgctcttcagcgccaacagcaacagcagctgcatggagctgagcaagaagattgctgagcggctgggcgtggagatgggcaaggtgcaggtgtaccaggagcccaaccgggagaccagggtgcagatccaggagagcgtgcggggcaaggatgtgttcatcatccagacagtgtccaaggatgtgaacaccaccatcatggagctgctgatcatggtgtatgcctgcaagaccagctgtgccaagagcatcattggagtcatcccctacttcccctacagcaagcagtgcaagatgaggaagaggggcagcatcgtgtccaagctgctggcctccatgatgtgcaaggccggcctgacccacctgatcaccatggacctgcaccagaaggagatccagggcttcttcaacatccctgtggacaacctgcgggccagccccttcctgctgcagtacatccaggaggagatcccagactacagaaatgctgtgattgtggccaagagccctgccagcgccaagagggcccagagctttgctgagcggctgcggctgggcattgctgtgattcatggagaggcccaggatgctgagagtgacctggtggatggccgccacagcccccccatggtgcgctctgtggccgccatccaccccagcctggagatccccatgctgatccccaaggagaagccacccatcaccgtggtgggagatgtgggcggccgcatcgccatcatcgtggtggtggtgaccaacaccatcccccatgaggtgcagaagctgcagtgccccaagatcaagacagtggacatctccatgatcctgtctgaggccatccgccgcatccacaatggagagagcatgagctacctgttcaggaacatcggcctggatgactag

SEQ ID NO: 164207 - DNA, 237 bp, Artificial Sequence
  Description of Artificial Sequence: Synthetic coding sequence
atgttctgtgtgaccccacctgagctggagaccaagatgaacatcaccaagggcggcctggtgctcttcagcgccaacagcaacagcagctgcatggagctgagcaagaagattgctgagaacaagagcaccaacagccgggtgtgtgagggcaagcgctgcttccaccaccccaactgctttgagggccgggagcaccaccaccacggggccccagaccacggcgtgtgcatgtag

SEQ ID NO: 164208 - DNA, 678 bp, Artificial Sequence
  Description of Artificial Sequence: Synthetic coding sequence
atggccggcagcagcgaggaggccccagactatggccggggcgtggtgatcatggatgactggccaggctatgacctgaacctcttcacctacccccagcactactacggggacctggagtatgtgctgatcccccacggcatcatcgtggacagaattgagcggctggccaaggacatcatgaaggacatcggctacagcgacatcatggtgctgtgtgtgctgaagggcggctacaagttctgtgccgacctggtggagcacctgaagaacatcagcaggaacagcgacagatttgtgtccatgaaggtggacttcatccggctgaagagctacagaaatgaccagagcatgggagagatgcagatcattggaggagatgacctgagcaccctggccggcaagaatgtgctgattgtggaggatgtggtgggcaccggccgcaccatgaaggccctgctgagcaacatcgagaagtacaagcccaacatgatcaaggtggccagcctgctggtgaagaggaccagcagaagtgatggcttccggccagactatgccggctttgagatccccaacctgtttgtggtgggctacgccctggactacaatgagtacttccgggacctgaaccacatctgtgtgatcaatgagcacggcaaggagaagtacagagtgtag

SEQ ID NO: 164209 - DNA, 573 bp, Artificial Sequence
  Description of Artificial Sequence: Synthetic coding sequence
atggccggcagcagcgaggaggccccagactatggccggggcgtggtgatcatggatgactggccaggctatgacctgaacctcttcacctacccccagcactactacggggacctggagtatgtgctgatcccccacggcatcatcgtggacagaattgagcggctggccaaggacatcatgaaggacatcggctacagcgacatcatggtgctgtgtgtgctgaagggcggctacaagttctgtgccgacctggtggagcacctgaagaacatcagcaggaacagcgacagatttgtgtccatgaaggtggacttcatccggctgaagagctacagaaatgaccagagcatgggagagatgcagatcattggaggagatgacctgagcaccctggccggcaagtctgtgctgtttgccaaggatgtggtgggcaccggccgcaccatgaaggccctgctgagcaacatcgagaagtacaagcccaacatgatcaaggtggccagcctgctggtgaagaggaccagcagaagtgatggcttccggccagacagccacatgaggcaccagtag

SEQ ID NO: 164210 - DNA, 522 bp, Artificial Sequence
  Description of Artificial Sequence: Synthetic coding sequence
atggccggcagcagcgaggaggccccagactatggccggggcgtggtgatcatggatgactggccaggctatgacctgaacctcttcacctacccccagcactactacggggacctggagtatgtgctgatcccccacggcatcatcgtggacagaattgagcggctggccaaggacatcatgaaggacatcggctacagcgacatcatggtgctgtgtgtgctgaagggcggctacaagttctgtgccgacctggtggagcacctgaagaacatcagcaggaacagcgacagatttgtgtccatgaaggtggacttcatccggctgaagagctaccgcctgcgggcccggctgaagaggaccaccatctgtgacagaggaggcctggccttcagccagggctacatgagcagctgtgcccccctgcaggagagccccaacaccctgtggaggggctacctgcaggtgctgatcccctgcttccacatccgcttccagctgcccaggtctgagcagaactag

SEQ ID NO: 164211 - DNA, 573 bp, Artificial Sequence
  Description of Artificial Sequence: Synthetic coding sequence
atggccggcagcagcgaggaggccccagactatggccggggcgtggtgatcatggatgactggccaggctatgacctgaacctcttcacctacccccagcactactacggggacctggagtatgtgctgatcccccacggcatcatcgtggacagaattgagcggctggccaaggacatcatgaaggacatcggctacagcgacatcatggtgctgtgtgtgctgaagggcggctacaagttctgtgccgacctggtggagcacctgaagaacatcagcaggaacagcgacagatttgtgtccatgaaggtggacttcatccggctgaagagctacagaaatgaccagagcatgggagagatgcagatcattggaggagatgacctgagcaccctggccggcaagaatgtgctgattgtggaggatgtggtgggcaccggccgcaccatgaaggccctgctgagcaacatcgagaagtacaagcccaacatgatcaaggtggccagcctgctggtgaagaggaccagcagaagtgatggcttccggccagacagccacatgaggcaccagtag

SEQ ID NO: 164212 - DNA, 1299 bp, Artificial Sequence
  Description of Artificial Sequence: Synthetic coding sequence
atggccacagctgaggtgctgaacatcggcaagaagctgtatgagggcaagaccaaggaggtgtatgagctgctggacagccctgggaaggtgctgctgcagagcaaggaccagatcacagctggaaatgctgccaggaagaaccacctggagggcaaggccgccatcagcaacaagatcaccagctgcatcttccagctgctgcaggaggccgtgaccagctacaagagcaaccgcatcaagacagccttcaccaggaaatgtggggagacagccttcatcgccccccagtgtgagatgatccccatcgagtgggtgtgccgccgcatcgccaccggcagcttcctgaagaggaaccctggggtgaaggagggctacaagttctacccacccaaggtggagctgttcttcaaggatgatgccaacaatgacccccagtggagcgaggagcagctgattgctgccaagttctgctttgctggcctgctgattggccagacagaggtggacatcatgagccacgccacccaggccatctttgagatcctggagaagtcctggctgccccagaactgcaccctggtggacatgaagattgaatttggagtggatgtgaccaccaaggagatcgtgctggctgatgtgattgacaatgacagctggaggctgtggcccagcggggacaggagccagcagaaggacaagcagagctacagagacctgaaggaggtgaccccagagggcctgcagatggtgaagaagaactttgagtgggtggccgagcgggtggagctgctgctgaagtctgagagccagtgccgggtggtggtgctgatgggcagcaccagtgacctgggccactgtgagaagatcaagaaggcctgtggcaactttggcatcccctgtgagctgcgggtgaccagcgcccacaagggcccagatgagaccctgcgcatcaaggccgagtatgaaggagatggcatccccaccgtgtttgtggccgtggccggccgcagcaatggcctgggccctgtgatgagcggcaacacagcctaccctgtgatcagctgcccccccctgaccccagactggggcgtgcaggatgtgtggagcagcctgcggctgcccagcggcctgggctgcagcacagtgctgagccctgagggcagcgcccagtttgctgcccagatcttcggcctgagcaaccacctggtgtggagcaagctgcgggccagcatcctgaacacctggatcagcctgaagcaggccgacaagaagatccgggagtgcaacctgtag

SEQ ID NO: 164213 - DNA, 1278 bp, Artificial Sequence
  Description of Artificial Sequence: Synthetic coding sequence
atggccacagctgaggtgctgaacatcggcaagaagctgtatgagggcaagaccaaggaggtgtatgagctgctggacagccctgggaaggtgctgctgcagagcaaggaccagatcacagctggaaatgctgccaggaagaaccacctggagggcaaggccgccatcagcaacaagatcaccagctgcatcttccagctgctgcaggaggccggcatcaagacagccttcaccaggaaatgtggggagacagccttcatcgccccccagtgtgagatgatccccatcgagtgggtgtgcagaagaattgccaccggcagcttcctgaagagaaatcctggggtgaaggagggctacaagttctacccacccaaggtggagctgttcttcaaggatgatgccaacaatgacccccagtggagcgaggagcagctgattgctgccaagttctgctttgctggcctgctgattggccagacagaggtggacatcatgagccacgccacccaggccatctttgagatcctggagaagtcctggctgccccagaactgcaccctggtggacatgaagattgaatttggagtggatgtgaccaccaaggagatcgtgctggctgatgtgattgacaatgacagctggaggctgtggcccagcggggacaggagccagcagaaggacaagcagagctacagagacctgaaggaggtgaccccagagggcctgcagatggtgaagaagaactttgagtgggtggccgagcgggtggagctgctgctgaagtctgagagccagtgccgggtggtggtgctgatgggcagcaccagtgacctgggccactgtgagaagatcaagaaggcctgtggcaactttggcatcccctgtgagctgcgggtgaccagcgcccacaagggcccagatgagaccctgcgcatcaaggccgagtatgaaggagatggcatccccaccgtgtttgtggccgtggccggccgcagcaatggcctgggccctgtgatgagcggcaacacagcctaccctgtgatcagctgcccccccctgaccccagactggggcgtgcaggatgtgtggagcagcctgcggctgcccagcggcctgggctgcagcacagtgctgagccctgagggcagcgcccagtttgctgcccagatcttcggcctgagcaaccacctggtgtggagcaagctgcgggccagcatcctgaacacctggatcagcctgaagcaggccgacaagaagatccgggagtgcaacctgtag

SEQ ID NO: 164214 - DNA, 1278 bp, Artificial Sequence; identical to SEQ ID NO: 164213
  Description of Artificial Sequence: Synthetic coding sequence

SEQ ID NO: 164215 - DNA, 4017 bp, Artificial Sequence
  Description of Artificial Sequence: Synthetic coding sequence
atgagccctgtgctgcacttctacgtgcggcccagcggccacgagggcgccgcccctggccacaccaggaggaagctgcagggcaagctgcctgagctgcagggcgtggagacagagctgtgctacaacgtgaactggacagctgaggccctgcccagcgctgaggagaccaagaagctgatgtggctgtttggctgccccctgctgctggatgatgtggcccgggagagctggctgctgcccggcagcaatgacctgctgctggaggtgggcccccggctgaacttcagcacccccaccagcaccaacatcgtgtctgtgtgccgggccaccggcctgggccctgtggacagagtggagaccacccggcgctaccgcctgagctttgcccacccccccagcgctgaggtggaggccatcgccctggccaccctgcatgacaggatgacagagcagcacttcccccaccccatccagagcttcagccctgagagcatgcctgagcccctgaatggccccatcaacatcctgggggagggccgcctggccctggagaaggccaaccaggagctgggcctggccctggacagctgggacctggacttctacaccaagcgcttccaggagctgcagaggaaccccagcacagtggaggcctttgacctggcccagagcaacagcgagcacagccgccactggttcttcaagggccagctgcacgtggatggccagaagctggtgcacagcctgtttgagagcatcatgagcacccaggagagcagcaaccccaacaacgtgctgaagttctgtgacaacagcagcgccatccagggcaaggaggtgcgcttcctgcggcctgaggaccccacccggcccagccgcttccagcagcagcagggcctgcggcacgtggtgttcaccgctgagacccacaacttccccactggagtgtgccccttcagcggggccaccactggaactggaggccgcatcagagatgtgcagtgcaccggccgcggggcccacgtggtggccggcacagctggctactgcttcggcaacctgcacatccctggctacaacctgccctgggaggaccccagcttccagtacccaggcaactttgcccggcccctggaggtggccatcgaggccagcaatggagccagtgactatggcaacaagtttggagagcctgtgctggccggctttgcccggagcctgggcctgcagctgcctgatggccagaggcgggagtggatcaagcccatcatgttttctgggggcatcggctccatggaggccgaccacatcagcaaggaggcccctgagcccggcatggaggtggtgaaggtgggcggccctgtgtacagaattggagtgggcggcggggccgccagctctgtgcaggtgcagggcgacaacaccagtgacctggactttggagctgtgcagagaggagaccctgagatggagcagaagatgaacagagtcatccgggcctgtgtggaggcccccaagggcaaccccatctgcagcctgcatgaccagggcgccggcggcaatggaaatgtgctgaaggagctgagtgaccctgctggggccatcatctacaccagccgcttccagctgggggaccccaccctgaatgccctggagatctggggcgctgagtaccaggagagcaatgccctgctgctgcggagccccaacagagacttcctgacccacgtgtctgcccgggagcgctgcccagcctgctttgtgggcaccatcactggagaccggcgcatcgtgctggtggatgacagagaatgtcctgtgagaagaaatggccagggagatgccccacccacccccctgcccacccctgtggacctggagctggagtgggtgctgggcaagatgcccaggaaggagttcttcctgcagaggaagccacccatgctgcagcccctggccctgcccccaggcctgtctgtgcaccaggccctggagcgggtgctgcggctgcctgctgtggccagcaagcgctacctgaccaacaaggtggacagatctgtgggcggcctggtggcccagcagcagtgtgtgggccccctgcagacccccctggctgatgtggccgtggtggccctgagccatgaggagctgattggagctgccacagccctgggggagcagcctgtgaagagcctgctggaccccaaggtggccgcccggctggccgtggccgaggccctgaccaacctggtgtttgccctggtgacagacctgagagatgtgaagtgcagcggcaactggatgtgggccgccaagctgcctggagagggcgccgccctggctgatgcctgtgaggccatggtggccgtgatggccgccctgggcgtggccgtggatggcggcaaggacagcctgtccatggccgcccgggtgggcacagagaccgtgcgggcccctggcagcctggtgatcagcgcctatgctgtgtgcccagacatcacagccaccgtgaccccagacctgaagcaccctgagggccggggccacctgctgtatgtggccctgagccctggccagcaccggctgggcggcacagccctggcccagtgcttcagccagctgggggagcaccccccagacctggacctgcctgagaacctggtgcgggccttcagcatcacccagggcctgctgaaggaccggctgctgtgcagcggccatgatgtgtctgatggcggcctggtgacctgcctgctggagatggcctttgctggcaactgtggcctgcaggtggatgtgcctgtgccccgggtggatgtgctgtctgtgctgtttgctgaggagcccggcctggtgctggaggtgcaggagccagacctggcccaggtgctgaagcgctacagagatgctggcctgcactgcctggagctgggccacactggagaggccggcccccacgccatggtgcgggtgtctgtgaatggagctgtggtgctggaggagcctgtgggggagctgcgggccctgtgggaggagaccagcttccagctggaccggctgcaggccgagccccgctgtgtggccgaggaggagcggggcctgcgggagaggatgggccccagctactgcctgccccccaccttccccaaggcctctgtgccccgggagcccggcggccccagcccccgggtggccatcctgcgggaggagggcagcaatggagaccgggagatggctgatgccttccacctggccggctttgaggtgtgggatgtgaccatgcaggacctgtgcagcggggccatcggcctggacaccttccggggcgtggcctttgtgggcggcttctcctatgcagatgtgctgggcagcgccaagggctgggccgctgctgtgaccttccaccccagggctggagctgagctgcggcgcttcaggaagaggccagacaccttcagcctgggcgtgtgcaatggctgccagctgctggccctgctgggctgggtgggcggggaccccaatgaagatgctgctgagatgggccctgacagccagcctgcccggcccggcctgctgctgcggcacaacctgagcggccgctatgagagccgctgggcctctgtgcgggtgggccctggccctgccctgatgctgcggggcatggagggcgctgtgctgcctgtgtggagcgcccatggagagggctacgtggccttcagcagccctgagctgcaggcccagatcgaggcccggggcctggcccccctgcactgggcagatgatgatggcaaccccacagagcagtaccccctgaaccccaacggcagccctgggggcgtggccggcatctgcagctgtgatggccgccacctggccgtgatgccccaccctgagagagctgtgcggccctggcagtgggcctggaggcccccaccatttgacaccctgaccaccagcccctggctgcagctgttcatcaatgccaggaactggaccctggagggcagctgctag

SEQ ID NO: 164216 - DNA, 2745 bp, Artificial Sequence
  Description of Artificial Sequence: Synthetic coding sequence
atgttttctgggggcatcggctccatggaggccgaccacatcagcaaggaggcccctgagcccggcatggaggtggtgaaggtgggcggccctgtgtacagaattggagtgggcggcggggccgccagctctgtgcaggtgcagggcgacaacaccagtgacctggactttggagctgtgcagagaggagaccctgagatggagcagaagatgaacagagtcatccgggcctgtgtggaggcccccaagggcaaccccatctgcagcctgcatgaccagggcgccggcggcaatggaaatgtgctgaaggagctgagtgaccctgctggggccatcatctacaccagccgcttccagctgggggaccccaccctgaatgccctggagatctggggcgctgagtaccaggagagcaatgccctgctgctgcggagccccaacagagacttcctgacccacgtgtctgcccgggagcgctgcccagcctgctttgtgggcaccatcactggagaccggcgcatcgtgctggtggatgacagagaatgtcctgtgagaagaaatggccagggagatgccccacccacccccctgcccacccctgtggacctggagctggagtgggtgctgggcaagatgcccaggaaggagttcttcctgcagaggaagccacccatgctgcagcccctggccctgcccccaggcctgtctgtgcaccaggccctggagcgggtgctgcggctgcctgctgtggccagcaagcgctacctgaccaacaaggtggacagatctgtgggcggcctggtggcccagcagcagtgtgtgggccccctgcagacccccctggctgatgtggccgtggtggccctgagccatgaggagctgattggagctgccacagccctgggggagcagcctgtgaagagcctgctggaccccaaggtggccgcccggctggccgtggccgaggccctgaccaacctggtgtttgccctggtgacagacctgagagatgtgaagtgcagcggcaactggatgtgggccgccaagctgcctggagagggcgccgccctggctgatgcctgtgaggccatggtggccgtgatggccgccctgggcgtggccgtggatggcggcaaggacagcctgtccatggccgcccgggtgggcacagagaccgtgcgggcccctggcagcctggtgatcagcgcctatgctgtgtgcccagacatcacagccaccgtgaccccagacctgaagcaccctgagggccggggccacctgctgtatgtggccctgagccctggccagcaccggctgggcggcacagccctggcccagtgcttcagccagctgggggagcaccccccagacctggacctgcctgagaacctggtgcgggccttcagcatcacccagggcctgctgaaggaccggctgctgtgcagcggccatgatgtgtctgatggcggcctggtgacctgcctgctggagatggcctttgctggcaactgtggcctgcaggtggatgtgcctgtgccccgggtggatgtgctgtctgtgctgtttgctgaggagcccggcctggtgctggaggtgcaggagccagacctggcccaggtgctgaagcgctacagagatgctggcctgcactgcctggagctgggccacactggagaggccggcccccacgccatggtgcgggtgtctgtgaatggagctgtggtgctggaggagcctgtgggggagctgcgggccctgtgggaggagaccagcttccagctggaccggctgcaggccgagccccgctgtgtggccgaggaggagcggggcctgcgggagaggatgggccccagctactgcctgccccccaccttccccaaggcctctgtgccccgggagcccggcggccccagcccccgggtggccatcctgcgggaggagggcagcaatggagaccgggagatggctgatgccttccacctggccggctttgaggtgtgggatgtgaccatgcaggacctgtgcagcggggccatcggcctggacaccttccggggcgtggcctttgtgggcggcttctcctatgcagatgtgctgggcagcgccaagggctgggccgctgctgtgaccttccaccccagggctggagctgagctgcggcgcttcaggaagaggccagacaccttcagcctgggcgtgtgcaatggctgccagctgctggccctgctgggctgggtgggcggggaccccaatgaagatgctgctgagatgggccctgacagccagcctgcccggcccggcctgctgctgcggcacaacctgagcggccgctatgagagccgctgggcctctgtgcgggtgggccctggccctgccctgatgctgcggggcatggagggcgctgtgctgcctgtgtggagcgcccatggagagggctacgtggccttcagcagccctgagctgcaggcccagatcgaggcccggggcctggcccccctgcactgggcagatgatgatggcaaccccacagagcagtaccccctgaaccccaacggcagccctgggggcgtggccggcatctgcagctgtgatggccgccacctggccgtgatgccccaccctgagagagctgtgcggccctggcagtgggcctggaggcccccaccatttgacaccctgaccaccagcccctggctgcagctgttcatcaatgccaggaactggaccctggagggcagctgctag

SEQ ID NO: 164217 - DNA, 2244 bp, Artificial Sequence
  Description of Artificial Sequence: Synthetic coding sequence
gtgaagggggagaggagaattgtgctggtggatgaccgggagtgccctgtgagaagaaatggccagggagatgccccacccacccccctgcccacccctgtggacctggagctggagtgggtgctgggcaagatgcccaggaaggagttcttcctgcagaggaagccacccatgctgcagcccctggccctgcccccaggcctgtctgtgcaccaggccctggagcgggtgctgcggctgcctgctgtggccagcaagcgctacctgaccaacaaggtggacagatctgtgggcggcctggtggcccagcagcagtgtgtgggccccctgcagacccccctggctgatgtggccgtggtggccctgagccatgaggagctgattggagctgccacagccctgggggagcagcctgtgaagagcctgctggaccccaaggtggccgcccggctggccgtggccgaggccctgaccaacctggtgtttgccctggtgacagacctgagagatgtgaagtgcagcggcaactggatgtgggccgccaagctgcccggggagggcgccgccctggctgatgcctgtgaggccatggtggccgtgatggccgccctgggcgtggccgtggatggcggcaaggacagcctgtccatggccgcccgggtgggcacagaaacagtgcgggcccctggcagcctggtgatcagcgcctatgctgtgtgcccagacatcacagccaccgtgaccccagacctgaagcaccctgagggccggggccacctgctgtatgtggccctgagccctggccagcaccggctgggcggcacagccctggcccagtgcttcagccagctgggggagcaccccccagacctggacctgcctgagaacctggtgcgggccttcagcatcacccagggcctgctgaaggaccggctgctgtgcagcggccatgatgtgtctgatggcggcctggtgacctgcctgctggagatggcctttgctggcaactgtggcctgcaggtggatgtgcctgtgccccgggtggatgtgctgtctgtgctgtttgctgaggagcccggcctggtgctggaggtgcaggagccagacctggcccaggtgctgaagcgctacagagatgctggcctgcactgcctggagctgggccacactggagaggccggcccccacgccatggtgcgggtgtctgtgaatggagctgtggtgctggaggagcctgtgggggagctgcgggccctgtgggaggagaccagcttccagctggaccggctgcaggccgagccccgctgtgtggccgaggaggagcggggcctgcgggagaggatgggccccagctactgcctgccccccaccttccccaaggcctctgtgccccgggagcccggcggccccagcccccgggtggccatcctgcgggaggagggcagcaatggagaccgggagatggctgatgccttccacctggccggctttgaggtgtgggatgtgaccatgcaggacctgtgcagcggggccatcggcctggacaccttccggggcgtggcctttgtgggcggcttctcctatgcagatgtgctgggcagcgccaagggctgggccgctgctgtgaccttccacccccgggccggggctgagctgcggcgcttcaggaagaggccagacaccttcagcctgggcgtgtgcaatggctgccagctgctggccctgctgggctgggtgggcggggaccccaatgaagatgctgctgagatgggccctgacagccagcctgcccggcccggcctgctgctgcggcacaacctgagcggccgctatgagagccgctgggcctctgtgcgggtgggccctggccctgccctgatgctgcggggcatggagggcgctgtgctgcctgtgtggagcgcccacggggagggctacgtggccttcagcagccctgagctgcaggcccagatcgaggcccggggcctggcccccctgcactgggcagatgatgatggcaaccccacagagcagtaccccctgaaccccaacggcagccctggaggagtggccggcatctgcagctgtgatggccgccacctggccgtgatgccccaccctgagagagctgtgcggccctggcagtgggcctggaggcctcctccatttgacaccctgaccaccagcccctggctgcagctgttcatcaatgccaggaactggaccctggagggcagctgctag

SEQ ID NO: 164218 - DNA, 1302 bp, Artificial Sequence
  Description of Artificial Sequence: Synthetic coding sequence
atggccgcccgggtgctgatcatcggcagcggcggccgggagcacaccctggcctggaagctggcccagagccaccacgtgaagcaggtgctggtggcccctggaaatgccggcacagcctgcagcgagaagatcagcaacacagccatcagcatcagtgaccacacagccctggcccagttctgcaaggagaagaagattgaatttgtggtggtgggccctgaggcccccctggccgccggcatcgtgggcaacctgcggtctgctggggtgcagtgcttcggccccacagctgaggccgcccagctggagagcagcaagagatttgccaaggagttcatggacagacatggcatccccacagcccagtggaaggccttcaccaagccagaggaggcctgcagcttcatcctgtctgctgacttccctgccctggtggtgaaggccagcggcctggccgccggcaagggcgtgattgtggccaagagcaaggaggaggcctgcaaggctgtgcaggagatcatgcaggagaaggccttcggggctgctggggagaccatcgtgattgaggagctgctggatggagaggaggtgtcctgcctgtgcttcacagatggcaagacagtggcccccatgcccccagcccaggaccacaagaggctgctggagggagatggcggccccaacacaggaggcatgggcgcctactgcccagccccccaggtgtccaatgacctgctgctgaagatcaaggacacagtgctgcagaggacagtggatggcatgcagcaggagggcaccccctacacaggcatcctgtatgccggcatcatgctgaccaagaatggccccaaggtgctggagttcaactgccgctttggagaccctgagtgccaggtgatcctgcccctgctgaagagtgacctgtatgaggtgatccagagcaccctggatggcctgctgtgcaccagcctgcctgtgtggctggagaaccacacagccctgactgtggtgatggccagcaagggctacccaggggactacaccaagggcgtggagatcaccggcttccctgaggcccaggccctgggcctggaggtgttccacgccggcacagccctgaagaatggcaaggtggtgacccacggcggccgggtgctggccgtgacagccatccgggagaacctgatcagcgccctggaggaggccaagaagggcctggccgccatcaagtttgagggcgccatctacaggaaggatgtgggcttccgggccatcgccttcctgcagcagcccaggtag

SEQ ID NO: 164219 - DNA, 3033 bp, Artificial Sequence
  Description of Artificial Sequence: Synthetic coding sequence
atggccgcccgggtgctgatcatcggcagcggcggccgggagcacaccctggcctggaagctggcccagagccaccacgtgaagcaggtgctggtggcccctggaaatgccggcacagcctgcagcgagaagatcagcaacacagccatcagcatcagtgaccacacagccctggcccagttctgcaaggagaagaagattgaatttgtggtggtgggccctgaggcccccctggccgccggcatcgtgggcaacctgcggtctgctggggtgcagtgcttcggccccacagctgaggccgcccagctggagagcagcaagagatttgccaaggagttcatggacagacatggcatccccacagcccagtggaaggccttcaccaagccagaggaggcctgcagcttcatcctgtctgctgacttccctgccctggtggtgaaggccagcggcctggccgccggcaagggcgtgattgtggccaagagcaaggaggaggcctgcaaggctgtgcaggagatcatgcaggagaaggccttcggggctgctggggagaccatcgtgattgaggagctgctggatggagaggaggtgtcctgcctgtgcttcacagatggcaagacagtggcccccatgcccccagcccaggaccacaagaggctgctggagggagatggcggccccaacacaggaggcatgggcgcctactgcccagccccccaggtgtccaatgacctgctgctgaagatcaaggacacagtgctgcagaggacagtggatggcatgcagcaggagggcaccccctacacaggcatcctgtatgccggcatcatgctgaccaagaatggccccaaggtgctggagttcaactgccgctttggagaccctgagtgccaggtgatcctgcccctgctgaagagtgacctgtatgaggtgatccagagcaccctggatggcctgctgtgcaccagcctgcctgtgtggctggagaaccacacagccctgactgtggtgatggccagcaagggctacccaggggactacaccaagggcgtggagatcaccggcttccctgaggcccaggccctgggcctggaggtgttccacgccggcacagccctgaagaatggcaaggtggtgacccacggcggccgggtgctggccgtgacagccatccgggagaacctgatcagcgccctggaggaggccaagaagggcctggccgccatcaagtttgagggcgccatctacaggaaggatgtgggcttccgggccatcgccttcctgcagcagcccaggagcctgacctacaaggagagcggcgtggacattgctgctggcaacatgctggtgaagaagatccagcccctggccaaggccaccagccgcagcggctgcaaggtggacctgggcggctttgctggcctgtttgacctgaaggccgccggcttcaaggaccccctgctggccagcggcacagatggagtgggcaccaagctgaagatcgcccagctgtgcaacaagcatgacaccatcggccaggacctggtggccatgtgtgtgaatgacatcctggcccagggcgctgagcccctcttcttcctggactacttcagctgtgggaagctggacctgtctgtgacagaggccgtggtggccggcatcgccaaggcctgtgggaaggccggctgtgccctgctgggcggggagacagctgagatgccagacatgtacccacctggagaatatgacctggccggctttgctgtgggcgccatggagcgggaccagaagctgccccacctggagcgcatcacagaaggagatgtggtggtgggcatcgccagcagcggcctgcacagcaatggcttcagcctggtgaggaagatcgtggccaagagcagcctgcagtacagcagccctgccccagatggctgtggggaccagaccctgggggacctgctgctgacccccacccgcatctacagccacagcctgctgcctgtgctgcggagcggccacgtgaaggcctttgcccacatcaccggcggcggcctgctggagaacatcccccgggtgctgcctgagaagctgggcgtggacctggatgcccagacctggaggatccccagggtcttctcctggctgcagcaggagggccacctgtctgaggaggagatggcccggaccttcaactgtggggtgggcgctgtgctggtggtgtccaaggagcagacagagcagatcctgcgggacatccagcagcacaaggaggaggcctgggtgattggctctgtggtggcccgggcagagggcagcccccgggtgaaggtgaagaacctgattgagagcatgcagatcaatggatctgtgctgaagaatggcagcctgaccaaccacttctcctttgagaagaagaaggcccgggtggccgtgctgatctctggaacaggcagcaacctgcaggccctgattgacagcacccgggagcccaacagcagcgcccagattgatattgtcatcagcaacaaggctgctgtggccggcctggacaaggccgagcgggccggcatccccaccagggtcatcaaccacaagctgtacaagaacagagtggagtttgacagcgccatcgacctggtgctggaggagttcagcattgatattgtgtgcctggccggcttcatgaggatcctgagcggcccctttgtgcagaagtggaatggcaagatgctgaacatccaccccagcctgctgcccagcttcaagggcagcaatgcccacgagcaggccctggagaccggggtgacagtgacaggctgcaccgtgcactttgtggccgaggatgtggatgctggccagatcatcctgcaggaggccgtgcctgtgaagagaggagacacagtggccaccctgtctgagcgggtgaagctggccgagcacaagatcttccctgctgccctgcagctggtggccagcggcaccgtgcagctgggggagaatggcaagatctgctgggtgaaggaggagtag

SEQ ID NO: 164220 - DNA, 3033 bp, Artificial Sequence; identical to SEQ ID NO: 164219
  Description of Artificial Sequence: Synthetic coding sequence

SEQ ID NO: 164221 - DNA, 3033 bp, Artificial Sequence; identical to SEQ ID NO: 164219
  Description of Artificial Sequence: Synthetic coding sequence

SEQ ID NO: 164222 - DNA, 699 bp, Artificial Sequence
  Description of Artificial Sequence: Synthetic coding sequence
atggccgcccgggtgctgatcatcggcagcggcggccgggagcacaccctggcctggaagctggcccagagccaccacgtgaagcaggtgctggtggcccctggaaatgccggcacagcctgcagcgagaagatcagcaacacagccatcagcatcagtgaccacacagccctggcccagttctgcaaggagaagaagattgaatttgtggtggtgggccctgaggcccccctggccgccggcatcgtgggcaacctgcggtctgctggggtgcagtgcttcggccccacagctgaggccgcccagctggagagcagcaagagatttgccaaggagttcatggacagacatggcatccccacagcccagtggaaggccttcaccaagccagaggaggcctgcagcttcatcctgtctgctgacttccctgccctggtggtgaaggccagcggcctggccgccggcaagggcgtgattgtggccaagagcaaggaggaggcctgcaaggctgtgcaggagatcatgcaggagaaggccttcggggctgctggggagaccatcgtgattgaggagctgctggatggagaggaggtgtcctgcctgtgcttcacagatggcaagacagtggcccccatgcccccagcccaggaccacaagaggctgctggagggagatggcggccccaacacaggaggatag

SEQ ID NO: 164223 - DNA, 726 bp, Artificial Sequence
  Description of Artificial Sequence: Synthetic coding sequence
atggccgcccgggtgctgatcatcggcagcggcggccgggagcacaccctggcctggaagctggcccagagccaccacgtgaagcaggtgctggtggcccctggaaatgccggcacagcctgcagcgagaagatcagcaacacagccatcagcatcagtgaccacacagccctggcccagttctgcaaggagaagaagattgaatttgtggtggtgggccctgaggcccccctggccgccggcatcgtgggcaacctgcggtctgctggggtgcagtgcttcggccccacagctgaggccgcccagctggagagcagcaagagatttgccaaggagttcatggacagacatggcatccccacagcccagtggaaggccttcaccaagccagaggaggcctgcagcttcatcctgtctgctgacttccctgccctggtggtgaaggccagcggcctggccgccggcaagggcgtgattgtggccaagagcaaggaggaggcctgcaaggctgtgcaggagatcatgcaggagaaggccttcggggctgctggggagaccatcgtgattgaggagctgctggatggagaggaggtgtcctgcctgtgcttcacagatggcaagacagtggcccccatgcccccagcccaggaccacaagaggctgctggagggagatggcggccccaacacaggaggcatgggcgcctactgcccagccccccagtag

SEQ ID NO: 164224 - DNA, 417 bp, Artificial Sequence
  Description of Artificial Sequence: Synthetic coding sequence
atggccgcccgggtgctgatcatcggcagcggcggccgggagcacaccctggcctggaagctggcccagagccaccacgtgaagcaggtgctggtggcccctggaaatgccggcacagcctgcagcgagaagatcagcaacacagccatcagcatcagtgaccacacagccctggcccagttctgcaaggagaagaagattgaatttgtggtggtgggccctgaggcccccctggccgccggcatcgtgggcaacctgcggtctgctggggtgcagtgcttcggccccacagctgaggccgcccagctggagagcagcaagagatttgccaaggagttcatggacagacatggcatccccacagcccagtggaaggccttcaccaagccagaggaggcctgcagcttcatcctgtag

SEQ ID NO: 164225 - DNA, 411 bp, Artificial Sequence
  Description of Artificial Sequence: Synthetic coding sequence
atggccgcccgggtgctgatcatcggcagcggcggccgggagcacaccctggcctggaagctggcccagagccaccacgtgaagcaggtgctggtggcccctggaaatgccggcacagcctgcagcgagaagatcagcaacacagccatcagcatcagtgaccacacagccctggcccagttctgcaaggagaagaagattgaatttgtggtggtgggccctgaggcccccctggccgccggcatcgtgggcaacctgcggtctgctggggtgcagtgcttcggccccacagctgaggccgcccagctggagagcagcaagagatttgccaaggagttcatggacagacatggcatccccacagcccagtggaaggccttcaccaagccagaggaggcctgcagcttctag

SEQ ID NO: 164226 - DNA, 1689 bp, Artificial Sequence
  Description of Artificial Sequence: Synthetic coding sequence
atgctggtgaagaagatccagcccctggccaaggccaccagccgcagcggctgcaaggtggacctgggcggctttgctggcctgtttgacctgaaggccgccggcttcaaggaccccctgctggccagcggcacagatggagtgggcaccaagctgaagatcgcccagctgtgcaacaagcatgacaccatcggccaggacctggtggccatgtgtgtgaatgacatcctggcccagggcgctgagcccctcttcttcctggactacttcagctgtgggaagctggacctgtctgtgacagaggccgtggtggccggcatcgccaaggcctgtgggaaggccggctgtgccctgctgggcggggagacagctgagatgccagacatgtacccacctggagaatatgacctggccggctttgctgtgggcgccatggagcgggaccagaagctgccccacctggagcgcatcacagaaggagatgtggtggtgggcatcgccagcagcggcctgcacagcaatggcttcagcctggtgaggaagatcgtggccaagagcagcctgcagtacagcagccctgccccagatggctgtggggaccagaccctgggggacctgctgctgacccccacccgcatctacagccacagcctgctgcctgtgctgcggagcggccacgtgaaggcctttgcccacatcaccggcggcggcctgctggagaacatcccccgggtgctgcctgagaagctgggcgtggacctggatgcccagacctggaggatccccagggtcttctcctggctgcagcaggagggccacctgtctgaggaggagatggcccggaccttcaactgtggggtgggcgctgtgctggtggtgtccaaggagcagacagagcagatcctgcgggacatccagcagcacaaggaggaggcctgggtgattggctctgtggtggcccgggcagagggcagcccccgggtgaaggtgaagaacctgattgagagcatgcagatcaatggatctgtgctgaagaatggcagcctgaccaaccacttctcctttgagaagaagaaggcccgggtggccgtgctgatctctggaacaggcagcaacctgcaggccctgattgacagcacccgggagcccaacagcagcgcccagattgatattgtcatcagcaacaaggctgctgtggccggcctggacaaggccgagcgggccggcatccccaccagggtcatcaaccacaagctgtacaagaacagagtggagtttgacagcgccatcgacctggtgctggaggagttcagcattgatattgtgtgcctggccggcttcatgaggatcctgagcggcccctttgtgcagaagtggaatggcaagatgctgaacatccaccccagcctgctgcccagcttcaagggcagcaatgcccacgagcaggccctggagaccggggtgacagtgacaggctgcaccgtgcactttgtggccgaggatgtggatgctggccagatcatcctgcaggaggccgtgcctgtgaagagaggagacacagtggccaccctgtctgagcgggtgaagctggccgagcacaagatcttccctgctgccctgcagctggtggccagcggcaccgtgcagctgggggagaatggcaagatctgctgggtgaaggaggagtag

SEQ ID NO: 164227 - DNA, 2265 bp, Artificial Sequence
  Description of Artificial Sequence: Synthetic coding sequence
atgagccggcccctgagtgaccaggagaagaggaagcagatctctgtgcggggcctggccggcgtggagaatgtgacagagctgaagaagaacttcaacagacacctgcacttcaccctggtgaaggacagaaatgtggccaccccccgggactactactttgccctggcccacacagtgcgggaccacctggtgggccgctggatccgcacccagcagcactactatgagaaggaccccaagaagatcagcggcggctggcagatggaggaggctgatgactggctgcgctatggcaacccctgggagaaggcccggcctgagttcaccctgcctgtgcacttctacggccacgtggagcacaccagccagggcgccaagtgggtggacacccaggtggtgctggccatgccctatgacacccctgtgcccggctacagaaataatgtggtgaacaccatgaggctgtggagcgccaaggccccaaatgacttcaacctgaaggacttcaacgtgggcggctacatccaggccgtgctggacaggaacctggccgagaacatcagccgggtgctgtacccaaatgacaacttctttgagggcaaggagctgcggctgaagcaggagtactttgtggtggccgccaccctgcaggacatcatccgccgcttcaagagcagcaagtttggctgccgggaccctgtgaggaccaactttgatgccttcccagacaaggtggccatccagctgaatgacacccaccccagcctggccatccctgagctgatgaggatcctggtggacctggagaggatggactgggacaaggcctgggatgtgacagtgaggacctgtgcctacaccaaccacacagtgctgcctgaggccctggagcgctggcctgtgcacctgctggagaccctgctgcccaggcacctgcagatcatctatgagatcaaccagcgcttcctgaacagagtggccgccgccttccctggagatgtggaccggctgcggaggatgagcctggtggaggagggcgctgtgaagaggatcaacatggcccacctgtgcatcgccggcagccatgctgtgaatggagtggcccgcatccacagcgagatcctgaagaagaccatcttcaaggacttctatgagctggagccccacaagttccagaacaagaccaacggcatcaccccccggcgctggctggtgctgtgcaaccctggcctggccgaggtgattgctgagcgcatcggggaggacttcatcagtgacctggaccagctgaggaagctgctgagctttgtggatgatgaggccttcatcagagatgtggccaaggtgaagcaggagaacaagctgaagtttgctgcctacctggagcgggagtacaaggtgcacatcaaccccaacagcctgtttgacatccaggtgaagaggatccacgagtacaagaggcagctgctgaactgcctgcacgtgatcaccctgtacaaccgcatcaagcgggagcccaacaagttctttgtgcccaggacagtgatgattggaggcaaggccgcccctggctaccacatggccaagatgatcatccggctggtgacagccatcggagatgtggtgaaccacgaccctgctgtgggggaccggctgcgggtcatcttcctggagaactacagagtgtccctggccgagaaggtgatcccagctgctgacctgtctgagcagatcagcacagctggaacagaggccagcggcactggaaacatgaagttcatgctgaatggagccctgaccatcggcaccatggatggagccaacgtggagatggccgaggaggccggggaggagaacttcttcatcttcggcatgagggtggaggatgtggacaagctggaccagaggggctacaatgcccaggagtactatgaccgcatccctgagctgcggcaggtgattgagcagctgagcagcggcttcttcagccccaagcagcctgacctcttcaaggacatcgtgaacatgctgatgcaccacgaccgcttcaaggtgtttgctgactatgaggactacatcaagtgccaggagaaggtgtctgccctgtacaagaacccccgggagtggaccaggatggtgatccggaacatcgccaccagcggcaagttcagcagtgacaggaccatcgcccagtatgcccgggagatctggggcgtggagcccagccggcagaggctgcctgccccagatgaggccatctag

SEQ ID NO: 164228 - DNA, 3633 bp, Artificial Sequence
  Description of Artificial Sequence: Synthetic coding sequence
atgaggagccgcagcaacagcggcgtgcggctggatggctacgcccggctggtgcagcagaccatcctgtgccaccagaaccctgtgacaggcctgctgcctgccagctatgaccagaaggatgcctgggtgcgggacaacgtgtacagcatcctggccgtgtggggcctgggcctggcctacaggaagaatgctgacagagatgaggacaaggccaaggcctatgagctggagcagagcgtggtgaagctgatgaggggcctgctgcactgcatgatccggcaggtggacaaggtggagagcttcaagtacagccagagcaccaaggacagcctgcacgccaagtacaacaccaagacctgtgccaccgtggtgggagatgaccagtggggccacctgcagctggatgccacctctgtgtacctgctcttcctggcccagatgacagccagcggcctgcacatcatccacagcctggatgaggtgaacttcatccagaacctggtgttctacatcgaggccgcctacaagacagctgactttggcatctgggagcggggggacaagaccaaccagggcatcagcgagctgaatgccagctctgtgggcatggccaaggccgccctggaggccctggatgagctggacctgtttggagtgaagggcggcccccagagcgtcatccacgtgctggctgatgaggtgcagcactgccagagcatcctgaacagcctgctgccccgggccagcaccagcaaggaggtggatgccagcctgctgtctgtggtgtccttccctgcctttgctgtggaggacagccagctggtggagctgaccaagcaggagatcatcaccaagctgcagggccgctatggctgctgccgcttcctgagagatggctacaagacccccaaggaggaccccaacagactctactatgagcctgctgagctgaagctgtttgagaacattgaatgtgagtggcccctcttctggacctacttcatcctggatggagtcttctctggaaatgctgagcaggtgcaggagtacaaggaggccctggaggccgtgctgatcaagggcaagaatggagtgcccctgctgcctgagctgtacagcgtgcccccagacagagtggatgaggagtaccagaacccccacacagtggacagagtgcccatgggcaagctgccccacatgtggggccagagcctgtacatcctgggcagcctgatggccgagggcttcctggcccctggagaaattgaccccctgaacagacgcttcagcacagtgcccaagccagatgtggtggtgcaggtgtccatcctggccgagacagaggagatcaagaccatcctgaaggacaagggcatctacgtggagaccatcgccgaggtgtaccccatccgggtgcagcctgcccgcatcctgagccacatctacagcagcctgggctgcaacaacaggatgaagctgagcggccggccctaccgccacatgggcgtgctgggcaccagcaagctgtatgacatcaggaagaccatcttcaccttcaccccccagttcatcgaccagcagcagttctacctggccctggacaacaagatgattgtggagatgctgaggacagacctgagctacctgtgcagccgctggaggatgacaggccagcccaccatcaccttccccatcagccacagcatgctggatgaagatggcaccagcctgaacagcagcatcctggccgccctgaggaagatgcaggacggctactttggaggagcccgggtgcagacaggcaagctgtctgagttcctgaccaccagctgctgcacccacctgtccttcatggaccccggccctgagggcaagctgtacagcgaggactatgatgacaactatgactacctggagagcggcaactggatgaatgactatgacagcaccagccacgcccgctgtggagatgaggtggcccgctacctggaccacctgctggcccacacagccccccaccccaagctggcccccaccagccagaagggcggcctggaccgcttccaggccgctgtgcagaccacctgtgacctgatgagcctggtgaccaaggccaaggagctgcacgtgcagaatgtgcacatgtacctgcccaccaagctgttccaggccagccggcccagcttcaacctgctggacagcccccacccccggcaggagaaccaggtgcccagcgtgcgggtggagatccacctgccccgggaccagagcggggaggtggacttcaaggccctggtgctgcagctgaaggagaccagcagcctgcaggagcaggccgacatcctgtacatgctgtacaccatgaagggccctgactggaacacagagctgtacaatgaaagaagtgccaccgtgcgggagctgctgacagagctgtatggcaaggtgggggagatccgccactggggcctcatccgctacatcagcggcatcctgaggaagaaggtggaggccctggatgaggcctgcacagacctgctgagccaccagaagcacctgactgtgggcctgcccccagagccccgggagaagaccatcagcgcccccctgccctatgaggccctgacccagctgattgatgaggccagcgagggggacatgagcatcagcatcctgacccaggagatcatggtgtacctggccatgtacatgaggacccagcccggcctgtttgctgagatgttccggctgcgcatcggcctcatcatccaggtgatggccacagagctggcccacagcctgcgctgcagcgctgaggaggccacagagggcctgatgaacctgagccccagcgccatgaagaacctgctgcaccacatcctgagcggcaaggagtttggagtggagaggtctgtgcggcccacagacagcaatgtgtccccagccatcagcatccatgaaattggagctgtgggcgccaccaagacagagaggacaggcatcatgcagctgaagtctgagatcaagcagagccctggcacctccatgacccccagcagcggcagcttccccagcgcctatgaccagcagagcagcaaggacagccggcagggccagtggcagaggagaagaaggctggatggagccctgaacagagtgcctgtgggcttctaccagaaggtgtggaaggtgctgcagaagtgccacggcctgtctgtggagggctttgtgctgcccagcagcaccacccgggagatgaccccaggagagatcaagttctctgtgcacgtggagagcgtgctgaacagagtgccccagcctgagtaccggcagctgctggtggaggccatcctggtgctgaccatgctggccgacatcgagatccacagcatcggcagcatcatcgctgtggagaagatcgtgcacatcgccaatgacctcttcctgcaggagcagaagaccctgggcgcagatgacaccatgctggccaaggaccctgccagcggcatctgcaccctgctgtatgacagcgcccccagcggccgcttcggcaccatgacctacctgagcaaggccgccgccacctacgtgcaggagttcctgccccacagcatctgtgccatgcagtag

SEQ ID NO: 164229 - DNA, 3723 bp, Artificial Sequence
  Description of Artificial Sequence: Synthetic coding sequence
atgaggagccgcagcaacagcggcgtgcggctggatggctacgcccggctggtgcagcagaccatcctgtgccaccagaaccctgtgacaggcctgctgcctgccagctatgaccagaaggatgcctgggtgcgggacaacgtgtacagcatcctggccgtgtggggcctgggcctggcctacaggaagaatgctgacagagatgaggacaaggccaaggcctatgagctggagcagagcgtggtgaagctgatgaggggcctgctgcactgcatgatccggcaggtggacaaggtggagagcttcaagtacagccagagcaccaaggacagcctgcacgccaagtacaacaccaagacctgtgccaccgtggtgggagatgaccagtggggccacctgcagctggatgccacctctgtgtacctgctcttcctggcccagatgacagccagcggcctgcacatcatccacagcctggatgaggtgaacttcatccagaacctggtgttctacatcgaggccgcctacaagacagctgactttggcatctgggagcggggggacaagaccaaccagggcatcagcgagctgaatgccagctctgtgggcatggccaaggccgccctggaggccctggatgagctggacctgtttggagtgaagggcggcccccagagcgtcatccacgtgctggctgatgaggtgcagcactgccagagcatcctgaacagcctgctgccccgggccagcaccagcaaggaggtggatgccagcctgctgtctgtggtgtccttccctgcctttgctgtggaggacagccagctggtggagctgaccaagcaggagatcatcaccaagctgcagggccgctatggctgctgccgcttcctgagagatggctacaagacccccaaggaggaccccaacagactctactatgagcctgctgagctgaagctgtttgagaacattgaatgtgagtggcccctcttctggacctacttcatcctggatggagtcttctctggaaatgctgagcaggtgcaggagtacaaggaggccctggaggccgtgctgatcaagggcaagaatggagtgcccctgctgcctgagctgtacagcgtgcccccagacagagtggatgaggagtaccagaacccccacacagtggacagagtgcccatgggcaagctgccccacatgtggggccagagcctgtacatcctgggcagcctgatggccgagggcttcctggcccctggagaaattgaccccctgaacagacgcttcagcacagtgcccaagccagatgtggtggtgcaggtgtccatcctggccgagacagaggagatcaagaccatcctgaaggacaagggcatctacgtggagaccatcgccgaggtgtaccccatccgggtgcagcctgcccgcatcctgagccacatctacagcagcctgggctgcaacaacaggatgaagctgagcggccggccctaccgccacatgggcgtgctgggcaccagcaagctgtatgacatcaggaagaccatcttcaccttcaccccccagttcatcgaccagcagcagttctacctggccctggacaacaagatgattgtggagatgctgaggacagacctgagctacctgtgcagccgctggaggatgacaggccagcccaccatcaccttccccatcagccacagcatgctggatgaagatggcaccagcctgaacagcagcatcctggccgccctgaggaagatgcaggacggctactttggaggagcccgggtgcagacaggcaagctgtctgagttcctgaccaccagctgctgcacccacctgtccttcatggaccccggccctgagggcaagctgtacagcgaggactatgatgacaactatgactacctggagagcggcaactggatgaatgactatgacagcaccagccacgcccgctgtggagatgaggtggcccgctacctggaccacctgctggcccacacagccccccaccccaagctggcccccaccagccagaagggcggcctggaccgcttccaggccgctgtgcagaccacctgtgacctgatgagcctggtgaccaaggccaaggagctgcacgtgcagaatgtgcacatgtacctgcccaccaagctgttccaggccagccggcccagcttcaacctgctggacagcccccacccccggcaggagaaccaggtgcccagcgtgcgggtggagatccacctgccccgggaccagagcggggaggtggacttcaaggccctggtgctgcagctgaaggagaccagcagcctgcaggagcaggccgacatcctgtacatgctgtacaccatgaagggccctgactggaacacagagctgtacaatgaaagaagtgccaccgtgcgggagctgctgacagagctgtatggcaaggtgggggagatccgccactggggcctcatccgctacatcagcggcatcctgaggaagaaggtggaggccctggatgaggcctgcacagacctgctgagccaccagaagcacctgactgtgggcctgcccccagagccccgggagaagaccatcagcgcccccctgccctatgaggccctgacccagctgattgatgaggccagcgagggggacatgagcatcagcatcctgacccaggagatcatggtgtacctggccatgtacatgaggacccagcccggcctgtttgctgagatgttccggctgcgcatcggcctcatcatccaggtgatggccacagagctggcccacagcctgcgctgcagcgctgaggaggccacagagggcctgatgaacctgagccccagcgccatgaagaacctgctgcaccacatcctgagcggcaaggagtttggagtggagaggtctgtgcggcccacagacagcaatgtgtccccagccatcagcatccatgaaattggagctgtgggcgccaccaagacagagaggacaggcatcatgcagctgaagtctgagatcaagcaggtggagttccggcggctgagcatctctgctgagagccagagcaatggaggccaccccctgggcatcgacctgatgagccccagcttcatgagccctggcacctccatgacccccagcagcggcagcttccccagcgcctatgaccagcagagcagcaaggacagccggcagggccagtggcagaggagaagaaggctggatggagccctgaacagagtgcctgtgggcttctaccagaaggtgtggaaggtgctgcagaagtgccacggcctgtctgtggagggctttgtgctgcccagcagcaccacccgggagatgaccccaggagagatcaagttctctgtgcacgtggagagcgtgctgaacagagtgccccagcctgagtaccggcagctgctggtggaggccatcctggtgctgaccatgctggccgacatcgagatccacagcatcggcagcatcatcgctgtggagaagatcgtgcacatcgccaatgacctcttcctgcaggagcagaagaccctgggcgcagatgacaccatgctggccaaggaccctgccagcggcatctgcaccctgctgtatgacagcgcccccagcggccgcttcggcaccatgacctacctgagcaaggccgccgccacctacgtgcaggagttcctgccccacagcatctgtgccatgcagtag

SEQ ID NO: 164230 - DNA, 3672 bp, Artificial Sequence
  Description of Artificial Sequence: Synthetic coding sequence
atgaggagccgcagcaacagcggcgtgcggctggatggctacgcccggctggtgcagcagaccatcctgtgccaccagaaccctgtgacaggcctgctgcctgccagctatgaccagaaggatgcctgggtgcgggacaacgtgtacagcatcctggccgtgtggggcctgggcctggcctacaggaagaatgctgacagagatgaggacaaggccaaggcctatgagctggagcagagcgtggtgaagctgatgaggggcctgctgcactgcatgatccggcaggtggacaaggtggagagcttcaagtacagccagagcaccaaggacagcctgcacgccaagtacaacaccaagacctgtgccaccgtggtgggagatgaccagtggggccacctgcagctggatgccacctctgtgtacctgctcttcctggcccagatgacagccagcggcctgcacatcatccacagcctggatgaggtgaacttcatccagaacctggtgttctacatcgaggccgcctacaagacagctgactttggcatctgggagcggggggacaagaccaaccagggcatcagcgagctgaatgccagctctgtgggcatggccaaggccgccctggaggccctggatgagctggacctgtttggagtgaagggcggcccccagagcgtcatccacgtgctggctgatgaggtgcagcactgccagagcatcctgaacagcctgctgccccgggccagcaccagcaaggaggtggatgccagcctgctgtctgtggtgtccttccctgcctttgctgtggaggacagccagctggtggagctgaccaagcaggagatcatcaccaagctgcagggccgctatggctgctgccgcttcctgagagatggctacaagacccccaaggaggaccccaacagactctactatgagcctgctgagctgaagctgtttgagaacattgaatgtgagtggcccctcttctggacctacttcatcctggatggagtcttctctggaaatgctgagcaggtgcaggagtacaaggaggccctggaggccgtgctgatcaagggcaagaatggagtgcccctgctgcctgagctgtacagcgtgcccccagacagagtggatgaggagtaccagaacccccacacagtggacagagtgcccatgggcaagctgccccacatgtggggccagagcctgtacatcctgggcagcctgatggccgagggcttcctggcccctggagaaattgaccccctgaacagacgcttcagcacagtgcccaagccagatgtggtggtgcaggtgtccatcctggccgagacagaggagatcaagaccatcctgaaggacaagggcatctacgtggagaccatcgccgaggtgtaccccatccgggtgcagcctgcccgcatcctgagccacatctacagcagcctgggctgcaacaacaggatgaagctgagcggccggccctaccgccacatgggcgtgctgggcaccagcaagctgtatgacatcaggaagaccatcttcaccttcaccccccagttcatcgaccagcagcagttctacctggccctggacaacaagatgattgtggagatgctgaggacagacctgagctacctgtgcagccgctggaggatgacaggccagcccaccatcaccttccccatcagccacagcatgctggatgaagatggcaccagcctgaacagcagcatcctggccgccctgaggaagatgcaggacggctactttggaggagcccgggtgcagacaggcaagctgtctgagttcctgaccaccagctgctgcacccacctgtccttcatggaccccggccctgagggcaagctgtacagcgaggactatgatgacaactatgactacctggagagcggcaactggatgaatgactatgacagcaccagccacgcccgctgtggagatgaggtggcccgctacctggaccacctgctggcccacacagccccccaccccaagctggcccccaccagccagaagggcggcctggaccgcttccaggccgctgtgcagaccacctgtgacctgatgagcctggtgaccaaggccaaggagctgcacgtgcagaatgtgcacatgtacctgcccaccaagctgttccaggccagccggcccagcttcaacctgctggacagcccccacccccggcaggagaaccaggtgcccagcgtgcgggtggagatccacctgccccgggaccagagcggggaggtggacttcaaggccctggtgctgcagctgaaggagaccagcagcctgcaggagcaggccgacatcctgtacatgctgtacaccatgaagggccctgactggaacacagagctgtacaatgaaagaagtgccaccgtgcgggagctgctgacagagctgtatggcaaggtgggggagatccgccactggggcctcatccgctacatcagcggcatcctgaggaagaaggtggaggccctggatgaggcctgcacagacctgctgagccaccagaagcacctgactgtgggcctgcccccagagccccgggagaagaccatcagcgcccccctgccctatgaggccctgacccagctgattgatgaggccagcgagggggacatgagcatcagcatcctgacccaggagatcatggtgtacctggccatgtacatgaggacccagcccggcctgtttgctgagatgttccggctgcgcatcggcctcatcatccaggtgatggccacagagctggcccacagcctgcgctgcagcgctgaggaggccacagagggcctgatgaacctgagccccagcgccatgaagaacctgctgcaccacatcctgagcggcaaggagtttggagtggagaggtctgtgcggcccacagacagcaatgtgtccccagccatcagcatccatgaaattggagctgtgggcgccaccaagacagagaggacaggcatcatgcagctgaagtctgagatcaagcaggtggagttccggcggctgagcatctctgctgagagccagagccctggcacctccatgacccccagcagcggcagcttccccagcgcctatgaccagcagagcagcaaggacagccggcagggccagtggcagaggagaagaaggctggatggagccctgaacagagtgcctgtgggcttctaccagaaggtgtggaaggtgctgcagaagtgccacggcctgtctgtggagggctttgtgctgcccagcagcaccacccgggagatgaccccaggagagatcaagttctctgtgcacgtggagagcgtgctgaacagagtgccccagcctgagtaccggcagctgctggtggaggccatcctggtgctgaccatgctggccgacatcgagatccacagcatcggcagcatcatcgctgtggagaagatcgtgcacatcgccaatgacctcttcctgcaggagcagaagaccctgggcgcagatgacaccatgctggccaaggaccctgccagcggcatctgcaccctgctgtatgattctgcccccagcggccgcttcggcaccatgacctacctgagcaaggctgctgccacctacgtgcaggagttcctgccccacagcatctgtgccatgcagtag

SEQ ID NO: 164231 - DNA, 3546 bp, Artificial Sequence
  Description of Artificial Sequence: Synthetic coding sequence
atgaggagccgcagcaacagcggcgtgcggctggatggctacgcccggctggtgcagcagaccatcctgtgccaccagaaccctgtgacaggcctgctgcctgccagctatgaccagaaggatgcctgggtgcgggacaacgtgtacagcatcctggccgtgtggggcctgggcctggcctacaggaagaatgctgacagagatgaggacaaggccaaggcctatgagctggagcagagcgtggtgaagctgatgaggggcctgctgcactgcatgatccggcaggtggacaaggtggagagcttcaagtacagccagagcaccaaggacagcctgcacgccaagtacaacaccaagacctgtgccaccgtggtgggagatgaccagtggggccacctgcagctggatgccacctctgtgtacctgctcttcctggcccagatgacagccagcggcctgcacatcatccacagcctggatgaggtgaacttcatccagaacctggtgttctacatcgaggccgcctacaagacagctgactttggcatctgggagcggggggacaagaccaaccagggcatcagcgagctgaatgccagctctgtgggcatggccaaggccgccctggaggccctggatgagctggacctgtttggagtgaagggcggcccccagagcgtcatccacgtgctggctgatgaggtgcagcactgccagagcatcctgaacagcctgctgccccgggccagcaccagcaaggaggtggatgccagcctgctgtctgtggtgtccttccctgcctttgctgtggaggacagccagctggtggagctgaccaagcaggagatcatcaccaagctgcagggccgctatggctgctgccgcttcctgagagatggctacaagacccccaaggaggaccccaacagactctactatgagcctgctgagctgaagctgtttgagaacattgaatgtgagtggcccctcttctggacctacttcatcctggatggagtcttctctggaaatgctgagcaggtgcaggagtacaaggaggccctggaggccgtgctgatcaagggcaagaatggagtgcccctgctgcctgagctgtacagcgtgcccccagacagagtggatgaggagtaccagaacccccacacagtggacagagtgcccatgggcaagctgccccacatgtggggccagagcctgtacatcctgggcagcctgatggccgagggcttcctggcccctggagaaattgaccccctgaacagacgcttcagcacagtgcccaagccagatgtggtggtgcaggtgtccatcctggccgagacagaggagatcaagaccatcctgaaggacaagggcatctacgtggagaccatcgccgaggtgtaccccatccgggtgcagcctgcccgcatcctgagccacatctacagcagcctgggctgcaacaacaggatgaagctgagcggccggccctaccgccacatgggcgtgctgggcaccagcaagctgtatgacatcaggaagaccatcttcaccttcaccccccagttcatcgaccagcagcagttctacctggccctggacaacaagatgattgtggagatgctgaggacagacctgagctacctgtgcagccgctggaggatgacaggccagcccaccatcaccttccccatcagccacagcatgctggatgaagatggcaccagcctgaacagcagcatcctggccgccctgaggaagatgcaggacggctactttggaggagcccgggtgcagacaggcaagctgtctgagttcctgaccaccagctgctgcacccacctgtccttcatggaccccggccctgagggcaagctgtacagcgaggactatgatgacaactatgactacctggagagcggcaactggatgaatgactatgacagcaccagccatgatgtgcacatgtacctgcccaccaagctgttccaggccagccggcccagcttcaacctgctggacagcccccacccccggcaggagaaccaggtgcccagcgtgcgggtggagatccacctgccccgggaccagagcggggaggtggacttcaaggccctggtgctgcagctgaaggagaccagcagcctgcaggagcaggccgacatcctgtacatgctgtacaccatgaagggccctgactggaacacagagctgtacaatgaaagaagtgccaccgtgcgggagctgctgacagagctgtatggcaaggtgggggagatccgccactggggcctcatccgctacatcagcggcatcctgaggaagaaggtggaggccctggatgaggcctgcacagacctgctgagccaccagaagcacctgactgtgggcctgcccccagagccccgggagaagaccatcagcgcccccctgccctatgaggccctgacccagctgattgatgaggccagcgagggggacatgagcatcagcatcctgacccaggagatcatggtgtacctggccatgtacatgaggacccagcccggcctgtttgctgagatgttccggctgagaattggcctcatcatccaggtgatggccacagagctggcccacagcctgcgctgcagcgctgaggaggccacagagggcctgatgaacctgagccccagcgccatgaagaacctgctgcaccacatcctgagcggcaaggagtttggagtggagaggtctgtgcggcccacagacagcaatgtgtccccagccatcagcatccacgagatcggggctgtgggcgccaccaagacagagaggacaggcatcatgcagctgaagtctgagatcaagcaggtggagttccggcggctgagcatctctgctgagagccagagcaatggaggccaccccctgggcatcgacctgatgagccccagcttcatgagccctggcacctccatgacccccagcagcggcagcttccccagcgcctatgaccagcagagcagcaaggacagccggcagggccagtggcagaggagaagaaggctggatggagccctgaacagagtgcctgtgggcttctaccagaaggtgtggaaggtgctgcagaagtgccacggcctgtctgtggagggctttgtgctgcccagcagcaccacccgggagatgaccccaggagagatcaagttctctgtgcacgtggagagcgtgctgaacagagtgccccagcctgagtaccggcagctgctggtggaggccatcctggtgctgaccatgctggccgacatcgagatccacagcatcggcagcatcatcgctgtggagaagatcgtgcacatcgccaatgacctcttcctgcaggagcagaagaccctgggcgcagatgacaccatgctggccaaggaccctgccagcggcatctgcaccctgctgtatgattctgcccccagcggccgcttcggcaccatgacctacctgagcaaggctgctgccacctacgtgcaggagttcctgccccacagcatctgtgccatgcagtag

SEQ ID NO: 164232 - DNA, 3456 bp, Artificial Sequence
  Description of Artificial Sequence: Synthetic coding sequence
atgaggagccgcagcaacagcggcgtgcggctggatggctacgcccggctggtgcagcagaccatcctgtgccaccagaaccctgtgacaggcctgctgcctgccagctatgaccagaaggatgcctgggtgcgggacaacgtgtacagcatcctggccgtgtggggcctgggcctggcctacaggaagaatgctgacagagatgaggacaaggccaaggcctatgagctggagcagagcgtggtgaagctgatgaggggcctgctgcactgcatgatccggcaggtggacaaggtggagagcttcaagtacagccagagcaccaaggacagcctgcacgccaagtacaacaccaagacctgtgccaccgtggtgggagatgaccagtggggccacctgcagctggatgccacctctgtgtacctgctcttcctggcccagatgacagccagcggcctgcacatcatccacagcctggatgaggtgaacttcatccagaacctggtgttctacatcgaggccgcctacaagacagctgactttggcatctgggagcggggggacaagaccaaccagggcatcagcgagctgaatgccagctctgtgggcatggccaaggccgccctggaggccctggatgagctggacctgtttggagtgaagggcggcccccagagcgtcatccacgtgctggctgatgaggtgcagcactgccagagcatcctgaacagcctgctgccccgggccagcaccagcaaggaggtggatgccagcctgctgtctgtggtgtccttccctgcctttgctgtggaggacagccagctggtggagctgaccaagcaggagatcatcaccaagctgcagggccgctatggctgctgccgcttcctgagagatggctacaagacccccaaggaggaccccaacagactctactatgagcctgctgagctgaagctgtttgagaacattgaatgtgagtggcccctcttctggacctacttcatcctggatggagtcttctctggaaatgctgagcaggtgcaggagtacaaggaggccctggaggccgtgctgatcaagggcaagaatggagtgcccctgctgcctgagctgtacagcgtgcccccagacagagtggatgaggagtaccagaacccccacacagtggacagagtgcccatgggcaagctgccccacatgtggggccagagcctgtacatcctgggcagcctgatggccgagggcttcctggcccctggagaaattgaccccctgaacagacgcttcagcacagtgcccaagccagatgtggtggtgcaggtgtccatcctggccgagacagaggagatcaagaccatcctgaaggacaagggcatctacgtggagaccatcgccgaggtgtaccccatccgggtgcagcctgcccgcatcctgagccacatctacagcagcctgggctgcaacaacaggatgaagctgagcggccggccctaccgccacatgggcgtgctgggcaccagcaagctgtatgacatcaggaagaccatcttcaccttcaccccccagttcatcgaccagcagcagttctacctggccctggacaacaagatgattgtggagatgctgaggacagacctgagctacctgtgcagccgctggaggatgacaggccagcccaccatcaccttccccatcagccacagcatgctggatgaagatggcaccagcctgaacagcagcatcctggccgccctgaggaagatgcaggacggctactttggaggagcccgggtgcagacaggcaagctgtctgagttcctgaccaccagctgctgcacccacctgtccttcatggaccccggccctgagggcaagctgtacagcgaggactatgatgacaactatgactacctggagagcggcaactggatgaatgactatgacagcaccagccatgatgtgcacatgtacctgcccaccaagctgttccaggccagccggcccagcttcaacctgctggacagcccccacccccggcaggagaaccaggtgcccagcgtgcgggtggagatccacctgccccgggaccagagcggggaggtggacttcaaggccctggtgctgcagctgaaggagaccagcagcctgcaggagcaggccgacatcctgtacatgctgtacaccatgaagggccctgactggaacacagagctgtacaatgaaagaagtgccaccgtgcgggagctgctgacagagctgtatggcaaggtgggggagatccgccactggggcctcatccgctacatcagcggcatcctgaggaagaaggtggaggccctggatgaggcctgcacagacctgctgagccaccagaagcacctgactgtgggcctgcccccagagccccgggagaagaccatcagcgcccccctgccctatgaggccctgacccagctgattgatgaggccagcgagggggacatgagcatcagcatcctgacccaggagatcatggtgtacctggccatgtacatgaggacccagcccggcctgtttgctgagatgttccggctgagaattggcctcatcatccaggtgatggccacagagctggcccacagcctgcgctgcagcgctgaggaggccacagagggcctgatgaacctgagccccagcgccatgaagaacctgctgcaccacatcctgagcggcaaggagtttggagtggagaggtctgtgcggcccacagacagcaatgtgtccccagccatcagcatccacgagatcggggctgtgggcgccaccaagacagagaggacaggcatcatgcagctgaagtctgagatcaagcagagccctggcacctccatgacccccagcagcggcagcttccccagcgcctatgaccagcagagcagcaaggacagccggcagggccagtggcagaggagaagaaggctggatggagccctgaacagagtgcctgtgggcttctaccagaaggtgtggaaggtgctgcagaagtgccacggcctgtctgtggagggctttgtgctgcccagcagcaccacccgggagatgaccccaggagagatcaagttctctgtgcacgtggagagcgtgctgaacagagtgccccagcctgagtaccggcagctgctggtggaggccatcctggtgctgaccatgctggccgacatcgagatccacagcatcggcagcatcatcgctgtggagaagatcgtgcacatcgccaatgacctcttcctgcaggagcagaagaccctgggcgcagatgacaccatgctggccaaggaccctgccagcggcatctgcaccctgctgtatgattctgcccccagcggccgcttcggcaccatgacctacctgagcaaggctgctgccacctacgtgcaggagttcctgccccacagcatctgtgccatgcagtag

SEQ ID NO: 164233 - DNA, 1164 bp, Artificial Sequence
  Description of Artificial Sequence: Synthetic coding sequence
atgaccagagatgaggccctgcctgacagccacagcgcccaggacttctatgagaactatgagcccaaggagatcctgggccggggcgtgtcctctgtggtgcggcgctgcatccacaagcccaccagccaggagtatgctgtgaaggtgattgatgtgactggaggcggcagcttcagccctgaggaggtgcgggagctgcgggaggccaccctgaaggaggtggacatcctgaggaaggtgtctggccaccccaacatcatccagctgaaggacacctatgagaccaacaccttcttcttcctggtgtttgacctgatgaagagaggagagctgtttgactacctgacagagaaggtgaccctgtctgagaaggagaccaggaagatcatgagggccctgctggaggtgatctgcaccctgcacaagctgaacatcgtgcaccgggacctgaagccagagaacatcctgctggatgacaacatgaacatcaagctgacagactttggcttcagctgccagctggagcctggagagcggctgcgggaggtgtgtggcacccccagctacctggcccctgagatcattgaatgttccatgaatgaagaccaccctggctacggcaaggaggtggacatgtggagcactggagtcatcatgtacaccctgctggccggcagcccccccttctggcacaggaagcagatgctgatgctgaggatgatcatgagcggcaactaccagtttggcagccctgagtgggatgactacagcgacacagtgaaggacctggtgagccgcttcctggtggtgcagccccagaaccgctacacagctgaggaggccctggcccaccccttcttccagcagtacctggtggaggaggtgcgccacttcagcccccggggcaagttcaaggtgattgccctgactgtgctggcctctgtgcgcatctactaccagtacagaagagtgaagcctgtgacccgggagatcgtcatccgggacccctatgccctgcggcccctgcggcggctgattgatgcctatgccttccgcatctacggccactgggtgaagaagggccagcagcagaacagagctgccctgtttgagaacacccccaaggctgtgctgctgagcctggccgaggaggactactag

SEQ ID NO: 164234 - DNA, 1260 bp, Artificial Sequence
  Description of Artificial Sequence: Synthetic coding sequence
atgaccagagatgaggccctgcctgacagccacagcgcccaggacttctatgagaactatgagcccaaggagatcctgggccggggcgtgtcctctgtggtgcggcgctgcatccacaagcccaccagccaggagtatgctgtgaaggtgattgatgtgactggaggcggcagcttcagccctgaggaggtgcgggagctgcgggaggccaccctgaaggaggtggacatcctgaggaaggtgtctggccaccccaacatcatccagctgaaggacacctatgagaccaacaccttcttcttcctggtgtttgacctgtgggaggacacagacaccatggagatggagcagaagtggtgcctgggctgggacagccccaagagcaccaacttccgggcccagggccgggccaggatgaagagaggagagctgtttgactacctgacagagaaggtgaccctgtctgagaaggagaccaggaagatcatgagggccctgctggaggtgatctgcaccctgcacaagctgaacatcgtgcaccgggacctgaagccagagaacatcctgctggatgacaacatgaacatcaagctgacagactttggcttcagctgccagctggagcctggagagcggctgcgggaggtgtgtggcacccccagctacctggcccctgagatcattgaatgttccatgaatgaagaccaccctggctacggcaaggaggtggacatgtggagcactggagtcatcatgtacaccctgctggccggcagcccccccttctggcacaggaagcagatgctgatgctgaggatgatcatgagcggcaactaccagtttggcagccctgagtgggatgactacagcgacacagtgaaggacctggtgagccgcttcctggtggtgcagccccagaaccgctacacagctgaggaggccctggcccaccccttcttccagcagtacctggtggaggaggtgcgccacttcagcccccggggcaagttcaaggtgattgccctgactgtgctggcctctgtgcgcatctactaccagtacagaagagtgaagcctgtgacccgggagatcgtcatccgggacccctatgccctgcggcccctgcggcggctgattgatgcctatgccttccgcatctacggccactgggtgaagaagggccagcagcagaacagagctgccctgtttgagaacacccccaaggctgtgctgctgagcctggccgaggaggactactag

SEQ ID NO: 164235 - DNA, 1002 bp, Artificial Sequence
  Description of Artificial Sequence: Synthetic coding sequence
atgcacccccaggcccacgagcccggggtgagaagagagggccaccggcggcaccgctggaggcagctgcagcccggcggcggggccggggccgcccggagccacgccgagggcggcggccacccagcccagggcctgcgggccccccagcaccagatgaagagaggagagctgtttgactacctgacagagaaggtgaccctgtctgagaaggagaccaggaagatcatgagggccctgctggaggtgatctgcaccctgcacaagctgaacatcgtgcaccgggacctgaagccagagaacatcctgctggatgacaacatgaacatcaagctgacagactttggcttcagctgccagctggagcctggagagcggctgcgggaggtgtgtggcacccccagctacctggcccctgagatcattgaatgttccatgaatgaagaccaccctggctacggcaaggaggtggacatgtggagcactggagtcatcatgtacaccctgctggccggcagcccccccttctggcacaggaagcagatgctgatgctgaggatgatcatgagcggcaactaccagtttggcagccctgagtgggatgactacagcgacacagtgaaggacctggtgagccgcttcctggtggtgcagccccagaaccgctacacagctgaggaggccctggcccaccccttcttccagcagtacctggtggaggaggtgcgccacttcagcccccggggcaagttcaaggtgattgccctgactgtgctggcctctgtgcgcatctactaccagtacagaagagtgaagcctgtgacccgggagatcgtcatccgggacccctatgccctgcggcccctgcggcggctgattgatgcctatgccttccgcatctacggccactgggtgaagaagggccagcagcagaacagagctgccctgtttgagaacacccccaaggctgtgctgctgagcctggccgaggaggactactag

SEQ ID NO: 164236 - DNA, 2529 bp, Artificial Sequence
  Description of Artificial Sequence: Synthetic coding sequence
atgagccggcccctgagtgaccaggagaagaggaagcagatctctgtgcggggcctggccggcgtggagaatgtgacagagctgaagaagaacttcaacagacacctgcacttcaccctggtgaaggacagaaatgtggccaccccccgggactactactttgccctggcccacacagtgcgggaccacctggtgggccgctggatccgcacccagcagcactactatgagaaggaccccaagaggatctactacctgagcctggagttctacatgggccgcaccctgcagaacaccatggtgaacctggccctggagaatgcctgtgatgaggccacctaccagctgggcctggacatggaggagctggaggagattgaggaggatgctggcctgggcaatggaggcctgggccgcctggccgcctgcttcctggacagcatggccaccctgggcctggccgcctacggctacggcatccgctatgaatttggcatcttcaaccagaagatcagcggcggctggcagatggaggaggctgatgactggctgcgctatggcaacccctgggagaaggcccggcctgagttcaccctgcctgtgcacttctacggccacgtggagcacaccagccagggcgccaagtgggtggacacccaggtggtgctggccatgccctatgacacccctgtgcccggctacagaaataatgtggtgaacaccatgaggctgtggagcgccaaggccccaaatgacttcaacctgaaggacttcaacgtgggcggctacatccaggccgtgctggacaggaacctggccgagaacatcagccgggtgctgtacccaaatgacaacttctttgagggcaaggagctgcggctgaagcaggagtactttgtggtggccgccaccctgcaggacatcatccgccgcttcaagagcagcaagtttggctgccgggaccctgtgaggaccaactttgatgccttcccagacaaggtggccatccagctgaatgacacccaccccagcctggccatccctgagctgatgaggatcctggtggacctggagaggatggactgggacaaggcctgggatgtgacagtgaggacctgtgcctacaccaaccacacagtgctgcctgaggccctggagcgctggcctgtgcacctgctggagaccctgctgcccaggcacctgcagatcatctatgagatcaaccagcgcttcctgaacagagtggccgccgccttccctggagatgtggaccggctgcggaggatgagcctggtggaggagggcgctgtgaagaggatcaacatggcccacctgtgcatcgccggcagccatgctgtgaatggagtggcccgcatccacagcgagatcctgaagaagaccatcttcaaggacttctatgagctggagccccacaagttccagaacaagaccaacggcatcaccccccggcgctggctggtgctgtgcaaccctggcctggccgaggtgattgctgagcgcatcggggaggacttcatcagtgacctggaccagctgaggaagctgctgagctttgtggatgatgaggccttcatcagagatgtggccaaggtgaagcaggagaacaagctgaagtttgctgcctacctggagcgggagtacaaggtgcacatcaaccccaacagcctgtttgacatccaggtgaagaggatccacgagtacaagaggcagctgctgaactgcctgcacgtgatcaccctgtacaaccgcatcaagcgggagcccaacaagttctttgtgcccaggacagtgatgattggaggcaaggccgcccctggctaccacatggccaagatgatcatccggctggtgacagccatcggagatgtggtgaaccacgaccctgctgtgggggaccggctgcgggtcatcttcctggagaactacagagtgtccctggccgagaaggtgatcccagctgctgacctgtctgagcagatcagcacagctggaacagaggccagcggcactggaaacatgaagttcatgctgaatggagccctgaccatcggcaccatggatggagccaacgtggagatggccgaggaggccggggaggagaacttcttcatcttcggcatgagggtggaggatgtggacaagctggaccagaggggctacaatgcccaggagtactatgaccgcatccctgagctgcggcaggtgattgagcagctgagcagcggcttcttcagccccaagcagcctgacctcttcaaggacatcgtgaacatgctgatgcaccacgaccgcttcaaggtgtttgctgactatgaggactacatcaagtgccaggagaaggtgtctgccctgtacaagaacccccgggagtggaccaggatggtgatccggaacatcgccaccagcggcaagttcagcagtgacaggaccatcgcccagtatgcccgggagatctggggcgtggagcccagccggcagaggctgcctgccccagatgaggccatctag

SEQ ID NO: 164237 - DNA, 2499 bp, Artificial Sequence
  Description of Artificial Sequence: Synthetic coding sequence
atgagccggcccctgagtgaccaggagaagaggaagcagatctctgtgcggggcctggccggcgtggagaatgtgacagagctgaagaagaacttcaacagacacctgcacttcaccctggtgaaggacagaaatgtggccaccccccgggactactactttgccctggcccacacagtgcgggaccacctggtgggccgctggatccgcacccagcagcactactatgagaaggaccccaagaggatctactacctgagcctggagttctacatgggccgcaccctgcagaacaccatggtgaacctggccctggagaatgcctgtgatgaggccacctaccaggtgggcctgggccgcctggccgcctgcttcctggacagcatggccaccctgggcctggccgcctacggctacggcatccgctatgaatttggcatcttcaaccagaagatcagcggcggctggcagatggaggaggctgatgactggctgcgctatggcaacccctgggagaaggcccggcctgagttcaccctgcctgtgcacttctacggccacgtggagcacaccagccagggcgccaagtgggtggacacccaggtggtgctggccatgccctatgacacccctgtgcccggctacagaaacaacgtggtgaacaccatgaggctgtggagcgccaaggccccaaatgacttcaacctgaaggacttcaacgtgggcggctacatccaggccgtgctggacaggaacctggccgagaacatcagccgggtgctgtacccaaatgacaacttctttgagggcaaggagctgcggctgaagcaggagtactttgtggtggccgccaccctgcaggacatcatccgccgcttcaagagcagcaagtttggctgccgggaccctgtgaggaccaactttgatgccttcccagacaaggtggccatccagctgaatgacacccaccccagcctggccatccctgagctgatgaggatcctggtggacctggagaggatggactgggacaaggcctgggatgtgacagtgaggacctgtgcctacaccaaccacacagtgctgcctgaggccctggagcgctggcctgtgcacctgctggagaccctgctgcccaggcacctgcagatcatctatgagatcaaccagcgcttcctgaacagagtggccgccgccttccctggagatgtggaccggctgcggaggatgagcctggtggaggagggcgctgtgaagaggatcaacatggcccacctgtgcatcgccggcagccatgctgtgaatggagtggcccgcatccacagcgagatcctgaagaagaccatcttcaaggacttctatgagctggagccccacaagttccagaacaagaccaacggcatcaccccccggcgctggctggtgctgtgcaaccctggcctggccgaggtgattgctgagagaattggagaggacttcatcagtgacctggaccagctgaggaagctgctgagctttgtggatgatgaggccttcatcagagatgtggccaaggtgaagcaggagaacaagctgaagtttgctgcctacctggagcgggagtacaaggtgcacatcaaccccaacagcctgtttgacatccaggtgaagagaattcatgagtacaagaggcagctgctgaactgcctgcacgtgatcaccctgtacaaccgcatcaagcgggagcccaacaagttctttgtgcccaggacagtgatgattggaggcaaggccgcccctggctaccacatggccaagatgatcatccggctggtgacagccatcggagatgtggtgaaccacgaccctgctgtgggggaccggctgcgggtcatcttcctggagaactacagagtgtccctggccgagaaggtgatcccagctgctgacctgtctgagcagatcagcacagctggaacagaggccagcggcaccggcaacatgaagttcatgctgaatggagccctgaccatcggcaccatggatggagccaacgtggagatggccgaggaggccggggaggagaacttcttcatcttcggcatgagggtggaggatgtggacaagctggaccagaggggctacaatgcccaggagtactatgaccgcatccctgagctgcggcaggtgattgagcagctgagcagcggcttcttcagccccaagcagcctgacctcttcaaggacatcgtgaacatgctgatgcaccacgaccgcttcaaggtgtttgctgactatgaggactacatcaagtgccaggagaaggtgtctgccctgtacaagaacccccgggagtggaccaggatggtgatcagaaatattgccaccagcggcaagttcagcagtgacaggaccatcgcccagtatgcccgggagatctggggcgtggagcccagccggcagaggctgcctgccccagcccctcatgctgagggcggcgtgctggagctggacctgtag

SEQ ID NO: 164238 - DNA, 1425 bp, Artificial Sequence
  Description of Artificial Sequence: Synthetic coding sequence
atggccaccaactggggcagcctgctgcaggacaagcagcagctggaggagctggcccggcaggccgtggaccgggccctggccgagggcgtgctgctgcggaccagccaggagcccaccagcagcgaggtggtgtcctatgcccccttcaccctcttccccagcctggtgcccagcgccctgctggagcaggcctatgctgtgcagatggacttcaacctgctggtggatgctgtgtcccagaatgctgccttcctggagcagaccctgagcagcaccatcaagcaggatgacttcaccgcccggctgtttgacatccacaagcaggtgctgaaggagggcatcgcccagaccgtcttcctgggcctgaacagaagtgactacatgttccagaggtctgcagatggcagccctgccctgaagcagatcgagatcaacaccatcagcgccagctttggaggcctggccagcaggaccccagctgtgcacagacatgtgctgtctgtgctgagcaagaccaaggaggccggcaagatcctgagcaacaaccccagcaagggcctggccctgggcatcgccaaggcctgggagctgtatggcagccccaatgccctggtgctgctgattgcccaggagaaggagaggaacatctttgaccagagggccattgaaaatgagctgctggccaggaacatccacgtgatccggaggacctttgaggacatcagcgagaagggcagcctggaccaggaccggcggctgtttgtggatggccaggagattgctgtggtgtacttcagagatggctacatgccccggcagtacagcctgcagaactgggaggcccggctgctgctggagaggagccatgctgccaagtgcccagacatcgccacccagctggccggcaccaagaaggtgcagcaggagctgagccggcccggcatgctggagatgctgctgcccggccagcctgaggccgtggcccggctgcgggccacctttgctggcctgtacagcctggatgtgggggaggagggggaccaggccatcgccgaggccctggccgcccccagcagatttgtgctgaagccccagcgggagggcggcggcaacaacctgtatggagaggagatggtgcaggccctgaagcagctgaaggacagcgaggagcgggccagctacatcctgatggagaagattgagcctgagccctttgagaactgcctgctgcggcccggcagccctgcccgggtggtgcagtgcatcagcgagctgggcatctttggagtgtatgtgcggcaggagaagaccctggtgatgaacaagcacgtgggccacctgctgcggaccaaggccatcgagcacgcagatggcggcgtggccgccggcgtggccgtgctggacaacccctaccctgtgtag

SEQ ID NO: 164239 - DNA, 738 bp, Artificial Sequence
  Description of Artificial Sequence: Synthetic coding sequence
tgaaagcaccaccacacagtgccccccagcgtgacccccaaggccctggacaggagccccccctgcccagagatgttcaccagggctgcccctggctaccacatggccaagctgatcatcaagctggtgaccagcattggagatgtggtgaaccacgaccctgtggtgggggaccggctgaaggtgatcttcctggagaactacagagtgtccctggccgagaaggtgatcccagctgctgacctgagccagcagatcagcacagctggaacagaggccagcggcaccggcaacatgaagttcatgctgaatggagccctgaccatcggcaccatggatggagccaacgtggagatggccgaggaggccggggctgagaacctcttcatcttcggcctgcgggtggaggatgtggaggccctggacaggaagggctacaatgcccgggagtactatgaccacctgcctgagctgaagcaggccgtggaccagatcagcagcggcttcttcagccccaaggagccagactgcttcaaggacatcgtgaacatgctgatgcaccacgaccgcttcaaggtgtttgctgactatgaggcctacatgcagtgccaggcccaggtggaccagctgtacagaaaccccaaggagtggaccaagaaggtgatcagaaatattgcctgcagcggcaagttcagcagtgacaggaccatcacagaatatgcccgggagatctggtag

SEQ ID NO: 164240 - DNA, 975 bp, Artificial Sequence
  Description of Artificial Sequence: Synthetic coding sequence
atggatgccccccggcaggtggtgaactttggacctggccctgccaagctgccccacagcgtgctgctggagatccagaaggagctgctggactacaagggcgtgggcatctctgtgctggagatgagccacaggagcagtgactttgccaagatcatcaacaacacagagaacctggtgcgggagctgctggccgtgcctgacaactacaaggtgatcttcctgcagggcggcggctgcggccagttctctgctgtgcccctgaacctgattggcctgaaggccggccgctgtgccgactatgtggtgactggagcctggagcgccaaggctgctgaggaggccaagaagtttggcaccatcaacatcgtgcaccccaagctgggcagctacaccaagatcccagaccccagcacctggaacctgaacccagatgccagctatgtgtactactgtgccaatgagaccgtgcacggcgtggagtttgacttcatcccagatgtgaagggagctgtgctggtgtgtgacatgagcagcaacttcctgagcaagcctgtggatgtgtccaagtttggagtcatctttgctggggcccagaagaatgtgggcagcgctggggtgacagtggtgattgtgagagatgacctgctgggctttgccctgagagaatgtcccagcgtgctggagtacaaggtgcaggccggcaacagcagcctgtacaacaccccaccctgcttcagcatctacgtgatgggcctggtgctggagtggatcaagaacaatggaggagctgctgccatggagaagctgagcagcatcaagagccagaccatctatgagatcatcgacaacagccagggcttctacgtgtctgtgggcggcatccgggccagcctgtacaatgctgtgaccattgaagatgtgcagaagctggccgccttcatgaagaagttcctggagatgcaccagctgtag

SEQ ID NO: 164241 - DNA, 1113 bp, Artificial Sequence
  Description of Artificial Sequence: Synthetic coding sequence
atggatgccccccggcaggtggtgaactttggacctggccctgccaagctgccccacagcgtgctgctggagatccagaaggagctgctggactacaagggcgtgggcatctctgtgctggagatgagccacaggagcagtgactttgccaagatcatcaacaacacagagaacctggtgcgggagctgctggccgtgcctgacaactacaaggtgatcttcctgcagggcggcggctgcggccagttctctgctgtgcccctgaacctgattggcctgaaggccggccgctgtgccgactatgtggtgactggagcctggagcgccaaggctgctgaggaggccaagaagtttggcaccatcaacatcgtgcaccccaagctgggcagctacaccaagatcccagaccccagcacctggaacctgaacccagatgccagctatgtgtactactgtgccaatgagaccgtgcacggcgtggagtttgacttcatcccagatgtgaagggagctgtgctggtgtgtgacatgagcagcaacttcctgagcaagcctgtggatgtgtccaagtttggagtcatctttgctggggcccagaagaatgtgggcagcgctggggtgacagtggtgattgtgagagatgacctgctgggctttgccctgagagaatgtcccagcgtgctggagtacaaggtgcaggccggcaacagcagcctgtacaacaccccaccctgcttcagcatctacgtgatgggcctggtgctggagtggatcaagaacaatggaggagctgctgccatggagaagctgagcagcatcaagagccagaccatctatgagatcatcgacaacagccagggcttctacgtgtgccctgtggagccccagaacagaagcaagatgaacatccccttcagaattggaaatgccaagggagatgatgccctggagaagcgcttcctggacaaggccctggagctgaacatgctgagcctgaagggccacaggtctgtgggcggcatccgggccagcctgtacaatgctgtgaccattgaagatgtgcagaagctggccgccttcatgaagaagttcctggagatgcaccagctgtag

SEQ ID NO: 164242 - DNA, 585 bp, Artificial Sequence
  Description of Artificial Sequence: Synthetic coding sequence
atgagcagcaacttcctgagcaagcctgtggatgtgtccaagtttggagtcatctttgctggggcccagaagaatgtgggcagcgctggggtgacagtggtgattgtgagagatgacctgctgggctttgccctgagagaatgtcccagcgtgctggagtacaaggtgcaggccggcaacagcagcctgtacaacaccccaccctgcttcagcatctacgtgatgggcctggtgctggagtggatcaagaacaatggaggagctgctgccatggagaagctgagcagcatcaagagccagaccatctatgagatcatcgacaacagccagggcttctacgtgtgccctgtggagccccagaacagaagcaagatgaacatccccttcagaattggaaatgccaagggagatgatgccctggagaagcgcttcctggacaaggccctggagctgaacatgctgagcctgaagggccacaggtctgtgggcggcatccgggccagcctgtacaatgctgtgaccattgaagatgtgcagaagctggccgccttcatgaagaagttcctggagatgcaccagctgtag

SEQ ID NO: 164243 - DNA, 1050 bp, Artificial Sequence
  Description of Artificial Sequence: Synthetic coding sequence
atgagcagcctgagcggcaaggtgcagacagtgctgggcctggtggagcccagcaagctgggccgcaccctgacccatgagcacctggccatgacctttgactgctgctactgccccccaccaccctgccaggaggccatcagcaaggagcccatcgtgatgaagaacctgtactggatccagaagaatgcctacagccacaaggagaacctgcagctgaaccaggagacagaggccatcaaggaggagctgctgtacttcaaggccaacggcggcggggccctggtggagaacaccaccaccggcatcagccgggacacccagaccctgaagaggctggccgaggagactggagtgcacatcatctctggagctggcttctacgtggatgccacccacagcagcgagacccgggccatgtctgtggagcagctgacagatgtgctgatgaatgagatcctgcatggagcagatggcaccagcatcaagtgtggcatcattggagagatcggctgctcctggcccctgacagaaagtgagaggaaggtgctgcaggccacagcccacgcccaggcccagctgggctgccctgtgatcatccaccctggccgcagcagccgggcccccttccagatcatccgcatcctgcaggaggccggggctgacatcagcaagacagtgatgagccacctggacaggaccatcctggacaagaaggagctgctggagtttgcccagctgggctgctacctggagtatgacctgtttggaacagagctgctgcactaccagctgggccctgacatcgacatgccagatgacaacaagaggatcagaagagtgcggctgctggtggaggagggctgtgaggaccgcatcctggtggcccatgacatccacaccaagacccggctgatgaagtatggaggccacggctacagccacatcctgaccaacgtggtgcccaagatgctgctgcggggcatcacagaaaatgtgctggacaagatcctgattgagaaccccaagcagtggctgaccttcaagtag

SEQ ID NO: 164244 - DNA, 1050 bp, Artificial Sequence; identical to SEQ ID NO: 164243
  Description of Artificial Sequence: Synthetic coding sequence

SEQ ID NO: 164245 - DNA, 1050 bp, Artificial Sequence; identical to SEQ ID NO: 164243
  Description of Artificial Sequence: Synthetic coding sequence

SEQ ID NO: 164246 - DNA, 909 bp, Artificial Sequence
  Description of Artificial Sequence: Synthetic coding sequence
atgagcagcctgagcggcaaggtgcagacagtgctgggcctggtggagcccagcaagctgggccgcaccctgacccatgagcacctggccatgacctttgactgctgctactgccccccaccaccctgccaggaggccatcagcaaggagcccatcgtgatgaagaacctgtactggatccagaagaatgcctacagccacaaggagaacctgcagctgaaccaggagacagaggccatcaaggaggagctgctgtacttcaaggccaacggcggcggggccctggtggagaacaccaccaccggcatcagccgggacacccagaccctgaagaggctggccgaggagactggagtgcacatcatctctggagctggcttctacgtggatgccacccacagcagcgagacccgggccatgtctgtggagcagctgacagatgtgctgatgaatgagatcctgcatggagcagatggcaccagcatcaagtgtggcatcattggagagatcggctgctcctggcccctgacagaaagtgagaggaaggtgctgcaggccacagcccacgcccaggcccagctgggctgccctgtgatcatccaccctggccgcagcagccgggcccccttccagatcatccgcatcctgcaggaggccggggctgacatcagcaagacagtgatgagccacctggacagagtgcggctgctggtggaggagggctgtgaagatcgcatcctggtggcccatgacatccacaccaagacccggctgatgaagtatggaggccacggctacagccacatcctgaccaacgtggtgcccaagatgctgctgcggggcatcacagaaaatgtgctggacaagatcctgattgagaaccccaagcagtggctgaccttcaagtag

SEQ ID NO: 164247 - DNA, 1050 bp, Artificial Sequence; identical to SEQ ID NO: 164243
  Description of Artificial Sequence: Synthetic coding sequence

SEQ ID NO: 164248 - DNA, 753 bp, Artificial Sequence
  Description of Artificial Sequence: Synthetic coding sequence
atgttcagcctgcccctgagcctgcccctgtgtgaggacacagccttcctgcccagcaagtgctgcagcagccacaagaccatcaagcaggcccggaccctcatcatgatcttcctggccagcggcacccacttccagaccatgctgaagagcaagctgaatgtgctgaccctgaagaaggagcccctgcctgctgtgatcttccacgagcctgaggccatcgagctgtgcaccaccacccccctgatgaagaccaggacccacagcggctgcaaggtgacctacctgggcaaggtgtccaccaccggcatgcagttcctgagcggctgcacagagaagcctgtgattgagctgtggaagaagcacaccctggccagagaagatgtgtttcctgccaatgccctgctggagatccggcccttccaggtgtggctgcaccacctggaccacaagggggaggccaccgtgcacatggacaccttccaggtggcccgcatcgcctactgcacagctgaccacaacgtgagccccaacatctttgcctgggtgtaccgggagatcaatgatgacctgagctaccagatggactgccacgctgtggagtgtgagagcaagctggaggccaagaagctggcccacgccatgatggaggccttcaggaagaccttccacagcatgaagagtgatggccgcatccacagcaacagcagcagcgaggaggtgtcccaggagctggagagtgatgatggatag

SEQ ID NO: 164249 - DNA, 747 bp, Artificial Sequence
  Description of Artificial Sequence: Synthetic coding sequence
atgcccagaattgctggcaaccacctgatgctggaggagagcaggacctgcagcagccctgagctgctggatggagtgtggccctgccagcccctgcacttcggcctgcctgccagcgagatgcacttccagaccatgctgaagagcaagctgaatgtgctgaccctgaagaaggagcccctgcctgctgtgatcttccacgagcctgaggccatcgagctgtgcaccaccacccccctgatgaagaccaggacccacagcggctgcaaggtgacctacctgggcaaggtgtccaccaccggcatgcagttcctgagcggctgcacagagaagcctgtgattgagctgtggaagaagcacaccctggccagagaagatgtgtttcctgccaatgccctgctggagatccggcccttccaggtgtggctgcaccacctggaccacaagggggaggccaccgtgcacatggacaccttccaggtggcccgcatcgcctactgcacagctgaccacaacgtgagccccaacatctttgcctgggtgtaccgggagatcaatgatgacctgagctaccagatggactgccacgctgtggagtgtgagagcaagctggaggccaagaagctggcccacgccatgatggaggccttcaggaagaccttccacagcatgaagagtgatggccgcatccacagcaacagcagcagcgaggaggtgtcccaggagctggagagtgatgatggatag

SEQ ID NO: 164250 - DNA, 654 bp, Artificial Sequence
  Description of Artificial Sequence: Synthetic coding sequence
atgtggcagcctgccacagagcggctgcagcacttccagaccatgctgaagagcaagctgaatgtgctgaccctgaagaaggagcccctgcctgctgtgatcttccacgagcctgaggccatcgagctgtgcaccaccacccccctgatgaagaccaggacccacagcggctgcaaggtgacctacctgggcaaggtgtccaccaccggcatgcagttcctgagcggctgcacagagaagcctgtgattgagctgtggaagaagcacaccctggcccgggaggatgtgtttcctgccaatgccctgctggagatccggcccttccaggtgtggctgcaccacctggaccacaagggggaggccaccgtgcacatggacaccttccaggtggccagaattgcctactgcacagctgaccacaacgtgagccccaacatctttgcctgggtgtaccgggagatcaatgatgacctgagctaccagatggactgccacgctgtggagtgtgagagcaagctggaggccaagaagctggcccacgccatgatggaggccttcaggaagaccttccacagcatgaagagtgatggccgcatccacagcaacagcagcagcgaggaggtgtcccaggagctggagagtgatgatggatag

SEQ ID NO: 164251 - DNA, 507 bp, Artificial Sequence
  Description of Artificial Sequence: Synthetic coding sequence
atgtggcagcctgccacagagcggctgcaggtgacctacctgggcaaggtgtccaccaccggcatgcagttcctgagcggctgcacagagaagcctgtgattgagctgtggaagaagcacaccctggccagagaagatgtgtttcctgccaatgccctgctggagatccggcccttccaggtgtggctgcaccacctggaccacaagggggaggccaccgtgcacatggacaccttccaggtggcccgcatcgcctactgcacagctgaccacaacgtgagccccaacatctttgcctgggtgtaccgggagatcaatgatgacctgagctaccagatggactgccacgctgtggagtgtgagagcaagctggaggccaagaagctggcccacgccatgatggaggccttcaggaagaccttccacagcatgaagagtgatggccgcatccacagcaacagcagcagcgaggaggtgtcccaggagctggagagtgatgatggatag

SEQ ID NO: 164252 - DNA, 753 bp, Artificial Sequence; identical to SEQ ID NO: 164248
  Description of Artificial Sequence: Synthetic coding sequence

SEQ ID NO: 164253 - DNA, 1017 bp, Artificial Sequence
  Description of Artificial Sequence: Synthetic coding sequence
atggagcagctgcgggctgctgcccggctgcagatcgtgctgggccacctgggccggcccagcgctggagctgtggtggcccaccccaccagcggcaccatcagcagcgccagcttccacccccagcagttccagtacaccctggacaacaacgtgctgaccctggagcagaggaagttctatgaagaaaatggcttcctggtgatcaagaacctggtgcctgatgctgacatccagcgcttcagaaatgaatttgagaagatctgcaggaaggaggtgaagcccctgggcctgactgtgatgagagatgtgaccatcagcaagtcagaatatgcccccagcgagaagatgatcaccaaggtgcaggacttccaggaggacaaggagctgttccgctactgcaccctgcctgagatcctgaagtatgtggagtgcttcaccggccccaacatcatggccatgcacaccatgctgatcaacaagcccccagattctgggaagaagaccagccgccaccccctgcaccaggacctgcactacttccccttccggcccagcgacctgattgtgtgtgcctggacagccatggagcacatcagcagaaataatggctgcctggtggtgctgcccggcacccacaagggcagcctgaagccccatgactaccccaagtgggagggcggcgtgaacaagatgttccacggcatccaggactatgaggagaacaaggcccgggtgcacctggtgatggagaagggggacacagtgttcttccaccccctgctgatccacggcagcggccagaacaagacccagggcttcaggaaggccatcagctgccactttgccagcgctgactgccactacattgatgtgaagggcaccagccaggagaacatcgagaaggaggtggtgggcatcgcccacaagttcttcggggctgaaaattctgtgaacctgaaggacatctggatgttccgggcccggctggtgaagggggagaggaccaacctgtag

SEQ ID NO: 164254 - DNA, 717 bp, Artificial Sequence
  Description of Artificial Sequence: Synthetic coding sequence
atgagagatgtgaccatcagcaagtcagaatatgcccccagcgagaagatgatcaccaaggtgcaggacttccaggaggacaaggagctgttccgctactgcaccctgcctgagatcctgaagtatgtggagtgcttcaccggccccaacatcatggccatgcacaccatgctgatcaacaagcccccagattctgggaagaagaccagccgccaccccctgcaccaggacctgcactacttccccttccggcccagcgacctgattgtgtgtgcctggacagccatggagcacatcagcagaaataatggctgcctggtggtgctgcccggcacccacaagggcagcctgaagccccatgactaccccaagtgggagggcggcgtgaacaagatgttccacggcatccaggactatgaggagaacaaggcccgggtgcacctggtgatggagaagggggacacagtgttcttccaccccctgctgatccacggcagcggccagaacaagacccagggcttcaggaaggccatcagctgccactttgccagcgctgactgccactacattgatgtgaagggcaccagccaggagaacatcgagaaggaggtggtgggcatcgcccacaagttcttcggggctgaaaattctgtgaacctgaaggacatctggatgttccgggcccggctggtgaagggggagaggaccaacctgtag

SEQ ID NO: 164255 - DNA, 15429 bp, Artificial Sequence
  Description of Artificial Sequence: Synthetic coding sequence
atgggaaatgaggccagcctggagggggagggcctgcctgagggcctggccgctgctgctgctgctgggggcggggccagcggggccggcagccccagccacacagccatcccagctggcatggaggccgacctgagccagctgtctgaggaggagcggcggcagattgctgctgtgatgagccgggcccagggcctgcccaagggctctgtgcccccagctgctgctgagagccccagcatgcacaggaagcaggagctggacagcagccacccccccaagcagagcggccggcccccagaccccggccgcccagcccagcccggcctgagcaagagcaggaccacagacaccttccgctctgagcagaagctgcccggccgcagccccagcaccatcagcctgaaggagagcaagagcaggacagacctgaaggaggagcacaagagctccatgatgcctggcttcctgtctgaggtgaatgccctgtctgctgtgtcctctgtggtgaacaagttcaacccctttgacctgatcagtgacagcgaggccagccaggaggagaccaccaagaagcagaaggtggtgcagaaggagcagggcaagccagagggcatcatcaagccacccctgcagcagcagccccccaagcccatccccaagcagcagggccctggccgggaccccctgcagcaggacggcacccccaagagcatcagcagccagcagcctgagaagatcaagagccagcccccaggcaccgggaagcccatccagggccccacccagaccccccagacagaccacgccaagctgcccctgcagagagatgccagccggccccagaccaagcaggccgacatcgtgcggggggagagcgtgaagcccagcctgcccagccccagcaagccacccatccagcagcccaccccaggcaagcccccagcccagcagcccggccacgagaagagccagcccggccctgccaagcccccagcccagcccagcggcctgaccaagcccctggcccagcagcccggcaccgtgaagccccctgtgcagcccccaggcaccaccaagcccccagcccagcccctgggccctgccaagcccccagcccagcagacaggcagcgagaagcccagcagcgagcagcccggccccaaggccctggcccagcccccaggagtgggcaagaccccagcccagcagcccggccctgccaagccacccacccagcaggtgggcacccccaagcccctggcccagcagcccggcctgcagagccctgccaaggcccctggccccaccaagacccctgtgcagcagcccggccctgggaagatcccagcccagcaggccggccctgggaagaccagcgcccagcagacaggccccaccaagccacccagccagctgcccggccctgccaagcccccaccccagcagcccggccctgccaagcccccaccccagcagcccggcagcgccaagccacccagccagcagcccggcagcaccaagcccccaccccagcagcccggccctgccaagcccagcccccagcagcccggcagcaccaagccacccagccagcagcccggcagcgccaagcccagcgcccagcagcccagccctgccaagcccagcgcccagcagagcaccaagcctgtgtcccagacaggcagcggcaagcccctgcagcccccaacagtgagccccagcgccaagcagccccccagccagggcctgcccaagaccatctgccccctgtgcaacaccacagagctgctgctgcacgtgcctgagaaggccaacttcaacacctgcacagagtgccagaccaccgtgtgcagcctgtgtggcttcaaccccaacccccacctgacagaggtgaaggagtggctgtgcctgaactgccagatgaagagggccctgggcggggacctggcccctgtgcccagcagcccccagcccaagctgaagacagcccctgtgaccaccaccagcgctgtgtccaagagcagcccccagccccagcagaccagccccaagaaggatgctgcccccaagcaggacctgagcaaggcccctgagcccaagaagcccccacccctggtgaagcagcccaccctgcacggcagccccagcgccaaggccaagcagcccccagaggccgacagcctgagcaagccagccccacccaaggagcccagcgtgcccagcgagcaggacaaggcccctgtggctgatgacaagcccaagcagcccaagatggtgaagcccaccacagacctggtgagcagcagcagcgccaccaccaagccagacatccccagcagcaaggtgcagagccaggccgaggagaagaccaccccacccctgaagacagattctgccaagcccagccagagcttccccccaactggagagaaggtgagcccctttgacagcaaggccatccccaggcctgccagtgacagcaagatcatcagccaccctggccccagcagcgagagcaagggccagaagcaggtggaccctgtgcagaagaaggaggagcccaagaaggcccagaccaagatgagccccaagccagatgccaagcccatgcccaagggcagccccaccccacctggcccccggcccacagctggccagacagtgcccaccccccagcagagccccaagccccaggagcagagccgccgcttcagcctgaacctgggcagcatcacagatgcccccaagagccagcccaccaccccccaggagaccgtgacaggcaagctgtttggatttggagccagcatcttcagccaggccagcaacctgatcagcacagctggccagcccggcccccacagccagagcggccctggggcccccatgaagcaggccccagcccccagccagccccccaccagccagggcccccccaagagcacaggccaggcccccccagccccagccaagagcatccctgtgaagaaggagaccaaggccccagctgctgagaagctggagcccaaggccgagcaggcccccaccgtgaagaggacagaaacagagaagaagcccccacccatcaaggacagcaagagcctgacagctgagccccagaaggctgtgctgcccaccaagctggagaagagccccaagccagagagcacctgccccctgtgcaagacagagctgaacatcggcagcaaggacccccccaacttcaacacctgcacagagtgcaagaaccaggtgtgcaacctgtgtggcttcaaccccaccccccacctgacagagatccaggagtggctgtgcctgaactgccagacccagagggccatcagcggccagctgggggacatcaggaagatgcccccagcccccagcggccccaaggccagccccatgcctgtgcccacagagagcagcagccagaagacagctgtgcccccccaggtgaagctggtgaagaagcaggagcaggaggtgaagacagaggccgagaaggtgatcctggagaaggtgaaggagaccctgtccatggagaagatcccccccatggtgaccacagaccagaagcaggaggagagcaagctggagaaggacaaggccagcgccctgcaggagaagaagcccctgcctgaggagaagaagctgatccctgaggaggagaagatccgctctgaggagaagaagcccctgctggaggagaagaagcccaccccagaggacaagaagctgctgcctgaggccaagaccagcgcccctgaggagcagaagcatgacctgctgaagagccaggtgcagattgctgaggagaagctggagggccgggtggcccccaagacagtgcaggagggcaagcagccccagaccaagatggagggcctgcccagcggcaccccccagagcctgcccaaggaggatgacaagaccaccaagaccatcaaggagcagccccagcccccctgcacagccaagccagaccaggtggagcccgggaaggagaagacagagaaggaggatgacaagagtgacaccagcagcagccagcagcccaagagcccccagggcctgagtgacaccggctacagcagtgatggcatcagcagcagcctgggggagatccccagcctcatccccacagatgagaaggacatcctgaagggcctgaagaaggacagcttcagccaggagagcagccccagcagccccagcgacctggccaagctggagagcacagtgctgagcatcctggaggcccaggccagcaccctggctgatgagaagtctgagaagaagacccagccccatgaggtgtccccagagcagcccaaggaccaggagaagacccagagcctgtctgagaccctggagatcaccatcagcgaggaggagatcaaggagagccaggaggagaggaaggacaccttcaagaaggacagccagcaggacatccccagcagcaaggaccacaaggagaagtcagaatttgtggatgacatcaccacccggcgggagccctatgacagcgtggaggagagcagcgagagcgagaacagccctgtgccccagaggaagaggaggacctctgtgggcagcagcagcagtgatgagtacaagcaggaggacagccagggcagcggggaggaggaggacttcatcaggaagcagatcatcgagatgtctgcagatgaagatgccagcggctctgaagatgatgagttcatccggaaccagctgaaggagatcagcagcagcacagagagccagaagaaggaggagaccaagggcaagggcaagatcacagctgggaagcaccggcggctgaccaggaagagcagcaccagcattgatgaagatgctggaagaagacacagctggcatgatgaagatgatgaggcctttgatgagagccctgagctgaagtaccgggagaccaagagccaggagagcgaggagctggtggtgactggaggcggcggcctgcggcgcttcaagaccatcgagctgaacagcaccatcgctgacaagtacagcgctgagagcagccagaagaagaccagcctgtactttgatgaggagcctgagctggagatggagagcctgacagacagcccagaagatagaagcagaggagagggcagcagcagcctgcacgccagcagcttcaccccaggcaccagccccacctctgtgagcagcctggatgaagattctgacagcagccccagccacaagaagggggagagcaagcagcagaggaaggcccggcaccggccccacggccccctgctgcccaccatcgaggacagcagcgaggaggaggagctgcgggaggaggaggagctgctgaaggagcaggagaagcagcgggagattgagcagcagcagaggaagagcagcagcaagaagagcaagaaggacaaggatgagctgcgggcccagaggagaagagagcggcccaagaccccacccagcaacctgagccccattgaagatgccagccccacagaggagctgcggcaggccgctgagatggaggagctgcacaggagcagctgcagcgagtacagccccagcattgaaagtgaccctgagggctttgagatcagccctgagaagatcatcgaggtgcagaaggtgtacaagctgcccacagctgtgtccctgtacagccccacagatgagcagagcatcatgcagaaggagggcagccagaaggccctgaagtctgctgaggagatgtatgaggagatgatgcacaagacccacaagtacaaggccttccctgctgccaatgaaagagatgaggtgtttgagaaggagcccctgtatggaggcatgctgattgaggactacatctatgagagcctggtggaggacacctacaacggctctgtggatggcagcctgctgacccggcaggaggaggagaatggcttcatgcagcagaagggccgggagcagaagatccggctgtctgagcagatctatgaggaccccatgcagaagatcacagacctgcagaaggagttctatgagctggagagcctgcacagcgtggtgccccaggaggacatcgtgagcagcagcttcatcatccctgagagccatgagatcgtggacctgggcaccatggtgaccagcacagaggaggagaggaagctgctggatgctgatgctgcctatgaggagctgatgaagaggcagcagatgcagctgaccccaggcagcagccccacccaggcccccatcggggaggacatgacagagagcaccatggactttgacaggatgccagatgccagcctgaccagctctgtgctgagcggggccagcctgacagacagcaccagcagcgccaccctgagcatcccagatgtgaagatcacccagcacttcagcacagaggagattgaagatgaatatgtgacagactacacccgggagatccaggagatcatcgcccacgagagcctcatcctgacctacagcgagcccagcgagagcgccacctctgtgcccccaagtgacacccccagcctgaccagctctgtgtcctctgtgtgcaccacagacagcagcagccccatcaccaccctggacagcatcaccaccgtgtacacagagcctgtggacatgatcaccaagtttgaagattctgaggagatcagcagcagcacctacttccctggcagcatcatcgactacccagaggagatctctgtgtccctggacagaacagcccccccagatggccgggccagcgctgaccacatcgtcatcagcctgagtgacatggccagcagcatcatcgagagcgtggtgcccaagccagagggccctgtggccgacacagtgtccacagacctgctgatcagcgagaaggaccctgtgaagaaggccaagaaggagactggaaatggcatcatcctggaggtgctggaggcctacagagacaagaaggagctggaggccgagaggaccaagagcagcctgtctgagaccgtgtttgaccacccccccagcagcgtcatcgccctgcccatgaaggagcagctgagcaccacctacttcaccagcggggagaccttcggccaggagaagccagccagccagctgcccagcggcagccccagcgtgagcagcctgcctgccaagccccggcccttcttccgcagcagcagcctggacatcagcgcccagcccccacctcctcctcctcctcctcctcctcctcctcctcctcctcctcctcctcctcctccacccctgcccccacccaccagccccaagcccaccatcctgcccaagaagaagctgactgtggccagccctgtgaccacagccacccccctgtttgatgctgtgaccaccctggagaccacagctgtgctgcggagcaatggcctgcctgtgacccgcatctgcaccacagcccctcctcctgtgccccccaagcccagcagcatccccagcggcctggtgttcacccacaggcctgagcccagcaagccacccatcgcccccaagcctgtgatcccccagctgcccaccaccacccagaagcccacagacatccaccccaagcccaccggcctgagcctgaccagctccatgaccctgaacctggtgaccagcgctgactacaagctgcccagccccaccagccccctgagcccccacagcaacaagagcagcccccgcttcagcaagagcctgacagagacctacgtggtgatcaccctgcccagcgagcccggcacccccacagacagcagcgccagccaggccatcacctcctggcccctgggcagccccagcaaggacctggtgtctgtggagcccgtcttctctgtggtgccccctgtgacagctgtggagatccccatcagcagcgagcagaccttctacatcagcggggccctgcagaccttcagcgccacccctgtgacagcccccagcagcttccaggccgcccccacctctgtgacccagttcctgaccacagaggtgtccaagacagaggtgtctgccaccaggagcacagcccccagcgtgggcctgagcagcatcagcatcaccatccccccagagcccctggccctggacaacatccacctggagaagccccagtacaaggaggatggcaagctgcagctggtgggagatgtgattgacctgaggacagtgcccaaggtggaggtgaagaccacagacaagtgcatcgacctgagcgccagcaccatggatgtgaagaggcagatcacagccaatgaggtgtatggcaagcagatctctgctgtgcagcccagcatcatcaacctgtctgtgaccagcagcatcgtgacccctgtgtccctggccacagagaccgtgacctttgtgacctgcacagccagcgccagctacaccaccggcacagagagcctggtgggcgctgagcacgccatgaccacccccctgcagctgaccaccagcaagcacgccgagcccccctaccgcatccccagcgaccaggtgttccccatcgcccgggaggaggcccccatcaacctgagcctgggcaccccagcccatgctgtgaccctggccatcaccaagcctgtgacagtgccccctgtgggcgtgaccaacggctggacagacagcacagtgtcccagggcatcacagatggagaggtggtggacctgagcaccaccaagagccacaggacagtggtgaccatggatgagagcaccagctctgtgatgaccaagatcattgaagatgagaagcctgtggacctgacagctggccggcgggctgtgtgctgtgatgtggtgtacaagctgcccttcggccgcagctgcacagcccagcagcctgccaccaccctgcctgaggacagatttggctacagagatgaccactaccagtatgacagaagtggcccctacggctaccggggcattggaggcatgaagcccagcatgtctgacaccaacctggccgaggccggccacttcttctacaagagcaagaatgcctttgactacagcgagggcacagacacagctgtggacctgaccagcggccgggtgaccaccggggaggtgatggactacagcagcaagaccaccggcccctacccagagacccggcaggtgatcagcggggccggcatcagcaccccccagtacagcacagccaggatgaccccacctcctggcccccagtactgtgtgggctctgtgctgcggagcagcaatggagtggtgtacagctctgtggccacccccacccccagcacctttgccatcaccacccagcccggcagcatcttcagcaccaccgtgcgggacctgagcggcatccacacagcagatgctgtgaccagcctgcctgccatgcaccacagccagcccatgcccaggagctacttcatcaccactggagccagcgagacagacattgctgtgactggaattgacatcagcgccagcctgcagaccatcaccatggagagcctgacagctgagaccatcgacagcgtgcccaccctgaccacagccagcgaggtgtttcctgaggtggtgggagatgaaagtgccctgctgattgtgcctgaggaggacaagcagcagcagcagctggacctggagcgggagctgctggagctggagaagatcaagcagcagagatttgctgaggagctggagtgggagcggcaggagatccagcgcttccgggagcaggagaagatcatggtgcagaagaagctggaggagctgcagagcatgaagcagcacctgctcttccagcaggaggaggagcggcaggcccagttcatgatgaggcaggagaccctggcccagcagcagctgcagctggagcagatccagcagctgcagcagcagctgcaccagcagctggaggagcagaagatccggcagatctaccagtacaactatgaccccagcggcacagccagcccccagaccaccacagagcaggccatcctggagggccagtatgctgccctggagggcagccagttctgggccacagaagatgccaccaccacagccagcgctgtggtggccatcgagatcccccagagccagggctggtacacagtgcagagtgatggagtgacccagtacatcgcccctcctggcatcctgagcacagtgtctgagatccccctgacagatgtggtggtgaaggaggagaagcagcccaagaagaggagcagcggggccaaggtgcggggccagtatgatgacatgggagagaacatgacagatgaccccaggagcttcaagaagatcgtggacagcggcgtgcagacagatgatgaagatgccacagacaggagctatgtgtccagaagaagaaggaccaagaagtctgtggacacctctgtgcagacagatgatgaggaccaggatgagtgggacatgcccaccaggagcaggaggaaggcccgggtgggcaagtatggagacagcatgacagaggccgacaagaccaagcccctgagcaaggtgagcagcattgctgtgcagacagtggccgagatctctgtgcagacagagcctgtgggcaccatccgcacccccagcatccgggcccgggtggatgccaaggtggagatcatcaagcacatcagcgcccctgagaagacctacaagggcggcagcctgggctgccagacagaagctgacagcgacacccagagcccccagtacctgagcgccaccagcccccccaaggacaagaagaggcccacccccctggagatcggctacagcagccacctgcgggctgacagcacagtgcagctggcccccagcccccccaagagccccaaggtgctgtacagccccatcagccccctgagccctgggaaggccctggagagcgcctttgtgccctatgagaagcccctgcctgatgacatcagcccccagaaggtgctgcacccagacatggccaaggtgcccccagccagccccaagacagccaagatgatgcagaggtccatgtctgaccccaagcccctgagccccacagcagatgagagcagccgggcccccttccagtacacagagggctacaccaccaagggcagccagaccatgaccagcagcggggcccagaagaaggtgaagaggaccctgcccaaccccccacctgaggagatcagcacaggcacccagagcaccttcagcaccatgggcaccgtgtccagaagacgcatctgcaggaccaacaccatggcccgggccaagatcctgcaggacatcgaccgggagctggacctggtggagcgggagagcgccaagctgaggaagaagcaggccgagctggatgaggaggagaaggagattgatgccaagctgcgctacctggagatgggcatcaacagaaggaaggaggccctgctgaaggagcgggagaagcgggagcgggcctacctgcagggcgtggctgaagatcgggactacatgtctgattctgaggtgagcagcacccggcccaccagaattgagagccagcacggcatcgagcggcccaggacagccccccagacagagttcagccagttcatccccccccagacccagacagagagccagctggtgccccccaccagcccctacacccagtaccagtacagcagccctgccctgcccacccaggcccccaccagctacacccagcagagccactttgagcagcagaccctgtaccaccagcaggtgagcccctaccagacccagcccaccttccaggccgtggccaccatgtccttcaccccccaggtgcagcccacccccaccccccagcccagctaccagctgcccagccagatgatggtgatccagcagaagccccggcagaccaccctgtacctggagcccaagatcaccagcaactatgaggtgatccggaaccagcccctgatgattgcccctgtgtccacagacaacacctttgctgtgagccacctgggcagcaagtacaacagcctggacctgagaattggcctggaggagaggagctccatggccagcagccccatcagcagcatctctgctgacagcttctacgccgacatcgaccaccacacccccaggaactacgtgctgattgatgacatcggggagatcaccaagggcacagctgccctgagcacagccttcagcctgcacgagaaggacctgagcaagacagaccggctgctgcggaccacagagacccggcgcagccaggaggtgacagacttcctggcccccctgcagagcagcagccggctgcacagctatgtgaaggccgaggaggaccccatggaggacccctatgagctgaagctgctgaagcaccagatcaagcaggagttcagaagaggaacagagagcctggaccacctggccggcctgagccactactaccacgccgacaccagctaccgccacttccccaagtctgagaagtacagcatcagccggctgaccctggagaagcaggccgccaagcagctgcctgctgccatcctgtaccagaagcagagcaagcacaagaagagcctgattgaccccaagatgagcaagttcagccccatccaggagagccgggacctggagccagactacagcagctacatgaccagcagcaccagcagcattggaggcatcagcagccgggcccggctgctgcaggatgacatcaccttcggcctgaggaagaacatcacagaccagcagaagttcatgggcagcagcctgggcaccggcctgggcaccctgggcaacaccatccgcagcgccctgcaggatgaagctgacaagccctacagcagcggcagccgcagccggcccagcagccggcccagctctgtgtatggcctggacctgagcatcaagagggacagcagcagcagcagcctgcggctgaaggcccaggaggccgaggccctggatgtgtccttcagccacgccagcagcagcgcccggaccaagcccaccagcctgcccatcagccagagccggggccgcatccccatcgtggcccagaacagcgaggaggagagccccctgagccctgtgggccagcccatgggcatggcccgggctgctgctggccccctgccccccatctctgctgacacccgggaccagtttggcagcagccacagcctgcctgaggtgcagcagcacatgagggaggagagcaggacccggggctatgaccgggacatcgccttcatcatggatgacttccagcacgccatgtctgacagcgaggcctaccacctgcggcgggaggagacagactggtttgacaagccccgggagagccggctggagaatggacatggcctggacaggaagctgcctgagcggctggtgcacagccggcccctgagccagcaccaggagcagatcatccagatgaatggcaagaccatgcactacatcttcccccacgcccgcatcaagatcacccgggacagcaaggaccacacagtgtctggaaatggcctgggcatcagaattgtgggcggcaaggagatccctggccacagcggggagatcggggcctacatcgccaagatcctgcccggcggcagcgctgagcagacaggcaagctgatggagggcatgcaggtgctggagtggaatggcatccccctgaccagcaagacctatgaggaggtgcagagcatcatcagccagcagagcggggaggccgagatctgtgtgcggctggacctgaacatgctgagtgacagcgagaacagccagcacctggagctgcacgagccccccaaggctgtggacaaggccaagagccctggggtggaccccaagcagctggccgctgagctgcagaaggtgtccctgcagcagagccccctggtgctgagctctgtggtggagaagggcagccacgtgcacagcggccccaccagcgctggcagcagctctgtgcccagccctggccagcccggcagccccagcgtgtccaagaagaagcacggcagcagcaagcccacagatggcaccaaggtggtgagccaccccatcactggagagatccagctgcagatcaactatgacctgggcaacctgatcatccacatcctgcaggccaggaacctggtgccccgggacaacaacggctacagcgacccctttgtgaaggtgtacctgctgcccggccggggccaggtgatggtggtgcagaatgccagcgctgagtacaagaggaggaccaagcacgtgcagaagagcctgaaccctgagtggaaccagaccgtcatctacaagagcatctccatggagcagctgaagaagaagaccctggaggtgacagtgtgggactatgaccgcttcagcagcaatgacttcctgggggaggtgctgattgacctgagcagcaccagccacctggacaacaccccccgctggtaccccctgaaggagcagacagagagcattgaccacggcaagagccacagcagccagagcagccagcagagccccaagcccagcgtcatcaagagccgcagccacggcatcttcccagaccccagcaaggacatgcaggtgcccaccatcgagaagagccacagcagccctggcagcagcaagagcagcagcgagggccacctgcggagccacggccccagccgcagccagagcaagacctctgtgacccagacccacctggaggatgctggggccgccatcgctgctgctgaggccgctgtgcagcagctgcgcatccagcccaccaagccacccaaccacaggcctgctgagagctctgtgtccacaggcagcagcggcagcagctttggcagcggctacagcgtggacagcgagggcagcagcagcacagctggggagaccaacctcttccccatcccccgcatcggcaagatgggccagaatggccaggagcctgtgaagcagcccggggtgggcgtgggcctggccgacacagaggccaagacccaggtgatgggagagatcaagatcgccctgaagaaggagatgaagacagatggagagcagctgattgtggagatcctgcagtgcaggaacatcacctacaagttcaagagcccagaccacctgcctgacctgtatgtgaagatctacgtgatgaacatcagcacccagaagaaggtgatcaagaagaagaccagggtgtgcagacatgaccgggagcccagcttcaatgagaccttccgcttcagcctgagccctgctggccacagcctgcagatcctgctcttcagcaatggaggcaagttcatgaagaagaccctcatcggggaggcctgcatctggctggacaaggtggacctgaggaagagaattgtgaactggcacaagctgctggtgagccccacccagacccactag

SEQ ID NO: 164256 - DNA, 1269 bp, Artificial Sequence
  Description of Artificial Sequence: Synthetic coding sequence
accaaggtgtggaacagcaatggcctgggcatcagaattgtgggcggcaaggagatccctggccacagcggggagatcggggcctacatcgccaagatcctgcccggcggcagcgctgagcagacaggcaagctgatggagggcatgcaggtgctggagtggaatggcatccccctgaccagcaagacctatgaggaggtgcagagcatcatcagccagcagagcggggaggccgagatctgtgtgcggctggacctgaacatgctgagtgacagcgagaacagccagcacctggagctgcacgagccccccaaggctgtggacaaggccaagagccctggggtggaccccaagcagctggccgctgagctgcagaaggtgtccctgcagcagagccccctggtgctgagctctgtggtggagaagggcagccacgtgcacagcggccccaccagcgctggcagcagctctgtgcccagccctggccagcccggcagccccagcgtgtccaagaagaagcacggcagcagcaagcccacagatggcaccaaggtggtgagccaccccatcactggagagatccagctgcagatcaactatgacctgggcaacctgatcatccacatcctgcaggccaggaacctggtgccccgggacaacaacggctacagcgacccctttgtgaaggtgtacctgctgcccggccgcggggctgagtacaagaggaggaccaagcacgtgcagaagagcctgaaccctgagtggaaccagaccgtcatctacaagagcatctccatggagcagctgaagaagaagaccctggaggtgacagtgtgggactatgaccgcttcagcagcaatgacttcctgggggaggtgctgattgacctgagcagcaccagccacctggacaacaccccccgctggtaccccctgaaggagcagacagagagcattgaccacggcaagagccacagcagccagagcagccagcagagccccaagcccagcgtcatcaagagccgcagccacggcatcttcccagaccccagcaaggacatgcaggtgcccaccatcgagaagagccacagcagccctggcagcagcaagagcagcagcgagggccacctgcggagccacggccccagccgcagccagagcaagacctctgtgacccagacccacctggaggatgctggagctgccatcgctgctgctgaggccgctgtgcagcagctgcgcatccagcccagcaagaggaggaagtag

SEQ ID NO: 164257 - DNA, 14808 bp, Artificial Sequence
  Description of Artificial Sequence: Synthetic coding sequence
atgggaaatgaggccagcctggagggggagggcctgcctgagggcctggccgctgctgctgctgctgggggcggggccagcggggccggcagccccagccacacagccatcccagctggcatggaggccgacctgagccagctgtctgaggaggagcggcggcagattgctgctgtgatgagccgggcccagggcctgcccaagggctctgtgcccccagctgctgctgagagccccagcatgcacaggaagcaggagctggacagcagccacccccccaagcagagcggccggcccccagaccccggccgcccagcccagcccggcctgagcaagagcaggaccacagacaccttccgctctgagcagaagctgcccggccgcagccccagcaccatcagcctgaaggagagcaagagcaggacagacctgaaggaggagcacaagagctccatgatgcctggcttcctgtctgaggtgaatgccctgtctgctgtgtcctctgtggtgaacaagttcaacccctttgacctgatcagtgacagcgaggccagccaggaggagaccaccaagaagcagaaggtggtgcagaaggagcagggcaagccagagggcatcatcaagccacccctgcagcagcagccccccaagcccatccccaagcagcagggccctggccgggaccccctgcagcaggacggcacccccaagagcatcagcagccagcagcctgagaagatcaagagccagcccccaggcaccgggaagcccatccagggccccacccagaccccccagacagaccacgccaagctgcccctgcagagagatgccagccggccccagaccaagcaggccgacatcgtgcggggggagagcgtgaagcccagcctgcccagccccagcaagccacccatccagcagcccaccccaggcaagcccccagcccagcagcccggccacgagaagagccagcccggccctgccaagcccccagcccagcccagcggcctgaccaagcccctggcccagcagcccggcaccgtgaagccccctgtgcagcccccaggcaccaccaagcccccagcccagcccctgggccctgccaagcccccagcccagcagacaggcagcgagaagcccagcagcgagcagcccggccccaaggccctggcccagcccccaggagtgggcaagaccccagcccagcagcccggccctgccaagccacccacccagcaggtgggcacccccaagcccctggcccagcagcccggcctgcagagccctgccaaggcccctggccccaccaagacccctgtgcagcagcccggccctgggaagatcccagcccagcaggccggccctgggaagaccagcgcccagcagacaggccccaccaagccacccagccagctgcccggccctgccaagcccccaccccagcagcccggccctgccaagcccccaccccagcagcccggcagcgccaagccacccagccagcagcccggcagcaccaagcccccaccccagcagcccggccctgccaagcccagcccccagcagcccggcagcaccaagccacccagccagcagcccggcagcgccaagcccagcgcccagcagcccagccctgccaagcccagcgcccagcagagcaccaagcctgtgtcccagacaggcagcggcaagcccctgcagcccccaacagtgagccccagcgccaagcagccccccagccagggcctgcccaagaccatctgccccctgtgcaacaccacagagctgctgctgcacgtgcctgagaaggccaacttcaacacctgcacagagtgccagaccaccgtgtgcagcctgtgtggcttcaaccccaacccccacctgacagaggtgaaggagtggctgtgcctgaactgccagatgaagagggccctgggcggggacctggcccctgtgcccagcagcccccagcccaagctgaagacagcccctgtgaccaccaccagcgctgtgtccaagagcagcccccagccccagcagaccagccccaagaaggatgctgcccccaagcaggacctgagcaaggcccctgagcccaagaagcccccacccctggtgaagcagcccaccctgcacggcagccccagcgccaaggccaagcagcccccagaggccgacagcctgagcaagccagccccacccaaggagcccagcgtgcccagcgagcaggacaaggcccctgtggctgatgacaagcccaagcagcccaagatggtgaagcccaccacagacctggtgagcagcagcagcgccaccaccaagccagacatccccagcagcaaggtgcagagccaggccgaggagaagaccaccccacccctgaagacagattctgccaagcccagccagagcttccccccaactggagagaaggtgagcccctttgacagcaaggccatccccaggcctgccagtgacagcaagatcatcagccaccctggccccagcagcgagagcaagggccagaagcaggtggaccctgtgcagaagaaggaggagcccaagaaggcccagaccaagatgagccccaagccagatgccaagcccatgcccaagggcagccccaccccacctggcccccggcccacagctggccagacagtgcccaccccccagcagagccccaagccccaggagcagagccgccgcttcagcctgaacctgggcagcatcacagatgcccccaagagccagcccaccaccccccaggagaccgtgacaggcaagctgtttggatttggagccagcatcttcagccaggccagcaacctgatcagcacagctggccagcccggcccccacagccagagcggccctggggcccccatgaagcaggccccagcccccagccagccccccaccagccagggcccccccaagagcacaggccaggcccccccagccccagccaagagcatccctgtgaagaaggagaccaaggccccagctgctgagaagctggagcccaaggccgagcaggcccccaccgtgaagaggacagaaacagagaagaagcccccacccatcaaggacagcaagagcctgacagctgagccccagaaggctgtgctgcccaccaagctggagaagagccccaagccagagagcacctgccccctgtgcaagacagagctgaacatcggcagcaaggacccccccaacttcaacacctgcacagagtgcaagaaccaggtgtgcaacctgtgtggcttcaaccccaccccccacctgacagagatccaggagtggctgtgcctgaactgccagacccagagggccatcagcggccagctgggggacatcaggaagatgcccccagcccccagcggccccaaggccagccccatgcctgtgcccacagagagcagcagccagaagacagctgtgcccccccaggtgaagctggtgaagaagcaggagcaggaggtgaagacagaggccgagaaggtgatcctggagaaggtgaaggagaccctgtccatggagaagatcccccccatggtgaccacagaccagaagcaggaggagagcaagctggagaaggacaaggccagcgccctgcaggagaagaagcccctgcctgaggagaagaagctgatccctgaggaggagaagatccgctctgaggagaagaagcccctgctggaggagaagaagcccaccccagaggacaagaagctgctgcctgaggccaagaccagcgcccctgaggagcagaagcatgacctgctgaagagccaggtgcagattgctgaggagaagctggagggccgggtggcccccaagacagtgcaggagggcaagcagccccagaccaagatggagggcctgcccagcggcaccccccagagcctgcccaaggaggatgacaagaccaccaagaccatcaaggagcagccccagcccccctgcacagccaagccagaccaggtggagcccgggaaggagaagacagagaaggaggatgacaagagtgacaccagcagcagccagcagcccaagagcccccagggcctgagtgacaccggctacagcagtgatggcatcagcagcagcctgggggagatccccagcctcatccccacagatgagaaggacatcctgaagggcctgaagaaggacagcttcagccaggagagcagccccagcagccccagcgacctggccaagctggagagcacagtgctgagcatcctggaggcccaggccagcaccctggctgatgagaagtctgagaagaagacccagccccatgaggtgtccccagagcagcccaaggaccaggagaagacccagagcctgtctgagaccctggagatcaccatcagcgaggaggagatcaaggagagccaggaggagaggaaggacaccttcaagaaggacagccagcaggacatccccagcagcaaggaccacaaggagaagtcagaatttgtggatgacatcaccacccggcgggagccctatgacagcgtggaggagagcagcgagagcgagaacagccctgtgccccagaggaagaggaggacctctgtgggcagcagcagcagtgatgagtacaagcaggaggacagccagggcagcggggaggaggaggacttcatcaggaagcagatcatcgagatgtctgcagatgaagatgccagcggctctgaagatgatgagttcatccggaaccagctgaaggagatcagcagcagcacagagagccagaagaaggaggagaccaagggcaagggcaagatcacagctgggaagcaccggcggctgaccaggaagagcagcaccagcattgatgaagatgctggaagaagacacagctggcatgatgaagatgatgaggcctttgatgagagccctgagctgaagtaccgggagaccaagagccaggagagcgaggagctggtggtgactggaggcggcggcctgcggcgcttcaagaccatcgagctgaacagcaccatcgctgacaagtacagcgctgagagcagccagaagaagaccagcctgtactttgatgaggagcctgagctggagatggagagcctgacagacagcccagaagatagaagcagaggagagggcagcagcagcctgcacgccagcagcttcaccccaggcaccagccccacctctgtgagcagcctggatgaagattctgacagcagccccagccacaagaagggggagagcaagcagcagaggaaggcccggcaccggccccacggccccctgctgcccaccatcgaggacagcagcgaggaggaggagctgcgggaggaggaggagctgctgaaggagcaggagaagcagcgggagattgagcagcagcagaggaagagcagcagcaagaagagcaagaaggacaaggatgagctgcgggcccagaggagaagagagcggcccaagaccccacccagcaacctgagccccattgaagatgccagccccacagaggagctgcggcaggccgctgagatggaggagctgcacaggagcagctgcagcgagtacagccccagcattgaaagtgaccctgagggctttgagatcagccctgagaagatcatcgaggtgcagaaggtgtacaagctgcccacagctgtgtccctgtacagccccacagatgagcagagcatcatgcagaaggagggcagccagaaggccctgaagtctgctgaggagatgtatgaggagatgatgcacaagacccacaagtacaaggccttccctgctgccaatgaaagagatgaggtgtttgagaaggagcccctgtatggaggcatgctgattgaggactacatctatgagagcctggtggaggacacctacaacggctctgtggatggcagcctgctgacccggcaggaggaggagaatggcttcatgcagcagaagggccgggagcagaagatccggctgtctgagcagatctatgaggaccccatgcagaagatcacagacctgcagaaggagttctatgagctggagagcctgcacagcgtggtgccccaggaggacatcgtgagcagcagcttcatcatccctgagagccatgagatcgtggacctgggcaccatggtgaccagcacagaggaggagaggaagctgctggatgctgatgctgcctatgaggagctgatgaagaggcagcagatgcagctgaccccaggcagcagccccacccaggcccccatcggggaggacatgacagagagcaccatggactttgacaggatgccagatgccagcctgaccagctctgtgctgagcggggccagcctgacagacagcaccagcagcgccaccctgagcatcccagatgtgaagatcacccagcacttcagcacagaggagattgaagatgaatatgtgacagactacacccgggagatccaggagatcatcgcccacgagagcctcatcctgacctacagcgagcccagcgagagcgccacctctgtgcccccaagtgacacccccagcctgaccagctctgtgtcctctgtgtgcaccacagacagcagcagccccatcaccaccctggacagcatcaccaccgtgtacacagagcctgtggacatgatcaccaagtttgaagattctgaggagatcagcagcagcacctacttccctggcagcatcatcgactacccagaggagatctctgtgtccctggacagaacagcccccccagatggccgggccagcgctgaccacatcgtcatcagcctgagtgacatggccagcagcatcatcgagagcgtggtgcccaagccagagggccctgtggccgacacagtgtccacagacctgctgatcagcgagaaggaccctgtgaagaaggccaagaaggagactggaaatggcatcatcctggaggtgctggaggcctacagagacaagaaggagctggaggccgagaggaccaagagcagcctgtctgagaccgtgtttgaccacccccccagcagcgtcatcgccctgcccatgaaggagcagctgagcaccacctacttcaccagcggggagaccttcggccaggagaagccagccagccagctgcccagcggcagccccagcgtgagcagcctgcctgccaagccccggcccttcttccgcagcagcagcctggacatcagcgcccagcccccacctcctcctcctcctcctcctcctcctcctcctcctcctcctcctcctcctcctccacccctgcccccacccaccagccccaagcccaccatcctgcccaagaagaagctgactgtggccagccctgtgaccacagccacccccctgtttgatgctgtgaccaccctggagaccacagctgtgctgcggagcaatggcctgcctgtgacccgcatctgcaccacagcccctcctcctgtgccccccaagcccagcagcatccccagcggcctggtgttcacccacaggcctgagcccagcaagccacccatcgcccccaagcctgtgatcccccagctgcccaccaccacccagaagcccacagacatccaccccaagcccaccggcctgagcctgaccagctccatgaccctgaacctggtgaccagcgctgactacaagctgcccagccccaccagccccctgagcccccacagcaacaagagcagcccccgcttcagcaagagcctgacagagacctacgtggtgatcaccctgcccagcgagcccggcacccccacagacagcagcgccagccaggccatcacctcctggcccctgggcagccccagcaaggacctggtgtctgtggagcccgtcttctctgtggtgccccctgtgacagctgtggagatccccatcagcagcgagcagaccttctacatcagcggggccctgcagaccttcagcgccacccctgtgacagcccccagcagcttccaggccgcccccacctctgtgacccagttcctgaccacagaggtgtccaagacagaggtgtctgccaccaggagcacagcccccagcgtgggcctgagcagcatcagcatcaccatccccccagagcccctggccctggacaacatccacctggagaagccccagtacaaggaggatggcaagctgcagctggtgggagatgtgattgacctgaggacagtgcccaaggtggaggtgaagaccacagacaagtgcatcgacctgagcgccagcaccatggatgtgaagaggcagatcacagccaatgaggtgtatggcaagcagatctctgctgtgcagcccagcatcatcaacctgtctgtgaccagcagcatcgtgacccctgtgtccctggccacagagaccgtgacctttgtgacctgcacagccagcgccagctacaccaccggcacagagagcctggtgggcgctgagcacgccatgaccacccccctgcagctgaccaccagcaagcacgccgagcccccctaccgcatccccagcgaccaggtgttccccatcgcccgggaggaggcccccatcaacctgagcctgggcaccccagcccatgctgtgaccctggccatcaccaagcctgtgacagtgccccctgtgggcgtgaccaacggctggacagacagcacagtgtcccagggcatcacagatggagaggtggtggacctgagcaccaccaagagccacaggacagtggtgaccatggatgagagcaccagctctgtgatgaccaagatcattgaagatgagaagcctgtggacctgacagctggccggcgggctgtgtgctgtgatgtggtgtacaagctgcccttcggccgcagctgcacagcccagcagcctgccaccaccctgcctgaggacagatttggctacagagatgaccactaccagtatgacagaagtggcccctacggctaccggggcattggaggcatgaagcccagcatgtctgacaccaacctggccgaggccggccacttcttctacaagagcaagaatgcctttgactacagcgagggcacagacacagctgtggacctgaccagcggccgggtgaccaccggggaggtgatggactacagcagcaagaccaccggcccctacccagagacccggcaggtgatcagcggggccggcatcagcaccccccagtacagcacagccaggatgaccccacctcctggcccccagtactgtgtgggctctgtgctgcggagcagcaatggagtggtgtacagctctgtggccacccccacccccagcacctttgccatcaccacccagcccggcagcatcttcagcaccaccgtgcgggacctgagcggcatccacacagcagatgctgtgaccagcctgcctgccatgcaccacagccagcccatgcccaggagctacttcatcaccactggagccagcgagacagacattgctgtgactggaattgacatcagcgccagcctgcagaccatcaccatggagagcctgacagctgagaccatcgacagcgtgcccaccctgaccacagccagcgaggtgtttcctgaggtggtgggagatgaaagtgccctgctgattgtgcctgaggaggacaagcagcagcagcagctggacctggagcgggagctgctggagctggagaagatcaagcagcagagatttgctgaggagctggagtgggagcggcaggagatccagcgcttccgggagcaggagaagatcatggtgcagaagaagctggaggagctgcagagcatgaagcagcacctgctcttccagcaggaggaggagcggcaggcccagttcatgatgaggcaggagaccctggcccagcagcagctgcagctggagcagatccagcagctgcagcagcagctgcaccagcagctggaggagcagaagatccggcagatctaccagtacaactatgaccccagcggcacagccagcccccagaccaccacagagcaggccatcctggagggccagtatgctgccctggagggcagccagttctgggccacagaagatgccaccaccacagccagcgctgtggtggccatcgagatcccccagagccagggctggtacacagtgcagagtgatggagtgacccagtacatcgcccctcctggcatcctgagcacagtgtctgagatccccctgacagatgtggtggtgaaggaggagaagcagcccaagaagaggagcagcggggccaaggtgcggggccagtatgatgacatgggagagaacatgacagatgaccccaggagcttcaagaagatcgtggacagcggcgtgcagacagatgatgaagatgccacagacaggagctatgtgtccagaagaagaaggaccaagaagtctgtggacacctctgtgcagacagatgatgaggaccaggatgagtgggacatgcccaccaggagcaggaggaaggcccgggtgggcaagtatggagacagcatgacagaggccgacaagaccaagcccctgagcaaggtgagcagcattgctgtgcagacagtggccgagatctctgtgcagacagagcctgtgggcaccatccgcacccccagcatccgggcccgggtggatgccaaggtggagatcatcaagcacatcagcgcccctgagaagacctacaagggcggcagcctgggctgccagacagaagctgacagcgacacccagagcccccagtacctgagcgccaccagcccccccaaggacaagaagaggcccacccccctggagatcggctacagcagccacctgcgggctgacagcacagtgcagctggcccccagcccccccaagagccccaaggtgctgtacagccccatcagccccctgagccctgggaaggccctggagagcgcctttgtgccctatgagaagcccctgcctgatgacatcagcccccagaaggtgctgcacccagacatggccaaggtgcccccagccagccccaagacagccaagatgatgcagaggtccatgtctgaccccaagcccctgagccccacagcagatgagagcagccgggcccccttccagtacacagagggctacaccaccaagggcagccagaccatgaccagcagcggggcccagaagaaggtgaagaggaccctgcccaaccccccacctgaggagatcagcacaggcacccagagcaccttcagcaccatgggcaccgtgtccagaagacgcatctgcaggaccaacaccatggcccgggccaagatcctgcaggacatcgaccgggagctggacctggtggagcgggagagcgccaagctgaggaagaagcaggccgagctggatgaggaggagaaggagattgatgccaagctgcgctacctggagatgggcatcaacagaaggaaggaggccctgctgaaggagcgggagaagcgggagcgggcctacctgcagggcgtggctgaagatcgggactacatgtctgattctgaggtgagcagcacccggcccaccagaattgagagccagcacggcatcgagcggcccaggacagccccccagacagagttcagccagttcatccccccccagacccagacagagagccagctggtgccccccaccagcccctacacccagtaccagtacagcagccctgccctgcccacccaggcccccaccagctacacccagcagagccactttgagcagcagaccctgtaccaccagcaggtgagcccctaccagacccagcccaccttccaggccgtggccaccatgtccttcaccccccaggtgcagcccacccccaccccccagcccagctaccagctgcccagccagatgatggtgatccagcagaagccccggcagaccaccctgtacctggagcccaagatcaccagcaactatgaggtgatccggaaccagcccctgatgattgcccctgtgtccacagacaacacctttgctgtgagccacctgggcagcaagtacaacagcctggacctgagaattggcctggaggagaggagctccatggccagcagccccatcagcagcatctctgctgacagcttctacgccgacatcgaccaccacacccccaggaactacgtgctgattgatgacatcggggagatcaccaagggcacagctgccctgagcacagccttcagcctgcacgagaaggacctgagcaagacagaccggctgctgcggaccacagagacccggcgcagccaggaggtgacagacttcctggcccccctgcagagcagcagccggctgcacagctatgtgaaggccgaggaggaccccatggaggacccctatgagctgaagctgctgaagcaccagatcaagcaggagttcagaagaggaacagagagcctggaccacctggccggcctgagccactactaccacgccgacaccagctaccgccacttccccaagtctgagaagtacagcatcagccggctgaccctggagaagcaggccgccaagcagctgcctgctgccatcctgtaccagaagcagagcaagcacaagaagagcctgattgaccccaagatgagcaagttcagccccatccaggagagccgggacctggagccagactacagcagctacatgaccagcagcaccagcagcattggaggcatcagcagccgggcccggctgctgcaggatgacatcaccttcggcctgaggaagaacatcacagaccagcagaagttcatgggcagcagcctgggcaccggcctgggcaccctgggcaacaccatccgcagcgccctgcaggatgaagctgacaagccctacagcagcggcagccgcagccggcccagcagccggcccagctctgtgtatggcctggacctgagcatcaagagggacagcagcagcagcagcctgcggctgaaggcccaggaggccgaggccctggatgtgtccttcagccacgccagcagcagcgcccggaccaagcccaccagcctgcccatcagccagagccggggccgcatccccatcgtggcccagaacagcgaggaggagagccccctgagccctgtgggccagcccatgggcatggcccgggctgctgctggccccctgccccccatctctgctgacacccgggaccagtttggcagcagccacagcctgcctgaggtgcagcagcacatgagggaggagagcaggacccggggctatgaccgggacatcgccttcatcatggatgacttccagcacgccatgtctgacagcgaggcctaccacctgcggcgggaggagacagactggtttgacaagccccgggagagccggctggagaatggacatggcctggacaggaagctgcctgagcggctggtgcacagccggcccctgagccagcaccaggagcagatcatccagatgaatggcaagaccatgcactacatcttcccccacgcccgcatcaagatcacccgggacagcaaggaccacacagtgtctggaaatggcctgggcatcagaattgtgggcggcaaggagatccctggccacagcggggagatcggggcctacatcgccaagatcctgcccggcggcagcgctgagcagacaggcaagctgatggagggcatgcaggtgctggagtggaatggcatccccctgaccagcaagacctatgaggaggtgcagagcatcatcagccagcagagcggggaggccgagatctgtgtgcggctggacctgaacatgctgagtgacagcgagaacagccagcacctggagctgcacgagccccccaaggctgtggacaaggccaagagccctggggtggaccccaagcagctggccgctgagctgcagaaggtgtccctgcagcagagccccctggtgctgagctctgtggtggagaagggcagccacgtgcacagcggccccaccagcgctggcagcagctctgtgcccagccctggccagcccggcagccccagcgtgtccaagaagaagcacggcagcagcaagcccacagatggcaccaaggtggtgagccaccccatcactggagagatccagctgcagatcaactatgacctgggcaacctgatcatccacatcctgcaggccaggaacctggtgccccgggacaacaacggctacagcgacccctttgtgaaggtgtacctgctgcccggccggggccaggtgatggtggtgcagaatgccagcgctgagtacaagaggaggaccaagcacgtgcagaagagcctgaaccctgagtggaaccagaccgtcatctacaagagcatctccatggagcagctgaagaagaagaccctggaggtgacagtgtgggactatgaccgcttcagcagcaatgacttcctgggggaggtgctgattgacctgagcagcaccagccacctggacaacaccccccgctggtaccccctgaaggagcagacagagagcattgaccacggcaagagccacagcagccagagcagccagcagagccccaagcccagcgtcatcaagagccgcagccacggcatcttcccagaccccagcaaggacatgcaggtgcccaccatcgagaagagccacagcagccctggcagcagcaagagcagcagcgagggccacctgcggagccacggccccagccgcagccagagcaagacctctgtgacccagacccacctggaggatgctggggccgccatcgctgctgctgaggccgctgtgcagcagctgcgcatccagcccagcaagaggaggaagtag

SEQ ID NO: 164258 - DNA, 10908 bp, Artificial Sequence
  Description of Artificial Sequence: Synthetic coding sequence
atgggaaatgaggccagcctggagggggagggcctgcctgagggcctggccgctgctgctgctgctgggggcggggccagcggggccggcagccccagccacacagccatcccagctggcatggaggccgacctgagccagctgtctgaggaggagcggcggcagattgctgctgtgatgagccgggcccagggcctgcccaagggctctgtgcccccagctgctgctgagagccccagcatgcacaggaagcaggagctggacagcagccacccccccaagcagagcggccggcccccagaccccggccgcccagcccagcccggcctgagcaagagcaggaccacagacaccttccgctctgagcagaagctgcccggccgcagccccagcaccatcagcctgaaggagagcaagagcaggacagacctgaaggaggagcacaagagctccatgatgcctggcttcctgtctgaggtgaatgccctgtctgctgtgtcctctgtggtgaacaagttcaacccctttgacctgatcagtgacagcgaggccagccaggaggagaccaccaagaagcagaaggtggtgcagaaggagcagggcaagccagagggcatcatcaagccacccctgcagcagcagccccccaagcccatccccaagcagcagggccctggccgggaccccctgcagcaggacggcacccccaagagcatcagcagccagcagcctgagaagatcaagagccagcccccaggcaccgggaagcccatccagggccccacccagaccccccagacagaccacgccaagctgcccctgcagagagatgccagccggccccagaccaagcaggccgacatcgtgcggggggagagcgtgaagcccagcctgcccagccccagcaagccacccatccagcagcccaccccaggcaagcccccagcccagcagcccggccacgagaagagccagcccggccctgccaagcccccagcccagcccagcggcctgaccaagcccctggcccagcagcccggcaccgtgaagccccctgtgcagcccccaggcaccaccaagcccccagcccagcccctgggccctgccaagcccccagcccagcagacaggcagcgagaagcccagcagcgagcagcccggccccaaggccctggcccagcccccaggagtgggcaagaccccagcccagcagcccggccctgccaagccacccacccagcaggtgggcacccccaagcccctggcccagcagcccggcctgcagagccctgccaaggcccctggccccaccaagacccctgtgcagcccaagccacccagccagcagcccggcagcaccaagcccccaccccagcagcccggccctgccaagcccagcccccagcagcccggcagcaccaagccacccagccagcagcccggcagcgccaagcccagcgcccagcagcccagccctgccaagcccagcgcccagcagagcaccaagcctgtgtcccagacaggcagcggcaagcccctgcagcccccaacagtgagccccagcgccaagcagccccccagccagggcctgcccaagaccatctgccccctgtgcaacaccacagagctgctgctgcacgtgcctgagaaggccaacttcaacacctgcacagagtgccagaccaccgtgtgcagcctgtgtggcttcaaccccaacccccacctgacagaggtgaaggagtggctgtgcctgaactgccagatgaagagggccctgggcggggacctggcccctgtgcccagcagcccccagcccaagctgaagacagcccctgtgaccaccaccagcgctgtgtccaagagcagcccccagccccagcagaccagccccaagaaggatgctgcccccaagcaggacctgagcaaggcccctgagcccaagaagcccccacccctggtgaagcagcccaccctgcacggcagccccagcgccaaggccaagcagcccccagaggccgacagcctgagcaagccagccccacccaaggagcccagcgtgcccagcgagcaggacaaggcccctgtggctgatgacaagcccaagcagcccaagatggtgaagcccaccacagacctggtgagcagcagcagcgccaccaccaagccagacatccccagcagcaaggtgcagagccaggccgaggagaagaccaccccacccctgaagacagattctgccaagcccagccagagcttccccccaactggagagaaggtgagcccctttgacagcaaggccatccccaggcctgccagtgacagcaagatcatcagccaccctggccccagcagcgagagcaagggccagaagcaggtggaccctgtgcagaagaaggaggagcccaagaaggcccagaccaagatgagccccaagccagatgccaagcccatgcccaagggcagccccaccccacctggcccccggcccacagctggccagacagtgcccaccccccagcagagccccaagccccaggagcagagccgccgcttcagcctgaacctgggcagcatcacagatgcccccaagagccagcccaccaccccccaggagaccgtgacaggcaagctgtttggatttggagccagcatcttcagccaggccagcaacctgatcagcacagctggccagcccggcccccacagccagagcggccctggggcccccatgaagcaggccccagcccccagccagccccccaccagccagggcccccccaagagcacaggccaggcccccccagccccagccaagagcatccctgtgaagaaggagaccaaggccccagctgctgagaagctggagcccaaggccgagcaggcccccaccgtgaagaggacagaaacagagaagaagcccccacccatcaaggacagcaagagcctgacagctgagccccagaaggctgtgctgcccaccaagctggagaagagccccaagccagagagcacctgccccctgtgcaagacagagctgaacatcggcagcaaggacccccccaacttcaacacctgcacagagtgcaagaaccaggtgtgcaacctgtgtggcttcaaccccaccccccacctgacagagaactgccagacccagagggccatcagcggccagctgggggacatcaggaagatgcccccagcccccagcggccccaaggccagccccatgcctgtgcccacagagagcagcagccagaagacagctgtgcccccccaggtgaagctggtgaagaagcaggagcaggaggtgaagacagaagctgagaaggtgatcctggagaaggtgaaggagaccctgtccatggagaagatcccccccatggtgaccacagaccagaagcaggaggagagcaagctggagaaggacaaggccagcgccctgcaggagaagaagcccctgcctgaggagaagaagctgatccctgaggaggagaagatccgctctgaggagaagaagcccctgctggaggagaagaagcccaccccagaggacaagaagctgctgcctgaggccaagaccagcgcccctgaggagcagaagcatgacctgctgaagagccaggtgcagattgctgaggagaagctggagggccgggtggcccccaagacagtgcaggagggcaagcagccccagaccaagatggagggcctgcccagcggcaccccccagagcctgcccaaggaggatgacaagaccaccaagaccatcaaggagcagccccagcccccctgcacagccaagccagaccaggagaaggaggatgacaagagtgacaccagcagcagccagcagcccaagagcccccagggcctgagtgacaccggctacagcagtgatggcatcagcagcagcctgggggagatccccagcctcatccccacagatgagaaggacatcctgaagggcctgaagaaggacagcttcagccaggagagcagccccagcagccccagcgacctggccaagctggagagcacagtgctgagcatcctggaggcccaggccagcaccctggctgatgagaagtctgagaagaagacccagccccatgaggtgtccccagagcagcccaaggaccaggagaagacccagagcctgtctgagaccctggagatcaccatcagcgaggaggagatcaaggagagccaggaggagaggaaggacaccttcaagaaggacagccagcaggacatccccagcagcaaggaccacaaggagaagtcagaatttgtggatgacatcaccacccggcgggagccctatgattctgtggaggagagcagcgagagcgagaacagccctgtgccccagaggaagaggaggacctctgtgggcagcagcagcagtgatgagtacaagcaggaggacagccagggcagcggggaggaggaggacttcatcaggaagcagatcatcgagatgtctgcagatgaagatgccagcggctctgaagatgatgagttcatccggaaccagctgaaggagatcagcagcagcacagagagccagaagaaggaggagaccaagggcaagggcaagatcacagctgggaagcaccggcggctgaccaggaagagcagcaccagcattgatgaagatgctggccgccgccacagctggcatgatgaagatgatgaggcctttgatgagagccctgagctgaagtaccgggagaccaagagccaggagagcgaggagctggtggtgactggaggcggcggcctgcggcgcttcaagaccatcgagctgaacagcaccatcgctgacaagtacagcgctgagagcagccagaagaagaccagcctgtactttgatgaggagcctgagctggagatggagagcctgacagacagccctgaggacaggagcagaggagagggcagcagcagcctgcacgccagcagcttcaccccaggcaccagccccacctctgtgagcagcctggatgaggacagcgacagcagccccagccacaagaagggggagagcaagcagcagaggaaggcccggcaccggccccacggccccctgctgcccaccatcgaggacagcagcgaggaggaggagctgcgggaggaggaggagctgctgaaggagcaggagaagcagcgggagattgagcagcagcagaggaagagcagcagcaagaagagcaagaaggacaaggatgagctgcgggcccagaggcggcgggagcggcccaagaccccacccagcaacctgagccccattgaagatgccagccccacagaggagctgcggcaggccgctgagatggaggagctgcacaggagcagctgcagcgagtacagccccagcattgaaagtgaccctgagggctttgagatcagccctgagaagatcatcgaggtgcagaaggtgtacaagctgcccacagctgtgtccctgtacagccccacagatgagcagagcatcatgcagaaggagggcagccagaaggccctgaagtctgctgaggagatgtatgaggagatgatgcacaagacccacaagtacaaggccttccctgctgccaatgaaagagatgaggtgtttgagaaggagcccctgtatggaggcatgctgattgaggactacatctatgagagcctggtggaggacacctacaatggatctgtggatggcagcctgctgacccggcaggaggaggagaatggcttcatgcagcagaagggccgggagcagaagatccggctgtctgagcagatctatgaggaccccatgcagaagatcacagacctgcagaaggagttctatgagctggagagcctgcacagcgtggtgccccaggaggacatcgtgagcagcagcttcatcatccctgagagccatgaaattgtggacctgggcaccatggtgaccagcacagaggaggagaggaagctgctggatgctgatgctgcctatgaggagctgatgaagaggcagcagatgcagctgaccccaggcagcagccccacccaggcccccatcggggaggacatgacagagagcaccatggactttgacaggatgccagatgccagcctgaccagctctgtgctgagcggggccagcctgacagacagcaccagcagcgccaccctgagcatcccagatgtgaagatcacccagcacttcagcacagaggagattgaagatgaatatgtgacagactacacccgggagatccaggagatcatcgcccacgagagcctcatcctgacctacagcgagcccagcgagagcgccacctctgtgccccccagcgacacccccagcctgaccagctctgtgtcctctgtgtgcaccacagacagcagcagccccatcaccaccctggacagcatcaccaccgtgtacacagagcctgtggacatgatcaccaagtttgaggacagcgaggagatcagcagcagcacctacttccctggcagcatcatcgactacccagaggagatctctgtgtccctggacagaacagcccccccagatggccgggccagcgctgaccacatcgtcatcagcctgagtgacatggccagcagcatcattgaatctgtggtgcccaagccagagggccctgtggccgacacagtgtccacagacctgctgatcagcgagaaggaccctgtgaagaaggccaagaaggagactggaaatggcatcatcctggaggtgctggaggcctacagagacaagaaggagctggaggccgagaggaccaagagcagcctgtctgaaacagtgtttgaccacccccccagctctgtgattgccctgcccatgaaggagcagctgagcaccacctacttcaccagcggggagaccttcggccaggagaagccagccagccagctgcccagcggcagccccagcgtgagcagcctgcctgccaagccccggcccttcttccgcagcagcagcctggacatcagcgcccagcccccacctcctcctcctcctcctcctcctcctcctcctcctcctcctcctcctcctcctccacccctgcccccacccaccagccccaagcccaccatcctgcccaagaagaagctgactgtggccagccctgtgaccacagccacccccctgtttgatgctgtgaccaccctggagaccacagctgtgctgcggagcaatggcctgcctgtgacccgcatctgcaccacagcccctcctcctgtgccccccaagcccagcagcatccccagcggcctggtgttcacccacaggcctgagcccagcaagccacccatcgcccccaagcctgtgatcccccagctgcccaccaccacccagaagcccacagacatccaccccaagcccaccggcctgagcctgaccagctccatgaccctgaacctggtgaccagcgctgactacaagctgcccagccccaccagccccctgagcccccacagcaacaagagcagcccccgcttcagcaagagcctgacagagacctacgtggtgatcaccctgcccagcgagcccggcacccccacagacagcagcgccagccaggccatcacctcctggcccctgggcagccccagcaaggacctggtgtctgtggagcctgtgttttctgtggtgccccctgtgacagctgtggagatccccatcagcagcgagcagaccttctacatcagcggggccctgcagaccttcagcgccacccctgtgacagcccccagcagcttccaggccgcccccacctctgtgacccagttcctgaccacagaggtgtccaagacagaggtgtctgccaccaggagcacagcccccagcgtgggcctgagcagcatcagcatcaccatccccccagagcccctggccctggacaacatccacctggagaagccccagtacaaggaggatggcaagctgcagctggtgggagatgtgattgacctgaggacagtgcccaaggtggaggtgaagaccacagacaagtgcatcgacctgagcgccagcaccatggatgtgaagaggcagatcacagccaatgaggtgtatggcaagcagatctctgctgtgcagcccagcatcatcaacctgtctgtgaccagcagcatcgtgacccctgtgtccctggccacagaaacagtgacctttgtgacctgcacagccagcgccagctacaccactggaacagagagcctggtgggcgctgagcacgccatgaccacccccctgcagctgaccaccagcaagcatgctgagcccccctaccgcatccccagcgaccaggtgttccccatcgcccgggaggaggcccccatcaacctgagcctgggcaccccagcccatgctgtgaccctggccatcaccaagcctgtgacagtgccccctgtgggcgtgaccaacggctggacagacagcacagtgtcccagggcatcacagatggagaggtggtggacctgagcaccaccaagagccacaggacagtggtgaccatggatgagagcaccagctctgtgatgaccaagatcattgaagatgagaagcctgtggacctgacagctggaagaagagctgtgtgctgtgatgtggtgtacaagctgcccttcggccgcagctgcacagcccagcagcctgccaccaccctgcctgaagatcgcttcggctacagagatgaccactaccagtatgacaggagcggcccctacggctaccggggcatcggcggcatgaagcccagcatgtctgacaccaacctggccgaggccggccacttcttctacaagagcaagaatgcctttgactacagcgagggcacagacacagctgtggacctgaccagcggccgggtgaccactggagaggtgatggactacagcagcaagaccaccggcccctacccagagacccggcaggtgatctctggagctggcatcagcaccccccagtacagcacagccaggatgaccccacctcctggcccccagtactgtgtgggctctgtgctgcggagcagcaatggagtggtgtacagctctgtggccacccccacccccagcacctttgccatcaccacccagcccggcagcatcttcagcaccaccgtgcgggacctgagcggcatccacacagcagatgctgtgaccagcctgcctgccatgcaccacagccagcccatgcccaggagctacttcatcaccaccggggccagcgagacagacattgctgtgacaggcatcgacatcagcgccagcctgcagaccatcaccatggagagcctgacagctgagaccattgattctgtgcccaccctgaccacagccagcgaggtgtttcctgaggtggtgggagatgagagcgccctgctgattgtgcctgaggaggacaagcagcagcagcagctggacctggagcgggagctgctggagctggagaagatcaagcagcagagatttgctgaggagctggagtgggagcggcaggagatccagcgcttccgggagcaggagaagatcatggtgcagaagaagctggaggagctgcagagcatgaagcagcacctgctcttccagcaggaggaggagcggcaggcccagttcatgatgaggcaggagaccctggcccagcagcagctgcagctggagcagatccagcagctgcagcagcagctgcaccagcagctggaggagcagaagatccggcagatctaccagtacaactatgaccccagcggcacagccagcccccagaccaccacagagcaggccatcctggagggccagtatgctgccctggagggcagccagttctgggccacagaagatgccaccaccacagccagcgctgtggtggccatcgagatcccccagagccagggctggtacacagtgcagagtgatggagtgacccagtacatcgcccctcctggcatcctgagcacagtgtctgagatccccctgacagatgtggtggtgaaggaggagaagcagcccaagaagaggagcagcggggccaaggtgcggggccagtatgatgacatgggagagaacatgacagatgaccccaggagcttcaagaagatcgtggacagcggcgtgcagacagatgatgaagatgccacagacaggagctatgtgtccagaagaagaaggaccaagaagtctgtggacacctctgtgcagacagatgatgaggaccaggatgagtgggacatgcccaccaggagcaggaggaaggcccgggtgggcaagtacggggacagcatgacagaagctgacaagaccaagcccctgagcaaggtgagcagcattgctgtgcagacagtggccgagatctctgtgcagacagagcctgtgggcaccatccgcacccccagcatccgggcccgggtggatgccaaggtggagatcatcaagcacatcagcgcccctgagaagacctacaagggcggcagcctgggctgccagacagaggccgacagcgacacccagagcccccagtacctgagcgccaccagcccccccaaggacaagaagaggcccacccccctggagatcggctacagcagccacctgcgggctgacagcacagtgcagctggcccccagcccccccaagagccccaaggtgctgtacagccccatcagccccctgagccctgggaaggccctggagagcgcctttgtgccctatgagaagcccctgcctgatgacatcagcccccagaaggtgctgcacccagacatggccaaggtgcccccagccagccccaagacagccaagatgatgcagaggtccatgtctgaccccaagcccctgagccccacagcagatgagagcagccgggcccccttccagtacacagagggctacacctag

SEQ ID NO: 164259 - DNA, 1635 bp, Artificial Sequence
  Description of Artificial Sequence: Synthetic coding sequence
atggagaagctgcaggagcacctgatcaaggccaaggccttcaccatcaagaagaccctggagatctacgtgcccatcaagcagttcttctacaacctgatccaccctgagtacagcgctgtgacagatgtgtatgtgctgatgttcctggccgacacagtggacttcatcatcatcgtgtttggcttctgggccttcggcaagcacagcgctgctgctgacatcaccagcagcctgtctgaggaccaggtgcccggccccttcctggtgatggtgctgatccagtttggcaccatggtggtggaccgggccctgtacctgaggaagacagtgctgggcaaggtgatcttccaggtgatcctggtgtttggcatccacttctggatgttcttcatcctgcccggggtgacagagaggaagttcagccagaacctggtggcccagctgtggtactttgtgaagtgtgtgtacttcggcctgagcgcctaccagatccgctgtggctaccccaccagggtgctgggcaacttcctgaccaagagctacaactacgtgaacctcttcctgttccagggcttccggctggtgcccttcctgacagagctgcgggctgtgatggactgggtgtggacagacaccaccctgagcctgagctcctggatctgtgtggaggacatctatgcccacatcttcatcctgaagtgctggagggagagcgagaagcccatcttcaccatgtctgcccagcagagccagctgaaggtgatggaccagcagagcttcaacaagttcatccaggccttcagccgggacaccggggccatgcagttcctggagaactatgagaaggaggacatcaccgtggccgagctggagggcaacagcaacagcctgtggaccatcagcccccccagcaagcagaagatgattcatgagctgctggaccccaacagcagcttctctgtggtgttctcctggagcatccagaggaacctgagcctgggcgccaagtctgagatcgccacagacaagctgtccttccccctgaagaacatcaccaggaagaacatcgccaagatgattgctggcaacagcacagagagcagcaagacccctgtgaccatcgagaagatctacccctactacgtgaaggcccccagcgacagcaacagcaagcccatcaagcagctgctgtctgagaacaacttcatggacatcaccatcatcctgagccgggacaacaccaccaagtacaacagcgagtggtgggtgctgaacctgaccggcaaccgcatctacaaccccaacagccaggccctggagctggtggtgttcaatgacaaggtgtccccacccagcctgggcttcctggccggctacggcatcatgggcctgtatgcctctgtggtgctggtgattggcaagtttgtgcgggagttcttcagcggcatcagccacagcatcatgtttgaggagctgcccaacgtggaccgcatcctgaagctgtgcacagacatcttcctggtgcgggagaccggggagctggagctggaggaggacctgtatgccaagctgatcttcctgtaccgcagccctgagaccatgatcaagtggacccgggagaagaccaactag

SEQ ID NO: 164260 - DNA, 8259 bp, Artificial Sequence
  Description of Artificial Sequence: Synthetic coding sequence
atggccagcgaggtggtgtgtggcctcatcttccggctgctgctgcccatctgcctggccgtggcctgtgccttccgctacaacggcctgagctttgtgtacctgatctacctgctgctgatccccctcttcagcgagcccaccaagaccaccatgcagggccacacaggccgcctgctgaagagcctgtgcttcatcagcctgtccttcctgctgctgcacatcatcttccacatcaccctggtgtccctggaggcccagcaccgcatcgcccctggctacaactgcagcacctgggagaagaccttccggcagatcggctttgagagcctgaagggagcagatgctggaaatggcatccgggtgtttgtgcctgacatcggcatgtttattgccagcctgaccatctggctgctgtgcagaaatattgtgcagaagcctgtgacagatgaggccgcccagagcaaccctgagtttgaaaatgaggagctggccgagggggagaagattgacagcgaggaggccctgatctatgaggaggacttcaatggaggagatggagtggagggggagctggaggagagcaccaagctgaagatgttccggcggctggcctctgtggccagcaagctgaaggagttcatcggcaacatgatcaccacagctgggaaggtggtggtgaccatcctgctgggcagcagcggcatgatgctgcccagcctgaccagctctgtgtacttctttgtgttcctgggcctgtgcacctggtggagctggtgcaggacctttgaccccctgctcttcagctgcctgtgtgtgctgctggccatcttcaccgctggccacctgattggcctgtacctgtaccagttccagttcttccaggaggccgtgcccccaaatgactactatgcccggctgtttggcatcaagagcgtcatccagacagactgcagcagcacctggaagatcatcgtgaacccagacctgtcctggtaccaccacgccaaccccatcctgctgctggtgatgtactacaccctggccaccctcatccgcatctggctgcaggagcccctggtgcaggatgagggcaccaaggaggaggacaaggccctggcctgcagccccatccagatcacagctggaagaagaagaagcctgtggtacgccacccactaccccacagatgagaggaagctgctgtccatgacccaggatgactacaagcccagtgatggcctgctggtgacagtgaatggaaatcctgtggactaccacaccatccaccccagcctgcccatggagaatggacctgggaaggctgacctgtacagcaccccccagtaccgctgggagcccagtgatgagagcagcgagaagcgggaggaggaggaggaggagaaggaggagtttgaggaggagaggagccgggaggagaagaggagcatcaaggtgcacgccatggtgtctgtgttccagttcatcatgaagcagagctacatctgtgccctgattgccatgatggcctggagcatcacctaccacagctggctgacctttgtgctgctgatctggagctgcaccctgtggatgatccggaacagaagaaaatatgccatgatcagcagccccttcatggtggtgtatggcaacctgctgctgatcctgcagtacatctggagctttgagctgcctgagatcaagaaggtgcccggcttcctggagaagaaggagcccggggagctggccagcaagatcctcttcaccatcaccttctggctgctgctgcggcagcacctgacagagcagaaggccctgcaggagaaggaggccctgctgtctgaggtgaagattggcagccaggagaatgaggagaaggatgaggagctgcaggacatccaggtggagggggagcccaaggaggaggaggaggaggaggccaaggaggagaagcaggagaggaagaaggtggagcaggaggaggccgaggaggaggatgagcaggacatcatgaaggtgctgggcaacctggtggtggccatgttcatcaagtactggatctacgtgtgtggcggcatgttcttctttgtgtcctttgagggcaagatcgtgatgtacaagatcatctacatggtgctcttcctgttctgtgtggccctgtaccaggtgcactatgagtggtggaggaagatcctgaagtacttctggatgtctgtggtgatctacaccatgctggtgctgatcttcatctacacctaccagtttgagaacttccctggcctgtggcagaacatgacaggcctgaagaaggagaagctggaggacctgggcctgaagcagttcaccgtggccgagctgttcacccgcatcttcatccccaccagcttcctgctggtgtgcatcctgcacctgcactacttccatgaccgcttcctggagctgacagacctgaagagcatccccagcaaagaagacaacaccatctaccgcctggcccaccctgagggcagcctgcctgacctgaccatgatgcacctgacagccagcctggagaagccagaggtgaggaagctggccgagcccggggaggagaagctggagggctacagcgagaaggcccagaagggggacctgggcaaggacagcgaggagagcgaggaggatggagaggaggaggaggagagcgaggaggaggaggagaccagtgacctgaggaacaagtggcacctggtgattgaccggctgactgtgctcttcctgaagttcctggagtacttccacaagctgcaggtgttcatgtggtggatcctggagctgcacatcatcaagatcgtgagcagctacatcatctgggtgtctgtgaaggaggtgtccctcttcaactacgtgttcctgatctcctgggcctttgccctgccctatgccaagctgcggcggctggccagctctgtgtgcaccgtgtggacctgtgtgatcatcgtgtgcaagatgctgtaccagctgcagaccatcaagccagagaacttctctgtgaactgcagcctgcccaatgaaaaccagaccaacatccccttcaatgagctgaacaagagcctgctgtacagcgcccccatcgaccccacagagtgggtgggcctgaggaagagcagccccctgctggtgtacctgaggaacaacctgctgatgctggccatcctggcctttgaggtgaccatctaccgccaccaggagtactaccggggcaggaacaacctgacagcccctgtgtccaggaccatcttccatgacatcacccggctgcacctggatgatggcctcatcaactgtgccaagtacttcatcaactacttcttctacaagtttggcctggagacctgcttcctgatgtctgtgaatgtgattggccagaggatggacttctacgccatgatccacgcctgctggctgattgctgtgctgtacagaagaagaaggaaggccatcgccgagatctggcccaagtactgctgcttcctggcctgcatcatcaccttccagtacttcatctgcatcggcatccccccagccccctgccgggactacccctggaggttcaagggggccagcttcaatgacaacatcatcaagtggctgtacttcccagacttcatcgtgcggcccaaccctgtgttcctggtgtatgacttcatgctgctgctgtgtgccagcctgcagaggcagatctttgaagatgagaacaaggctgctgtgcgcatcatggccggggacaacgtggagatctgcatgaacctggatgctgccagcttcagccagcacaaccctgtgcctgacttcatccactgccgcagctacctggacatgagcaaggtgatcatcttctcctacctgttctggtttgtgctgaccatcatcttcatcaccggcaccacccgcatcagcatcttctgcatgggctacctggtggcctgcttctacttcctgctgtttggaggagacctgctgctgaagcccatcaagagcatcctgcgctactgggactggctgattgcctacaacgtgtttgtgatcaccatgaagaacatcctgagcattggagcctgtggctacatcggcaccctggtgcacaacagctgctggctgatccaggccttcagcctggcctgcaccgtgaagggctaccagatgcctgctgccaacagcccctgcaccctgcccagcggggaggccggcatcatctgggacagcatctgctttgccttcctgctgctgcagaggagggtcttcatgagctactacttcctgcacgtggtggccgacatcaaggccagccagatcctggccagcagaggagctgagctgttccaggccaccatcgtgaaggctgtgaaggccagaattgaggaggagaagaagtccatggaccagctgaagaggcagatggaccgcatcaaggcccggcagcagaagtacaagaagggcaaggagaggatgctgagcctgacccaggagcctggagagggccaggacatgcagaagctgtctgaagaagatgatgagcgggaggccgacaagcagaaggccaagggcaagaagaagcagtggtggaggccctgggtggaccacgcctccatggtgcgcagcggggactactacctgtttgaaacagacagcgaggaggaggaggaggaggagctgaagaaggaggatgaggagcccccaagaagaagtgccttccagtttgtgtaccaggcctggatcacagaccccaagacagccctgcggcagaggcacaaggagaagaagaggtctgcccgggaggagaggaagagaagaaggaagggcagcaaggagggccctgtggagtgggaggacagagaagatgagcccatcaagaagaagagtgatggccctgacaacatcatcaagaggatcttcaacatcctgaagttcacctgggtgctcttcctggccaccgtggacagcttcaccacctggctgaacagcatcagccgggagcacatcgacatcagcacagtgctgagaattgagcgctgcatgctgacccgggagatcaagaagggaaatgtgcccacccgggagagcatccacatgtactaccagaaccacatcatgaacctgagccgggagagcggcctggacaccattgatgagcaccctggagctgccagcggggcccagacagcccacaggatggacagcctggacagccatgacagcatcagcagcgagcccacccagtgcaccatgctgtacagccggcagggcaccacagagaccatcgaggaggtggaggccgagcaggaggaggaggccggcagcacagcccctgagccccgggaggccaaggagtatgaggccaccggctatgatgtgggcgccatgggcgctgaggaggccagcctgaccccagaggaggagctgacccagttcagcaccctggatggagatgtggaggccccacccagctacagcaaggctgtgtcctttgagcacctgagctttggcagccaggatgacagcgctgggaagaacaggatggctgtgtccccagatgacagcaggacagacaagctgggcagcagcatcctgccccccctgacccatgagctgacagccagcgagctgctgctgaagaagatgtttcatgatgatgagctggaggagagcgagaagttctacgtgggccagccccgcttcctgctgctcttctacgccatgtacaacaccctggtggcccggtctgagatggtgtgctacttcgtcatcatcctgaaccacatggtgtctgcctccatgatcaccctgctgctgcccatcctgatcttcctgtgggccatgctgtctgtgccccggcccagccgccgcttctggatgatggccatcgtgtacacagaggtggccatcgtggtgaagtacttcttccagtttggcttcttcccctggaacaagaatgtggaggtgaacaaggacaagccctaccacccccccaacatcattggagtggagaagaaggagggctacgtgctgtatgacctgatccagctgctggccctcttcttccacaggagcatcctgaagtgccacggcctgtgggatgaagatgacatgacagaaagtggcatggcccgggaggagagtgatgatgagctgagcctgggccacggccggcgggacagcagtgacagcctgaagagcatcaacctggccgcctctgtggagagcgtgcacgtgaccttccctgagcagcagacagctgtgcggaggaagaggagcggcagcagcagcgagcccagccagaggagcagcttcagcagcaacagaagccagaggggcagcaccagcaccaggaacagcagccagaagggcagctctgtgctgagcatcaagcagaagggcaagcgggagctgtacatggagaagctgcaggagcacctgatcaaggccaaggccttcaccatcaagaagaccctggagatctacgtgcccatcaagcagttcttctacaacctgatccaccctgagtacagcgctgtgacagatgtgtatgtgctgatgttcctggccgacacagtggacttcatcatcatcgtgtttggcttctgggccttcggcaagcacagcgctgctgctgacatcaccagcagcctgtctgaggaccaggtgcccggccccttcctggtgatggtgctgatccagtttggcaccatggtggtggaccgggccctgtacctgaggaagacagtgctgggcaaggtgatcttccaggtgatcctggtgtttggcatccacttctggatgttcttcatcctgcccggggtgacagagaggaagttcagccagaacctggtggcccagctgtggtactttgtgaagtgtgtgtacttcggcctgagcgcctaccagatccgctgtggctaccccaccagggtgctgggcaacttcctgaccaagagctacaactacgtgaacctcttcctgttccagggcttccggctggtgcccttcctgacagagctgcgggctgtgatggactgggtgtggacagacaccaccctgagcctgagctcctggatctgtgtggaggacatctatgcccacatcttcatcctgaagtgctggagggagagcgagaagcgctacccccagccccggggccagaagaagaagaaggtggtgaagtatggcatgggcggcatgatcatcgtgctgctgatctgcatcgtgtggttccccctgctcttcatgagcctcatcaagtctgtggccggggtcatcaaccagcccctggatgtgtctgtgaccatcaccctgggcggctaccagcccatcttcaccatgtctgcccagcagagccagctgaaggtgatggaccagcagagcttcaacaagttcatccaggccttcagccgggacaccggggccatgcagttcctggagaactatgagaaggaggacatcaccgtggccgagctggagggcaacagcaacagcctgtggaccatcagcccccccagcaagcagaagatgattcatgagctgctggaccccaacagcagcttctctgtggtgttctcctggagcatccagaggaacctgagcctgggcgccaagtctgagatcgccacagacaagctgtccttccccctgaagaacatcaccaggaagaacatcgccaagatgattgctggcaacagcacagagagcagcaagacccctgtgaccatcgagaagatctacccctactacgtgaaggcccccagcgacagcaacagcaagcccatcaagcagctgctgtctgagaacaacttcatggacatcaccatcatcctgagccgggacaacaccaccaagtacaacagcgagtggtgggtgctgaacctgaccggcaaccgcatctacaaccccaacagccaggccctggagctggtggtgttcaatgacaaggtgtccccacccagcctgggcttcctggccggctacggcatcatgggcctgtatgcctctgtggtgctggtgattggcaagtttgtgcgggagttcttcagcggcatcagccacagcatcatgtttgaggagctgcccaacgtggaccgcatcctgaagctgtgcacagacatcttcctggtgcgggagaccggggagctggagctggaggaggacctgtatgccaagctgatcttcctgtaccgcagccctgagaccatgatcaagtggacccgggagaagaccaactag

SEQ ID NO: 164261 - DNA, 1692 bp, Artificial Sequence
  Description of Artificial Sequence: Synthetic coding sequence
atgtctgtggtgatctacaccatgctggtgctgatcttcatctacacctaccagtttgagaacttccctggcctgtggcagaacatgacaggcctgaagaaggagaagctggaggacctgggcctgaagcagttcaccgtggccgagctgttcacccgcatcttcatccccaccagcttcctgctggtgtgcatcctgcacctgcactacttccatgaccgcttcctggagctgacagacctgaagagcatccccagcaaggaggacaacaccatctacagccacgccaaggtgaatggccgggtgtacctgatcatcaacagcatcaagaagaagctgcccatccaccagaatgagctggcccaccctgagggcagcctgcctgacctgaccatgatgcacctgacagccagcctggagaagccagaggtgaggaagctggccgagcccggggaggagaagctggagggctacagcgagaaggcccagaagggggacctgggcaaggacagcgaggagagcgaggaggatggagaggaggaggaggagagcgaggaggaggaggagaccagtgacctgaggaacaagtggcacctggtgattgaccggctgactgtgctcttcctgaagttcctggagtacttccacaagctgcaggtgttcatgtggtggatcctggagctgcacatcatcaagatcgtgagcagctacatcatctgggtgtctgtgaaggaggtgtccctcttcaactacgtgttcctgatctcctgggcctttgccctgccctatgccaagctgcggcggctggccagctctgtgtgcaccgtgtggacctgtgtgatcatcgtgtgcaagatgctgtaccagctgcagaccatcaagccagagaacttctctgtgaactgcagcctgcccaatgaaaaccagaccaacatccccttcaatgagctgaacaagagcctgctgtacagcgcccccatcgaccccacagagtgggtgggcctgaggaagagcagccccctgctggtgtacctgaggaacaacctgctgatgctggccatcctggcctttgaggtgaccatctaccgccaccaggagtactaccggggcaggaacaacctgacagcccctgtgtccaggaccatcttccatgacatcacccggctgcacctggatgatggcctcatcaactgtgccaagtacttcatcaactacttcttctacaagtttggcctggagacctgcttcctgatgtctgtgaatgtgattggccagaggatggacttctacgccatgatccacgcctgctggctgattgctgtgctgtacagaagaagaaggaaggccatcgccgagatctggcccaagtactgctgcttcctggcctgcatcatcaccttccagtacttcatctgcatcggcatccccccagccccctgccgggactacccctggaggttcaagggggccagcttcaatgacaacatcatcaagtggctgtacttcccagacttcatcgtgcggcccaaccctgtgttcctggtgtatgacttcatgctgctgctgtgtgccagcctgcagaggcagatctttgaagatgagaacaaggctgctgtgcgcatcatggccggggacaacgtggagatctgcatgaacctggatgctgccagcttcagccagcacaacccctag

SEQ ID NO: 164262 - DNA, 1941 bp, Artificial Sequence
  Description of Artificial Sequence: Synthetic coding sequence
atgacagagagcggcatggcccgggaggagagtgatgatgagctgagcctgggccatggaagaagagacagcagtgacagcctgaagagcatcaacctggccgcctctgtggagagcgtgcacgtgaccttccctgagcagcagacagctgtgcggaggaagaggagcggcagcagcagcgagcccagccagaggagcagcttcagcagcaacagaagccagaggggcagcaccagcaccaggaacagcagccagaagggcagctctgtgctgagcatcaagcagaagggcaagcgggagctgtacatggagaagctgcaggagcacctgatcaaggccaaggccttcaccatcaagaagaccctggagatctacgtgcccatcaagcagttcttctacaacctgatccaccctgagtacagcgctgtgacagatgtgtatgtgctgatgttcctggccgacacagtggacttcatcatcatcgtgtttggcttctgggccttcggcaagcacagcgctgctgctgacatcaccagcagcctgtctgaggaccaggtgcccggccccttcctggtgatggtgctgatccagtttggcaccatggtggtggaccgggccctgtacctgaggaagacagtgctgggcaaggtgatcttccaggtgatcctggtgtttggcatccacttctggatgttcttcatcctgcccggggtgacagagaggaagttcagccagaacctggtggcccagctgtggtactttgtgaagtgtgtgtacttcggcctgagcgcctaccagatccgctgtggctaccccaccagggtgctgggcaacttcctgaccaagagctacaactacgtgaacctcttcctgttccagggcttccggctggtgcccttcctgacagagctgcgggctgtgatggactgggtgtggacagacaccaccctgagcctgagctcctggatctgtgtggaggacatctatgcccacatcttcatcctgaagtgctggagggagagcgagaagcccatcttcaccatgtctgcccagcagagccagctgaaggtgatggaccagcagagcttcaacaagttcatccaggccttcagccgggacaccggggccatgcagttcctggagaactatgagaaggaggacatcaccgtggccgagctggagggcaacagcaacagcctgtggaccatcagcccccccagcaagcagaagatgattcatgagctgctggaccccaacagcagcttctctgtggtgttctcctggagcatccagaggaacctgagcctgggcgccaagtctgagatcgccacagacaagctgtccttccccctgaagaacatcaccaggaagaacatcgccaagatgattgctggcaacagcacagagagcagcaagacccctgtgaccatcgagaagatctacccctactacgtgaaggcccccagcgacagcaacagcaagcccatcaagcagctgctgtctgagaacaacttcatggacatcaccatcatcctgagccgggacaacaccaccaagtacaacagcgagtggtgggtgctgaacctgaccggcaaccgcatctacaaccccaacagccaggccctggagctggtggtgttcaatgacaaggtgtccccacccagcctgggcttcctggccggctacggcatcatgggcctgtatgcctctgtggtgctggtgattggcaagtttgtgcgggagttcttcagcggcatcagccacagcatcatgtttgaggagctgcccaacgtggaccgcatcctgaagctgtgcacagacatcttcctggtgcgggagaccggggagctggagctggaggaggacctgtatgccaagctgatcttcctgtaccgcagccctgagaccatgatcaagtggacccgggagaagaccaactag

SEQ ID NO: 164263 - DNA, 2130 bp, Artificial Sequence
  Description of Artificial Sequence: Synthetic coding sequence
atgacagagagcggcatggcccgggaggagagtgatgatgagctgagcctgggccatggaagaagagacagcagtgacagcctgaagagcatcaacctggccgcctctgtggagagcgtgcacgtgaccttccctgagcagcagacagctgtgcggaggaagaggagcggcagcagcagcgagcccagccagaggagcagcttcagcagcaacagaagccagaggggcagcaccagcaccaggaacagcagccagaagggcagctctgtgctgagcatcaagcagaagggcaagcgggagctgtacatggagaagctgcaggagcacctgatcaaggccaaggccttcaccatcaagaagaccctggagatctacgtgcccatcaagcagttcttctacaacctgatccaccctgagtacagcgctgtgacagatgtgtatgtgctgatgttcctggccgacacagtggacttcatcatcatcgtgtttggcttctgggccttcggcaagcacagcgctgctgctgacatcaccagcagcctgtctgaggaccaggtgcccggccccttcctggtgatggtgctgatccagtttggcaccatggtggtggaccgggccctgtacctgaggaagacagtgctgggcaaggtgatcttccaggtgatcctggtgtttggcatccacttctggatgttcttcatcctgcccggggtgacagagaggaagttcagccagaacctggtggcccagctgtggtactttgtgaagtgtgtgtacttcggcctgagcgcctaccagatccgctgtggctaccccaccagggtgctgggcaacttcctgaccaagagctacaactacgtgaacctcttcctgttccagggcttccggctggtgcccttcctgacagagctgcgggctgtgatggactgggtgtggacagacaccaccctgagcctgagctcctggatctgtgtggaggacatctatgcccacatcttcatcctgaagtgctggagggagagcgagaagcgctacccccagccccggggccagaagaagaagaaggtggtgaagtatggcatgggcggcatgatcatcgtgctgctgatctgcatcgtgtggttccccctgctcttcatgagcctcatcaagtctgtggccggggtcatcaaccagcccctggatgtgtctgtgaccatcaccctgggcggctaccagcccatcttcaccatgtctgcccagcagagccagctgaaggtgatggaccagcagagcttcaacaagttcatccaggccttcagccgggacacaggagccatgcagttcctggagaactatgagaaggaggacatcaccgtggccgagctggagggcaacagcaacagcctgtggaccatcagcccccccagcaagcagaagatgatccacgagctgctggaccccaacagcagcttctctgtggtgttctcctggagcatccagaggaacctgagcctgggcgccaagtcagaaattgccacagacaagctgtccttccccctgaagaacatcaccaggaagaacatcgccaagatgattgctggcaacagcacagagagcagcaagacccctgtgaccatcgagaagatctacccctactacgtgaaggcccccagcgacagcaacagcaagcccatcaagcagctgctgtctgagaacaacttcatggacatcaccatcatcctgagccgggacaacaccaccaagtacaacagcgagtggtgggtgctgaacctgactggaaaccgcatctacaaccccaacagccaggccctggagctggtggtgttcaatgacaaggtgagcccccccagcctgggcttcctggccggctacggcatcatgggcctgtatgcctctgtggtgctggtgattggcaagtttgtgcgggagttcttcagcggcatcagccacagcatcatgtttgaggagctgcccaacgtggaccgcatcctgaagctgtgcacagacatcttcctggtgcgggagactggagagctggagctggaggaggacctgtatgccaagctgatcttcctgtaccgcagccctgagaccatgatcaagtggacccgggagaagaccaactag

SEQ ID NO: 164264 - DNA, 2565 bp, Artificial Sequence
  Description of Artificial Sequence: Synthetic coding sequence
atggccctgcggctggtggccgactttgacctgggcaaggatgtgctgccctggctgcgggcccagagagctgtgtctgaggccagcggggccggcagcggcggcgcagatgtgctggagaatgactatgagagcctgcacgtgctgaatgtggagagaaatggaaacatcatctacacctacaaggatgacaagggaaatgtggtgtttggcctgtatgactgccagacccggcagaatgagctgctgtacacctttgagaaggacctgcaggtgttcagctgcagcgtgaacagcgagaggaccctgctggccgccagcctggtgcagagcaccaaggagggcaagagaaatgagctgcagcccggcagcaagtgcctgaccctgctggtggagatccaccctgtgaacaacgtgaaggtgctgaaggctgtggacagctacatctgggtgcagttcctgtacccccacatcgagagccaccccctgcctgagaaccacctgctgctgatcagcgaggagaagtacatcgagcagttccgcatccacgtggcccaggaggatggcaacagagtggtgatcaagaacagcggccacctgccccgggacagaattgctgaagattttgtgtgggcccagtgggacatgtctgagcagaggctgtactacatcgacctgaagaagagccgcagcatcctgaagtgcatccagttctatgcagatgagagctacaacctgatgtttgaggtgcccctggacatcagcctgagcaacagcggcttcaagctggtgaactttggctgtgactaccaccagtacagagacaagttcagcaagcacctgaccctgtgtgtgttcaccaaccacacaggcagcctgtgtgtgtgctacagccccaagtgtgcctcctggggccagatcacctacagcgtcttctacatccacaagggccacagcaagaccttcaccaccagcctggagaatgtgggcagccacatgaccaagggcatcaccttcctgaacctggactactacgtggccgtgtacctgcccggccacttcttccacctgctgaatgtgcagcacccagacctgatctgccacaacctcttcctgactggaaataatgagatgattgacatgctgccccactgccccctgcagagcctgagcggcagcctggtgctggactgctgcagcggcaagctgtaccgggccctgctgagccagagcagcctgctgcagctgctgcagaacacctgcctggactgtgagaagatggccgccctgcactgtgccctgtactgcggccagggcgcccagttcctggaggcccagatcatccagtggatcagtgaaaatgtgtctgcctgccacagctttgacctgatccaggagttcatcatcgccagcagctactggagcgtgtacagcgagaccagcaacatggacaagctgctgccccacagctctgtgctgacctggaacacagagatccctggcatcaccctggtgacagaagatattgccctgcccctgatgaaggtgctgtccttcaagggctactgggagaagctgaacagcaacctggagtatgtgaagtatgccaagccccacttccactacaacaacagcgtggtgcggcgggagtggcacaacctgatcagcgaggagaagacaggcaagagaagatctgctgcctacgtgaggaacatcctggacaatgctgtgaaggtgatcagcaacctggaggccaggaacctgggcccccggctgacccccctgctgcaggaggaggacagccaccagaggctgctgatgggcctgatggtgtctgagctgaaggaccacttcctgcggcacctgcagggcgtggagaagaagaagattgagcagatggtgctggactacatcagcaagctgctggacctgatctgccacatcgtggagaccaactggaggaagcacaacctgcacagctgggtgctgcacttcaacagccggggcagcgctgctgagtttgctgtgttccacatcatgacccgcatcctggaggccaccaacagcctcttcctgcccctgcccccaggcttccacaccctgcacaccatcctgggcgtgcagtgcctgcccctgcacaacctgctgcactgcattgattctggagtgctgctgctgacagaaacagctgtgatccggctgatgaaggacctggacaacacagagaagaatgagaagctgaagttcagcatcatcgtgcggctgccccccctgattggccagaagatctgccgcctgtgggaccaccccatgagcagcaacatcatcagcaggaaccacgtgacccggctgctgcagaactacaagaagcagcccagaaattccatgatcaacaagagcagcttctctgtggagttcctgcccctgaactacttcatcgagatcctgacagacatcgagagcagcaaccaggccctgtacccctttgagggccatgacaacgtggatgctgagtttgtggaggaggccgccctgaagcacacagccatgctgctgggcctgtag

SEQ ID NO: 164265 - DNA, 528 bp, Artificial Sequence
  Description of Artificial Sequence: Synthetic coding sequence
atgacccgcatcctggaggccaccaacagcctcttcctgcccctgcccccaggcttccacaccctgcacaccatcctgggcgtgcagtgcctgcccctgcacaacctgctgcactgcatcgacagcggcgtgctgctgctgacagaaacagctgtgatccggctgatgaaggacctggacaacacagagaagaatgagaagctgaagttcagcatcatcgtgcggctgcccccactcatcggccagaagatctgccgcctgtgggaccaccccatgagcagcaacatcatcagcagaaatcatgtgacccggctgctgcagaactacaagaagcagcccaggaacagcatgatcaacaagagcagcttctctgtggagttcctgcccctgaactacttcatcgagatcctgacagacatcgagagcagcaaccaggccctgtacccctttgagggccatgacaacgtggatgctgagtttgtggaggaggccgccctgaagcacacagccatgctgctgggcctgtag

SEQ ID NO: 164266 - DNA, 873 bp, Artificial Sequence
  Description of Artificial Sequence: Synthetic coding sequence
atggccaaccccaagctgctgggcatgggcctgtctgaggccgaggccatcggggctgacagcgccaggtttgaggagctgctgctgcaggccagcaaggagctgcagcaggcccagaccaccaggcctgagagcacccagatccagccccagcccggcttctgcatcaagaccaacagcagcgagggcaaggtgttcatcaacatctgccacagccccagcatccccccaccagcagatgtgacagaggaggagctgctgcagatgctggaggaggaccaggccggcttccgcatccccatgagcctgggggagccccacgccgagctggatgccaagggccagggctgcacagcctatgatgtggccgtgaacagcgacttctacagaaggatgcagaacagcgacttcctgcgggagctggtgatcaccatcgcccgggagggcctggaggacaagtacaacctgcagctgaaccctgagtggaggatgatgaagaaccggcccttcatgggcagcatcagccagcagaacatccgctctgagcagaggccccgcatccaggagctgggggacctgtacaccccagcccctggccgggcagagagcggccctgagaagccccacctgaacctgtggctggaggccccagacctgctgctggccgaggtggacctgcccaagctggatggagccctgggcctgagcctggagattggagaaaatcggctggtgatgggcggcccccagcagctgtaccacctggatgcctacatccccctgcagatcaacagccatgagagcaaggccgccttccacaggaagaggaagcagctgatggtggccatgcccctgctgcctgtgcccagctag

SEQ ID NO: 164267 - DNA, 942 bp, Artificial Sequence
  Description of Artificial Sequence: Synthetic coding sequence
atgctgctgagcaagatcaacagcctggcccacctgcgggccgccccctgcaatgacctgcacgccaccaagctggcccctgggaaggagaaggagcccctggagagccagtaccaggtgggccccctgctgggcagcggcggctttggatctgtgtacagcggcatccgggtgtctgacaacctgcctgtggccatcaagcacgtggagaaggaccgcatcagtgactggggcgagctgcccaacggcaccagggtgcccatggaggtggtgctgctgaagaaggtgagcagcggcttctctggagtcatccggctgctggactggtttgagaggccagacagctttgtgctgatcctggagaggcctgagcctgtgcaggacctgtttgacttcatcacagagcggggggccctgcaggaggagctggcccggagcttcttctggcaggtgctggaggccgtgcgccactgccacaactgtggggtgctgcaccgggacatcaaggatgagaacatcctgattgacctgaacagaggagagctgaagctgattgactttggaagtggggccctgctgaaggacacagtgtacacagactttgatggcaccagggtgtacagccccccagagtggatccgctaccaccgctaccacggccgctctgctgctgtgtggagcctgggcatcctgctgtatgacatggtgtgtggggacatcccctttgaacatgatgaggagatcatccggggccaggtgttcttccggcagagggtgtcctctgagtgccagcacctgatccgctggtgcctggccctgcggcccagcgaccggcccacctttgaggagatccagaaccacccctggatgcaggatgtgctgctgccccaggagacagctgagatccacctgcacagcctgagccctggccccagcaagtag

SEQ ID NO: 164268 - DNA, 936 bp, Artificial Sequence
  Description of Artificial Sequence: Synthetic coding sequence
atgctgaccaagcccctgcagggccccccagcccctcctggcacccccaccccacctcctgggggcaaggaccgggaggcctttgaggccgagtaccgcctgggccccctgctgggcaagggcggctttggaacagtgtttgctggccaccggctgacagaccggctgcaggtggccatcaaggtgatccccaggaacagagtgctgggctggagccccctgagtgacagcgtgacctgccccctggaggtggccctgctgtggaaggtgggcgctgggggcggccaccctggggtcatccggctgctggactggtttgagacccaggagggcttcatgctggtgctggagcggcccctgcctgcccaggacctgtttgactacatcacagagaagggccccctgggggagggccccagccgctgcttcttcggccaggtggtggccgccatccagcactgccacagccggggcgtggtgcaccgggacatcaaggatgagaacatcctgattgacctgcggcggggctgtgccaagctgattgactttggaagtggggccctgctgcatgatgagccctacacagactttgatggcaccagggtgtacagccccccagagtggatcagccgccaccagtaccacgccctgcctgccaccgtgtggagcctgggcatcctgctgtatgacatggtgtgtggggacatcccctttgagcgggaccaggagatcctggaggccgagctgcacttccctgcccacgtgtccccagactgctgtgccctgatccgccgctgcctggcccccaagcccagcagccggcccagcctggaggagatcctgctggacccctggatgcagaccccagcagaagatgtgcccctgaaccccagcaaaggaggccctgcccccctggcctggagcctgctgccctag

SEQ ID NO: 164269 - DNA, 438 bp, Artificial Sequence
  Description of Artificial Sequence: Synthetic coding sequence
atgctggtgctggagcggcccctgcctgcccaggacctgtttgactacatcacagagaagggccccctgggggagggccccagccgctgcttcttcggccaggtggtggccgccatccagcactgccacagccggggcgtggtgcaccgggacatcaaggatgagaacatcctgattgacctgcggcggggctgtgccaagctgattgactttggaagtggggccctgctgcatgatgagccctacacagactttgatggcaccagggtgtacagccccccagagtggatcagccgccaccagtaccacgccctgcctgccaccgtgtggagcctgggcatcctgctgtatgacatggtgtgtggggacatcccctttgagcgggaccaggagatcctggaggccgagctgcacttccctgcccacgtgagcccctag

SEQ ID NO: 164270 - DNA, 2925 bp, Artificial Sequence
  Description of Artificial Sequence: Synthetic coding sequence
atggccaaggccggccgggccggcggccccccacctgggggcggggccccctggcacctgagaaatgtgctgagtgacagcgtggagagcagtgatgatgagttctttgatgcccgggaggagatggccgagggcaagaatgccatcctgattggcatgagccagtggaacagcaatgacctggtggagcagatcgagaccatgggcaagctggatgagcaccagggcgagggcacagccccctgcaccagcagcatcctgcaggagaagcagcgggagctgtacagagtgtccctgcggcggcagcgcttccctgcccagggcagcattgagatccacgaggacagcgaggagggctgcccccagaggagctgcaagacccacgtgctgctgctggtgctgcatggaggcaacatcctggacaccggggccggggaccccagctgcaaggctgctgacatccacaccttcagctctgtgctggagaaggtgacccgggcccacttccctgctgccctgggccacatcctgatcaagtttgtgccctgcccagccatctgcagcgaggccttcagcctggtgagccacctgaacccctacagccatgatgagggctgcctgagcagcagccaggaccacgtgcccctggccgccctgcccctgctggccatcagcagcccccagtaccaggatgctgtggccaccgtgattgagcgggccaaccaggtgtaccgggagttcctgaagagcagtgatggcatcggcttcagcggccaggtgtgcctgattggagactgtgtgggcggcctgctggcctttgatgccatctgctacagcgctggccccagcggggacagccctgccagcagcagcaggaagggcagcatcagcagcacccaggacacccctgtggccgtggaggaggactgcagcctggccagcagcaagaggctgagcaagagcaacatcgacatcagcagcggcctggaggatgaggagcccaagaggcccctgcccaggaagcagagcgacagcagcacctatgactgtgaggccatcacccagcaccacgccttcctgagcagcatccacagctctgtgctgaaggatgagagcgagaccccagctgctgggggcccccagctgcctgaggtgtccctgggccgctttgattttgatgtgtctgacttcttcctgtttggcagccccctgggcctggtgctggccatgagaagaacagtgctgcccggcctggatggcttccaggtgcggcctgcctgcagccaggtgtacagcttcttccactgtgccgaccccagcgccagccggctggagcccctgctggagcccaagttccacctggtgccccctgtgtctgtgccccgctaccagcgcttccccctgggagatggccagagcctgctgctggctgatgccctgcacacccacagccccctcttcctggagggcagcagccgggacagcccccccctgctggatgccccagccagccccccccaggccagccgcttccagaggcctggccgcaggatgtctgagggcagcagccacagcgagagcagcgagagcagtgacagcatggcccctgtgggcgccagccgcatcacagccaagtggtggggcagcaagagaattgattatgccctgtactgcccagatgtgctgacagccttccccaccgtggccctgccccacctgttccacgccagctactgggagagcacagatgtggtggccttcatcctgcggcaggtgatgagatatgaatctgtgaacatcaaggagagcgcccggctggaccctgctgccctgagccctgccaacccccgggagaagtggctgaggaagaggacccaggtgaagctgagaaatgtgacagccaaccaccgggccaatgatgtgattgctgctgaagatggcccccaggtgctggtgggccgcttcatgtatggccccctggacatggtggccctgaccggggagaaggtggacatcctggtgatggccgagcccagcagcggccgctgggtgcacctggacacagagatcaccaacagcagcggccgcatcacctacaacgtgccccggccccggcggctgggcgtgggcgtgtaccctgtgaagatggtggtgcggggggaccagacctgtgccatgagctacctgactgtgctgccccggggcatggagtgtgtggtgttcagcattgatggcagctttgctgcctctgtgtccatcatgggcagtgaccccaaggtgcggcctggagctgtggatgtggtgcgccactggcaggacctgggctacatgatcctgtacatcaccggccgcccagacatgcagaagcagagggtggtgtcctggctgagccagcacaacttcccccagggcatgatcttcttcagtgatggcctggtgcatgaccccctgcggcagaaggccatcttcctgaggaacctgatgcaggagtgcttcatcaagatctctgctgcctacggcagcaccaaggacatctctgtgtacagcgtgctgggcctgcctgccagccagatcttcatcgtgggccggcccaccaagaagtaccagacccagtgccagttcctgtctgagggctacgccgcccacctggccgccctggaggccagccacaggagccggcccaagaagaacaacagcaggatgatcctgaggaagggcagctttggcctgcacgcccagcctgagttcctgaggaagaggaaccacctgcggaggaccatgtctgtgcagcagcctgaccccccagctgccaaccccaagccagagcgggcccagagccagcctgagagtgacaaggaccacgagcggcccctgcctgccctgtcctgggcccggggcccccccaagtttgagagcgtgccctag

SEQ ID NO: 164271 - DNA, 2817 bp, Artificial Sequence
  Description of Artificial Sequence: Synthetic coding sequence
atggccaaggccggccgggccggcggccccccacctgggggcggggccccctggcacctgagaaatgtgctgagtgacagcgtggagagcagtgatgatgagttctttgatgcccggggggagggcacagccccctgcaccagcagcatcctgcaggagaagcagcgggagctgtacagagtgtccctgcggcggcagcgcttccctgcccagggcagcattgagatccacgaggacagcgaggagggctgcccccagaggagctgcaagacccacgtgctgctgctggtgctgcatggaggcaacatcctggacaccggggccggggaccccagctgcaaggctgctgacatccacaccttcagctctgtgctggagaaggtgacccgggcccacttccctgctgccctgggccacatcctgatcaagtttgtgccctgcccagccatctgcagcgaggccttcagcctggtgagccacctgaacccctacagccatgatgagggctgcctgagcagcagccaggaccacgtgcccctggccgccctgcccctgctggccatcagcagcccccagtaccaggatgctgtggccaccgtgattgagcgggccaaccaggtgtaccgggagttcctgaagagcagtgatggcatcggcttcagcggccaggtgtgcctgattggagactgtgtgggcggcctgctggcctttgatgccatctgctacagcgctggccccagcggggacagccctgccagcagcagcaggaagggcagcatcagcagcacccaggacacccctgtggccgtggaggaggactgcagcctggccagcagcaagaggctgagcaagagcaacatcgacatcagcagcggcctggaggatgaggagcccaagaggcccctgcccaggaagcagagcgacagcagcacctatgactgtgaggccatcacccagcaccacgccttcctgagcagcatccacagctctgtgctgaaggatgagagcgagaccccagctgctgggggcccccagctgcctgaggtgtccctgggccgctttgattttgatgtgtctgacttcttcctgtttggcagccccctgggcctggtgctggccatgagaagaacagtgctgcccggcctggatggcttccaggtgcggcctgcctgcagccaggtgtacagcttcttccactgtgccgaccccagcgccagccggctggagcccctgctggagcccaagttccacctggtgccccctgtgtctgtgccccgctaccagcgcttccccctgggagatggccagagcctgctgctggctgatgccctgcacacccacagccccctcttcctggagggcagcagccgggacagcccccccctgctggatgccccagccagccccccccaggccagccgcttccagaggcctggccgcaggatgtctgagggcagcagccacagcgagagcagcgagagcagtgacagcatggcccctgtgggcgccagccgcatcacagccaagtggtggggcagcaagagaattgattatgccctgtactgcccagatgtgctgacagccttccccaccgtggccctgccccacctgttccacgccagctactgggagagcacagatgtggtggccttcatcctgcggcaggtgatgagatatgaatctgtgaacatcaaggagagcgcccggctggaccctgctgccctgagccctgccaacccccgggagaagtggctgaggaagaggacccaggtgaagctgagaaatgtgacagccaaccaccgggccaatgatgtgattgctgctgaagatggcccccaggtgctggtgggccgcttcatgtatggccccctggacatggtggccctgaccggggagaaggtggacatcctggtgatggccgagcccagcagcggccgctgggtgcacctggacacagagatcaccaacagcagcggccgcatcacctacaacgtgccccggccccggcggctgggcgtgggcgtgtaccctgtgaagatggtggtgcggggggaccagacctgtgccatgagctacctgactgtgctgccccggggcatggagtgtgtggtgttcagcattgatggcagctttgctgcctctgtgtccatcatgggcagtgaccccaaggtgcggcctggagctgtggatgtggtgcgccactggcaggacctgggctacatgatcctgtacatcaccggccgcccagacatgcagaagcagagggtggtgtcctggctgagccagcacaacttcccccagggcatgatcttcttcagtgatggcctggtgcatgaccccctgcggcagaaggccatcttcctgaggaacctgatgcaggagtgcttcatcaagatctctgctgcctacggcagcaccaaggacatctctgtgtacagcgtgctgggcctgcctgccagccagatcttcatcgtgggccggcccaccaagaagtaccagacccagtgccagttcctgtctgagggctacgccgcccacctggccgccctggaggccagccacaggagccggcccaagaagaacaacagcaggatgatcctgaggaagggcagctttggcctgcacgcccagcctgagttcctgaggaagaggaaccacctgcggaggaccatgtctgtgcagcagcctgaccccccagctgccaaccccaagccagagcgggcccagagccagcctgagagtgacaaggaccacgagcggcccctgcctgccctgtcctgggcccggggcccccccaagtttgagagcgtgccctag

SEQ ID NO: 164272 - DNA, 609 bp, Artificial Sequence
  Description of Artificial Sequence: Synthetic coding sequence
atggccaccctcatctacgtggacaaggaaaatggagagcccggcaccagggtggtggccaaggatggcctgaagctgggcagcggccccagcatcaaggccctggatggccgcagccaggtgtccacccccaggtttgggaagacctttgatgcccccccagccctgcccaaggccaccaggaaggccctgggcaccgtgaacagagccacagagaagtctgtgaagaccaagggccccctgaagcagaagcagcccagcttcagcgccaagaagatgacagagaagacagtgaaggccaagagctctgtgcctgccagtgatgatgcctacccagaaattgagaagttcttccccttcaaccccctggactttgagagctttgacctgcctgaggagcaccagatcgcccacctgcccctgagcggcgtgcccctgatgatcctggatgaggagcgggagctggagaagctgttccagctgggcccccccagccctgtgaagatgcccagccccccctgggagagcaacctgctgcagagccccagcagcatcctgagcaccctggatgtggagctgccccctgtgtgctgtgacatcgacatctag

SEQ ID NO: 164273 - DNA, 609 bp, Artificial Sequence; identical to SEQ ID NO: 164272
  Description of Artificial Sequence: Synthetic coding sequence

SEQ ID NO: 164274 - DNA, 609 bp, Artificial Sequence; identical to SEQ ID NO: 164272
  Description of Artificial Sequence: Synthetic coding sequence

SEQ ID NO: 164275 - DNA, 543 bp, Artificial Sequence
  Description of Artificial Sequence: Synthetic coding sequence
atggcccctggggtggcccggggccccaccccctactggaggctgcggctgggcggggccgccctgctgctgctgctgatccctgtggccgccgcccaggagcccccaggggccgcctgcagccagaacaccaacaagacctgtgaggagtgcctgaagaatgtgtcctgcctgtggtgcaacaccaacaaggcctgcctggactaccctgtgacctctgtgctgcccccagccagcctgtgcaagctgagcagcgcccgctggggcgtgtgctgggtgaactttgaggccctgatcatcaccatgtctgtggtgggcggcaccctgctgctgggcatcgccatctgctgctgctgctgctgcaggaggaagaggagcaggaagccagacagaagtgaggagaaggccatgagggagcgggaggagcggcgcatccggcaggaggagcggcgggcagagatgaagaccaggcatgatgagatcaggaagaagtatggcctcttcaaggaggagaacccctatgccaggtttgagaacaactag

SEQ ID NO: 164276 - DNA, 429 bp, Artificial Sequence
  Description of Artificial Sequence: Synthetic coding sequence
atggcccctggggtggcccggggccccaccccctactggaggctgcggctgggcggggccgccctgctgctgctgctgatccctgtggccgccgcccaggagcccccaggggccgcctgcagccagaacaccaacaagacctgtgaggagtgcctgaagaatgtgtctgcctgcctgaagaagaagaccaggatgctggacctgaagaccaccaaggccctgcagcacatcagcccagatgccagctgtgaggtgcacgccccccagcccagccctgctggccggccccggggccactgcggcctgctgaccctggccagcgagcccgccagcctgcccggccaggccgccggggagctgcccctgaaggacagccccctggtgctgcagacaggagacctgctcttccctgtgcacctgtgcttctag

SEQ ID NO: 164277 - DNA, 576 bp, Artificial Sequence
  Description of Artificial Sequence: Synthetic coding sequence
atggccaccctcatctacgtggacaaggagattggagagcccggcaccagggtggccgccaaggatgtgctgaagctggagagccggcccagcatcaaggccctggatggcatcagccaggtgctgaccaggagatttgggaagacctatgatgcccccagcgccctgcccaaggccaccaggaaggccctgggcaccgtgaacagagccacagagaagtctgtgaagaccaacggccccaggaagcagaagcagcccagcttcagcgccaagaagatgacagagaagacagtgaagaccaagagctctgtgcctgccagtgatgatgcctacccagaaattgagaagttcttccccttcaacctgctggactttgagagctttgacctgcctgaggagcggcagatcgcccacctgcccctgagcggcgtgcccctgatgatcctggatgaggagggggagctggagaagctgttccagctgggcccccccagccctgtgaagatgcccagccccccctgggagtgcaacctgtttgctgtgtccttcaagcacagcgtggaccccggctgctag

SEQ ID NO: 164278 - DNA, 2586 bp, Artificial Sequence
  Description of Artificial Sequence: Synthetic coding sequence
atgacaggccgggcccgggcccgggcccggggccgggcccggggccaggagacagcccagctggtgggcagcacagccagccagcagcccggctacatccagccccggccccagcccccacctgctgagggggagctgtttggccggggccggcagaggggcacagctgggggcacagccaagagccagggcctgcagatctctgctggcttccaggagctgagcctggccgagcggggcggcagaagaagagacttccatgacctgggcgtgaacacccggcagaacctggaccacgtgaaggagagcaagacaggcagcagcggcatcatcgtgcggctgagcaccaaccacttccggctgaccagccggccccagtgggccctgtaccagtaccacatcgactacaaccccctgatggaggcccggcggctgcggagcgccctgctcttccagcacgaggacctgattggaaaatgtcatgcctttgatggcaccatcctcttcctgcccaagaggctgcagcagaaggtgacagaggtgttcagcaagaccagaaatggagaagatgtgcgcatcaccatcaccctgaccaatgagctgccccccaccagccccacctgcctgcagttctacaacatcatcttccggcggctgctgaagatcatgaacctgcagcagatcggcaggaactactacaaccccaatgaccccatcgacatccccagccaccggctggtgatctggccaggcttcaccaccagcatcctgcagtatgagaacagcatcatgctgtgcacagatgtgagccacaaggtgctgcggtctgagaccgtgctggacttcatgttcaacttctaccaccagacagaggagcacaagttccaggagcaggtgtccaaggagctgattggcctggtggtgctgaccaagtacaacaacaagacctacagagtggatgacatcgactgggaccagaaccccaagagcaccttcaagaaggcagatggcagcgaggtgtccttcctggagtactacaggaagcagtacaaccaggagatcacagacctgaagcagcctgtgctggtgtcccagcccaagagaagaagaggccctgggggcaccctgcccggccctgccatgctgatccctgagctgtgctacctgaccggcctgacagacaagatgagaaatgacttcaacgtgatgaaggacctggccgtgcacacccggctgaccccagagcagaggcagcgggaggtgggccgcctgattgactacatccacaagaatgacaacgtgcagcgggagctgcgggactggggcctgagctttgacagcaacctgctgtccttcagcggccgcatcctgcagacagagaagatccaccagggcggcaagacctttgactacaacccccagtttgctgactggagcaaggagaccaggggggcccccctcatctctgtgaagcccctggacaactggctgctgatctacaccaggagaaattatgaagctgccaacagcctcatccagaacctcttcaaggtgaccccagccatgggcatgcagatgaggaaggccatcatgattgaggtggatgacagaacagaggcctacctgcgggtgctgcagcagaaggtgacagctgacacccagatcgtggtgtgcctgctgagcagcaacaggaaggacaagtatgatgccatcaagaagtacctgtgcacagactgccccacccccagccagtgtgtggtggcccggaccctgggcaagcagcagacagtgatggccatcgccaccaagatcgccctgcagatgaactgcaagatgggcggggagctgtggagggtggacatccccctgaagctggtgatgattgtgggcatcgactgctaccatgacatgacagctggaagaagaagcattgctggctttgtggccagcatcaatgaaggcatgacccgctggttcagccgctgcatcttccaggaccggggccaggagctggtggatggcctgaaggtgtgcctgcaggccgccctgcgggcctggaacagctgcaatgagtacatgcccagccgcatcatcgtgtacagagatggagtgggagatggccagctgaagaccctggtgaactatgaggtgccccagttcctggactgcctgaagagcatcggccggggctacaacccccggctgaccgtcatcgtggtgaagaagagggtgaacacccgcttctttgcccagagcggcggccgcctgcagaaccccctgcccggcaccgtgattgatgtggaggtgaccaggcctgagtggtatgacttcttcatcgtgtcccaggccgtgcgcagcggctctgtgagccccacccactacaacgtcatctatgacaacagcggcctgaagccagaccacatccagaggctgacctacaagctgtgccacatctactacaactggccaggagtcatccgggtgcctgccccctgccagtatgcccacaagctggccttcctggtgggccagagcatccaccgggagcccaacctgagcctgagcaaccggctgtactacctgtag

SEQ ID NO: 164279 - DNA, 369 bp, Artificial Sequence
  Description of Artificial Sequence: Synthetic coding sequence
atgacaggccgggcccgggcccgggcccggggccgggcccggggccaggagacagcccagctggtgggcagcacagccagccagcagcccggctacatccagccccggccccagcccccacctgctgagggggagctgtttggccggggccggcagaggggcacagctgggggcacagccaagagccagggcctgcagatctctgctggcttccaggagctgagcctggccgagcggggcggcagaagaagagacttccatgacctgggcgtgaacacccggcagaacctggaccacgtgaaggagagcaagacaggcagcagcggcatcatcgtgcggctgagcaccaaccacttccggctgacctag

SEQ ID NO: 164280 - DNA, 453 bp, Artificial Sequence
  Description of Artificial Sequence: Synthetic coding sequence
atgacaggccgggcccgggcccgggcccggggccgggcccggggccaggagacagcccagctggtgggcagcacagccagccagcagcccggctacatccagccccggccccagcccccacctgctgagggggagctgtttggccggggccggcagaggggcacagctgggggcacagccaagagccagggcctgcagatctctgctggcttccaggagctgagcctggccgagcggggcggcagaagaagagacttccatgacctgggcgtgaacacccggcagaacctggaccacgtgaaggagagcaagacaggcagcagcggcatcatcgtgcggctgagcaccaaccacttccggctgaccagccggccccagtgggccctgtaccagtaccacatcgactacaaccccctgatggaggcccggcggctgcggagcgccctgctgtag

SEQ ID NO: 164281 - DNA, 519 bp, Artificial Sequence
  Description of Artificial Sequence: Synthetic coding sequence
atgacaggccgggcccgggcccgggcccggggccgggcccggggccaggagacagcccagctggtgggcagcacagccagccagcagcccggctacatccagccccggccccagcccccacctgctgagggggagctgtttggccggggccggcagaggggcacagctgggggcacagccaagagccagggcctgcagatctctgctggcttccaggagctgagcctggccgagcggggcggcagaagaagagacttccatgacctgggcgtgaacacccggcagaacctggaccacgtgaaggagagcaagacaggcagcagcggcatcatcgtgcggctgagcaccaaccacttccggctgaccagccggccccagtgggccctgtaccagtaccacatcgactacaaccccctgatggaggcccggcggctgcggagcgccctgctcttccagcacgaggacctgattggaaaatgtcatgcctttgatggcaccatcctcttcctgcccaagtag

SEQ ID NO: 164282 - DNA, 498 bp, Artificial Sequence
  Description of Artificial Sequence: Synthetic coding sequence
atgacaggccgggcccgggcccgggcccggggccgggcccggggccaggagacagcccagctggtgggcagcacagccagccagcagcccggctacatccagccccggccccagcccccacctgctgagggggagctgtttggccggggccggcagaggggcacagctgggggcacagccaagagccagggcctgcagatctctgctggcttccaggagctgagcctggccgagcggggcggcagaagaagagacttccatgacctgggcgtgaacacccggcagaacctggaccacgtgaaggagagcaagacaggcagcagcggcatcatcgtgcggctgagcaccaaccacttccggctgaccagccggccccagtgggccctgtaccagtaccacatcgactacaaccccctgatggaggcccggcggctgcggagcgccctgctcttccagcacgaggacctgattggaaaatgtcatgcctttgatggatag

SEQ ID NO: 164283 - DNA, 2922 bp, Artificial Sequence
  Description of Artificial Sequence: Synthetic coding sequence
atggaccccttccggcccagcttccggggccagagccccatccaccccagccagtgccaggccgtgaggatgcctggctgctggccccaggccagcaagcccctggaccctgccctgggccgcggggccccagctggccggggccacgtgtttgggaagccagaggagcccagcacccagaggggccctgcccagcgggagagcgtgggcctggtgtccatgttccggggcctgggcatcgagaccgtgtccaagacccccctgaagcgggagatgctgcccagcggccggggcatcctgggccggggcctgagcgccaacctggtgaggaaggaccgggaggagctgagccccaccttctgggaccccaaggtgctggccgccggggacagcaagatggccgagacctctgtgggctggagcaggaccctgggccggggcagcagtgatgccagcctgctgcccctgggccgggccgccggcggcatcagccgggaggtggacaagccaccctgcaccttcagcacccccagccggggccccccccagctgagcagccccccagccctgccccagagccccctgcacagcccagaccggcccctggtgctgactgtggagcacaaggagaaggagctgattgtgaagcagggcagcaagggcaccccccagagcctgggcctgaacctggtgaagatccagtgccacaatgaagctgtgtaccagtaccacgtgaccttcagccccaacgtggagtgcaagtccatgagatttggcatgctgaaggaccaccaggccgtgactggaaatgtgacagcctttgatggcagcatcctgtacctgcctgtgaagctgcagcaggtgctggagctgaagagccagaggaagacagattctgctgagatcagcatcaagatccagatgaccaagatcctggagccctgcagcgacctgtgcatccccttctacaacgtggtgttccggcgggtgatgaagctgctggacatgaagctggtgggcaggaacttctatgaccccaccagcgccatggtgctgcagcagcaccggctgcagatctggccaggctacgccgccagcatccggaggacagatggcggcctcttcctgctggctgatgtgagccacaaggtgatcagaaatgactgtgtgctggatgtgatgcacgccatctaccagcagaacaaggagcacttccaggatgagtgcaccaagctgctggtgggcaacatcgtcatcacccgctacaacaacagaacctacagaattgatgatgtggactggaacaagacccccaaggacagcttcaccatgtctgatggcaaggagatcaccttcctggagtactacagcaagaactacggcatcaccgtgaaggaggaggaccagcccctgctgatccaccggcccagcgagcggcaggacaaccacggcatgctgctgaagggggagatcctgctgctgcctgagctgtccttcatgacaggcatccctgagaagatgaagaaggacttccgggccatgaaggacctggcccagcagatcaacctgagccccaagcagcaccacagcgccctggagtgcctgctgcagagaattgccaagaatgaggccgccaccaatgagctgatgcgctggggcctgcggctgcagaaggatgtgcacaagattgagggccgggtgctgcccatggagcgcatcaacctgaagaacaccagcttcatcaccagccaggagctgaactgggtgaaggaggtgacccgggaccccagcatcctgaccatccccatgcacttctgggccctcttctaccccaagagggccatggaccaggcccgggagctggtgaacatgctggagaagattgctggccccatcggcatgaggatgagccccccagcctgggtggagctgaaggatgacagaattgagacctacgtgaggaccatccagagcaccctgggcgctgagggcaagatccagatggtggtgtgcatcatcatgggccccagagatgacctgtatggagccatcaagaagctgtgctgcgtgcagagccctgtgcccagccaggtggtgaatgtgaggaccatcggccagcccacccggctgcggtctgtggcccagaagatcctgctgcagatcaactgcaagctgggcggggagctgtggggcgtggacatccccctgaagcagctgatggtgattggcatggatgtgtaccatgaccccagccggggcatgaggtctgtggtgggctttgtggccagcatcaacctgaccctgaccaagtggtacagccgggtggtgttccagatgccccaccaggagatcgtggacagcctgaagctgtgcctggtgggcagcctgaagaagttctatgaggtgaaccactgcctgcctgagaagatcgtggtgtacagagatggagtgtctgatggccagctgaagacagtggccaactatgagatcccccagctgcagaagtgctttgaggcctttgagaactaccagcccaagatggtggtgtttgtggtgcagaagaagatcagcaccaacctgtacctggccgccccccagaactttgtgacccccaccccaggcaccgtggtggaccacaccatcaccagctgtgagtgggtggacttctacctgctggcccaccacgtgcggcagggctgcggcatccccacccactacgtgtgtgtgctgaacacagccaacctgagcccagaccacatgcagaggctgaccttcaagctgtgccacatgtactggaactggccaggcaccatccgggtgcctgccccctgcaagtatgcccacaagctggccttcctgagcggccacatcctgcaccacgagcccgccatccagctgtgtgagaacctcttcttcctgtag

SEQ ID NO: 164284 - DNA, 2922 bp, Artificial Sequence; identical to SEQ ID NO: 164283
  Description of Artificial Sequence: Synthetic coding sequence

SEQ ID NO: 164285 - DNA, 639 bp, Artificial Sequence
  Description of Artificial Sequence: Synthetic coding sequence
atgaaggtgttcaagttcatcggcctgatgatcctgctgaccagcgccttctctgctggcagcggccagagccccatgacagtgctgtgcagcattgactggttcatggtgacagtgcaccccttcatgctgaacaatgatgtgtgtgtgcacttccacgagctgcacctgggcctgggctgcccccccaaccacgtgcagccccacgcctaccagttcacctacagagtgacagaatgtggcatccgggccaaggctgtgtcccaggacatggtgatctacagcacagagatccactacagcagcaagggcacccccagcaagtttgtgattcctgtgtcctgtgccgccccccagaagagcccctggctgaccaagccctgcagcatgagggtggccagcaagagccgggccacagcccagaaggatgagaagtgctatgaggtgttcagcctgagccagagcagccagaggcccaactgtgactgccccccctgtgtgttttctgaggaggagcacacccaggtgccctgccaccaggccggggcccaggaggcccagcccctgcagcccagccacttcctggacatcagcgaggactggagcctgcacacagatgacatgattggctccatgtag

SEQ ID NO: 164286 - DNA, 294 bp, Artificial Sequence
  Description of Artificial Sequence: Synthetic coding sequence
atgaggcccctgctgtgtgccctgaccggcctggccctgctgcgggctgctggcagcctggccgctgctgagcccttcagcccccccaggggggacagcgcccagagcacagcctgtgacagacacatggctgtgcagaggcggctggatgtgatggaggagatggtggagaagacagtggaccacctgggcacagaggtgaagggcctgctgggcctgctggaggagctggcctggaacctgcccccaggccccttcagccctgccccagacctgctgggagatggcttctag

SEQ ID NO: 164287 - DNA, 264 bp, Artificial Sequence
  Description of Artificial Sequence: Synthetic coding sequence
atgaggcccctgctgtgtgccctgaccggcctggccctgctgcgggctgctggcagcctggccgctgctgagcccttcagcccccccaggggggacagcgcccagagcacagcctgtgacagacacatggctgtgcagaggcggctggatgtgatggaggagatggccagcgagccctggagctggagccctgctgtgggcggcggggccccagcccggcagaggccccagaaccagccctgccccctggacttcctgccctag

SEQ ID NO: 164288 - DNA, 168 bp, Artificial Sequence
  Description of Artificial Sequence: Synthetic coding sequence
atggctgtgcagaggcggctggatgtgatggaggagatggtggagaagacagtggaccacctgggcacagaggtgaagggcctgctgggcctgctggaggagctggcctggaacctgcccccaggccccttcagccctgccccagacctgctgggagatggcttctag

SEQ ID NO: 164289 - DNA, 2244 bp, Artificial Sequence
  Description of Artificial Sequence: Synthetic coding sequence
atgaaccacagccccctgaagacagccctggcctatgagtgcttccaggaccaggacaacagcaccctggccctgcccagcgaccagaagatgaagacaggcaccagcggccggcagagggtgcaggagcaggtgatgatgacagtgaagaggcagaagagcaagagcagccagagcagcaccctgagccacagcaacagaggctccatgtatgatggcctggccgacaactacaactacggcaccaccagccgcagcagctactacagcaagttccaggccggaaatggctcctggggctaccccatctacaacggcaccctgaagcgggagccagacaacagacgcttcagcagctacagccagatggagaactggagccgccactacccccggggcagctgcaacaccaccggggccggcagtgacatctgcttcatgcagaagatcaaggccagccgctctgagccagacctgtactgtgacccccggggcaccctgaggaagggcaccctgggcagcaagggccagaagaccacccagaaccgctacagcttctacagcacctgcagcggccagaaggccatcaagaagtgccctgtgcggccccccagctgtgccagcaagcaggaccctgtgtacatcccccccatcagctgcaacaaggacctgagctttggccacagccgggccagcagcaagatctgcagcgaggacattgaatgttctggcctgaccatccccaaggctgtgcagtacctgagcagccaggatgagaagtaccaggccatcggggcctactacatccagcacacctgcttccaggatgagagcgccaagcagcaggtgtaccagctgggcggcatctgcaagctggtggacctgctgcggagccccaaccagaatgtgcagcaggccgccgccggggccctgaggaacctggtgttccgcagcaccaccaacaagctggagacccggcggcagaatggcatccgggaggccgtgtccctgctgcggaggactggaaatgctgagatccagaagcagctgaccggcctgctgtggaacctgagcagcacagatgagctgaaggaggagctgattgctgatgccctgcctgtgctggccgacagagtcatcatccccttcagcggctggtgtgatggcaacagcaacatgagccgggaggtggtggaccctgaggtgttcttcaatgccaccggctgcctgaggaagaggctgggcatgagggagctgctggccctggtgccccagagggccaccagcagccgggtgaacctgagcagcgcagatgctggccggcagaccatgaggaactacagcggcctgattgacagcctgatggcctacgtgcagaactgtgtggccgccagccgctgtgatgacaagtctgtggagaactgcatgtgtgtgctgcacaacctgagctaccgcctggatgctgaggtgcccacccgctaccggcagctggagtacaatgccagaaatgcctacacagagaagagcagcacaggctgcttcagcaacaagagtgacaagatgatgaacaacaactatgactgccccctgcctgaggaggagaccaaccccaagggcagcggctggctgtaccacagtgatgccatccgcacctacctgaacctgatgggcaagagcaagaaggatgccaccctggaggcctgtgccggggccctgcagaacctgacagccagcaagggcctgatgagcagcggcatgagccagctgattggcctgaaggagaagggcctgccccagatcgcccggctgctgcagagcggcaacagtgatgtggtgcgcagcggggccagcctgctgagcaacatgagccgccaccccctgctgcaccgggtgatgggcaaccaggtgtttcctgaggtgacccggctgctgaccagccacacaggcaacaccagcaacagcgaggacatcctgagcagcgcctgctacacagtgaggaacctgatggccagccagccccagctggccaagcagtacttcagcagctccatgctgaacaacatcatcaacctgtgccgcagcagcgccagccccaaggctgctgaggccgcccggctgctgctgagtgacatgtggagcagcaaggagctgcagggcgtgctgcggcagcagggctttgacaggaacatgctgggcaccctggccggggccaacagcctgaggaacttcaccagccgcttctag

SEQ ID NO: 164290 - DNA, 2244 bp, Artificial Sequence; identical to SEQ ID NO: 164289
  Description of Artificial Sequence: Synthetic coding sequence

SEQ ID NO: 164291 - DNA, 2181 bp, Artificial Sequence
  Description of Artificial Sequence: Synthetic coding sequence
atgaaccacagccccctgaagacagccctggcctatgagtgcttccaggaccaggacaacagcaccctggccctgcccagcgaccagaagatgaagacaggcaccagcggccggcagagggtgcaggagcaggtgatgatgacagtgaagaggcagaagagcaagagcagccagagcagcaccctgagccacagcaacagaggctccatgtatgatggcctggccgacaactacaactacggcaccaccagccgcagcagctactacagcaagttccaggccggaaatggctcctggggctaccccatctacaacggcaccctgaagcgggagccagacaacagacgcttcagcagctacagccagatggagaactggagccgccactacccccggggcagctgcaacaccaccggggccggcagtgacatctgcttcatgcagaagatcaaggccagccgctctgagccagacctgtactgtgacccccggggcaccctgaggaagggcaccctgggcagcaagggccagaagaccacccagaaccgctacagcttctacagcacctgcagcggccagaaggccatcaagaagtgccctgtgcggccccccagctgtgccagcaagcaggaccctgtgtacatcccccccatcagctgcaacaaggacctgagctttggccacagccgggccagcagcaagatctgcagcgaggacattgaatgttctggcctgaccatccccaaggctgtgcagtacctgagcagccaggatgagaagtaccaggccatcggggcctactacatccagcacacctgcttccaggatgagagcgccaagcagcaggtgtaccagctgggcggcatctgcaagctggtggacctgctgcggagccccaaccagaatgtgcagcaggccgccgccggggccctgaggaacctggtgttccgcagcaccaccaacaagctggagacccggcggcagaatggcatccgggaggccgtgtccctgctgcggaggactggaaatgctgagatccagaagcagctgaccggcctgctgtggaacctgagcagcacagatgagctgaaggaggagctgattgctgatgccctgcctgtgctggccgacagagtcatcatccccttcagcggctggtgtgatggcaacagcaacatgagccgggaggtggtggaccctgaggtgttcttcaatgccaccggctgcctgaggaacctgagcagcgcagatgctggccggcagaccatgaggaactacagcggcctgattgacagcctgatggcctacgtgcagaactgtgtggccgccagccgctgtgatgacaagtctgtggagaactgcatgtgtgtgctgcacaacctgagctaccgcctggatgctgaggtgcccacccgctaccggcagctggagtacaatgccagaaatgcctacacagagaagagcagcacaggctgcttcagcaacaagagtgacaagatgatgaacaacaactatgactgccccctgcctgaggaggagaccaaccccaagggcagcggctggctgtaccacagtgatgccatccgcacctacctgaacctgatgggcaagagcaagaaggatgccaccctggaggcctgtgccggggccctgcagaacctgacagccagcaagggcctgatgagcagcggcatgagccagctgattggcctgaaggagaagggcctgccccagatcgcccggctgctgcagagcggcaacagtgatgtggtgcgcagcggggccagcctgctgagcaacatgagccgccaccccctgctgcaccgggtgatgggcaaccaggtgtttcctgaggtgacccggctgctgaccagccacactggaaacaccagcaacagcgaggacatcctgagcagcgcctgctacacagtgaggaacctgatggccagccagccccagctggccaagcagtacttcagcagctccatgctgaacaacatcatcaacctgtgccgcagcagcgccagccccaaggctgctgaggccgcccggctgctgctgagtgacatgtggagcagcaaggagctgcagggcgtgctgcggcagcagggctttgacaggaacatgctgggcaccctggccggggccaacagcctgaggaacttcaccagccgcttctag

SEQ ID NO: 164292 - DNA, 2646 bp, Artificial Sequence
  Description of Artificial Sequence: Synthetic coding sequence
atggccgcccctggggccccagcagaatatggctacatcagaacagtgctgggccagcagatcctgggccagctggacagcagcagcctggccctgcccagcgaggccaagctgaagctggccggcagcagcggccggggcggccagacagtgaagagcctgcgcatccaggagcaggtgcagcagaccctggccaggaagggccgcagctctgtgggcaatggaaacctgcacaggaccagctctgtgcctgaatatgtgtacaacctgcacctggtggagaatgactttgtgggcggccgcagccctgtgcccaagacctatgacatgctgaaggccggcaccacagccacctatgagggccgctggggccggggcacagcccagtacagcagccagaagtctgtggaggagaggagcctgcggcaccccctgcggcggctggagatcagcccagacagcagccctgagcgggcccactacacccacagcgactaccagtacagccagaggagccaggccggccacaccctgcaccaccaggagagccggcgggccgccctgctggtgcccccaagatatgcccggagtgaaattgtgggcgtgtccagagctggcaccaccagccggcagaggcactttgacacctaccaccggcagtaccagcacggctctgtgtctgacacagtgtttgacagcatcccagccaacccagccctgctgacctacccccggcccggcaccagccgctccatgggcaacctgctggagaaggagaactacctgacagctggcctgactgtgggccaggtgcggcccctggtgcccctgcagcctgtgacccagaacagagccagccgcagctcctggcaccagagcagcttccacagcaccaggaccctgcgggaggccggccccagcgtggccgtggacagcagtggaagaagagcccacctgactgtgggccaggccgccgccggcggcagcggcaacctgctgacagagaggagcaccttcacagacagccagctgggcaatgctgacatggagatgaccctggagagagctgtgtccatgctggaggccgaccacatgctgcccagccgcatctctgctgctgccaccttcatccagcacgagtgcttccagaagtctgaggccaggaagagggtgaaccagctgcggggcatcctgaagctgctgcagctgctgaaggtgcagaatgaagatgtgcagagagctgtgtgtggggccctgaggaacctggtgtttgaagataatgacaacaagctggaggtggccgagctgaatggagtgccccggctgctgcaggtgctgaagcagacccgggacctggagaccaagaagcagatcacagaccacacagtgaacctgcggagcagaaatggctggccaggagctgtggcccacgcctgcaaccccagcaccctgggcggccagggcggccgcatcaccaggtctggagtgcgggaccagcctgaccagcacggcctgctgtggaacctgagcagcaatgacaagctgaagaacctgatgatcacagaggccctgctgaccctgacagagaacatcatcatccccttcagcggctggccagagggggactaccccaaggccaacggcctgctggactttgacatcttctacaacgtgacaggctgcctgaggaacatgagcagcgctggagcagatggcaggaaggccatgagaagatgtgatggcctgattgacagcctggtgcactacgtgcggggcaccatcgctgactaccagccagatgacaaggccacagagaactgtgtgtgcatcctgcacaacctgagctaccagctggaggccgagctgcctgagaagtacagccagaacatctacatccagaacagaaacatccagacagacaacaacaagagcatcggctgcttcggcagccgcagcaggaaggtgaaggagcagtaccaggatgtgcccatgcctgaggagaagagcaaccccaagggcgtggagtggctgtggcacagcatcgtcatccgcatgtacctgagcctcatcgccaagtctgtgaggaactacacccaggaggccagcctgggcgccctgcagaacctgacagctggcagcggccccatgcccacctctgtggcccagacagtggtgcagaaggagagcggcctgcagcacaccaggaagatgctgcacgtgggggaccccagcgtgaagaagacagccatcagcctgctgaggaacctgagcaggaacctgagcctgcagaatgagatcgccaaggagaccctgcctgacctggtgtccatcatcccagacacagtgcccagcacagacctgctgattgagaccacagccagcgcctgctacaccctgaacaacatcatccagaacagctaccagaatgcccgggacctgctgaacacaggaggcatccagaagatcatggccatctctgctggagatgcctatgccagcaacaaggccagcaaggccgcctctgtgctgctgtacagcctgtgggcccacacagagctgcaccacgcctacaagaaggcccagttcaagaagacagactttgtgaacagcaggacagccaaggcctaccacagcctgaaggactag

SEQ ID NO: 164293 - DNA, 2514 bp, Artificial Sequence
  Description of Artificial Sequence: Synthetic coding sequence
atggccgcccctggggccccagcagaatatggctacatcagaacagtgctgggccagcagatcctgggccagctggacagcagcagcctggccctgcccagcgaggccaagctgaagctggccggcagcagcggccggggcggccagacagtgaagagcctgcgcatccaggagcaggtgcagcagaccctggccaggaagggccgcagctctgtgggcaatggaaacctgcacaggaccagctctgtgcctgaatatgtgtacaacctgcacctggtggagaatgactttgtgggcggccgcagccctgtgcccaagacctatgacatgctgaaggccggcaccacagccacctatgagggccgctggggccggggcacagcccagtacagcagccagaagtctgtggaggagaggagcctgcggcaccccctgcggcggctggagatcagcccagacagcagccctgagcgggcccactacacccacagcgactaccagtacagccagaggagccaggccggccacaccctgcaccaccaggagagccggcgggccgccctgctggtgcccccaagatatgcccggagtgaaattgtgggcgtgtccagagctggcaccaccagccggcagaggcactttgacacctaccaccggcagtaccagcacggctctgtgtctgacacagtgtttgacagcatcccagccaacccagccctgctgacctacccccggcccggcaccagccgctccatgggcaacctgctggagaaggagaactacctgacagctggcctgactgtgggccaggtgcggcccctggtgcccctgcagcctgtgacccagaacagagccagccgcagctcctggcaccagagcagcttccacagcaccaggaccctgcgggaggccggccccagcgtggccgtggacagcagtggaagaagagcccacctgactgtgggccaggccgccgccggcggcagcggcaacctgctgacagagaggagcaccttcacagacagccagctgggcaatgctgacatggagatgaccctggagagagctgtgtccatgctggaggccgaccacatgctgcccagccgcatctctgctgctgccaccttcatccagcacgagtgcttccagaagtctgaggccaggaagagggtgaaccagctgcggggcatcctgaagctgctgcagctgctgaaggtgcagaatgaagatgtgcagagagctgtgtgtggggccctgaggaacctggtgtttgaagataatgacaacaagctggaggtggccgagctgaatggagtgccccggctgctgcaggtgctgaagcagacccgggacctggagaccaagaagcagatcaccggcctgctgtggaacctgagcagcaatgacaagctgaagaacctgatgatcacagaggccctgctgaccctgacagagaacatcatcatccccttcagcggctggccagagggggactaccccaaggccaacggcctgctggactttgacatcttctacaacgtgacaggctgcctgaggaacatgagcagcgctggagcagatggcaggaaggccatgagaagatgtgatggcctgattgacagcctggtgcactacgtgcggggcaccatcgctgactaccagccagatgacaaggccacagagaactgtgtgtgcatcctgcacaacctgagctaccagctggaggccgagctgcctgagaagtacagccagaacatctacatccagaacagaaacatccagacagacaacaacaagagcatcggctgcttcggcagccgcagcaggaaggtgaaggagcagtaccaggatgtgcccatgcctgaggagaagagcaaccccaagggcgtggagtggctgtggcacagcatcgtcatccgcatgtacctgagcctcatcgccaagtctgtgaggaactacacccaggaggccagcctgggcgccctgcagaacctgacagctggcagcggccccatgcccacctctgtggcccagacagtggtgcagaaggagagcggcctgcagcacaccaggaagatgctgcacgtgggggaccccagcgtgaagaagacagccatcagcctgctgaggaacctgagcaggaacctgagcctgcagaatgagatcgccaaggagaccctgcctgacctggtgtccatcatcccagacacagtgcccagcacagacctgctgattgagaccacagccagcgcctgctacaccctgaacaacatcatccagaacagctaccagaatgcccgggacctgctgaacacaggaggcatccagaagatcatggccatctctgctggagatgcctatgccagcaacaaggccagcaaggccgcctctgtgctgctgtacagcctgtgggcccacacagagctgcaccacgcctacaagaaggcccagttcaagaagacagactttgtgaacagcaggacagccaaggcctaccacagcctgaaggactag

SEQ ID NO: 164294 - DNA, 2475 bp, Artificial Sequence
  Description of Artificial Sequence: Synthetic coding sequence
atggccgcccctggggccccagcagaatatggctacatcagaacagtgctgggccagcagatcctgggccagctggacagcagcagcctggccctgcccagcgaggccaagctgaagctggccggcagcagcggccggggcggccagacagtgaagagcctgcgcatccaggagcaggtgcagcagaccctggccaggaagggccgcagctctgtgggcaatggaaacctgcacaggaccagctctgtgcctgaatatgtgtacaacctgcacctggtggagaatgactttgtgggcggccgcagccctgtgcccaagacctatgacatgctgaaggccggcaccacagccacctatgagggccgctggggccggggcacagcccagtacagcagccagaagtctgtggaggagaggagcctgcggcaccccctgcggcggctggagatcagcccagacagcagccctgagcgggcccactacacccacagcgactaccagtacagccagaggagccaggccggccacaccctgcaccaccaggagagccggcgggccgccctgctggtgcccccaagatatgcccggagtgaaattgtgggcgtgtccagagctggcaccaccagccggcagaggcactttgacacctaccaccggcagtaccagcacggctctgtgtctgacacagtgtttgacagcatcccagccaacccagccctgctgacctacccccggcccggcaccagccgctccatgggcaacctgctggagaaggagaactacctgacagctggcctgactgtgggccaggtgcggcccctggtgcccctgcagcctgtgacccagaacagagccagccgcagctcctggcaccagagcagcttccacagcaccaggaccctgcgggaggccggccccagcgtggccgtggacagcagtggaagaagagcccacctgactgtgggccaggccgccgccggcggcagcggcaacctgctgacagagaggagcaccttcacagacagccagctgggcaatgctgacatggagatgaccctggagagagctgtgtccatgctggaggccgaccacatgctgcccagccgcatctctgctgctgccaccttcatccagcacgagtgcttccagaagtctgaggccaggaagagggtgaaccagctgcggggcatcctgaagctgctgcagctgctgaaggtgcagaatgaagatgtgcagagagctgtgtgtggggccctgaggaacctggtgtttgaagataatgacaacaagctggaggtggccgagctgaatggagtgccccggctgctgcaggtgctgaagcagacccgggacctggagaccaagaagcagatcacagaccacacagtgaacctgcggagcagaaatggctggccaggagctgtggcccacgcctgcaaccccagcaccctgggcggccagggcggccgcatcaccaggtctggagtgcgggaccagcctgaccagcacggcctgctgtggaacctgagcagcaatgacaagctgaagaacctgatgatcacagaggccctgctgaccctgacagagaacatcatcatccccttcagcggctggccagagggggactaccccaaggccaacggcctgctggactttgacatcttctacaacgtgacaggctgcctgaggaacatgagcagcgctggagcagatggcaggaaggccatgagaagatgtgatggcctgattgacagcctggtgcactacgtgcggggcaccatcgctgactaccagccagatgacaaggccacagagaactgtgtgtgcatcctgcacaacctgagctaccagctggaggccgagctgcctgagaagtacagccagaacatctacatccagaacagaaacatccagacagacaacaacaagagcatcggctgcttcggcagccgcagcaggaaggtgaaggagcagtaccaggatgtgcccatgcctgaggagaagagcaaccccaagggcgtggagtggctgtggcacagcatcgtcatccgcatgtacctgagcctcatcgccaagtctgtgaggaactacacccaggaggccagcctgggcgccctgcagaacctgacagctggcagcggccccatgcccacctctgtggcccagacagtggtgcagaaggagagcggcctgcagcacaccaggaagatgctgcacgtgggggaccccagcgtgaagaagacagccatcagcctgctgaggaacctgagcaggaacctgagcctgcagaatgagatcgccaaggagaccctgcctgacctggtgtccatcatcccagacacagtgcccagcacagacctgctgattgagaccacagccagcgcctgctacaccctgaacaacatcatccagaacagctaccagaatgcccgggacctgctgaacagaggccaccctgagaactacggccactag

SEQ ID NO: 164295 - DNA, 2394 bp, Artificial Sequence
  Description of Artificial Sequence: Synthetic coding sequence
atgcaggacggcaacttcctgctgagcgccctgcagcctgaggccggcgtgtgcagcctggccctgcccagcgacctgcagctggacagaagaggagctgagggccctgaggccgagcggctgcgggccgcccgggtgcaggagcaggtgcgggcccggctgctgcagctgggccagcagcccaggcacaacggggctgctgagcctgagcctgaggccgagacagcccggggcaccagccggggccagtaccacaccctgcaggccggcttcagcagccgcagccagggcctgagcggggacaagaccagcggcttccggcccatcgccaagccagcctacagccctgcctcctggagcagccgctctgctgtggacctgagctgcagccggcggctgagcagcgcccacaacggcggcagcgcctttggagctgctggctacggcggggcccagcccaccccacccatgcccaccaggcctgtgtccttccacgagcggggcggcgtgggcagcagagctgactatgacaccctgagcctgcggagcctgcggctgggccctgggggcctggatgaccgctacagcctggtgtctgagcagctggagcctgctgccaccagcacctaccgggcctttgcctatgagcggcaggccagcagcagcagcagccgggccggcggcctggactggccagaggccacagaggtgagccccagcaggaccatccgggccccagctgtgaggaccctgcagcgcttccagagcagccacaggagccggggcgtgggcggcgctgtgcctggagctgtgctggagcctgtggcccgggcccccagcgtgcgcagcctgagcctgagcctggccgacagcggccacctgcctgatgtgcacggcttcaacagctatggcagccacaggaccctgcagaggctgagcagcggctttgatgacatcgacctgcccagcgctgtgaagtacctgatggccagtgaccccaacctgcaggtgctgggcgccgcctacatccagcacaagtgctacagtgatgctgctgccaagaagcaggcccggagcctgcaggccgtgccccggctggtgaagctgttcaaccacgccaaccaggaggtgcagagacatgccaccggggccatgaggaacctgatctatgacaatgctgacaacaagctggccctggtggaggagaatggcatctttgagctgctgcggaccctgcgggagcaggatgatgagctgaggaagaatgtgacaggcatcctgtggaacctgagcagcagtgaccacctgaaggaccggctggcccgggacaccctggagcagctgacagacctggtgctgagccccctgtctggagctgggggccccccactcatccagcagaatgccagcgaggccgagatcttctacaatgccaccggcttcctgaggaacctgagcagcgccagccaggccacccggcagaagatgagggagtgccacggcctggtggatgccctggtgaccagcatcaaccacgccctggatgctggaaaatgtgaggacaagtctgtggagaatgctgtgtgtgtgctgaggaacctgagctaccgcctgtatgatgagatgcctccttctgccctgcagaggctggagggccggggcagaagagacctggccggggcccctcctggagaggtggtgggctgcttcaccccccagagccggcggctgcgggagctgcccctggccgcagatgccctgacctttgctgaggtgtccaaggaccccaagggcctggagtggctgtggagcccccagatcgtgggcctgtacaaccggctgctgcagagatgtgagctgaacagacacaccacagaagctgctgctggggccctgcagaacatcacagctggggaccggcgctgggccggcgtgctgagccggctggccctggagcaggagcgcatcctgaaccccctgctggacagagtgaggacagctgaccaccaccagctgcggagcctgaccggcctcatccggaacctgagcagaaatgccaggaacaaggatgagatgagcaccaaggtggtgagccacctgattgagaagctgcccggctctgtgggggagaagagccccccagctgaggtgctggtgaacatcatcgctgtgctgaacaacctggtggtggccagccccatcgccgcccgggacctgctgtactttgatggcctgaggaagctgatcttcatcaagaagaagagggacagcccagacagcgagaagagcagccgggccgccagcagcctgctggccaacctgtggcagtacaacaagctgcaccgggacttccgggccaagggctacaggaaggaggacttcctgggcccctag

SEQ ID NO: 164296 - DNA, 276 bp, Artificial Sequence
  Description of Artificial Sequence: Synthetic coding sequence
acagccttccggaggaccccaggagaggagtttgcctggagggaccctgagctgcctgaggtgatccacatgctgcagcaccagttccccagcgtgcaggccaatgctgctgcctacctgcagcacctgtgctttggagacaacaaggtgaagatggaggtgtgccgcctgggcggcatcaagcacctggtggacctgctggaccaccgggtgggcagcagcgaggagtgcctgtggtgccccagcaagccccgcttctggcaggtgtacagatag

SEQ ID NO: 164297 - DNA, 3450 bp, Artificial Sequence
  Description of Artificial Sequence: Synthetic coding sequence
atgcctgcccctgagcaggccagcctggtggaggagggccagccccagacccggcaggaggccgccagcacaggccctggcatggagcctgagaccacagccaccaccatcctggcctctgtgaaggagcaggagctgcagttccagaggctgacccgggagctggaggtggagcggcagatcgtggccagccagctggagcgctgccgcctgggcgctgagagccccagcatcgccagcaccagcagcacagagaagagcttcccctggaggagcacagatgtgcccaacacaggagtgtccaagccccgggtgtctgatgctgtgcagcccaacaactacctgatcagaacagagcctgagcagggcaccctgtacagccctgagcagaccagcctgcacgagagcgagggcagcctgggcaacagccgcagcagcacccagatgaacagctacagcgacagcggctaccaggaggccggcagcttccacaacagccagaatgtgtccaaggctgacaaccggcagcagcacagcttcatcggcagcaccaacaaccacgtggtgaggaacagcagagctgagggccagaccctggtgcagcccagcgtggccaacagagccatgagaagagtgtcctctgtgcccagccgggcccagagccccagctatgtgatcagcactggagtgagccccagccggggcagcctgcggaccagcctgggcagcggcttcggcagccccagcgtgacagacccccggcccctgaaccccagcgcctacagcagcaccaccctgcctgctgcccgggccgccagcccctacagccagaggcctgccagccccacagccatccgccgcatcggctctgtgaccagccggcagaccagcaaccccaacggccccaccccccagtaccagaccacagcccgggtgggcagccccctgaccctgacagatgcccagaccagggtggccagccccagccagggccaggtgggcagcagcagccccaagaggagcggcatgacagctgtgccccagcacctgggccccagcctgcagaggacagtgcatgacatggagcagtttggccagcagcagtatgacatctatgaaagaatggtgccccccaggccagacagcctgaccggcctgcggagcagctatgccagccagcacagccagctgggccaggacctgcggtctgctgtgtccccagacctgcacatcacccccatctatgagggccgcacctactacagccctgtgtaccgcagccccaaccacggcaccgtggagctgcagggcagccagacagccctgtacagaactggatctgtgggcatcggcaacctgcagaggaccagcagccagaggagcaccctgacctaccagaggaacaactatgccctgaacaccacagccacctatgcagagccctaccggcccatccagtacagagtgcaggagtgcaactacaaccggctgcagcacgctgtgcctgcagatgatggcaccaccaggagccccagcattgacagcatccagaaggacccccgggagtttgcctggagggaccctgagctgcctgaggtgatccacatgctgcagcaccagttccccagcgtgcaggccaatgctgctgcctacctgcagcacctgtgctttggagacaacaaggtgaagatggaggtgtgccgcctgggcggcatcaagcacctggtggacctgctggaccaccgggtgctggaggtgcagaagaatgcctgtggggccctgaggaacctggtgtttgggaagagcacagatgagaacaagatcgccatgaagaatgtgggcggcatcccagccctgctgcggctgctgaggaagagcattgatgctgaggtgcgggagctggtgactggagtgctgtggaacctgagcagctgtgatgctgtgaagatgaccatcatcagagatgccctgagcaccctgaccaacacagtgattgtgccccacagcggctggaacaacagcagctttgatgatgaccacaagatcaagttccagaccagcctggtgctgaggaacaccaccggctgcctgaggaacctgagcagcgctggggaggaggccaggaagcagatgaggagctgtgagggcctggtggacagcctgctgtatgtgatccacacctgtgtgaacaccagtgactatgacagcaagacagtggagaactgtgtgtgcaccctgaggaacctgagctaccgcctggagctggaggtgccccaggcccggctgctgggcctgaatgagctggatgacctgctgggcaaggagagccccagcaaggacagcgagcccagctgctggggcaagaagaagaagaagaagaagaggaccccccaggaggaccagtgggatggagtgggccccatccctggcctgagcaagagccccaagggcgtggagatgctgtggcaccccagcgtggtgaagccctacctgaccctgctggccgagagcagcaacccagccaccctggagggcagcgctggcagcctgcagaacctgtctgctggcaactggaagtttgctgcctacatccgggctgctgtgaggaaggagaagggcctgcccatcctggtggagctgctgaggatggacaatgacagagtggtgtcctctgtggccacagccctgaggaacatggccctggatgtgaggaacaaggagctgattggcaagtatgccatgagggacctggtgaaccggctgcccggcggcaatggccccagcgtgctgagtgatgagaccatggccgccatctgctgtgccctgcacgaggtgaccagcaagaacatggagaatgccaaggccctggccgacagcggcggcatcgagaagctggtgaacatcaccaagggccgcggggacaggagcagcctgaaggtggtgaaggccgccgcccaggtgctgaacaccctgtggcagtacagagacctgcggagcatctacaagaaggatggctggaaccagaaccacttcatcacccctgtgtccaccctggagcgggaccgcttcaagagccaccccagcctgagcaccaccaaccagcagatgagccccatcatccagagcggcagcagcaagcccagccccatctacatcagcagctacagcagccctgcccgggagcagaacagaaggctgcagcaccagcagctgtactacagccaggatgacagcaacaggaagaactttgatgcctaccgcctgtacctgcagagcccccacagctatgaggacccctactttgatgacagagtgcacttccctgccagcacagactacagcacccagtatggcctgaagagcaccaccaactacgtggacttctacagcaccaagaggcccagctacagagctgagcagtacccaggcagcccagacagctgggtgtag

SEQ ID NO: 164298 - DNA, 3579 bp, Artificial Sequence
  Description of Artificial Sequence: Synthetic coding sequence
atgcctgcccctgagcaggccagcctggtggaggagggccagccccagacccggcaggaggccgccagcacaggccctggcatggagcctgagaccacagccaccaccatcctggcctctgtgaaggagcaggagctgcagttccagaggctgacccgggagctggaggtggagcggcagatcgtggccagccagctggagcgctgccgcctgggcgctgagagccccagcatcgccagcaccagcagcacagagaagagcttcccctggaggagcacagatgtgcccaacacaggagtgtccaagccccgggtgtctgatgctgtgcagcccaacaactacctgatcagaacagagcctgagcagggcaccctgtacagccctgagcagaccagcctgcacgagagcgagggcagcctgggcaacagccgcagcagcacccagatgaacagctacagcgacagcggctaccaggaggccggcagcttccacaacagccagaatgtgtccaaggctgacaaccggcagcagcacagcttcatcggcagcaccaacaaccacgtggtgaggaacagcagagctgagggccagaccctggtgcagcccagcgtggccaacagagccatgagaagagtgtcctctgtgcccagccgggcccagagccccagctatgtgatcagcactggagtgagccccagccggggcagcctgcggaccagcctgggcagcggcttcggcagccccagcgtgacagacccccggcccctgaaccccagcgcctacagcagcaccaccctgcctgctgcccgggccgccagcccctacagccagaggcctgccagccccacagccatccgccgcatcggctctgtgaccagccggcagaccagcaaccccaacggccccaccccccagtaccagaccacagcccgggtgggcagccccctgaccctgacagatgcccagaccagggtggccagccccagccagggccaggtgggcagcagcagccccaagaggagcggcatgacagctgtgccccagcacctgggccccagcctgcagaggacagtgcatgacatggagcagtttggccagcagcagtatgacatctatgaaagaatggtgccccccaggccagacagcctgaccggcctgcggagcagctatgccagccagcacagccagctgggccaggacctgcggtctgctgtgtccccagacctgcacatcacccccatctatgagggccgcacctactacagccctgtgtaccgcagccccaaccacggcaccgtggagctgcagggcagccagacagccctgtacagaactggatctgtgggcatcggcaacctgcagaggaccagcagccagaggagcaccctgacctaccagaggaacaactatgccctgaacaccacagccacctatgcagagccctaccggcccatccagtacagagtgcaggagtgcaactacaaccggctgcagcacgctgtgcctgcagatgatggcaccaccaggagccccagcattgacagcatccagaaggacccccgggagtttgcctggagggaccctgagctgcctgaggtgatccacatgctgcagcaccagttccccagcgtgcaggccaatgctgctgcctacctgcagcacctgtgctttggagacaacaaggtgaagatggaggtgtgccgcctgggcggcatcaagcacctggtggacctgctggaccaccgggtgctggaggtgcagaagaatgcctgtggggccctgaggaacctggtgtttgggaagagcacagatgagaacaagatcgccatgaagaatgtgggcggcatcccagccctgctgcggctgctgaggaagagcattgatgctgaggtgcgggagctggtgactggagtgctgtggaacctgagcagctgtgatgctgtgaagatgaccatcatcagagatgccctgagcaccctgaccaacacagtgattgtgccccacagcggctggaacaacagcagctttgatgatgaccacaagatcaagttccagaccagcctggtgctgaggaacaccaccggctgcctgaggaacctgagcagcgctggggaggaggccaggaagcagatgaggagctgtgagggcctggtggacagcctgctgtatgtgatccacacctgtgtgaacaccagtgactatgacagcaagacagtggagaactgtgtgtgcaccctgaggaacctgagctaccgcctggagctggaggtgccccaggcccggctgctgggcctgaatgagctggatgacctgctgggcaaggagagccccagcaaggacagcgagcccagctgctggggcaagaagaagaagaagaagaagaggaccccccaggaggaccagtgggatggagtgggccccatccctggcctgagcaagagccccaagggcgtggagatgctgtggcaccccagcgtggtgaagccctacctgaccctgctggccgagagcagcaacccagccaccctggagggcagcgctggcagcctgcagaacctgtctgctggcaactggaagtttgctgcctacatccgggctgctgtgaggaaggagaagggcctgcccatcctggtggagctgctgaggatggacaatgacagagtggtgtcctctgtggccacagccctgaggaacatggccctggatgtgaggaacaaggagctgattggcaagtatgccatgagggacctggtgaaccggctgcccggcggcaatggccccagcgtgctgagtgatgagaccatggccgccatctgctgtgccctgcacgaggtgaccagcaagaacatggagaatgccaaggccctggccgacagcggcggcatcgagaagctggtgaacatcaccaagggccgcggggacaggagcagcctgaaggtggtgaaggccgccgcccaggtgctgaacaccctgtggcagtacagagacctgcggagcatctacaagaaggatggctggaaccagaaccacttcatcacccctgtgtccaccctggagcgggaccgcttcaagagccaccccagcctgagcaccaccaaccagcagatgagccccatcatccagagcgtgggcagcaccagcagcagccctgccctgctgggcatccgggaccccaggagtgaatatgacaggacccagccccccatgcagtactacaacagccagggagatgccacccacaagggcctgtacccaggcagcagcaagcccagccccatctacatcagcagctacagcagccctgcccgggagcagaacagaaggctgcagcaccagcagctgtactacagccaggatgacagcaacaggaagaactttgatgcctaccgcctgtacctgcagagcccccacagctatgaggacccctactttgatgacagagtgcacttccctgccagcacagactacagcacccagtatggcctgaagagcaccaccaactacgtggacttctacagcaccaagaggcccagctacagagctgagcagtacccaggcagcccagacagctgggtgtag

SEQ ID NO: 164299 - DNA, 1845 bp, Artificial Sequence
  Description of Artificial Sequence: Synthetic coding sequence
atgaacagctacagcgacagcggctaccaggaggccggcagcttccacaacagccagaatgtgtccaaggctgacaaccggcagcagcacagcttcatcggcagcaccaacaaccacgtggtgaggaacagcagagctgagggccagaccctggtgcagcccagcgtggccaacagagccatgagaagagtgtcctctgtgcccagccgggcccagagccccagctatgtgatcagcactggagtgagccccagccggggcagcctgcggaccagcctgggcagcggcttcggcagccccagcgtgacagacccccggcccctgaaccccagcgcctacagcagcaccaccctgcctgctgcccgggccgccagcccctacagccagaggcctgccagccccacagccatccgccgcatcggctctgtgaccagccggcagaccagcaaccccaacggccccaccccccagtaccagaccacagcccgggtgggcagccccctgaccctgacagatgcccagaccagggtggccagccccagccagggccaggtgggcagcagcagccccaagaggagcggcatgacagctgtgccccagcacctgggccccagcctgcagaggacagtgcatgacatggagcagtttggccagcagcagtatgacatctatgaaagaatggtgccccccaggccagacagcctgacagcctacggcgtgcccatgctggtgtccatcgtgtccctgggcaagacctttgtgctgccctgcccagacctgcacatcacccccatctatgagggccgcacctactacagccctgtgtaccgcagccccaaccacggcaccgtggagctgcagggcagccagacagccctgtacagaacaggctctgtgggcatcggcaacctgcagaggaccagcagccagaggagcaccctgacctaccagaggaacaactatgccctgaacaccacagccacctacgccgagccctaccggcccatccagtacagagtgcaggagtgcaactacaaccggctgcagcacgctgtgcctgcagatgatggcaccaccaggagccccagcattgacagcatccagaaggacccccgggagtttgcctggagggaccctgagctgcctgaggtgatccacatgctgcagcaccagttccccagcgtgcaggccaatgctgctgcctacctgcagcacctgtgcttcggggacaacaaggtgaagatggaggtgtgccgcctgggcggcatcaagcacctggtggacctgctggaccaccgggtgctggaggtgcagaagaatgcctgtggggccctgaggaacctggtgtttgggaagagcacagatgagaacaagatcgccatgaagaatgtgggcggcatcccagccctgctgcggctgctgaggaagagcattgatgctgaggtgcgggagctggtgactggagtgctgtggaacctgagcagctgtgatgctgtgaagatgaccatcatcagagatgccctgagcaccctgaccaacacagtcatcgtgccccacagcggctggaacaacagcagctttgatgatgaccacaagatcaagttccagaccagcctggtgctgaggaacaccaccggctgcctgaggaacctgagcagcgctggggaggaggccaggaagcagatgaggagctgtgagggcctggtggacagcctgctgtatgtgatccacacctgtgtgaacaccagtgactatgacagcaagacagtggagaactgtgtgtgcaccctgaggaacctgattggctggagctggcgctgcccccggcccggctactgggactag

SEQ ID NO: 164300 - DNA, 1329 bp, Artificial Sequence
  Description of Artificial Sequence: Synthetic coding sequence
atgggcctggccatggagcacggcggcagctatgcccgggccggcggcagcagccggggctgctggtactacctgcgctacttcttcctgtttgtgtccctcatccagttcctgatcatcctgggcctggtgctcttcatggtgtatggaaatgtgcacgtgtccacagagagcaacctgcaggccacagaaagaagagctgagggcctgtacagccagctgctgggcctgacagccagccagagcaacctgaccaaggagctgaacttcaccacccgggccaaggatgccatcatgcagatgtggctgaatgcccggcgggacctggaccgcatcaatgccagcttccggcagtgccagggcgacagagtcatctacaccaacaaccagcgctacatggccgccatcatcctgtctgagaagcagtgccgggaccagttcaaggacatgaacaagagctgtgatgccctgctcttcatgctgaaccagaaggtgaagaccctggaggtggagatcgccaaggagaagaccatctgcaccaaggacaaggagagcgtgctgctgaacaagagggtggccgaggagcagctggtggagtgtgtgaagacccgggagctgcagcaccaggagcggcagctggccaaggagcagctgcagaaggtgcaggccctgtgcctgcccctggacaaggacaagtttgagatggacctgaggaacctgtggagggacagcatcatccccaggagcctggacaacctgggctacaacctgtaccaccccctgggcagcgagctggccagcatcagaagagcctgtgaccacatgcccagcctgatgagcagcaaggtggaggagctggcccggagcctgcgggctgacatcgagcgggtggcccgggagaacagcgacctgcagaggcagaagctggaggcccagcagggcctgcgggccagccaggaggccaagcagaaggtggagaaggaggcccaggcccgggaggccaagctgcaggctgaatgttcccggcagacccagctggccctggaggagaaggctgtgctgaggaaggagcgggacaacctggccaaggagctggaggagaagaagcgggaggccgagcagctgaggatggagctggccatccggaacagcgccctggacacctgcatcaagaccaagagccagcccatgatgcctgtgtcccggcccatgggccctgtgcccaacccccagcccattgatcctgccagcctggaggagttcaagaggaagatcctggagagccagaggcctcctgctggcatccctgtggcccccagcagtggatag

SEQ ID NO: 164301 - DNA, 291 bp, Artificial Sequence
  Description of Artificial Sequence: Synthetic coding sequence
atggagcacaaggaggtggtgctgctgctgctgctcttcctgaagagcggccagggcgagcccctggatgattatgtgaacacccagggccccagcctcttctctgtgaccaagaagcagctgggcgccggcagccgggaggagtgtgccgccaagtgtgaggaggacaaggagttcacctgccgggccttccagtaccacagcaaggagcagcagtgtgtgatcatggccgagaacaggaagagcagcatcatcatccgcatgagagatgctgtgctgtttgagaagtag

SEQ ID NO: 164302 - DNA, 291 bp, Artificial Sequence; identical to SEQ ID NO: 164301
  Description of Artificial Sequence: Synthetic coding sequence

SEQ ID NO: 164303 - DNA, 291 bp, Artificial Sequence; identical to SEQ ID NO: 164301
  Description of Artificial Sequence: Synthetic coding sequence

SEQ ID NO: 164304 - DNA, 492 bp, Artificial Sequence
  Description of Artificial Sequence: Synthetic coding sequence
atggatgccctggagggggagagctttgccctgtccttcagcagcgccagtgatgctgagtttgatgctgtggtgggctacctggaggacatcatcatggatgatgagttccagctgctgcagaggaacttcatggacaagtactacctggagtttgaggacacagaggagaacaagctgatctacacccccatcttcaatgagtacatcagcctggtggagaagtacatcgaggagcagctgctgcagagaattcctgagttcaacatggccgccttcaccaccaccctgcagcaccacaaggatgaggtggccggggacatctttgacatgctgctgaccttcacagacttcctggccttcaaggagatgttcctggactacagagctgagaaggagggccggggcctggacctgagcagcggcctggtggtgaccagcctgtgcaagagcagcagcctgcctgccagccagaacaacctgcggcactag

SEQ ID NO: 164305 - DNA, 1890 bp, Artificial Sequence
  Description of Artificial Sequence: Synthetic coding sequence
atggagaacagcaccaccaccatcagccgggaggagctggaggagctgcaggaggccttcaacaagattgatattgacaacagcggctacgtgtctgactatgagctgcaggacctcttcaaggaggccagcctgcccctgcccggctacaaggtgcgggagatcgtggagaagatcctgtctgtggccgacagcaacaaggatggcaagatcagctttgaggagtttgtgtccctgatgcaggagctgaagagcaaggacatcagcaagaccttcaggaagatcatcaacaagcgggagggcatcacagccatcggcggcaccagcaccatcagcagcgagggcacccagcacagctacagcgaggaggagaaggtggcctttgtgaactggatcaacaaggccctggagaatgaccctgactgcaagcacctgatccccatgaaccccaatgatgacagcctcttcaagagcctggctgatggcatcctgctgtgcaagatgatcaacctgtctgagccagacaccattgatgagcgggccatcaacaagaagaagctgacccccttcaccatcagcgagaacctgaacctggccctgaacagcgccagcgccatcggctgcaccgtggtgaacattggagccagtgacctgaaggagggcaagccccacctggtgctgggcctgctgtggcagatcatcaaggtgggcctgtttgctgacatcgagatcagcagaaatgaggccctgattgccctgctgaatgaaggagaggagctggaggagctgatgaagctgagccctgaggagctgctgctgcgctgggtgaactaccacctgaccaatgccggctggcacaccatcagcaacttcagccaggacatcaaggacagccgggcctacttccacctgctgaaccagatcgcccccaagggcggggaggatggccctgccatcgccatcgacctgagcggcatcaatgagaccaatgacctgaagagagctggcctgatgctgcaggaggccgacaagctgggctgcaagcagtttgtgaccccagcagatgtggtgtctggcaaccccaagctgaacctggcctttgtggccaacctcttcaacacctacccctgcctgcacaagcccaacaacaatgacatcgacatgaacctgctggagggggagagcaaggaggagaggaccttcaggaactggatgaacagcctgggcgtgaacccctacatcaaccacctgtacagcgacctggctgatgccctggtgatcttccagctgtatgagatgatccgggtgcctgtgaactggagccacgtgaacaagccaccctacccagccctgggcggcaacatgaagaagattgagaactgcaactatgctgtggagctgggcaagaacaaggccaagttcagcctggtgggcattgctggccaggacctgaatgaaggcaacagcaccctgaccctggccctggtgtggcagctgatgaggcgctacaccctgaatgtgctgagtgacctgggggagggggagaaggtgaatgatgagatcatcatcaagtgggtgaaccagaccctgaagagcgccaacaagaagaccagcatcagcagcttcaaggacaagagcatcagcaccagcctgcctgtgctggacctgattgatgccatcgccccaaatgctgtgcggcaggagatgatcagaagagagaacctgagtgatgaggacaagctgaacaatgccaagtatgccatctctgtggccaggaagatcggggcccgcatctatgccctgcctgatgacctggtggaggtgaagcccaagatggtgatgacagtgtttgcctgcctgatgggcaagggcctgaaccgcatcaagtag

SEQ ID NO: 164306 - DNA, 1890 bp, Artificial Sequence; identical to SEQ ID NO: 164305
  Description of Artificial Sequence: Synthetic coding sequence

SEQ ID NO: 164307 - DNA, 165 bp, Artificial Sequence
  Description of Artificial Sequence: Synthetic coding sequence
atggagaacagcaccaccaccatcagccgggaggagctggaggagctgcaggaggccttcaacaagattgatattgacaacagcggctacgtgtctgactatgagctgcaggacctcttcaaggaggccagcctgcccctgcccggctacaaggtgcgggagtag

SEQ ID NO: 164308 - DNA, 363 bp, Artificial Sequence
  Description of Artificial Sequence: Synthetic coding sequence
atggagaacagcaccaccaccatcagccgggaggagctggaggagctgcaggaggccttcaacaagattgatattgacaacagcggctacgtgtctgactatgagctgcaggacctcttcaaggaggccagcctgcccctgcccggctacaaggtgcgggagatcgtggagaagatcctgtctgtggccgacagcaacaaggatggcaagatcagctttgaggagtttgtgtccctgatgcaggagctgaagagcaaggacatcagcaagaccttcaggaagatcatcaacaagcgggagggcatcacagccatcggcggcaccagcaccatcagcagcgagggcacccagcacagctactag

SEQ ID NO: 164309 - DNA, 360 bp, Artificial Sequence
  Description of Artificial Sequence: Synthetic coding sequence
atggagaacagcaccaccaccatcagccgggaggagctggaggagctgcaggaggccttcaacaagattgatattgacaacagcggctacgtgtctgactatgagctgcaggacctcttcaaggaggccagcctgcccctgcccggctacaaggtgcgggagatcgtggagaagatcctgtctgtggccgacagcaacaaggatggcaagatcagctttgaggagtttgtgtccctgatgcaggagctgaagagcaaggacatcagcaagaccttcaggaagatcatcaacaagcgggagggcatcacagccatcggcggcaccagcaccatcagcagcgagggcacccagcacagctag

SEQ ID NO: 164310 - DNA, 102 bp, Artificial Sequence
  Description of Artificial Sequence: Synthetic coding sequence
atggagaacagcaccaccaccatcagccgggaggagctggaggagctgcaggaggccttcaacaagattgatattgacaacagcggctacgtgtctgactag

SEQ ID NO: 164311 - DNA, 177 bp, Artificial Sequence
  Description of Artificial Sequence: Synthetic coding sequence
atggagaacagcaccaccaccatcagccgggaggagctggaggagctgcaggaggccttcaacaagattgatattgacaacagcggctacgtgtctgactatgagctgcaggacctcttcaaggaggccagcctgcccctgcccggctacaaggtgcgggagatcgtggagaagtag

SEQ ID NO: 164312 - DNA, 1890 bp, Artificial Sequence; identical to SEQ ID NO: 164305
  Description of Artificial Sequence: Synthetic coding sequence

SEQ ID NO: 164313 - DNA, 162 bp, Artificial Sequence
  Description of Artificial Sequence: Synthetic coding sequence
atggagaacagcaccaccaccatcagccgggaggagctggaggagctgcaggaggccttcaacaagattgatattgacaacagcggctacgtgtctgactatgagctgcaggacctcttcaaggaggccagcctgcccctgcccggctacaaggtgaggtag

SEQ ID NO: 164314 - DNA, 1785 bp, Artificial Sequence
  Description of Artificial Sequence: Synthetic coding sequence
atgcccctgcccggctacaaggtgcgggagatcatccagaagctgatgctggatggagacaggaacaaggatggcaagatcagctttgatgaatttgtgtacatcttccaggaggtgaagagcagtgacatcgccaagaccttcaggaaggccatcaacaggaaggagggcatctgtgccctgggcggcaccagcgagctgagcagcgagggcacccagcacagctacagcgaggaggagaagtatgcctttgtgaactggatcaacaaggccctggagaatgaccctgactgccgccacgtgatccccatgaaccccaacacagatgacctcttcaaggctgtgggagatggcatcgtgctgtgcaagatgatcaacctgtctgtgcctgacaccattgatgagcgggccatcaacaagaagaagctgacccccttcatcatccaggagaacctgaacctggccctgaacagcgccagcgccatcggctgccacgtggtgaacattggagctgaggacctgcgggccggcaagccccacctggtgctgggcctgctgtggcagatcatcaagattggcctgtttgctgacatcgagctgagcagaaatgaggccctggccgccctgctgagagatggagagaccctggaggagctgatgaagctgagccctgaggagctgctgctgcgctgggccaacttccacctggagaacagcggctggcagaagatcaacaacttctctgctgacatcaagctgattgacttcagcaacagcgtgaaggacagcaaggcctacttccacctgctgaaccagatcgcccccaagggccagaaggagggggagcccagaattgacatcaacatgagcggcttcaatgaaacagatgacctgaagagagctgagagcatgctgcagcaggccgacaagctgggctgccggcagtttgtgaccccagcagatgtggtgtctggcaaccccaagctgaacctggcctttgtggccaacctcttcaacaagtacccagccctgaccaagccagagaaccaggacatcgactggaccctgctggagggggagacccgggaggagaggaccttcaggaactggatgaacagcctgggcgtgaacccccacgtgaaccacctgtatgctgacctgcaggatgccctggtgatcctgcagctgtatgagcgcatcaaggtgcctgtggactggagcaaggtgaacaagccaccctaccccaagctgggcgccaacatgaagaagctggagaactgcaactatgctgtggagctgggcaagcacccagccaagttcagcctggtgggcattggaggccaggacctgaatgatggcaaccagaccctgaccctggccctggtgtggcagctgatgaggcgctacaccctgaatgtgctggaggacctgggagatggccagaaggccaatgatgacatcatcgtgaactgggtgaacagaaccctgtctgaggccggcaagagcaccagcatccagagcttcaaggacaagaccatcagcagcagcctggccgtggtggacctgattgatgccatccagcccggctgcatcaactatgacctggtgaagagcggcaacctgacagaagatgacaagcacaacaatgccaagtatgctgtgtccatggcccggcgcatcggggcccgggtgtatgccctgcctgaggacctggtggaggtgaagcccaagatggtgatgacagtgtttgcctgcctgatgggccggggcatgaagagggtgtag

SEQ ID NO: 164315 - DNA, 1893 bp, Artificial Sequence
  Description of Artificial Sequence: Synthetic coding sequence
atggatgagatggccaccacccagatcagcaaggatgagctggatgagctgaaggaggcctttgccaaggtggacctgaacagcaatggcttcatctgtgactatgagctgcacgagctgttcaaggaggccaacatgcccctgcccggctacaaggtgcgggagatcatccagaagctgatgctggatggagacaggaacaaggatggcaagatcagctttgatgaatttgtgtacatcttccaggaggtgaagagcagtgacatcgccaagaccttcaggaaggccatcaacaggaaggagggcatctgtgccctgggcggcaccagcgagctgagcagcgagggcacccagcacagctacagcgaggaggagaagtatgcctttgtgaactggatcaacaaggccctggagaatgaccctgactgcagacatgtgatccccatgaaccccaacacagatgacctcttcaaggctgtgggagatggcatcgtgctgtgcaagatgatcaacctgtctgtgcctgacaccattgatgagcgggccatcaacaagaagaagctgacccccttcatcatccaggagaacctgaacctggccctgaacagcgccagcgccatcggctgccacgtggtgaacatcggggctgaggacctgcgggccggcaagccccacctggtgctgggcctgctgtggcagatcatcaagattggcctgtttgctgacatcgagctgagcagaaatgaggccctggccgccctgctgagagatggagagaccctggaggagctgatgaagctgagccctgaggagctgctgctgcgctgggccaacttccacctggagaacagcggctggcagaagatcaacaacttctctgctgacatcaaggacagcaaggcctacttccacctgctgaaccagatcgcccccaagggccagaaggagggggagcccagaattgacatcaacatgagcggcttcaatgaaacagatgacctgaagagagctgagagcatgctgcagcaggccgacaagctgggctgccggcagtttgtgaccccagcagatgtggtgtctggcaaccccaagctgaacctggcctttgtggccaacctcttcaacaagtacccagccctgaccaagccagagaaccaggacatcgactggaccctgctggagggggagacccgggaggagaggaccttcaggaactggatgaacagcctgggcgtgaacccccacgtgaaccacctgtatgctgacctgcaggatgccctggtgatcctgcagctgtatgagcgcatcaaggtgcctgtggactggagcaaggtgaacaagccaccctaccccaagctgggcgccaacatgaagaagctggagaactgcaactatgctgtggagctgggcaagcacccagccaagttcagcctggtgggcattggaggccaggacctgaatgatggcaaccagaccctgaccctggccctggtgtggcagctgatgaggcgctacaccctgaatgtgctggaggacctgggagatggccagaaggccaatgatgacatcatcgtgaactgggtgaacagaaccctgtctgaggccggcaagagcaccagcatccagagcttcaaggacaagaccatcagcagcagcctggccgtggtggacctgattgatgccatccagcccggctgcatcaactatgacctggtgaagagcggcaacctgacagaagatgacaagcacaacaatgccaagtatgctgtgtccatggcccggcgcatcggggcccgggtgtatgccctgcctgaggacctggtggaggtgaagcccaagatggtgatgacagtgtttgcctgcctgatgggccggggcatgaagagggtgtag

SEQ ID NO: 164316 - DNA, 1893 bp, Artificial Sequence; identical to SEQ ID NO: 164315
  Description of Artificial Sequence: Synthetic coding sequence

SEQ ID NO: 164317 - DNA, 1854 bp, Artificial Sequence
  Description of Artificial Sequence: Synthetic coding sequence
atggaggacctgaacagcaatggcttcatctgtgactatgagctgcacgagctgttcaaggaggccaacatgcccctgcccggctacaaggtgcgggagatcatccagaagctgatgctggatggagacaggaacaaggatggcaagatcagctttgatgaatttgtgtacatcttccaggaggtgaagagcagtgacatcgccaagaccttcaggaaggccatcaacaggaaggagggcatctgtgccctgggcggcaccagcgagctgagcagcgagggcacccagcacagctacagcgaggaggagaagtatgcctttgtgaactggatcaacaaggccctggagaatgaccctgactgcagacatgtgatccccatgaaccccaacacagatgacctcttcaaggctgtgggagatggcatcgtgctgtgcaagatgatcaacctgtctgtgcctgacaccattgatgagcgggccatcaacaagaagaagctgacccccttcatcatccaggagaacctgaacctggccctgaacagcgccagcgccatcggctgccacgtggtgaacatcggggctgaggacctgcgggccggcaagccccacctggtgctgggcctgctgtggcagatcatcaagattggcctgtttgctgacatcgagctgagcagaaatgaggccctggccgccctgctgagagatggagagaccctggaggagctgatgaagctgagccctgaggagctgctgctgcgctgggccaacttccacctggagaacagcggctggcagaagatcaacaacttctctgctgacatcaagctgattgacttcagcaacagcgtgaaggacagcaaggcctacttccacctgctgaaccagatcgcccccaagggccagaaggagggggagcccagaattgacatcaacatgagcggcttcaatgaaacagatgacctgaagagagctgagagcatgctgcagcaggccgacaagctgggctgccggcagtttgtgaccccagcagatgtggtgtctggcaaccccaagctgaacctggcctttgtggccaacctcttcaacaagtacccagccctgaccaagccagagaaccaggacatcgactggaccctgctggagggggagacccgggaggagaggaccttcaggaactggatgaacagcctgggcgtgaacccccacgtgaaccacctgtatgctgacctgcaggatgccctggtgatcctgcagctgtatgaaagaatcaaggtgcctgtggactggagcaaggtgaacaagccaccctaccccaagctgggcgccaacatgaagaagctggagaactgcaactatgctgtggagctgggcaagcacccagccaagttcagcctggtgggcatcggcggccaggacctgaatgatggcaaccagaccctgaccctggccctggtgtggcagctgatgaggcgctacaccctgaatgtgctggaggacctgggagatggccagaaggccaatgatgacatcatcgtgaactgggtgaacagaaccctgtctgaggccggcaagagcaccagcatccagagcttcaaggacaagaccatcagcagcagcctggccgtggtggacctgattgatgccatccagcccggctgcatcaactatgacctggtgaagagcggcaacctgacagaagatgacaagcacaacaatgccaagtatgctgtgtccatggccaggagaattggagcccgggtgtatgccctgcctgaggacctggtggaggtgaagcccaagatggtgatgacagtgtttgcctgcctgatgggccggggcatgaagagggtgtag

SEQ ID NO: 164318 - DNA, 1758 bp, Artificial Sequence
  Description of Artificial Sequence: Synthetic coding sequence
atgcccctgcccggctacaaggtgcgggagatcatccagaagctgatgctggatggagacaggaacaaggatggcaagatcagctttgatgaatttgtgtacatcttccaggaggtgaagagcagtgacatcgccaagaccttcaggaaggccatcaacaggaaggagggcatctgtgccctgggcggcaccagcgagctgagcagcgagggcacccagcacagctacagcgaggaggagaagtatgcctttgtgaactggatcaacaaggccctggagaatgaccctgactgccgccacgtgatccccatgaaccccaacacagatgacctcttcaaggctgtgggagatggcatcgtgctgtgcaagatgatcaacctgtctgtgcctgacaccattgatgagcgggccatcaacaagaagaagctgacccccttcatcatccaggagaacctgaacctggccctgaacagcgccagcgccatcggctgccacgtggtgaacattggagctgaggacctgcgggccggcaagccccacctggtgctgggcctgctgtggcagatcatcaagattggcctgtttgctgacatcgagctgagcagaaatgaggccctggccgccctgctgagagatggagagaccctggaggagctgatgaagctgagccctgaggagctgctgctgcgctgggccaacttccacctggagaacagcggctggcagaagatcaacaacttctctgctgacatcaaggacagcaaggcctacttccacctgctgaaccagatcgcccccaagggccagaaggagggggagcccagaattgacatcaacatgagcggcttcaatgaaacagatgacctgaagagagctgagagcatgctgcagcaggccgacaagctgggctgccggcagtttgtgaccccagcagatgtggtgtctggcaaccccaagctgaacctggcctttgtggccaacctcttcaacaagtacccagccctgaccaagccagagaaccaggacatcgactggaccctgctggagggggagacccgggaggagaggaccttcaggaactggatgaacagcctgggcgtgaacccccacgtgaaccacctgtatgctgacctgcaggatgccctggtgatcctgcagctgtatgaaagaatcaaggtgcctgtggactggagcaaggtgaacaagccaccctaccccaagctgggcgccaacatgaagaagctggagaactgcaactatgctgtggagctgggcaagcacccagccaagttcagcctggtgggcatcggcggccaggacctgaatgatggcaaccagaccctgaccctggccctggtgtggcagctgatgaggcgctacaccctgaatgtgctggaggacctgggagatggccagaaggccaatgatgacatcatcgtgaactgggtgaacagaaccctgtctgaggccggcaagagcaccagcatccagagcttcaaggacaagaccatcagcagcagcctggccgtggtggacctgattgatgccatccagcccggctgcatcaactatgacctggtgaagagcggcaacctgacagaagatgacaagcacaacaatgccaagtatgctgtgtccatggccaggagaattggagcccgggtgtatgccctgcctgaggacctggtggaggtgaagcccaagatggtgatgacagtgtttgcctgcctgatgggccggggcatgaagagggtgtag

SEQ ID NO: 164319 - DNA, 675 bp, Artificial Sequence
  Description of Artificial Sequence: Synthetic coding sequence
atgaacagcctgggcgtgaacccccacgtgaaccacctgtatgctgacctgcaggatgccctggtgatcctgcagctgtatgagcgcatcaaggtgcctgtggactggagcaaggtgaacaagccaccctaccccaagctgggcgccaacatgaagaagctggagaactgcaactatgctgtggagctgggcaagcacccagccaagttcagcctggtgggcattggaggccaggacctgaatgatggcaaccagaccctgaccctggccctggtgtggcagctgatgaggcgctacaccctgaatgtgctggaggacctgggagatggccagaaggccaatgatgacatcatcgtgaactgggtgaacagaaccctgtctgaggccggcaagagcaccagcatccagagcttcaaggacaagaccatcagcagcagcctggccgtggtggacctgattgatgccatccagcccggctgcatcaactatgacctggtgaagagcggcaacctgacagaagatgacaagcacaacaatgccaagtatgctgtgtccatggcccggcgcatcggggcccgggtgtatgccctgcctgaggacctggtggaggtgaagcccaagatggtgatgacagtgtttgcctgcctgatgggccggggcatgaagagggtgtag

SEQ ID NO: 164320 - DNA, 306 bp, Artificial Sequence
  Description of Artificial Sequence: Synthetic coding sequence
atgagcagcgctgctggcttctgtgccagccggcccggcctgctcttcctgggcctgctgctgctgcccctggtggtggcctttgccagcgctgaggccgaggaggatggagacctgcagtgcctgtgtgtgaagaccaccagccaggtgcggcccaggcacatcaccagcctggaggtgatcaaggccggcccccactgccccacagcccagctgattgccaccctgaagaatggaaggaagatctgcctggacctgcaggcccccctgtacaagaagatcatcaagaagctgctggagagctag

SEQ ID NO: 164321 - DNA, 405 bp, Artificial Sequence
  Description of Artificial Sequence: Synthetic coding sequence
atgaagagcctgacctggatcctgggcctgtgggccctggccgcctgcttcaccccaggagagagccagaggggcccccggggcccctacccacctggccccctggcccctcctcctccaccctgcttcccctttggaactggatttgtgcccccaccccaccccccaccctacggccctggccgcttccccccacccctgagccccccctacggccctggccgcatcccccccagccccccaccaccctacggccctggccgcatccagagccacagcctgcccccaccctacggccctggctacccccagccccccagccagccccggccctacccacctggcccccccttcttccctgtgaacagccccacagatcctgccctgcccaccccagccccctag

SEQ ID NO: 164322 - DNA, 399 bp, Artificial Sequence
  Description of Artificial Sequence: Synthetic coding sequence
atgagccagggcgacagcaacccagctgccatcccccacgccgctgaggacatccagggagatgaccgctggatgagccagcacaacagatttgtgctggactgcaaggacaaggagccagatgtgctgtttgtgggggacagcatggtgcagctgatgcagcagtatgagatctggagggagctgttcagccccctgcacgccctgaactttggaattggaggagacaccaccaggcatgtgctgtggaggctgaagaatggagagctggagaacatcaagcccaaggtgattgtggtgtgggtgggcaccaacaaccacgagaacacagctgaggaggtggccggcggcatcgaggccatcgtgcagctgatcaacacccggcagccccaggcctag

SEQ ID NO: 164323 - DNA, 690 bp, Artificial Sequence
  Description of Artificial Sequence: Synthetic coding sequence
atgagccagggcgacagcaacccagctgccatcccccacgccgctgaggacatccagggagatgaccgctggatgagccagcacaacagatttgtgctggactgcaaggacaaggagccagatgtgctgtttgtgggggacagcatggtgcagctgatgcagcagtatgagatctggagggagctgttcagccccctgcacgccctgaactttggaattggaggagacaccaccaggcatgtgctgtggaggctgaagaatggagagctggagaacatcaagcccaaggtgattgtggtgtgggtgggcaccaacaaccacgagaacacagctgaggaggtggccggcggcatcgaggccatcgtgcagctgatcaacacccggcagccccaggccaagatcatcgtgctgggcctgctgcccagaggagagaagcccaaccccctgcggcagaagaatgccaaggtgaaccagctgctgaaggtgtccctgcccaagctggccaacgtgcagctgctggacacagatggcggctttgtgcacagtgatggagccatcagctgccacgacatgtttgacttcctgcacctgaccggcggcggctacgccaagatctgcaagcccctgcacgagctgatcatgcagctgctggaggagaccccagaggagaagcagaccaccatcgcctag

SEQ ID NO: 164324 - DNA, 468 bp, Artificial Sequence
  Description of Artificial Sequence: Synthetic coding sequence
atgagccagggcgacagcaacccagctgccatcccccacgccgctgaggacatccagggagatgaccgctggatgagccagcacaacagatttgtgctggactgcaaggacaaggagccagatgtgctgtttgtgggggacagcatggtgcagctgatgcagcagtatgagatctggagggagctgttcagccccctgcacgccctgaactttggaattggaggagacaccaccaggcatgtgctgtggaggctgaagaatggagagctggagaacatcaagcccaaggtgattgtggtgtgggtgggcaccaacaaccacgagaacacagctgaggaggtggccggcggcatcgaggccatcgtgcagctgatcaacacccggcagccccaggccaagatcatcgtgctgatcatctactggcaggatgagcaggactaccacgagaggaaggtgcagatggactag

SEQ ID NO: 164325 - DNA, 609 bp, Artificial Sequence
  Description of Artificial Sequence: Synthetic coding sequence
atgagccagggcgacagcaacccagctgccatcccccacgccgctgaggacatccagggagatgaccgctggatgagccagcacaacagatttgtgctggactgcaaggacaaggagccagatgtgctgtttgtgggggacagcatggtgcagctgatgcagcagtatgagatctggagggagctgttcagccccctgcacgccctgaactttggaattggaggagacaccaccaggcatgtgctgtggaggctgaagaatggagagctggagaacatcaagcccaaggtgattgtggtgtgggtgggcaccaacaaccacgagaacacagctgaggaggtggccggcggcatcgaggccatcgtgcagctgatcaacacccggcagccccaggccaagatcatcgtgctgggcaaggctgctgccagcaagtacagcatcagcgagatcgtgcggctggagcagggctctgtgaactggagcatcggcacctacccagatgacaccccagccaccaccaggcctgccatcctgcagctgttcaccgggaagatgagccgcatcaccatgaaggagaagagccgctggacagaggagatcctgcactag

SEQ ID NO: 164326 - DNA, 696 bp, Artificial Sequence
  Description of Artificial Sequence: Synthetic coding sequence
atgtctggagaagaaaatcctgccagcaagcccacccctgtgcaggatgtgcagggagatggccgctggatgagcctgcaccacagatttgtggccgacagcaaggacaaggagcctgaggtggtgttcatcggggacagcctggtgcagctgatgcaccagtgtgagatctggagggagctgttcagccccctgcacgccctgaactttggaattggaggagatggcacccagcacgtgctgtggaggctggagaatggagagctggagcacatccggcccaagatcgtggtggtgtgggtgggcaccaacaaccacggccacacagctgagcaggtgactggaggcatcaaggccatcgtgcagctggtgaatgaaaggcagccccaggcccgggtggtggtgctgggcctgctgccccggggccagcaccccaaccccctgcgggagaagaaccggcaggtgaatgagctggtgcgggccgccctggccggccacccccgggcccacttcctggatgctgaccccggctttgtgcacagtgatggcaccatcagccaccacgacatgtatgactacctgcacctgagccggctgggctacacccctgtgtgccgggccctgcacagcctgctgctgcggctgctggcccaggaccagggccagggcgcccccctgctggagcccgccccctag

SEQ ID NO: 164327 - DNA, 696 bp, Artificial Sequence; identical to SEQ ID NO: 164326
  Description of Artificial Sequence: Synthetic coding sequence

SEQ ID NO: 164328 - DNA, 720 bp, Artificial Sequence
  Description of Artificial Sequence: Synthetic coding sequence
atgaccatcaagctgtgggacttccagggctttgagtgcatccgcaccatgcacggccatgaccacaacgtgtcctctgtggccatcatgcccaacggggaccacatcgtgtctgccagccgggacaagaccatcaagatgtgggaggtgcagacaggctactgtgtgaagaccttcaccggccaccgggagtgggtgaggatggtgcggcccaaccaggacggcaccctcatcgccagctgcagcaatgaccagacagtgcgggtgtgggtggtggccaccaaggagtgcaaggccgagctgcgggagcacgagcacgtggtggagtgcatctcctgggcccctgagagcagctacagcagcatcagcgaggccaccggcagcgagaccaagaagagcggcaagccaggccccttcctgctgagcggcagccgggacaagaccatcaagatgtgggatgtgtccacaggcatgtgcctgatgaccctggtgggccatgacaactgggtgcggggcgtgctcttccacagcggcggcaagttcatcctgagctgtgctgatgacaagaccctgcgggtgtgggactacaagaacaagcgctgcatgaagaccctgaatgcccacgagcactttgtgaccagcctggacttccacaagacagccccctacgtggtgacaggctctgtggaccagacagtgaaggtgtgggagtgcaggtag

SEQ ID NO: 164329 - DNA, 1233 bp, Artificial Sequence
  Description of Artificial Sequence: Synthetic coding sequence
atggtgctgagccagaggcagagagatgagctgaacagagccatcgctgactacctgcggagcaatggctatgaggaggcctacagcgtcttcaagaaggaggccgagctggatgtgaatgaggagctggacaagaagtatgccggcctgctggagaagaagtggaccagcgtcatccggctgcagaagaaggtgatggagctggagagcaagctgaatgaggccaaggaggagttcaccagcggcggccccctgggccagaagagggaccccaaggagtggatcccccggcccccagagaagtatgccctgagcggccacaggagccctgtgaccagggtcatcttccaccctgtgttttctgtgatggtgtctgcctctgaagatgccaccatcaaggtgtgggactatgaaacaggagactttgagaggaccctgaagggccacacagacagcgtgcaggacatcagctttgaccacagcggcaagctgctggccagctgcagcgctgacatgaccatcaagctgtgggacttccagggctttgagtgcatccgcaccatgcacggccatgaccacaacgtgtcctctgtggccatcatgcccaatggagaccacatcgtgtctgccagccgggacaagaccatcaagatgtgggaggtgcagacaggctactgtgtgaagaccttcaccggccaccgggagtgggtgaggatggtgcggcccaaccaggacggcaccctgattgccagctgcagcaatgaccagacagtgcgggtgtgggtggtggccaccaaggagtgcaaggccgagctgcgggagcatgaacatgtggtggagtgcatctcctgggcccctgagagcagctacagcagcatcagcgaggccactggaagtgagaccaagaagagcggcaagccaggccccttcctgctgagcggcagccgggacaagaccatcaagatgtgggatgtgtccacaggcatgtgcctgatgaccctggtgggccatgacaactgggtgcggggcgtgctcttccacagcggcggcaagttcatcctgagctgtgctgatgacaagaccctgcgggtgtgggactacaagaacaagcgctgcatgaagaccctgaatgcccacgagcactttgtgaccagcctggacttccacaagacagccccctacgtggtgactggatctgtggaccagacagtgaaggtgtgggagtgcaggtag

SEQ ID NO: 164330 - DNA, 618 bp, Artificial Sequence
  Description of Artificial Sequence: Synthetic coding sequence
atgaccatcaagctgtgggacttccagggctttgagtgcatccgcaccatgcacggccatgaccacaacgtgtcctctgtggccatcatgcccaacggggaccacatcgtgtctgccagccgggacaagaccatcaagatgtgggaggtgcagacaggctactgtgtgaagaccttcaccggccaccgggagtgggtgaggatggtgcggcccaaccaggacggcaccctcatcgccagctgcagcaatgaccagacagtgcgggtgtgggtggtggccaccaaggagtgcaaggccgagctgcgggagcacgagcacgtggtggagtgcatctcctgggcccctgagagcagctacagcagcatcagcgaggccaccggcagcgaggtgggccatgacaactgggtgcggggcgtgctcttccacagcggcggcaagttcatcctgagctgtgctgatgacaagaccctgcgggtgtgggactacaagaacaagcgctgcatgaagaccctgaatgcccacgagcactttgtgaccagcctggacttccacaagacagccccctacgtggtgacaggctctgtggaccagacagtgaaggtgtgggagtgcaggtag

SEQ ID NO: 164331 - DNA, 1029 bp, Artificial Sequence
  Description of Artificial Sequence: Synthetic coding sequence
atggagccccatgacagcagccacatggattctgagttccgctacaccctcttccccatcgtgtacagcatcatctttgtgctgggcgtgattgccaacggctacgtgctgtgggtgtttgcccggctgtacccctgcaagaagttcaatgagatcaagatcttcatggtgaacctgaccatggctgacatgctgttcctgatcaccctgcccctgtggatcgtgtactaccagaaccagggcaactggatcctgcccaagttcctgtgcaatgtggccggctgcctcttcttcatcaacacctactgcagcgtggccttcctgggcgtcatcacctacaaccgcttccaggccgtgacccggcccatcaagacagcccaggccaacaccaggaagaggggcatcagcctgagcctggtgatctgggtggccatcgtgggcgccgccagctacttcctgatcctggacagcaccaacacagtgcctgacagcgctggcagcggaaatgtgacccgctgctttgagcactatgaaaaaggatctgtgcctgtgctgatcatccacatcttcatcgtgttctccttcttcctggtgttcctgatcatcctcttctgcaacctggtgatcatccgcaccctgctgatgcagcctgtgcagcagcagagaaatgctgaggtgaagaggcgggccctgtggatggtgtgcaccgtgctggccgtgttcatcatctgctttgtgccccaccacgtggtgcagctgccctggaccctggccgagctgggcttccaggacagcaagttccaccaggccatcaatgatgcccaccaggtgaccctgtgcctgctgagcaccaactgtgtgctggaccccgtcatctactgcttcctgaccaagaagttcaggaagcacctgacagagaagttctacagcatgaggagcagcaggaagtgcagccgggccaccacagacacagtgacagaggtggtggtgcccttcaaccagatccctggcaacagcctgaagaactag

SEQ ID NO: 164332 - DNA, 1029 bp, Artificial Sequence; identical to SEQ ID NO: 164331
  Description of Artificial Sequence: Synthetic coding sequence

SEQ ID NO: 164333 - DNA, 1029 bp, Artificial Sequence; identical to SEQ ID NO: 164331
  Description of Artificial Sequence: Synthetic coding sequence

SEQ ID NO: 164334 - DNA, 1128 bp, Artificial Sequence
  Description of Artificial Sequence: Synthetic coding sequence
atgaaggtgtggctgctgctgggcctgctgctggtgcatgaggccctggaggatgtgacaggccagcacctgcccaagaacaagaggcccaaggagcctggagaaaatcgcatcaagcccaccaacaagaaggtgaagcccaagatccccaagatgaaggaccgggacagcgccaacagcgcccccaagacccagagcatcatgatgcaggtgctggacaagggccgcttccagaagccagctgccaccctgagcctgctggccggccagacagtggagctgcgctgcaagggcagcagaattggctggagctacccagcctacctggacaccttcaaggacagccggctgtctgtgaagcagaatgaaagatatggccagctgaccctggtgaacagcaccagcgctgacaccggggagttcagctgctgggtgcagctgtgcagcggctacatctgcaggaaggatgaggccaagacaggcagcacctacatcttcttcacagagaagggggagctgtttgtgcccagccccagctactttgatgtggtgtacctgaacccagaccggcaggccgtggtgccctgccgggtgacagtgctgagcgccaaggtgaccctgcaccgggagttccctgccaaggagatcccagccaatggaacagacatcgtgtatgacatgaagaggggctttgtgtacctgcagccccacagcgagcaccagggcgtggtgtactgcagagctgaggccggcggccgcagccagatctctgtgaagtaccagctgctgtatgtggccgtgcccagcggcccccccagcaccaccatcctggccagcagcaacaaggtgaagtctggagatgacatctctgtgctgtgcaccgtgctgggggagccagatgtggaggtggagttcacctggatcttccctggccagaaggatgagaggcctgtgaccatccaggacacctggaggctcatccaccggggcctgggccacaccacccgcatcagccagagcgtcatcaccgtggaggactttgagaccattgatgctggctactacatctgcacagcccagaacctgcagggccagaccaccgtggccaccaccgtggagttctcctag

SEQ ID NO: 164335 - DNA, 1128 bp, Artificial Sequence; identical to SEQ ID NO: 164334
  Description of Artificial Sequence: Synthetic coding sequence

SEQ ID NO: 164336 - DNA, 1128 bp, Artificial Sequence; identical to SEQ ID NO: 164334
  Description of Artificial Sequence: Synthetic coding sequence

SEQ ID NO: 164337 - DNA, 3075 bp, Artificial Sequence
  Description of Artificial Sequence: Synthetic coding sequence
atggcccagggcgccatgaggttctgcagcgagggggactgtgccatcagccccccacgctgcccccggcgctggctgcctgagggccctgtgccccagagccccccagcctccatgtatggcagcacaggcagcctgctgcggcgggtggccggccctggcccccggggccgggagctgggccgggtgacagccccctgcacccccctgcggggcccccccagcccccgggtggcccccagcccctgggcccccagcagccccaccggccagcccccacctggggcccagagctctgtggtgatcttccgctttgtggagaaggcctctgtgcggcccctgaatggcctgcctgcccctgggggcctgagccgctcctgggacctgggcggcgtgagccccccccggcccaccccagccctgggccctggcagcaacaggaagctgcggctggaggccagcaccagtgaccccctgcctgcccggggcggcagcgccctgcccggcagcaggaacctggtgcacggccccccagccccaccccaggtgggcgcagatggcctgtacagcagcctgcccaacggcctgggcggccccccagagcggctggccaccctgtttggaggccctgctgacaccggcttcctgaaccagggcgacacctggagcagcccccgggaggtgagcagccacgcccagagaattgcccgggccaagtgggagttcttctacggcagcctggacccccccagcagcggggccaagcccccagagcaggccccacccagccccccaggagtgggcagccggcagggcagcggcgtggccgtgggccgggccgccaagtacagcgagacagacctggacacagtgcccctgcgctgctaccgggagacagacattgatgaggtgctggccgagcgggaggaggccgacagcgccatcgagagccagcccagcagcgagggccccccaggcacagcctaccccccagcccccaggcctggccccctgcccggcccccaccccagcctgggcagcggaaatgaagatgaagatgatgatgaagctggaggagaagaagatgtggatgatgaggtgtttgaggccagcgagggcgcccggcccggcagcaggatgcccctgaagagccctgtgcccttcctgcccggcaccagccccagcgcagatggccctgacagcttcagctgtgtgtttgaggccatcctggagagccaccgggccaagggcaccagctacaccagcctggccagcctggaggccctggccagccctggccccacccagagccccttcttcacctttgagctgcccccccagcccccagcccccaggccagaccccccagccccagcccccctggcccccctggagccagacagcggcaccagcagcgctgctgatggcccctggacccagagaggagaggaggaggaggccgaggcccgggccaagctggcccctggccgggagccccccagcccctgccacagcgaggacagcctgggcctgggcgccgcccccctgggcagcgagccccccctgagccagctggtgtctgacagcgacagcgagctggacagcacagagcggctggccctgggcagcacagacaccctgagcaatggccagaaggctgacctggaggccgcccagaggctggccaagaggctgtaccgcctggatggcttcaggaaggcagatgtggcccggcacctgggcaagaacaatgacttcagcaagctggtggccggggagtacctgaagttctttgtgttcaccggcatgaccctggaccaggccctgcgggtcttcctgaaggagctggccctgatgggagagacccaggagcgggagcgggtgctggcccacttcagccagcgctacttccagtgcaaccctgaggccctgagcagtgaagatggagcccacaccctgacctgtgccctgatgctgctgaacacagacctgcacggccacaacatcggcaagaggatgacctgtggggacttcatcggcaacctggagggcctgaatgatggaggagacttcccccgggagctgctgaaggccctgtacagcagcatcaagaatgagaagctgcagtgggccattgatgaggaggagctgcggcgcagcctgtctgagctggccgaccccaaccccaaggtgatcaagaggatcagcggcggcagcggcagcggcagcagccccttcctggacctgaccccagagcctggagctgctgtgtacaagcacggggccctggtgaggaaggtgcatgctgaccctgactgcaggaagaccccccggggcaagaggggctggaagagcttccacggcatcctgaagggcatgatcctgtacctgcagaaggaggagtacaagccaggcaaggccctgtctgaaacagagctgaagaatgccatcagcatccaccacgccctggccacccgggccagtgactacagcaagaggcctcatgtgttctacctgaggacagctgactggagggtcttcctgttccaggcccccagcctggagcagatgcagagctggatcacccgcatcaacgtggtggccgccatgttcagcgccccacccttccctgctgctgtgagcagccagaagaagttcagccggcccctgctgcccagcgctgccacccggctgagccaggaggagcaggtgaggacccatgaggccaagctgaaggccatggccagcgagctgcgggagcacagagctgcccagctgggcaagaagggccggggcaaggaggccgaggagcagaggcagaaggaggcctacctggagtttgagaagagccgctacagcacctacgccgccctgctgcgggtgaagctgaaggccggcagcgaggagctggatgctgtggaggccgccctggcccaggccggcagcacagaagatggcctgccccccagccacagcagccccagcctgcagcccaagcccagcagccagccccgggcccagaggcacagcagcgagcccaggcctggagctggcagcggccgcaggaagccctag

SEQ ID NO: 164338 - DNA, 3075 bp, Artificial Sequence; identical to SEQ ID NO: 164337
  Description of Artificial Sequence: Synthetic coding sequence

SEQ ID NO: 164339 - DNA, 2784 bp, Artificial Sequence
  Description of Artificial Sequence: Synthetic coding sequence
cagatctggcgctgccccctgcagcaccacgccgagagcgccccacccctgcctgccctgtcctgggcccagcccctgctgtgcctgagctctgtgtctgccctgggggagcagaggcccaccccagccctgggccctggcagcaacaggaagctgcggctggaggccagcaccagtgaccccctgcctgcccggggcggcagcgccctgcccggcagcaggaacctggtgcacggccccccagccccaccccaggtgggcgcagatggcctgtacagcagcctgcccaacggcctgggcggccccccagagcggctggccaccctgtttggaggccctgctgacaccggcttcctgaaccagggcgacacctggagcagcccccgggaggtgagcagccacgcccagagaattgcccgggccaagtgggagttcttctacggcagcctggacccccccagcagcggggccaagcccccagagcaggccccacccagccccccaggagtgggcagccggcagggcagcggcgtggccgtgggccgggccgccaagtacagcgagacagacctggacacagtgcccctgcgctgctaccgggagacagacattgatgaggtgctggccgagcgggaggaggccgacagcgccatcgagagccagcccagcagcgagggccccccaggcacagcctaccccccagccccccggcccggccccctgcccggcccccaccccagcctgggcagcggaaatgaagatgaagatgatgatgaggccggcggggaggaggatgtggatgatgaggtgtttgaggccagcgagggcgcccggcccggcagcaggatgcccctgaagagccctgtgcccttcctgcccggcaccagccccagcgcagatggccctgacagcttcagctgtgtgtttgaggccatcctggagagccaccgggccaagggcaccagctacaccagcctggccagcctggaggccctggccagccctggccccacccagagccccttcttcacctttgagctgcccccccagcccccagcccccaggccagaccccccagccccagcccccctggcccccctggagccagattctggcaccagcagcgctgctgatggcccctggacccagagaggagaggaggaggaggccgaggcccgggccaagctggcccctggccgggagccccccagcccctgccacagcgaggacagcctgggcctgggcgccgcccccctgggcagcgagccccccctgagccagctggtgtctgacagcgacagcgagctggacagcacagagcggctggccctgggcagcacagacaccctgagcaatggccagaaggctgacctggaggccgcccagaggctggccaagaggctgtaccgcctggatggcttcaggaaggcagatgtggcccggcacctgggcaagaacaatgacttcagcaagctggtggccggggagtacctgaagttctttgtgttcaccggcatgaccctggaccaggccctgcgggtcttcctgaaggagctggccctgatgggagagacccaggagcgggagcgggtgctggcccacttcagccagcgctacttccagtgcaaccctgaggccctgagcagtgaagatggagcccacaccctgacctgtgccctgatgctgctgaacacagacctgcacggccacaacatcggcaagaggatgacctgtggggacttcatcggcaacctggagggcctgaatgatggaggagacttcccccgggagctgctgaaggccctgtacagcagcatcaagaatgagaagctgcagtgggccattgatgaggaggagctgcggcgcagcctgtctgagctggccgaccccaaccccaaggtgatcaagaggatcagcggcggcagcggcagcggcagcagccccttcctggacctgaccccagagcccggggctgctgtgtacaagcatggagccctggtgaggaaggtgcacgccgaccctgactgcaggaagaccccccggggcaagaggggctggaagagcttccacggcatcctgaagggcatgatcctgtacctgcagaaggaggagtacaagccaggcaaggccctgtctgaaacagagctgaagaatgccatcagcatccaccacgccctggccacccgggccagtgactacagcaagaggccccacgtgttctacctgaggacagctgactggagggtcttcctgttccaggcccccagcctggagcagatgcagagctggatcacccgcatcaacgtggtggccgccatgttttctgccccacccttccctgctgctgtgagcagccagaagaagttcagccggcccctgctgcccagcgctgccacccggctgagccaggaggagcaggtgaggacccatgaggccaagctgaaggccatggccagcgagctgcgggagcaccgggccgcccagctgggcaagaagggccggggcaaggaggccgaggagcagaggcagaaggaggcctacctggagtttgagaagagccgctacagcacctatgctgccctgctgcgggtgaagctgaaggccggcagcgaggagctggatgctgtggaggccgccctggcccaggccggcagcacagaagatggcctgccccccagccacagcagccccagcctgcagcccaagcccagcagccagccccgggcccagaggcacagcagcgagcccaggcctggggccggcagcggccgcaggaagccctag

SEQ ID NO: 164340 - DNA, 1542 bp, Artificial Sequence
  Description of Artificial Sequence: Synthetic coding sequence
atgggcagctcctggtgcctgtatggctgctgcaatgccggcgtgaagaccacccggctggaggcccacagcgagatgggcagcacagagatcctggagaaggagaccccagagaacctgagcaatggcaccagcagcaatgtggaggccgccaagaggctggccaagaggctgtaccagctggaccgcttcaagagaagtgatgtggccaagcacctgggcaagaacaatgagttcagcaagctggtggccgaggagtacctgaagttctttgacttcaccggcatgaccctggaccagagcctgcgctacttcttcaaggccttcagcctggtgggggagacccaggagcgggagcgggtgctgatccacttcagcaaccgctacttctactgcaacccagacaccatcgccagccaggatggagtgcactgcctgacctgtgccatcatgctgctgaacacagacctgcacggccacaacatcggcaagaagatgacctgccaggagttcatcgccaacctgcagggcgtgaatgaaggagtggacttcagcaaggacctgctgaaggccctgtacaacagcatcaagaatgagaagctggagtgggccgtggatgatgaggagaagaagaagagccccagcgagagcacagaggagaaggccaacggcacccaccccaagaccatcagcagaattggcagcaccaccaaccccttcctggacatcccccatgaccccaatgctgctgtgtacaagagcggcttcctggccaggaagatccatgctgacatggatggcaagaagaccccccggggcaagaggggctggaagaccttctatgctgtgctgaagggcaccgtgctgtacctgcagaaggatgagtacaagccagagaaggccctgtctgaggaggacctgaagaatgctgtgtctgtgcaccacgccctggccagcaaggccacagattatgagaagaagcccaacgtgttcaagctgaagacagctgactggagggtgctgctcttccagacccagagccctgaggagatgcagggctggatcaacaagatcaactgtgtggccgctgtgttcagcgccccacccttccctgctgccatcggcagccagaagaagttcagccggcccctgctgcctgccaccaccaccaagctgagccaggaggagcagctgaagagccatgagagcaagctgaagcagatcaccacagagctggccgagcacaggagctaccccccagacaagaaggtgaaggccaaggatgtggatgagtacaagctgaaggaccactacctggagtttgagaagaccaggtatgagatgtatgtgtccatcctgaaggagggcggcaaggagctgctgagcaatgatgagagcgaggccgccggcctgaagaagagccacagcagccccagcctgaacccagacaccagccccatcacagccaaggtgaagagaaatgtgtctgagaggaaggaccacaggcctgagacccccagcatcaagcagaaggtgacctag

SEQ ID NO: 164341 - DNA, 3144 bp, Artificial Sequence
  Description of Artificial Sequence: Synthetic coding sequence
atggagggccgctctgctgctgctgagacctttgtgtgggtgaacaatgccagcgcccacagccagagcgtggccaaggccaagtatgagttcctgtttggccgctctgagggcaaggccccagacaccagtgaccacggcggcagcaccctgctgcccccaaatgtgaccaatgagttcccagaatatggcaccatggaggagggcggggagggcctgcgggccagcctggagtttgatggagaggccctgccctgccacccccaggagcagcagggcgtgcagcccctgaccggctgccacagcggcctggacagcgtgacagagggccccaaggatgtgcgggaggcccccagccagagccacctgaaggagcagagcctgcagcccatcgacagcctcatcagcgccctgaaggccacagaggcccgcatcatcagcggcaccctgcaggccaccaaggtgctggaccaggatgctgtgtcctccttctctgtgcagcaggtggagaaggagctggacacagccagcaggaagacccagagggtgaacaagaccctgcctgctggccagaagaacctgcctgagatccccctgtctgctgaggtgaccacagaggagagcttctacctgagcatccagaaggacctgacagccctgctgaccggggacacccaggccgagatcagccagatcatgaacaatggaagaaaaggagctgtgtgtgtgcaggagcccagctgccccctggccagcctgggcagcagcgctgtgacctgccacagcgctggctctgtgggcttcctgaaggagcagaggtctgccctgggccgggagcaccctgggggctgtgacaggagcagctccatgggccggcccggccgggtgaagcacgtggagttccagggcgtggagatcctgtggacaggaggagacaagcgggagacccagcaccccatcgactttgagaccagcctgcagaggacagccagcccagacagcaaggagagcagcaaggtgcccaggcacctgatcagcagcgctggcctgtgcaacagcagcagcctgacagaaaatgtgtgggatgagagctggaaggcccccagcgagcggcccggcaccagcagcggcaccttcagccctgtgcggctggatgaaagtggagaagatgaggtgttcctgcaggagaacaagcagcacctggagaagacccccaagccagagcgggaccgggagcgcatcagcgagcaggaggagcacgtgaagggggaggatgaggacatcctgggccctggctacacagaggacagcacagatgtgtacagcagccagtttgagaccatcctggacaacaccagcctgtactacagcgctgagagcctggagaccctgtacagcgagccagacagctacttctcctttgagatgcccctgacccccatgatccagcagaggatcaaggagggcggccagttcctggagaggaccagcggcggcggccaccaggacatcctgtctgtgtctgcagatggcggcatcgtgatgggctacagcagtggagtgaccaacggcctgaatgatgccagtgacagcatctacaccaagggcaccccagagatcgccttctggggcagcaatgccggcgtgaagaccacccggctggaggcccacagcgagatgggcagcacagagatcctggagaaggagaccccagagaacctgagcaatggcaccagcagcaatgtggaggccgccaagaggctggccaagaggctgtaccagctggaccgcttcaagagaagtgatgtggccaagcacctgggcaagaacaatgagttcagcaagctggtggccgaggagtacctgaagttctttgacttcaccggcatgaccctggaccagagcctgcgctacttcttcaaggccttcagcctggtgggggagacccaggagcgggagcgggtgctgatccacttcagcaaccgctacttctactgcaacccagacaccatcgccagccaggatggagtgcactgcctgacctgtgccatcatgctgctgaacacagacctgcacggccacaacatcggcaagaagatgacctgccaggagttcatcgccaacctgcagggcgtgaatgaaggagtggacttcagcaaggacctgctgaaggccctgtacaacagcatcaagaatgagaagctggagtgggccgtggatgatgaggagaagaagaagagccccagcgagagcacagaggagaaggccaacggcacccaccccaagaccatcagcagaattggcagcaccaccaaccccttcctggacatcccccatgaccccaatgctgctgtgtacaagagcggcttcctggccaggaagatccatgctgacatggatggcaagaagaccccccggggcaagaggggctggaagaccttctatgctgtgctgaagggcaccgtgctgtacctgcagaaggatgagtacaagccagagaaggccctgtctgaggaggacctgaagaatgctgtgtctgtgcaccacgccctggccagcaaggccacagattatgagaagaagcccaacgtgttcaagctgaagacagctgactggagggtgctgctcttccagacccagagccctgaggagatgcagggctggatcaacaagatcaactgtgtggccgctgtgttcagcgccccacccttccctgctgccatcggcagccagaagaagttcagccggcccctgctgcctgccaccaccaccaagctgagccaggaggagcagctgaagagccatgagagcaagctgaagcagatcaccacagagctggccgagcacaggagctaccccccagacaagaaggtgaaggccaaggatgtggatgagtacaagctgaaggaccactacctggagtttgagaagaccaggtatgagatgtatgtgtccatcctgaaggagggcggcaaggagctgctgagcaatgatgagagcgaggccgccggcctgaagaagagccacagcagccccagcctgaacccagacaccagccccatcacagccaaggtgaagagaaatgtgtctgagaggaaggaccacaggcctgagacccccagcatcaagcagaaggtgacctag

SEQ ID NO: 164342 - DNA, 810 bp, Artificial Sequence
  Description of Artificial Sequence: Synthetic coding sequence
atgattggagtgaacagcgtgcagagcgccagcaaggtgcgggtgaggaccagcggctctgtgaagtacagccgggaggacagcatccggcggcagagccacaggagcaagtccatgaagatcagcaacagcagcgagttcagcgccaaggagaacaaggccctgtacaacagcatcaagaatgagaagctggagtgggccgtggatgatgaggagaagaagaagagccccagcgagagcacagaggagaaggccaacggcacccaccccaagaccatcagccgcatcggcagcaccaccaaccccttcctggacatcccccatgaccccaatgctgctgtgtacaagagcggcttcctggccaggaagatccacgccgacatggatggcaagaagaccccccggggcaagaggggctggaagaccttctatgctgtgctgaagggcaccgtgctgtacctgcagaagcatgagagcaagctgaagcagatcaccacagagctggccgagcacaggagctaccccccagacaagaaggtgaaggccaaggatgtggatgagtacaagctgaaggaccactacctggagtttgagaagaccaggtatgagatgtatgtgtccatcctgaaggagggcggcaaggagctgctgagcaatgatgagagcgaggccgccggcctgaagaagagccacagcagccccagcctgaacccagacaccagccccatcacagccaaggtgaagagaaatgtgtctgagaggaaggaccacaggcctgagacccccagcatcaagcagaaggtgacctag

SEQ ID NO: 164343 - DNA, 3150 bp, Artificial Sequence
  Description of Artificial Sequence: Synthetic coding sequence
atggagggccgctctgctgctgctgagacctttgtgtgggtgaacaatgccagcgcccacagccagagcgtggccaaggccaagtatgagttcctgtttggccgctctgagggcaaggccccagacaccagtgaccacggcggcagcaccctgctgcccccaaatgtgaccaatgagttcccagaatatggcaccatggaggagggcggggagggcctgcgggccagcctggagtttgatggagaggccctgccctgccacccccaggagcagcagggcgtgcagcccctgaccggctgccacagcggcctggacagcgtgacagagggccccaaggatgtgcgggaggcccccagccagagccacctgaaggagcagagcctgcagcccatcgacagcctcatcagcgccctgaaggccacagaggcccgcatcatcagcggcaccctgcaggccaccaaggtgctggaccaggatgctgtgtcctccttctctgtgcagcaggtggagaaggagctggacacagccagcaggaagacccagagggtgaacaagaccctgcctgctggccagaagaacctgcctgagatccccctgtctgctgaggtgaccacagaggagagcttctacctgagcatccagaaggacctgacagccctgctgaccggggacacccaggccgagatcagccagatcatgaacaatggaagaaaaggagctgtgtgtgtgcaggagcccagctgccccctggccagcctgggcagcagcgctgtgacctgccacagcgctggctctgtgggcttcctgaaggagcagaggtctgccctgggccgggagcaccctgggggctgtgacaggagcagctccatgggccggcccggccgggtgaagcacgtggagttccagggcgtggagatcctgtggacaggaggagacaagcgggagacccagcaccccatcgactttgagaccagcctgcagaggacagccagcccagacagcaaggagagcagcaaggtgcccaggcacctgatcagcagcgctggcctgtgcaacagcagcagcctgacagaaaatgtgtgggatgagagctggaaggcccccagcgagcggcccggcaccagcagcggcaccttcagccctgtgcggctggatgaaagtggagaagatgaggtgttcctgcaggagaacaagcagcacctggagaagacccccaagccagagcgggaccgggagcgcatcagcgagcaggaggagcacgtgaagggggaggatgaggacatcctgggccctggctacacagaggacagcacagatgtgtacagcagccagtttgagaccatcctggacaacaccagcctgtactacagcgctgagagcctggagaccctgtacagcgagccagacagctacttctcctttgagatgcccctgacccccatgatccagcagaggatcaaggagggcggccagttcctggagaggaccagcggcggcggccaccaggacatcctgtctgtgtctgcagatggcggcatcgtgatgggctacagcagtggagtgaccaacggcctgaatgatgccagtgacagcatctacaccaagggcaccccagagatcgccttctggggcagcaatgccggcgtgaagaccacccggctggaggcccacagcgagatgggcagcacagagatcctggagaaggagaccccagagaacctgagcaatggcaccagcagcaatgtggaggccgccaagaggctggccaagaggctgtaccagctggaccgcttcaagagaagtgatgtggccaagcacctgggcaagaacaatgagttcagcaagctggtggccgaggagtacctgaagttctttgacttcaccggcatgaccctggaccagagcctgcgctacttcttcaaggccttcagcctggtgggggagacccaggagcgggagcgggtgctgatccacttcagcaaccgctacttctactgcaacccagacaccatcgccagccaggatggagtgcactgcctgacctgtgccatcatgctgctgaacacagacctgcacggccacgtgagcaacatcggcaagaagatgacctgccaggagttcatcgccaacctgcagggcgtgaatgaaggagtggacttcagcaaggacctgctgaaggccctgtacaacagcatcaagaatgagaagctggagtgggccgtggatgatgaggagaagaagaagagccccagcgagagcacagaggagaaggccaacggcacccaccccaagaccatcagcagaattggcagcaccaccaaccccttcctggacatcccccatgaccccaatgctgctgtgtacaagagcggcttcctggccaggaagatccatgctgacatggatggcaagaagaccccccggggcaagaggggctggaagaccttctatgctgtgctgaagggcaccgtgctgtacctgcagaaggatgagtacaagccagagaaggccctgtctgaggaggacctgaagaatgctgtgtctgtgcaccacgccctggccagcaaggccacagattatgagaagaagcccaacgtgttcaagctgaagacagctgactggagggtgctgctcttccagacccagagccctgaggagatgcagggctggatcaacaagatcaactgtgtggccgctgtgttcagcgccccacccttccctgctgccatcggcagccagaagaagttcagccggcccctgctgcctgccaccaccaccaagctgagccaggaggagcagctgaagagccatgagagcaagctgaagcagatcaccacagagctggccgagcacaggagctaccccccagacaagaaggtgaaggccaaggatgtggatgagtacaagctgaaggaccactacctggagtttgagaagaccaggtatgagatgtatgtgtccatcctgaaggagggcggcaaggagctgctgagcaatgatgagagcgaggccgccggcctgaagaagagccacagcagccccagcctgaacccagacaccagccccatcacagccaaggtgaagagaaatgtgtctgagaggaaggaccacaggcctgagacccccagcatcaagcagaaggtgacctag

SEQ ID NO: 164344 - DNA, 3171 bp, Artificial Sequence
  Description of Artificial Sequence: Synthetic coding sequence
atgatgggagactaccgcctgcctgaccacccccagcccatggagatcctgaacctgtacctgggggacagcctggagccccaccctggagaatgtccccgggagacctgcagccatgaggaccccccagagccctttgaggagcagacctgggccacagatcctcctgagcccacccggcagaatgtgcccccctggggcagcggcgtggagctgacccacctgggctcctgggtgcaccaggacggcctggagccctgccaggagcagacccgggccacagaccccccagagagcacccggcaggatgccccaccctggggcagcggcgtggagctgacccacctgggcagccccagcgcccagcgggagcaccggcagaacacagccagccctggcagccctgtgaacagccacctgcccggcagccccaagcagaacagaagcaccagcacccaggtggtgttctgggccggcatcctgcaggcccagatgtgtgtgctggacctggaggaggagctggagaagacagagggcctgaaggccggcctgaagtgctgcctgcccaccccacctgtggacctgcccggggacaccggcctgcacagcagccccccagaaaatgaagattctggagaggacagcagcgagcctgagggggagggccaggcctggctgcgggagggcaccccagacagcagcccccagtggggcgctgaggaggagagcatgttcttcagcaaccccctcttcctggccagcccctgcagcgagaacagcgccagcggggagtgcttctcctggggcgccagtgacagccatgctggggtgaggactggacctgagagccctgccaccctggagccccccctgcctgaagatactgtgctgtgggagctggagagcgagccagacctgggagatggagctgccatcagcggccactgcaccccacccttccctgtgcccatctacaagccccacagcatctgctgggcctctgtggccgctgctgagggcgccccagctgcccctcctggccacggggagagcgagggggaccggctgggccctgcccccagcgctgccccctgtgtggatgaggccctgacctgggagagcggctgtgtgggcagtgacctgggccctgctgcccaccctgtgcagccctgggccagcctgagccctgagggctggcagaggggcggccccttctggccccaggtgaccctgaacagccaggacagagatgagcgggagggcggccacccccaggagagcctgccctgcaccctggccccctgcccctggaggagccctgccagcagccctgagcccagcagccctgagagcgagagccggggccctggcccccggcccagccctgccagcagccaggagggcagcccccagctgcagcaccacagcagcggcatcctgcccaagtggaccctggatgccagccagagcagcctgctggagacagatggagagcagcccagcagcctgaagaagaaggaggccggggaggcccccaagccaggagaggaggtgaagtctgagggcacagcccggcctgctgagactggagatgtgcagcctgacatccacctgaccagcgctgagcacgagaacctgcggacccccatgaacagctcctggctgcccggcagccccatgccccaggcccagagccctgaggagggccagaggcccccagctggggacaagctggccaacggggtgaggaacaacaaggtggcctggaacctggccagccggctgtaccgcctggagggcttcaggaagtctgaggtggccgcctacctgcagaagaacaatgacttcagcagagctgtggccgaggagtacctgtccttcttccagtttggaggccagagcctggaccgggccctgcgctccttcctgcaggccctggtgctgtctggagagacccaggagcgggagcgcatcctgtaccagttcagccgccgcttccaccactgcaaccctggcatcttccccagcgtggacagcgtgcacaccctgacctgtgccatcatgctgctgaacacagacctgcacggccagaacatcggcaagtccatgagctgccaggagttcatcaccaacctgaatggcctgagagatggcggcaacttccccaaggagctgctgaaggccctgtactggagcatccgctctgagaagctggagtgggccgtggatgaggaggacacagcccggcctgagaaggcccagcccagcctgcctgctgggaagatgagcaagcccttcctgcagctggcccaggaccccaccgtgcccacctacaagcagggcatcctggccaggaagatgcaccaggatgctgatggcaagaagaccccctggggcaagaggggctggaagatgttccacaccctgctgcggggcatggtgctgtacttcctgaagcagggcgaggaccactgcctggagggggagagcctggtgggccagatggtggatgagcctgtgggcgtgcaccacagcctggccaccccagccacccactacaccaagaagccccacgtgttccagctgaggacagctgactggaggctgtacctgttccaggcccccacagccaaggagatgagctcctggatcgcccgcatcaacctggccgccgccacccacagcgccccacccttccctgctgctgtgggcagccagaggagatttgtgcggcccatcctgcctgtgggccctgcccagagcagcctggaggagcagcacaggagccatgagaactgcctggatgctgctgctgatgacctgctggacctgcagaggaacctgcctgagcggcggggccggggccgggagctggaggagcaccggctgaggaaggagtacctggagtatgagaagaccaggtatgagacctacgtgcagctgctggtggcccggctgcactgccccagtgatgccctggacctgtgggaggagcagctgggccgggaggccggcggcacccgggagcccaagctgagcctgaagaagagccacagcagccccagcctgcaccaggatgaggcccccaccacagccaaggtgaagaggaacatcagcgagaggaggacctacaggaagatcatccccaagaggaacagaaaccagctgtag

SEQ ID NO: 164345 - DNA, 1152 bp, Artificial Sequence
  Description of Artificial Sequence: Synthetic coding sequence
atgccctacgtggaccggcagaaccgcatctgtggcttcctggacatcgaggagaatgaaaacagcggcaagttcctgcggcgctacttcatcctggacacccgggaggacagctttgtgtggtacatggacaacccccagaacctgcccagcggcagcagccgggtgggcgccatcaagctgacctacatcagcaaggtgtctgatgccaccaagctgcggcccaaggccgagttctgctttgtgatgaatgccggcatgaggaagtacttcctgcaggccaatgaccagcaggacctggtggagtgggtgaatgtgctgaacaaggccatcaagatcaccgtgcccaagcagagcgacagccagcccaacagcgacaacctgagcagacatggagaatgtgggaagaagcaggtgtcctacagaacagacatcgtgggcggcgtgcccatcatcacccccacccagaaggaggaggtgaatgaatgtggggagagcattgacaggaacaacctgaagaggagccagagccacctgccctacttcacccccaagccaccccaggacagcgctgtgatcaaggccggctactgtgtgaagcagggcgctgtgatgaagaactggaagaggcgctacttccagctggatgagaacaccatcggctacttcaagtctgagctggagaaggagcccctgcgggtcatccccctgaaggaggtgcacaaggtgcaggagtgcaagcagagcgacatcatgatgagggacaacctgtttgagatcgtgaccaccagcaggaccttctacgtgcaggccgacagccctgaggagatgcacagctggatcaaggctgtgtctggggccatcgtggcccagaggggccctggccgcagcgccagctccatgaggcaggcccggcggctgagcaacccctgcatccagaggagcatcccccctgtgctgcagaaccccaacaccctgtctgtgctgcccacccagcccccaccaccccacatcccccagcccctggccgccaccctgtggagccagcccctgccctggaggtctgaggacttcaccagcctgctgcccaggagcagccagggcaccagccgcagccggctgagcctgcaggagaaccagctgcccaagtag

SEQ ID NO: 164346 - DNA, 1152 bp, Artificial Sequence; identical to SEQ ID NO: 164345
  Description of Artificial Sequence: Synthetic coding sequence

SEQ ID NO: 164347 - DNA, 1215 bp, Artificial Sequence
  Description of Artificial Sequence: Synthetic coding sequence
atgccctacgtggaccggcagaaccgcatctgtggcttcctggacatcgaggagaatgaaaacagcggcaagttcctgcggcgctacttcatcctggacacccgggaggacagctttgtgtggtacatggacaacccccagaacctgcccagcggcagcagccgggtgggcgccatcaagctgacctacatcagcaaggtgtctgatgccaccaagctgcggcccaaggccgagttctgctttgtgatgaatgccggcatgaggaagtacttcctgcaggccaatgaccagcaggacctggtggagtgggtgaatgtgctgaacaaggccatcaagatcaccgtgcccaagcagagcgacagccagcccaacagcgacaacctgagcagacatggagaatgtgggaagaagcaggtgtcctacagaacagacatcgtgggcggcgtgcccatcatcacccccacccagaaggaggaggtgaatgaatgtggggagagcattgacaggaacaacctgaagaggagccagagccacctgccctacttcacccccaagccaccccaggacagcgctgtgatcaaggccggctactgtgtgaagcagggcgctgtgatgaagaactggaagaggcgctacttccagctggatgagaacaccatcggctacttcaagtctgagctggagaaggagcccctgcgggtcatccccctgaaggaggtgcacaaggtgcaggagtgcaagcagagcgacatcatgatgagggacaacctgtttgagatcgtgaccaccagcaggaccttctacgtgcaggccgacagccctgaggagatgcacagctggatcaaggctgtgtctggggccatcgtggcccagaggggccctggccgcagcgccagcagcgagcaccccccaggccccagcgagagcaagcacgccttccggcccaccaatgctgccacagccaccagccacagcacagccagccgcagcaacagcctggtgtccaccttcaccatggagaagaggggcttctatgagagcctggccaaggtgaagccaggcaacttcaaggtgcagacagtgagcccccgggagcccgccagcaaggtgacagagcaggccctgctgcggccccagagcaagaatggcccccaggagaaggactgtgacctggtggacctggatgatgccagcctgcctgtgtctgatgtgtag

SEQ ID NO: 164348 - DNA, 345 bp, Artificial Sequence
  Description of Artificial Sequence: Synthetic coding sequence
atgccctacgtggaccggcagaaccgcatctgtggcttcctggacatcgaggagaatgaaaacagcggcaagttcctgcggcgctacttcatcctggacacccgggaggacagctttgtgtggtacatggacaacccccagaacctgcccagcggcagcagccgggtgggcgccatcaagctgacctacatcagcaaggtgtctgatgccaccaagctgcggcccaaggccgagttctgctttgtgatgaatgccggcatgaggaagtacttcctgcaggccaatgaccagcaggacctggtggagtgggtgaatgtgctgaacaaggccatcaagatcacctag

SEQ ID NO: 164349 - DNA, 1215 bp, Artificial Sequence; identical to SEQ ID NO: 164347
  Description of Artificial Sequence: Synthetic coding sequence

SEQ ID NO: 164350 - DNA, 1215 bp, Artificial Sequence; identical to SEQ ID NO: 164347
  Description of Artificial Sequence: Synthetic coding sequence

SEQ ID NO: 164351 - DNA, 1005 bp, Artificial Sequence
  Description of Artificial Sequence: Synthetic coding sequence
atgccctacgtggaccggcagaaccgcatctgtggcttcctggacatcgaggagaatgaaaacagcggcaagttcctgcggcgctacttcatcctggacacccgggaggacagctttgtgtggtacatggacaacccccagaacctgcccagcggcagcagccgggtgggcgccatcaagctgacctacatcagcaaggtgtctgatgccaccaagctgcggcccaaggccgagttctgctttgtgatgaatgccggcatgaggaagtacttcctgcaggccaatgaccagcaggacctggtggagtgggtgaatgtgctgaacaaggccatcaagatcaccgtgcccaagcagagcgacagccagcccaacagcgacaacctgagcagacatggagaatgtgggaagaagcaggtgtcctacagaacagacatcgtgggcggcgtgcccatcatcacccccacccagaaggaggaggtgaatgaatgtggggagagcattgacaggaacaacctgaagaggagccagagccacctgccctacttcacccccaagccaccccaggacagcgctgtgatcaaggccggctactgtgtgaagcagggcgctgtgatgaagaactggaagaggcgctacttccagctggatgagaacaccatcggctacttcaagtctgagctggagaaggagcccctgcgggtcatccccctgaaggaggtgcacaaggtgcaggagtgcaagcagagcgacatcatgatgagggacaacctgtttgagatcgtgaccaccagcaggaccttctacgtgcaggccgacagccctgaggagatgcacagctggatcaaggctgtgtctggggccatcgtggcccagaggggccctggccgcagcgccagctccatgaggcaggcccggcggctgagcaacccctgcatccagcgctacaccagcagagctggagaatgttccacctacgtgggcagccacgccaacgtgcccagctag

SEQ ID NO: 164352 - DNA, 1278 bp, Artificial Sequence
  Description of Artificial Sequence: Synthetic coding sequence
atgccctacgtggaccggcagaaccgcatctgtggcttcctggacatcgaggagcacgagaacagcggcaagttcctgcggcgctacttcatcctggacacccaggccaactgcctgctgtggtacatggacaacccccagaacctggccatgggcgctggagctgtgggcgccctgcagctgacctacatcagcaaggtgtccatcgccacccccaagcagaagcccaagacccccttctgcttcgtcatcaatgccctgagccagcgctacttcctgcaggccaatgaccagaaggacatgaaggactgggtggaggccctgaaccaggccagcaagatcaccgtgcccaagggcggcggcctgcccatgaccacagaggtgctgaagagcctggccgcccccccagccctggagaagaagccccaggtggcctacaagacagagatcattggaggagtggtggtgcacacccccatcagccagaatggaggagatggccaggagggcagcgagcccggcagccacaccatcctgcggcgcagccagagctacatccccaccagcggctgccgggccagcactggacctcctctcatcaagagcggctactgtgtgaagcagggcaatgtgaggaagtcctggaagaggcgcttctttgccctggatgacttcaccatctgctacttcaagtgtgagcaggaccgggagcccctgcggaccatcttcctgaaggatgtgctgaagacccatgagtgcctggtgaagagcggggacctgctgatgagggacaacctgtttgagatcatcaccagcagcaggaccttctacgtgcaggccgacagccctgaggacatgcacagctggatcaaggagattggagctgctgtgcaggccctgaagtgccacccccgggagaccagcttcagccgcagcatcagcctgacccggcccggcagcagcagcctgagcagcggccccaacagcatcctgtgccggggccggccccccctggaggagaagaaggccctgtgcaaggcccccagcgtggccagctcctggcagccctggacccctgtgccccaggccggggagaagctgctgcccccaggggacaccagcgaggacagcctcttcacccccaggcctggagagggcagcgcccctggggtgctgcccagcagccgcatccgccacaggtctgagccccagcaccccaaggagaagcccttcatgttcaacctggatgatgagaacatccgcaccagtgatgtgtag

SEQ ID NO: 164353 - DNA, 348 bp, Artificial Sequence
  Description of Artificial Sequence: Synthetic coding sequence
atgccctacgtggaccggcagaaccgcatctgtggcttcctggacatcgaggagcacgagaacagcggcaagttcctgcggcgctacttcatcctggacacccaggccaactgcctgctgtggtacatggacaacccccagaacctggccatgggcgctggagctgtgggcgccctgcagctgacctacatcagcaaggtgtccatcgccacccccaagcagaagcccaagacccccttctgcttcgtcatcaatgccctgagccagcgctacttcctgcaggccaatgaccagaaggacatgaaggactgggtggaggccctgaaccaggccagcaagatcacctag

SEQ ID NO: 164354 - DNA, 1128 bp, Artificial Sequence
  Description of Artificial Sequence: Synthetic coding sequence
atgggcgctggagctgtgggcgccctgcagctgacctacatcagcaaggtgtccatcgccacccccaagcagaagcccaagacccccttctgcttcgtcatcaatgccctgagccagcgctacttcctgcaggccaatgaccagaaggacatgaaggactgggtggaggccctgaaccaggccagcaagatcaccgtgcccaagggcggcggcctgcccatgaccacagaggtgctgaagagcctggccgcccccccagccctggagaagaagccccaggtggcctacaagacagagatcattggaggagtggtggtgcacacccccatcagccagaatggaggagatggccaggagggcagcgagcccggcagccacaccatcctgcggcgcagccagagctacatccccaccagcggctgccgggccagcactggacctcctctcatcaagagcggctactgtgtgaagcagggcaatgtgaggaagtcctggaagaggcgcttctttgccctggatgacttcaccatctgctacttcaagtgtgagcaggaccgggagcccctgcggaccatcttcctgaaggatgtgctgaagacccatgagtgcctggtgaagagcggggacctgctgatgagggacaacctgtttgagatcatcaccagcagcaggaccttctacgtgcaggccgacagccctgaggacatgcacagctggatcaaggagattggagctgctgtgcaggccctgaagtgccacccccgggagaccagcttcagccgcagcatcagcctgacccggcccggcagcagcagcctgagcagcggccccaacagcatcctgtgccggggccggccccccctggaggagaagaaggccctgtgcaaggcccccagcgtggccagctcctggcagccctggacccctgtgccccaggccggggagaagctgctgcccccaggggacaccagcgaggacagcctcttcacccccaggcctggagagggcagcgcccctggggtgctgcccagcagccgcatccgccacaggtctgagccccagcaccccaaggagaagcccttcatgttcaacctggatgatgagaacatccgcaccagtgatgtgtag

SEQ ID NO: 164355 - DNA, 4083 bp, Artificial Sequence
  Description of Artificial Sequence: Synthetic coding sequence
atgagccggcagagcaccctgtacagcttcttccccaagagccctgccctgagtgatgccaacaaggccagcgcccgggccagccgggagggcggccgggctgctgctgcccctggggccagccccagccctggaggagatgctgcctggagcgaggccggccctggcccccggcccctggcccggagcgccagcccccccaaggccaagaacctgaatggaggcctgcggcgctctgtggccccagctgcccccaccagctgtgacttcagccctggggacctggtgtgggccaagatggagggctacccctggtggccctgcctggtgtacaaccacccctttgatggcaccttcatccgggagaagggcaagtctgtgcgggtgcacgtgcagttctttgatgacagccccacccggggctgggtgtccaagaggctgctgaagccctacacaggcagcaagagcaaggaggcccagaagggcggccacttctacagcgccaagccagagatcctgcgggccatgcagagagcagatgaggccctgaacaaggacaagatcaagaggctggagctggccgtgtgtgatgagcccagcgagcctgaggaggaggaggagatggaggtgggcaccacctacgtgacagacaagtcagaagaagataatgaaattgaaagtgaggaggaggtgcagcccaagacccagggcagcagaagaagcagccggcagatcaagaagagaagagtcatcagtgacagcgagagtgacatcggcggcagtgatgtggagttcaagccagacaccaaggaggagggcagcagtgatgagatcagcagcggcgtgggggacagcgagagcgagggcctgaacagccctgtgaaggtggccaggaagaggaagaggatggtgactggaaatggcagcctgaagaggaagagcagcaggaaggagaccccatctgccaccaagcaggccaccagcatcagcagcgagaccaagaacaccctgcgggccttcagcgccccccagaacagcgagagccaggcccacgtgtctggaggaggagatgacagcagccggcccaccgtgtggtaccacgagaccctggagtggctgaaggaggagaagagaagagatgagcacagaagaagaccagaccacccagactttgatgccagcaccctgtatgtgcctgaggacttcctgaacagctgcaccccaggcatgaggaagtggtggcagatcaagagccagaactttgacctggtgatctgctacaaggtgggcaagttctatgagctgtaccacatggatgccctgattggagtgtctgagctgggcctggtgttcatgaagggcaactgggcccacagcggcttccctgagatcgccttcggccgctacagcgacagcctggtgcagaagggctacaaggtggcccgggtggagcagacagagaccccagagatgatggaggcccgctgcaggaagatggcccacatcagcaaatatgacagagtggtgcggcgggagatctgccgcatcatcaccaagggcacccagacctacagcgtgctggagggggaccccagcgagaactacagcaagtacctgctgagcctgaaggagaaggaggaggacagcagcggccacacccgggcctacggcgtgtgctttgtggacaccagcctgggcaagttcttcatcggccagttcagtgatgacagacactgcagccgcttccgcaccctggtggcccactacccacctgtgcaggtgctgtttgagaagggcaacctgagcaaggagaccaagaccatcctgaagagcagcctgagctgcagcctgcaggagggcctcatccctggcagccagttctgggatgccagcaagaccctgcggaccctgctggaggaggagtacttccgggagaagctgagtgatggcattggagtgatgctgccccaggtgctgaagggcatgaccagcgagagtgacagcatcggcctgaccccaggagagaagtctgagctggccctgagcgccctgggcggctgtgtgttctacctgaagaagtgcctgattgaccaggagctgctgtccatggccaactttgaggagtacatccccctggacagcgacacagtgtccaccaccaggtctggggccatcttcaccaaggcctaccagaggatggtgctggatgctgtgaccctgaacaacctggagatcttcctgaatggcaccaacggcagcacagagggcaccctgctggagcgggtggacacctgccacaccccatttgggaagaggctgctgaagcagtggctgtgtgcccccctgtgcaaccactacgccatcaatgaccggctggatgccatcgaggacctgatggtggtgcctgacaagatcagcgaggtggtggagctgctgaagaagctgcctgacctggagcggctgctgagcaagatccacaacgtgggcagccccctgaagagccagaaccacccagacagccgggccatcatgtatgaggagaccacctacagcaagaagaagatcatcgacttcctgagcgccctggagggcttcaaggtgatgtgcaagatcatcggcatcatggaggaggtggctgatggcttcaagagcaagatcctgaagcaggtgatcagcctgcagaccaagaaccctgagggccgcttcccagacctgactgtggagctgaaccgctgggacacagcctttgaccacgagaaggccaggaagacaggcctcatcacccccaaggccggctttgacagcgactatgaccaggccctggccgacatccgggagaatgagcagagcctgctggagtacctggagaagcagaggaaccgcatcggctgcaggaccatcgtgtactggggcatcggcaggaaccgctaccagctggagatccctgagaacttcaccaccaggaacctgcctgaggagtatgagctgaagagcaccaagaagggctgcaagcgctactggaccaagaccatcgagaagaagctggccaacctgatcaatgctgaggagaggagagatgtgtccctgaaggactgcatgaggaggctcttctacaactttgacaagaactacaaggactggcagagcgctgtggagtgcatcgctgtgctggatgtgctgctgtgcctggccaactacagcagaggaggagatggccccatgtgcaggcctgtgatcctgctgcctgaggacaccccacccttcctggagctgaagggcagccgccacccctgcatcaccaagaccttctttggagatgacttcatccccaatgacatcctgattggctgtgaggaggaggagcaggagaatggcaaggcctactgtgtgctggtgacaggccccaacatgggcggcaagagcaccctgatgaggcaggccggcctgctggccgtgatggcccagatgggctgctacgtgcctgctgaggtgtgccgcctgacccccatcgacagagtcttcacccggctgggcgccagtgaccgcatcatgtctggagagagcaccttctttgtggagctgtctgaaacagccagcatcctgatgcacgccacagcccacagcctggtgctggtggatgagctgggccggggcacagccacctttgatggaacagccatcgccaatgctgtggtgaaggagctggccgagaccatcaagtgcaggaccctcttcagcacccactaccacagcctggtggaggactacagccagaatgtggccgtgcggctgggccacatggcctgcatggtggagaatgaatgtgaggaccccagccaggagaccatcaccttcctgtacaagttcatcaagggggcctgccccaagagctatggcttcaatgctgcccggctggccaacctgcctgaggaggtgatccagaagggccacaggaaggcccgggagtttgagaagatgaaccagagcctgcggctcttccgggaggtgtgcctggccagcgagaggagcacagtggatgctgaggccgtgcacaagctgctgaccctcatcaaggagctgtag

SEQ ID NO: 164356 - DNA, 2340 bp, Artificial Sequence
  Description of Artificial Sequence: Synthetic coding sequence
atggagggcagccggcccaggagcagcctgagcctggccagcagcgccagcaccatcagcagcctgagcagcctgagccccaagaagcccaccagggctgtgaacaagatccacgccttcggcaagagaggaaatgccctgcggcgggaccccaacctgcctgtgcacatccggggctggctgcacaagcaggacagcagcggcctgcggctgtggaagaggcgctggtttgtgctgagcggccactgcctcttctactacaaggacagccgggaggagagcgtgctgggctctgtgctgctgcccagctacaacatccggccagatggccctggggccccccggggccgccgcttcaccttcaccgctgagcaccctggcatgaggacctacgtgctggccgctgacaccctggaggacctgcggggctggctgcgggccctgggccgggccagcagagcagaaggagatgattatggccagcccaggagccctgcccggccccagcccggggagggccctgggggccctgggggccccccagaggtgtccagaggagaggagggccgcatcagcgagagccctgaggtgacccggctgagccggggccggggccggccccggctgctgacccccagccccaccacagacctgcacagcggcctgcagatgagaagagcccggagcccagacctcttcacccccctgagcaggcctcccagccccctgagcctgccccggcccaggtctgccccagcccggcggcccccagcccccagcggggacacagcccccccagcccggccccacacccccctgagcagaattgatgtgcggccccccctggactggggcccccagaggcagaccctgagccggccccccaccccccggcggggccccccatctgaggccggcggcggcaagccacccaggagcccccagcactggagccaggagcccaggacccaggcccacagcggcagccccacctacctgcagctgccccccaggcctcctggcacccgggcctccatggtgctgctgcccggcccccccctggagagcaccttccaccagagcctggagacagacaccctgctgaccaagctgtgtggccaggaccggctgctgcggcggctgcaggaggagattgaccagaagcaggaggagaaggagcagctggaggccgccctggagctgacccggcagcagctgggccaggccacccgggaggccggggcccctggccgggcctggggccggcagaggctgctgcaggaccggctggtgtctgtgcgggccaccctgtgccacctgacccaggagcgggagcgggtgtgggacacctacagcggcctggagcaggagctgggcaccctgcgggagaccctggagtacctgctgcacctgggcagcccccaggacagagtgtctgcccagcagcagctgtggatggtggaggacaccctggccggcctgggcggcccccagaagcccccaccccacacagagccagacagccccagccctgtgctgcagggcgaggagagcagcgagcgggagagcctgcctgagagcctggagctgagcagccccaggagccctgagacagactggggccggcccccaggaggagacaaggacctggccagcccccacctgggcctgggcagcccccgggtgtcccgggccagcagccctgagggccgccacctgcccagcccccagctgggcaccaaggcccctgtggcccggcccaggatgtctgcccaggagcagctggagaggatgagaagaaaccaggagtgtggccggcccttcccccggcccaccagcccccggctgctgaccctgggccgcaccctgagccctgcccggcggcagccagatgtggagcagaggcctgtggtgggccacagcggggcccagaagtggctgcggagcagcggctcctggagcagccccaggaacaccaccccctacctgcccaccagcgagggccaccgggagcgggtgctgagcctgagccaggccctggccacagaggccagccagtggcacaggatgatgactggaggcaacctggacagccagggcgaccccctgcccggggtgcccctgcccccaagtgaccccacccggcaggagaccccaccacccaggagcccccctgtggccaacagcggcagcacaggcttcagccggcggggcagcggccggggcggcggccccaccccctggggccctgcctgggatgctggcatcgcccctcctgtgctgccccaggatgagggcgcctggcccctgcgggtgaccctgctgcagagcagcttctag

SEQ ID NO: 164357 - DNA, 1752 bp, Artificial Sequence
  Description of Artificial Sequence: Synthetic coding sequence
atggagggcagccggcccaggagcagcctgagcctggccagcagcgccagcaccatcagcagcctgagcagcctgagccccaagaagcccaccagggctgtgaacaagatccacgccttcggcaagagaggaaatgccctgcggcgggaccccaacctgcctgtgcacatccggggctggctgcacaagcaggacagcagcggcctgcggctgtggaagaggcgctggtttgtgctgagcggccactgcctcttctactacaaggacagccgggaggagagcgtgctgggctctgtgctgctgcccagctacaacatccggccagatggccctggggccccccggggccgccgcttcaccttcaccgctgagcaccctggcatgaggacctacgtgctggccgctgacaccctggaggacctgcggggctggctgcgggccctgggccgggccagcagagcagaaggagatgattatggccagcccaggagccctgcccggccccagcccggggagggccctgggggccctgggggccccccagaggtgtccagaggagaggagggccgcatcagcgagagccctgaggtgacccggctgagccggggccggggccggccccggctgctgacccccagccccaccacagacctgcacagcggcctgcagatgagaagagcccggagcccagacctcttcacccccctgagcaggcctcccagccccctgagcctgccccggcccaggtctgccccagcccggcggcccccagcccccagcggggacacagcccccccagcccggccccacacccccctgagcagaattgatgtgcggccccccctggactggggcccccagaggcagaccctgagccggccccccaccccccggcggggccccccatctgaggccggcggcggcaagccacccaggagcccccagcactggagccaggagcccaggacccagcccggcccccccctggagagcaccttccaccagagcctggagacagacaccctgctgaccaagctgtgtggccaggaccggctgctgcggcggctgcaggaggagattgaccagaagcaggaggagaaggagcagctggaggccgccctggagctgacccggcagcagctgggccaggccacccgggaggccggggcccctggccgggcctggggccggcagaggctgctgcaggaccggctggtgtctgtgcgggccaccctgtgccacctgacccaggagcgggagcgggtgtgggacacctacagcggcctggagcaggagctgggcaccctgcgggagaccctggagtacctgctgcacctgggcagcccccaggacagagtgtctgcccagcagcagctgtggatggtggaggacaccctggccggcctgggcggcccccagaagcccccaccccacacagagccagacagccccagccctgtgctgcagggcgaggagagcagcgagcgggagagcctgcctgagagcctggagctgagcagccccaggagccctgagacagactggggccggcccccaggaggagacaaggacctggccagcccccacctgggcctgggcagcccccgggtgtcccgggccagcagccctgagggccgccacctgcccagcccccagctgggcaccaagagcaaggagcaccaccccctgctggccgacttccgccgcagccctggagctggcagccagcccctgcccagccctggctactag

SEQ ID NO: 164358 - DNA, 3366 bp, Artificial Sequence
  Description of Artificial Sequence: Synthetic coding sequence
atggctgctgccaccgtgggccgggacaccctgcctgagcactggagctatggagtgtgcagagatggccgggtcttcttcatcaatgaccagctgcgctgcaccacctggctgcaccccaggactggagagcctgtgaacagcggccacatgatccgcagtgacctgccccggggctgggaggagggcttcacagaggagggcgccagctacttcatcgaccacaaccagcagaccacagccttccgccaccctgtgacaggccagttctccccagaaaattctgagttcatcctgcaggaggagcccaacccccacatgagcaagcaggacaggaaccagaggcccagctccatggtgtctgagaccagcacagctggaacagccagcaccctggaggccaagccaggccccaagatcatcaagagcagcagcaaggtgcacagctttgggaagagggaccaggccatcagaagaaaccccaacgtgcctgtggtggtgcggggctggctgcacaagcaggacagcagcggcatgaggctgtggaagaggcgctggtttgtgctggccgactactgcctcttctactacaaggacagccgggaggaggccgtgctgggcagcatccccctgcccagctatgtgatcagccctgtggcccctgaggaccgcatcagcaggaagtacagcttcaaggctgtgcacacaggcatgagggccctgatctacaacagcagcacagctggcagccaggccgagcagagcggcatgaggacctactacttctctgctgacacccaggaggacatgaatgcctgggtgcgggccatgaaccaggccgcccaggtgctgagccgcagcagcctgaagagggacatggagaaggtggagcggcaggccgtgccccaggccaaccacacagagagctgccatgaatgtggccgggtgggccctggccacacccgggactgcccccaccggggccatgatgacatcgtgaactttgagcggcaggagcaggagggggagcagtaccgcagccagagggaccccctggagggcaagagggacaggagcaaggcccggagcccctacagccctgctgaggaggatgccctcttcatggacctgcccaccggcccccggggccagcaggcccagccccagagagctgagaagaatggcatgctgcctgccagctatggccctggagagcagaatggaactggaggctaccagagggccttcccccccaggaccaaccctgagaagcacagccagaggaagagcaacctggcccaggtggagcactgggcccgggcccagaagggggacagccgcagcctgcccctggaccagaccctgccccggcagggccctggccagagcctgtccttccctgagaactaccagaccctgcccaagagcaccaggcaccccagcggcggcagcagccccccaccaagaaacctgcccagcgactacaagtatgcccaggaccgggccagccacctgaagatgagcagcgaggagcggcgggcccacagagatggcaccgtgtggcagctgtatgagtggcagcagaggcagcagttccgccacggcagccccacagcccccatctgcctgggcagccctgagttcacagaccagggccgcagccgctccatgctggaggtgcccaggagcatctctgtgccccccagccccagcgacatccccccacctggcccccccagggtcttccccccaagaagaccccacaccccagctgagcgggtgacagtgaagcccccagaccagaggagatctgtggacatcagcctgggggacagcccccggcgggcccggggccatgctgtgaagaacagcagccacgtggacagaagatccatgcccagcatgggctacatgacccacacagtgtctgcccccagcctgcacggcaagtctgcagatgacacctacctgcagctgaagaaggacctggagtacctggacctgaagatgacaggccgggacctgctgaaggacaggagcctgaagcctgtgaagattgctgagagtgacacagatgtgaagctgagcatcttctgtgagcaggacagagtgctgcaggacctggaggacaagatccgggccctgaaggagaacaaggaccagctggagagcgtgctggaggtgctgcaccggcagatggagcagtacagagaccagccccagcacctggagaagatcgcctaccagcagaagctgctgcaggaggacctggtgcacatccgggcagagctgagccgggagagcacagagatggagaatgcctggaatgagtacctgaagctggagaatgatgtggagcagctgaagcagaccctgcaggagcagcacagaagagccttcttcttccaggagaagagccagatccagaaggacctgtggagaattgaagatgtgacagctggcctgagcgccaacaaggagaacttccgcatcctggtggagagcgtgaagaaccctgagaggaagacagtgcccctcttcccccacccccctgtgcccagcctgagcaccagcgagagcaagcccccaccccagcccagcccccccaccagccctgtgaggacccccctggaggtgcggctcttcccccagctgcagacctacgtgccctaccggccccaccccccccagctgaggaaggtgaccagccccctgcagagccccaccaaggccaagcccaaggtggaggatgaggccccacccaggcctcccctgcctgagctgtacagccctgaggaccagcccccagctgtgccccccctgccccgggaggccaccatcatccgccacacctctgtgcggggcctgaagaggcagagtgatgagaggaagagggaccgggagctgggccagtgtgtgaatggagacagccgggtggagctgcggagctatgtgtctgagcctgagctggccaccctgagcggggacatggcccagcccagcctgggcctggtgggccctgagagccgctaccagaccctgcccggccggggcctgagcggcagcaccagccggctgcagcagagcagcaccatcgccccctacgtgaccctgcggcggggcctgaatgctgagagcagcaaggccaccttcccccggcccaagagcgccctggagcggctgtacagcggggaccaccagaggggcaagatgtctgctgaggagcagctggagaggatgaagaggcaccagaaggccctggtgcgggagaggaagaggaccctgggccagggcgagaggacaggcctgcccagcagccgctacctgagccggcccctgcccggggacctgggctctgtgtgctag

SEQ ID NO: 164359 - DNA, 3369 bp, Artificial Sequence
  Description of Artificial Sequence: Synthetic coding sequence
atggctgctgccaccgtgggccgggacaccctgcctgagcactggagctatggagtgtgcagagatggccgggtcttcttcatcaatgaccagctgcgctgcaccacctggctgcaccccaggactggagagcctgtgaacagcggccacatgatccgcagtgacctgccccggggctgggaggagggcttcacagaggagggcgccagctacttcatcgaccacaaccagcagaccacagccttccgccaccctgtgacaggccagttctccccagaaaattctgagttcatcctgcaggaggagcccaacccccacatgagcaagcaggacaggaaccagaggcccagctccatggtgtctgagaccagcacagctggaacagccagcaccctggaggccaagccaggccccaagatcatcaagagcagcagcaaggtgcacagctttgggaagagggaccaggccatcagaagaaaccccaacgtgcctgtggtggtgcggggctggctgcacaagcaggacagcagcggcatgaggctgtggaagaggcgctggtttgtgctggccgactactgcctcttctactacaaggacagccgggaggaggccgtgctgggcagcatccccctgcccagctatgtgatcagccctgtggcccctgaggaccgcatcagcaggaagtacagcttcaaggctgtgcacacaggcatgagggccctgatctacaacagcagcacagctggcagccaggccgagcagagcggcatgaggacctactacttctctgctgacacccaggaggacatgaatgcctgggtgcgggccatgaaccaggccgcccaggtgctgagccgcagcagcctgaagagggacatggagaaggtggagcggcaggccgtgccccaggccaaccacacagagagctgccatgaatgtggccgggtgggccctggccacacccgggactgcccccaccggggccatgatgacatcgtgaactttgagcggcaggagcaggagggggagcagtaccgcagccagagggaccccctggagggcaagagggacaggagcaaggcccggagcccctacagccctgctgaggaggatgccctcttcatggacctgcccaccggcccccggggccagcaggcccagccccagagagctgagaagaatggcatgctgcctgccagctatggccctggagagcagaatggaactggaggctaccagagggccttcccccccaggaccaaccctgagaagcacagccagaggaagagcaacctggcccaggtggagcactgggcccgggcccagaagggggacagccgcagcctgcccctggaccagaccctgccccggcagggccctggccagagcctgtccttccctgagaactaccagaccctgcccaagagcaccaggcaccccagcggcggcagcagccccccaccaagaaacctgcccagcgactacaagtatgcccaggaccgggccagccacctgaagatgagcagcgaggagcggcgggcccacagagatggcaccgtgtggcagctgtatgagtggcagcagaggcagcagttccgccacggcagccccacagcccccatctgcctgggcagccctgagttcacagaccagggccgcagccgctccatgctggaggtgcccaggagcatctctgtgccccccagccccagcgacatccccccacctggcccccccagggtcttccccccaagaagaccccacaccccagctgagcgggtgacagtgaagcccccagaccagaggagatctgtggacatcagcctgggggacagcccccggcgggcccggggccatgctgtgaagaacagcagccacgtggacagaagatccatgcccagcatgggctacatgacccacacagtgtctgcccccagcctgcacggcaagtctgcagatgacacctacctgcagctgaagaaggacctggagtacctggacctgaagatgacaggccgggacctgctgaaggacaggagcctgaagcctgtgaagattgctgagagtgacacagatgtgaagctgagcatcttctgtgagcaggacagagtgctgcaggacctggaggacaagatccgggccctgaaggagaacaaggaccagctggagagcgtgctggaggtgctgcaccggcagatggagcagtacagagaccagccccagcacctggagaagatcgcctaccagcagaagctgctgcaggaggacctggtgcacatccgggcagagctgagccgggagagcacagagatggagaatgcctggaatgagtacctgaagctggagaatgatgtggagcagctgaagcagaccctgcaggagcagcacagaagagccttcttcttccaggagaagagccagatccagaaggacctgtggagaattgaagatgtgacagctggcctgagcgccaacaaggagaacttccgcatcctggtggagagcgtgaagaaccctgagaggaagacagtgcccctcttcccccacccccctgtgcccagcctgagcaccagcgagagcaagcccccaccccagcccagcccccccaccagccctgtgaggacccccctggaggtgcggctcttcccccagctgcagacctacgtgccctaccggccccaccccccccagctgaggaaggtgaccagccccctgcagagccccaccaaggccaagcccaaggtgcaggaggatgaggccccaccccggccccccctgcctgagctgtacagccctgaggaccagcccccagctgtgccccccctgccccgggaggccaccatcatccgccacacctctgtgcggggcctgaagaggcagagtgatgagaggaagagggaccgggagctgggccagtgtgtgaatggagacagccgggtggagctgcggagctatgtgtctgagcctgagctggccaccctgagcggggacatggcccagcccagcctgggcctggtgggccctgagagccgctaccagaccctgcccggccggggcctgagcggcagcaccagccggctgcagcagagcagcaccatcgccccctacgtgaccctgcggcggggcctgaatgctgagagcagcaaggccaccttcccccggcccaagagcgccctggagcggctgtacagcggggaccaccagaggggcaagatgtctgctgaggagcagctggagaggatgaagaggcaccagaaggccctggtgcgggagaggaagaggaccctgggccagggcgagaggacaggcctgcccagcagccgctacctgagccggcccctgcccggggacctgggctctgtgtgctag

SEQ ID NO: 164360 - DNA, 2262 bp, Artificial Sequence
  Description of Artificial Sequence: Synthetic coding sequence
tgagatgccctcttcatggacctgcccaccggcccccggggccagcaggcccagccccagagagctgagaagaatggcatgctgcctgccagctatggccctggagagcagaatggcaccggcggctaccagagggccttcccccccaggaccaaccctgagaagcacagccagaggaagagcaacctggcccaggtggagcactgggcccgggcccagaagggggacagccgcagcctgcccctggaccagaccctgccccggcagggccctggccagagcctgtccttccctgagaactaccagaccctgcccaagagcaccaggcaccccagcggcggcagcagccccccacccaggaacctgcccagcgactacaagtatgcccaggaccgggccagccacctgaagatgagcagcgaggagcggcgggcccacagagatggcaccgtgtggcagctgtatgagtggcagcagaggcagcagttcagacatggcagccccacagcccccatctgcctgggcagccctgagttcacagaccagggccgcagccgctccatgctggaggtgcccaggagcatctctgtgccccccagccccagcgacatccccccacctggcccccccagggtcttccccccccggcggccccacaccccagctgagcgggtgacagtgaagcccccagaccagaggagatctgtggacatcagcctgggggacagcccccggcgggcccggggccatgctgtgaagaacagcagccacgtggaccggcgctccatgcccagcatgggctacatgacccacacagtgtctgcccccagcctgcacggcaagtctgcagatgacacctacctgcagctgaagaaggacctggagtacctggacctgaagatgacaggccgggacctgctgaaggacaggagcctgaagcctgtgaagattgctgagagtgacacagatgtgaagctgagcatcttctgtgagcaggacagagtgctgcaggacctggaggacaagatccgggccctgaaggagaacaaggaccagctggagagcgtgctggaggtgctgcaccggcagatggagcagtacagagaccagccccagcacctggagaagatcgcctaccagcagaagctgctgcaggaggacctggtgcacatccgggcagagctgagccgggagagcacagagatggagaatgcctggaatgagtacctgaagctggagaatgatgtggagcagctgaagcagaccctgcaggagcagcaccggcgggccttcttcttccaggagaagagccagatccagaaggacctgtggagaattgaagatgtgacagctggcctgagcgccaacaaggagaacttccgcatcctggtggagagcgtgaagaaccctgagaggaagacagtgcccctcttcccccacccccctgtgcccagcctgagcaccagcgagagcaagcccccaccccagcccagcccccccaccagccctgtgaggacccccctggaggtgcggctcttcccccagctgcagacctacgtgccctaccggccccaccccccccagctgaggaaggtgaccagccccctgcagagccccaccaaggccaagcccaaggtgcaggaggatgaggccccacccaggcctcccctgcctgagctgtacagccctgaggaccagcccccagctgtgccccccctgccccgggaggccaccatcatccgccacacctctgtgcggggcctgaagaggcagagtgatgagaggaagagggaccgggagctgggccagtgtgtgaatggagacagccgggtggagctgcggagctatgtgtctgagcctgagctggccaccctgagcggggacatggcccagcccagcctgggcctggtgggccctgagagccgctaccagaccctgcccggccggggcctgagcggcagcaccagccggctgcagcagagcagcaccatcgccccctacgtgaccctgcggcggggcctgaatgctgagagcagcaaggccaccttcccccggcccaagagcgccctggagcggctgtacagcggggaccaccagaggggcaagatgtctgctgaggagcagctggagaggatgaagaggcaccagaaggccctggtgcgggagaggaagaggaccctgggccagggcgagaggacaggcctgcccagcagccgctacctgagccggcccctgcccggggacctgggctctgtgtgctag

SEQ ID NO: 164361 - DNA, 816 bp, Artificial Sequence
  Description of Artificial Sequence: Synthetic coding sequence
atgctgcaggcctgcaagatggagggcttccccctggtgcccccccagcccagcgaggacctggtgccctatgacacagacctgtaccagaggcagacccatgagtactacccctacctgagcagtgatggagagagccacagcgaccactactgggacttccacccccaccacgtgcacagcgagtttgagagctttgctgagaacaacttcacagagctgcagagcgtgcagcccccccagctgcagcagctgtaccgccacatggagctggagcagatgcacgtgctggacacccccatggtgcccccccaccccagcctgggccaccaggtgtcctacctgcccaggatgtgcctgcagtaccccagcctgagccctgcccagcccagcagtgatgaggaggagggggagcggcagagcccccccctggaggtgtctgatggagaggctgatggcctggagcccggccctggcctgctgcccggggagaccggcagcaagaagaagatccggctgtaccagttcctgctggacctgctgcggagcggggacatgaaggacagcatctggtgggtggacaaggacaagggcaccttccagttcagcagcaagcacaaggaggccctggcccaccgctggggcatccagaagggcaacaggaagaagatgacctaccagaagatggcccgggccctgaggaactacggcaagacaggagaggtgaagaaggtgaagaagaagctgacctaccagttcagcggggaggtgctgggccggggcggcctggccgagcggcggcaccccccccactag

SEQ ID NO: 164362 - DNA, 732 bp, Artificial Sequence
  Description of Artificial Sequence: Synthetic coding sequence
atgagccctgctgcccctgtgcccccagattctgccctggagagcccctttgaggagatggccctggtgcggggcggctggctgtggaggcagagcagcatcctgcggcgctggaagaggaactggtttgccctgtggctggatggcaccctgggctactaccatgatgaaacagcccaggatgaagaagatagagtgctgatccacttcaacgtgcgggacatcaagattggccctgagtgccatgatgtgcagcccccagagggccgcagcagagatggcctgctgactgtgaacctgcgggagggcggccgcctgcacctgtgtgccgagaccaaggatgatgccctggcctggaagacagccctgctggaggccaacagcaccccagccccagctggggccaccgtgccccccaggagccggcgggtgtgcagcaaggtgcgctgtgtgaccaggtcctggagcccctgcaaggtggagcggcgcatctgggtgcgggtgtacagcccctaccaggactactatgaggtggtgcccccaaatgcccacgaggccacctacgtgcgcagctactacggccccccctatgccggccctggggtgacccacgtgattgtgcgggaggacccctgctacagcgctggggcccccctggccatgggcatgctggccggggccgccactggagctgccctgggcagcctgatgtggagcccctgctggttctag

SEQ ID NO: 164363 - DNA, 627 bp, Artificial Sequence
  Description of Artificial Sequence: Synthetic coding sequence
atgagccctgctgcccctgtgcccccagattctgccctggagagcccctttgaggagatggccctggtgcggggcggctggctgtggaggcagagcagcatcctgcggcgctggaagaggaactggtttgccctgtggctggatggcaccctgggctactaccatgatgaaacagcccaggatgaagaagatagagtgctgatccacttcaacgtgcgggacatcaagattggccctgagtgccatgatgtgcagcccccagagggccgcagcagagatggcctgctgactgtgaacctgcgggagggcggccgcctgcacctgtgtgccgagaccaaggatgatgccctggcctggaagacagccctgctggaggccaacagcacccctgtgcgggtgtacagcccctaccaggactactatgaggtggtgcccccaaatgcccacgaggccacctacgtgcgcagctactacggccccccctatgccggccctggggtgacccacgtgattgtgcgggaggacccctgctacagcgctggggcccccctggccatgggcatgctggccggggccgccaccggggccgccctgggcagcctgatgtggagcccctgctggttctag

SEQ ID NO: 164364 - DNA, 675 bp, Artificial Sequence
  Description of Artificial Sequence: Synthetic coding sequence
atggccctggtgcggggcggctggctgtggaggcagagcagcatcctgcggcgctggaagaggaactggtttgccctgtggctggatggcaccctgggctactaccatgatgaaacagcccaggatgaggaggacagagtgctgatccacttcaacgtgcgggacatcaagattggaccagaatgtcatgatgtgcagcccccagagggccgcagcagagatggcctgctgactgtgaacctgcgggagggcggccgcctgcacctgtgtgccgagaccaaggatgatgccctggcctggaagacagccctgctggaggccaacagcaccccagccccagctggggccaccgtgcccccaagaagcagaagagtgtgcagcaaggtgcgctgtgtgaccaggtcctggagcccctgcaaggtggagcggcgcatctgggtgcgggtgtacagcccctaccaggactactatgaggtggtgcccccaaatgcccacgaggccacctacgtgcgcagctactacggccccccctatgccggccctggggtgacccacgtgattgtgcgggaggacccctgctacagcgctggggcccccctggccatgggcatgctggccggggccgccaccggggccgccctgggcagcctgatgtggagcccctgctggttctag

SEQ ID NO: 164365 - DNA, 570 bp, Artificial Sequence; identical to SEQ ID NO: 148585
  Description of Artificial Sequence: Synthetic coding sequence

SEQ ID NO: 164366 - DNA, 354 bp, Artificial Sequence
  Description of Artificial Sequence: Synthetic coding sequence
atggccctggtgcggggcggctggctgtggaggcagagcagcatcctgcggcgctggaagaggaactggtttgccctgtggctggatggcaccctgggctactaccatgatgaaacagcccaggatgaggaggacagagtgctgatccacttcaacgtgcgggacatcaagattggaccagaatgtcatgatgtgcagcccccagagggccgcagcagagatggcctgctgactgtgaacctgcgggagggcggccgcctgcacctgtgtgccgagaccaaggatgatgccctggcctggaagacagccctgctggaggccaacagcacccctgtgcgggtgtacagcccctag

SEQ ID NO: 164367 - DNA, 492 bp, Artificial Sequence
  Description of Artificial Sequence: Synthetic coding sequence
atggccctggtgcggggcggctggctgtggaggcagagcagcatcctgcggcgctggaagaggaactggtttgccctgtggctggatggcaccctgggctactaccatgatgaaacagcccaggatgaggaggacagagtgctgatccacttcaacgtgcgggacatcaagattggaccagaatgtcatgatgtgcagcccccagagggccgcagcagagatggcctgctgactgtgaacctgcgggagggcggccgcctgcacctgtgtgccgagaccaaggatgatgccctggcctggaagacagccctgctggaggccaacagcacccctgtgcgggtgtacagcccctaccaggactactatgaggtggtgcccccaaatgcccacgaggccacctacgtgcgcagctactacggccccccctatgccggccctggggtgacccacgtgattgtgcgggaggacccctgctacagcgctggggcctag

SEQ ID NO: 164368 - DNA, 480 bp, Artificial Sequence
  Description of Artificial Sequence: Synthetic coding sequence
atggccctggtgcggggcggctggctgtggaggcagagcagcatcctgcggcgctggaagaggaactggtttgccctgtggctggatggcaccctgggctactaccatgatgaaacagcccaggatgaggaggacagagtgctgatccacttcaacgtgcgggacatcaagattggaccagaatgtcatgatgtgcagcccccagagggccgcagcagagatggcctgctgactgtgaacctgcgggagggcggccgcctgcacctgtgtgccgagaccaaggatgatgccctggcctggaagacagccctgctggaggccaacagcacccccatgatccggctgaagctgatccacccccacaacaagtacctgctgagctgctacagcgctggggcccccctggccatgggcatgctggccggggccgccactggagctgccctgggcagcctgatgtggagcccctgctggttctag

SEQ ID NO: 164369 - DNA, 483 bp, Artificial Sequence
  Description of Artificial Sequence: Synthetic coding sequence
atggccctggtgcggggcggctggctgtggaggcagagcagcatcctgcggcgctggaagaggaactggtttgccctgtggctggatggcaccctgggctactaccatgatgaaacagcccaggatgaggaggacagagtgctgatccacttcaacgtgcgggacatcaagattggaccagaatgtcatgatgtgcagcccccagagggccgcagcagagatggcctgctgactgtgaacctgcgggagggcggccgcctgcacctgtgtgccgagaccaaggatgatgccctggcctggaagacagccctgctggaggccaacagcaccccagccccagctggggccaccgtgcccccaagaagcagaagagtgtgcagcaaggtgcgctgtgtgaccaggtcctggagcccctgcaaggtggagcggcgcatctgggtgcgggtgtacagcccctaccaggactactatgaggtggtgtag

SEQ ID NO: 164370 - DNA, 465 bp, Artificial Sequence
  Description of Artificial Sequence: Synthetic coding sequence
atggccctggtgcggggcggctggctgtggaggcagagcagcatcctgcggcgctggaagaggaactggtttgccctgtggctggatggcaccctgggctactaccatgatgaaacagcccaggatgaggaggacagagtgctgatccacttcaacgtgcgggacatcaagattggaccagaatgtcatgatgtgcagcccccagagggccgcagcagagatggcctgctgactgtgaacctgcgggagggcggccgcctgcacctgtgtgccgagaccaaggatgatgccctggcctggaagacagccctgctggaggccaacagcacccctgtgcgggtgtacagcccctaccaggactactatgaggtggtgcccccaaatgcccacgaggccacctacgtgcgcagctactacggccccccctatgccggccctggggtgacccacgtgattgtgaggtag

SEQ ID NO: 164371 - DNA, 258 bp, Artificial Sequence
  Description of Artificial Sequence: Synthetic coding sequence
atggccctggtgcggggcggctggctgtggaggcagagcagcatcctgcggcgctggaagaggaactggtttgccctgtggctggatggcaccctgggctactaccatgatgaaacagcccaggatgaggaggacagagtgctgatccacttcaacgtgcgggacatcaagattggaccagaatgtcatgatgtgcagcccccagagggccgcagcagagatggcctgctgactgtgaacctgcgggagggcggctag

SEQ ID NO: 164372 - DNA, 3576 bp, Artificial Sequence
  Description of Artificial Sequence: Synthetic coding sequence
atggagcggcccctggagaatggagatgagagcccagacagccagggccacgccacagactggaggtttgctgtgtgcagcttcagagatgcctgggaggaggaggagcccgccagccagatgcacgtgaaggaccccggcccccccaggcctcctgctggggccacccaggatgaggagctgcagggcagccccctgagcaggaagttccagctgcccccagctgctgatgaaagtggagatgcccagaggggcaccgtggagagcagctctgtgctgtctgagggccctggccccagcggcgtggagagcctgctgtgccccatgagcagccacctgagcctggcccagggcgagagtgacaccccaggagtgggcctggtgggggaccccggccccagccgggccatgcccagcggcctgagccctggggccctggacagcgaccctgtgggcctgggggaccccctgtctgagatcagcaagctgctggaggccgcccccagcggcagcggcctgcccaagccagctgactgcctgctggcccaggacctgtgctgggagctgctggccagcggcatggccaccctgcccggcaccagagatgtgcagggccgggctgtgctgctgctgtgtgcccacagccctgcctggctgcagagcgagtgcagcagccaggagctgatccggctgctgctgtacctgcggagcatccccaggcctgaggtgcaggccctgggcctgactgtgctggtggatgcccgcatctgtgcccccagcagcagcctcttcagcggcctgagccagctgcaggaggccgcccctggagctgtgtaccaggtgctgctggtgggcagcaccctgctgaaggaggtgcccagcggcctgcagctggagcagctgcccagccagagcctgctgacccacatccccacagctggcctgcccaccagcctgggcggcggcctgccctactgccaccaggcctggctggacttcagaagaaggctggaggccctgctgcagaactgccaggccgcctgtgccctgctgcagggcgccattgaatctgtgaaggctgtgccccagcccatggagcctggagaggtgggccagctgctgcagcagacagaggtgctgatgcagcaggtgctggacagcccctggctggcctggctgcagtgccagggcggccgggagctgacctggctgaagcaggaggtgcctgaggtgaccctgagcccagactacagaacagccatggacaaggcagatgagctgtatgacagagtggatggcctgctgcaccagctgaccctgcagagcaaccagaggatccaggccctggagctggtgcagaccctggaggcccgggagagcggcctgcaccagatcgaggtgtggctgcagcaggtgggctggccagccctggaggaggccggggagcccagcctggacatgctgctgcaggcccagggcagcttccaggagctgtaccaggtggcccaggagcaggtgcggcagggcgagaagttcctgcagcccctgaccggctgggaggccgctgagctggaccccccaggggcccgcttcctggccctgcgggcccagctgacagagttcagccgggccctggcccagcgctgccagaggctggctgatgctgagcggctcttccagctgttccgggaggccctgacctgggccgaggagggccagagggtgctggccgagctggagcaggagaggcctggggtggtgctgcagcagctgcagctgcactggaccaggcacccagacctgcccccagcccacttcaggaagatgtgggccctggccaccggcctgggcagcgaggccatccggcaggagtgccgctgggcctgggcccgctgccaggacacctggctggccctggaccagaagctggaggccagcctgaagctgccccctgtgggcagcacagccagcctgtgtgtgtcccaggtgcctgctgccccagcccacccccccctgaggaaggcctacagctttgacaggaacctgggccagagcctgtctgagcccgcctgccactgccaccacgccgccaccatcgccgcctgcagaagacctgaggccggcggcggggccctgccccaggccagccccaccgtgcccccacctggcagcagtgaccccaggagcctgaaccggctgcagctggtgctggccgagatggtggccacagagcgggagtatgtgcgggccctggagtacaccatggagaactacttccctgagctggacagaccagatgtgccccagggcctgcggggccagagggcccacctgtttggaaacctggagaagctgcgggacttccactgccacttcttcctgcgggagctggaggcctgcaccaggcaccccccccgggtggcctatgccttcctgcggcaccgggtgcagtttggcatgtatgccctgtacagcaagaacaagcccaggagtgatgccctgatgagcagctatggccacaccttcttcaaggacaagcagcaggccctgggggaccacctggacctggccagctacctgctgaagcccatccagaggatgggcaagtatgccctgctgctgcaggagctggcccgggcctgtggcggccccacccaggagctgagcgccctgcgggaggcccagagcctggtgcacttccagctgcggcacggcaatgacctgctggccatggatgccatccagggctgtgatgtgaacctgaaggagcagggccagctggtgcggcaggatgaatttgtggtgaggacaggccgccacaagtctgtgcggcgcatcttcctgtttgaggagctgctgctcttcagcaagcccaggcatggccccactggagtggacacctttgcctacaagaggagcttcaagatggctgacctgggcctgacagagtgctgcggcaacagcaacctgcgctttgagatctggttcagaagaaggaaggcccgggacacctttgtgctgcaggccagcagcctggccatcaagcaggcctggacagctgacatcagccacctgctgtggaggcaggccgtgcacaacaaggaggtgaggatggccgagatggtgtccatgggcgtgggcaacaaggccttccgggacatcgcccccagcgaggaggccatcaatgacagaacagtgaactacgtgctgaagtgccgggaggtgcgcagccgggccagcattgctgtggccccctttgaccatgacagcctgtacctgggcgccagcaacagcctgcccggggaccctgccagctgcagcgtgctgggcagcctgaacctgcacctgtacagagatcctgccctgctgggcctgcgctgccccctgtaccccagcttccctgaggaggccgccctggaggccgaggccgagctgggcggccagcccagcctgacagctgaggacagcgagatcagcagccagtgccccagcgccagcggcagcagcggcagtgacagcagctgtgtgtctggccaggccctgggccggggcctggaggacctgccctgtgtgtag

SEQ ID NO: 164373 - DNA, 3576 bp, Artificial Sequence; identical to SEQ ID NO: 164372
  Description of Artificial Sequence: Synthetic coding sequence

SEQ ID NO: 164374 - DNA, 582 bp, Artificial Sequence
  Description of Artificial Sequence: Synthetic coding sequence
atggagcggcccctggagaatggagatgagagcccagacagccagggccacgccacagactggaggtttgctgtgtgcagcttcagagatgcctgggaggaggaggagcccgccagccagatgcacgtgaaggaccccggcccccccaggcctcctgctggggccacccaggatgaggagctgcagggcagccccctgagcaggaagttccagctgcccccagctgctgatgaaagtggagatgcccagaggggcaccgtggagagcagctctgtgctgtctgagggccctggccccagcggcgtggagagcctgctgtgccccatgagcagccacctgagcctggcccagggcgagagtgacaccccaggagtgggcctggtgggggaccccggccccagccgggccatgcccagcggcctgagccctggggccctggacagcgaccctgtgggcctgggggaccccctgtctgagatcagcaagctgctggaggccggcaaggagggctgggcccgggaggtgtgggagggcaatggagatgcctggagagatgagtgccaggactttggaggcctgtag

SEQ ID NO: 164375 - DNA, 3576 bp, Artificial Sequence; identical to SEQ ID NO: 164372
  Description of Artificial Sequence: Synthetic coding sequence

SEQ ID NO: 164376 - DNA, 3333 bp, Artificial Sequence
  Description of Artificial Sequence: Synthetic coding sequence
atggagcggcccctggagaatggagatgagagcccagacagccagggccacgccacagactggaggtttgctgtgtgcagcttcagagatgcctgggaggaggaggagcccgccagccagatgcacgtgaaggaccccggcccccccaggcctcctgctggggccacccaggatgaggagctgcagggcagccccctgagcaggaagttccagctgcccccagctgctgatgaaagtggagatgcccagaggggcaccgtggagagcagctctgtgctgtctgagggccctggccccagcggcgtggagagcctgctgtgccccatgagcagccacctgagcctggcccagggcaccagagatgtgcagggccgggctgtgctgctgctgtgtgcccacagccctgcctggctgcagagtgaatgtagcagccaggagctgatccggctgctgctgtacctgcggagcatccccaggcctgaggtgcaggccctgggcctgactgtgctggtggatgcccgcatctgtgcccccagcagcagcctcttcagcggcctgagccagctgcaggaggccgcccctggagctgtgtaccaggtgctgctggtgggcagcaccctgctgaaggaggtgcccagcggcctgcagctggagcagctgcccagccagagcctgctgacccacatccccacagctggcctgcccaccagcctgggcggcggcctgccctactgccaccaggcctggctggacttcagaagaaggctggaggccctgctgcagaactgccaggccgcctgtgccctgctgcagggcgccatcgagagcgtgaaggctgtgccccagcccatggagcccggggaggtgggccagctgctgcagcagacagaggtgctgatgcagcaggtgctggacagcccctggctggcctggctgcagtgccagggcggccgggagctgacctggctgaagcaggaggtgcctgaggtgaccctgagcccagactacagaacagccatggacaaggcagatgagctgtatgacagagtggatggcctgctgcaccagctgaccctgcagagcaaccagaggatccaggccctggagctggtgcagaccctggaggcccgggagagcggcctgcaccagatcgaggtgtggctgcagcaggtgggctggccagccctggaggaggccggggagcccagcctggacatgctgctgcaggcccagggcagcttccaggagctgtaccaggtggcccaggagcaggtgcggcagggcgagaagttcctgcagcccctgaccggctgggaggccgctgagctggaccccccaggggcccgcttcctggccctgcgggcccagctgacagagttcagccgggccctggcccagcgctgccagaggctggctgatgctgagcggctcttccagctgttccgggaggccctgacctgggccgaggagggccagagggtgctggccgagctggagcaggagaggcctggggtggtgctgcagcagctgcagctgcactggaccaggcacccagacctgcccccagcccacttcaggaagatgtgggccctggccaccggcctgggcagcgaggccatccggcaggagtgccgctgggcctgggcccgctgccaggacacctggctggccctggaccagaagctggaggccagcctgaagctgccccctgtgggcagcacagccagcctgtgtgtgtcccaggtgcctgctgccccagcccacccccccctgaggaaggcctacagctttgacaggaacctgggccagagcctgtctgagcccgcctgccactgccaccacgccgccaccatcgccgcctgccggcggcctgaggccggcggcggggccctgccccaggccagccccaccgtgcccccacctggcagcagtgaccccaggagcctgaaccggctgcagctggtgctggccgagatggtggccacagagcgggagtatgtgcgggccctggagtacaccatggagaactacttccctgagctggacagaccagatgtgccccagggcctgcggggccagagggcccacctgtttggaaacctggagaagctgcgggacttccactgccacttcttcctgcgggagctggaggcctgcaccaggcaccccccccgggtggcctatgccttcctgcggcaccgggtgcagtttggcatgtatgccctgtacagcaagaacaagcccaggagtgatgccctgatgagcagctatggccacaccttcttcaaggacaagcagcaggccctgggggaccacctggacctggccagctacctgctgaagcccatccagaggatgggcaagtatgccctgctgctgcaggagctggcccgggcctgtggcggccccacccaggagctgagcgccctgcgggaggcccagagcctggtgcacttccagctgcggcatggaaatgacctgctggccatggatgccatccagggctgtgatgtgaacctgaaggagcagggccagctggtgcggcaggatgaatttgtggtgaggacaggccgccacaagtctgtgcggcgcatcttcctgtttgaggagctgctgctcttcagcaagcccaggcatggccccaccggggtggacacctttgcctacaagaggagcttcaagatggctgacctgggcctgacagagtgctgcggcaacagcaacctgcgctttgagatctggttcagaagaaggaaggcccgggacacctttgtgctgcaggccagcagcctggccatcaagcaggcctggacagctgacatcagccacctgctgtggaggcaggccgtgcacaacaaggaggtgaggatggccgagatggtgtccatgggcgtgggcaacaaggccttccgggacatcgcccccagcgaggaggccatcaatgacagaacagtgaactacgtgctgaagtgccgggaggtgcgcagccgggccagcattgctgtggccccctttgaccatgacagcctgtacctgggcgccagcaacagcctgcccggggaccctgccagctgcagcgtgctgggcagcctgaacctgcacctgtacagagatcctgccctgctgggcctgcgctgccccctgtaccccagcttccctgaggaggccgccctggaggccgaggccgagctgggcggccagcccagcctgacagcagaagattctgagatcagcagccagtgccccagcgccagcggcagcagcggcagtgacagcagctgtgtgtctggccaggccctgggccggggcctggaggacctgccctgtgtgtag

SEQ ID NO: 164377 - DNA, 3021 bp, Artificial Sequence
  Description of Artificial Sequence: Synthetic coding sequence
atgcactatgatggccacgtgcgctttgacctgcccccccagggctctgtgctggccagaaatgtgtccaccaggagctgcccccccaggaccagccctgctgtggacctggaggaggaggaggaggagagctctgtggatggaaaaggagacaggaagagcacaggcctgaagctgagcaagaagaaggcccggcggcggcacacagatgaccccagcaaagaatgcttcaccctgaagtttgacctgaatgtggacattgaaacagaaattgtgcctgccatgaagaagaagagcctgggggaggtgctgctgcctgtgtttgagaggaaaggaattgccctgggcaaggtggacatctacctggaccagagcaacacccccctgagcctgacctttgaggcctacagatttggaggccactacctgcgggtgaaggccccagccaagccaggagatgagggcaaggtggagcagggcatgaaggacagcaagagcctgagcctgcccatcctgcggcctgctggcactggacctccagccctggagcgggtggatgcccagagccggcgggagagcctggacatcctggcccctggaagaagaaggaagaacatgtctgagttcctgggggaggccagcatccctggccaggagccccccacccccagcagctgcagcctgcccagcggcagcagcggcagcaccaacacaggagacagctggaagaacagagctgccagccgcttcagcggcttcttcagcagcggccccagcaccagcgccttcggccgggaggtggacaagatggagcagctggagggcaagctgcacacctacagcctgtttggcctgccccggctgccccggggcctgcgctttgaccatgacagctgggaggaggagtatgatgaagatgaagatgaagataatgcctgcctgcggctggaggacagctggagggagctgattgatggccacgagaagctgacccggcggcagtgccaccagcaggaggccgtgtgggagctgctgcacacagaggccagctacatcaggaagctgcgggtcatcatcaacctcttcctgtgctgcctgctgaacctgcaggagagcggcctgctgtgtgaggtggaggccgagcggctcttcagcaacatccctgagatcgcccagctgcaccggcggctgtgggcctctgtgatggcccctgtgctggagaaggcccggaggacccgggccctgctgcagcccggggacttcctgaagggcttcaagatgtttggcagcctcttcaagccctacatccgctactgcatggaggaggagggctgcatggagtacatgaggggcctgctgcgggacaatgacctcttccgggcctacatcacctgggccgagaagcacccccagtgccagaggctgaagctgagtgacatgctggccaagccccaccagaggctgaccaagtaccccctgctgctgaagtctgtgctgaggaagacagaggagccccgggccaaggaggccgtggtggccatgattggctctgtggagcgcttcatccaccacgtgaatgcctgcatgaggcagaggcaggagcggcagaggctggccgctgtggtgtccagaattgatgcctatgaggtggtggagagcagcagtgatgaggtggacaagctgctgaaggagttcctgcacctggacctgacagcccccatccctggggccagccctgaggagacccggcagctgctgctggagggcagcctgaggatgaaggagggcaaggacagcaagatggatgtgtactgcttcctgttcacagacctgctgctggtgaccaaggctgtgaagaaggccgagaggaccagggtcatccggccccccctgctggtggacaagatcgtgtgccgggagctgcgggaccccggcagcttcctgctgatctacctgaatgagttccacagcgctgtgggcgcctacaccttccaggccagcggccaggccctgtgccggggctgggtggacaccatctacaatgcccagaaccagctgcagcagctgcgggcccaggagcccccaggcagccagcagcccctgcagagcctggaggaggaggaggatgagcaggaggaggaggaggaggaggaggaggaggaggaggagggagaagattctggcaccagcgctgccagcagccccaccatcatgaggaagagcagcggcagcccagacagccagcactgtgccagtgatggcagcacagagaccctggccatggtggtggtggagcccggggacaccctgagcagccctgagtttgattctggccccttcagcagccagagtgatgagaccagcctgagcaccacagccagcagcgccacccccaccagcgagctgctgcccctgggccctgtggatggccgcagctgcagcatggattctgcctacggcaccctgagccccaccagcctgcaggactttgtggcccctggccccatggccgagctggtgccccgggcccctgagagcccccgggtgcccagccccccacccagcccccggctgcggcggaggacccctgtgcagctgctgagctgccccccccacctgctgaagagcaagtctgaggccagcctgctgcagctgctggccggggccggcacccacggcacccccagcgcccccagccgcagcctgtctgagctgtgcctggccgtgcctgcccctggcatccgcacccagggcagcccccaggaggccggccccagctgggactgccgcggggcccccagccctggcagcggccctggcctggtgggctgcctggccggggagcccgccggcagccacaggaagagatgtggggacctgcccagcggggccagcccccgggtgcagcctgagcccccacctggggtgtctgcccagcacaggaagctgaccctggcccagctgtaccgcatccgcaccaccctgctgctgaacagcaccctgacagccagcgaggtgtag

SEQ ID NO: 164378 - DNA, 2793 bp, Artificial Sequence
  Description of Artificial Sequence: Synthetic coding sequence
atgcactatgatggccacgtgcgctttgacctgcccccccagggctctgtgctggccagaaatgtgtccaccaggagctgcccccccaggaccagccctgctgtggacctggaggaggaggaggaggagagctctgtggatggaaaaggagacaggaagagcacaggcctgaagctgagcaagaagaaggcccggcggcggcacacagatgaccccagcaaagaatgcttcaccctgaagtttgacctgaatgtggacattgaaacagaaattgtgcctgccatgaagaagaagagcctgggggaggtgctgctgcctgtgtttgagaggaaaggaattgccctgggcaaggtggacatctacctggaccagagcaacacccccctgagcctgacctttgaggcctacagatttggaggccactacctgcgggtgaaggccccagccaagccaggagatgagggcaaggtggagcagggcatgaaggacagcaagagcctgagcctgcccatcctgcggcctgctggcactggacctccagccctggagcgggtggatgcccagagccggcgggagagcctggacatcctggcccctggaagaagaaggaagaacatgtctgagttcctgggggaggccagcatccctggccaggagccccccacccccagcagctgcagcctgcccagcggcagcagcggcagcaccaacacaggagacagctggaagaacagagctgccagccgcttcagcggcttcttcagcagcggccccagcaccagcgccttcggccgggaggtggacaagatggagcagctggagggcaagctgcacacctacagcctgtttggcctgccccggctgccccggggcctgcgctttgaccatgacagctgggaggaggagtatgatgaagatgaagatgaagataatgcctgcctgcggctggaggacagctggagggagctgattgatggccacgagaagctgacccggcggcagtgccaccagcaggaggccgtgtgggagctgctgcacacagaggccagctacatcaggaagctgcgggtcatcatcaacctcttcctgtgctgcctgctgaacctgcaggagagcggcctgctgtgtgaggtggaggccgagcggctcttcagcaacatccctgagatcgcccagctgcaccggcggctgtgggcctctgtgatggcccctgtgctggagaaggcccggaggacccgggccctgctgcagcccggggacttcctgaagggcttcaagatgtttggcagcctcttcaagccctacatccgctactgcatggaggaggagggctgcatggagtacatgaggggcctgctgcgggacaatgacctcttccgggcctacatcacctgggccgagaagcacccccagtgccagaggctgaagctgagtgacatgctggccaagccccaccagaggctgaccaagtaccccctgctgctgaagtctgtgctgaggaagacagaggagccccgggccaaggaggccgtggtggccatgattggctctgtggagcgcttcatccaccacgtgaatgcctgcatgaggcagaggcaggagcggcagaggctggccgctgtggtgtccagaattgatgcctatgaggtggtggagagcagcagtgatgaggtggacaagctgctgaaggagttcctgcacctggacctgacagcccccatccctggggccagccctgaggagacccggcagctgctgctggagggcagcctgaggatgaaggagggcaaggacagcaagatggatgtgtactgcttcctgttcacagacctgctgctggtgaccaaggctgtgaagaaggccgagaggaccagggtcatccggccccccctgctggtggacaagatcgtgtgccgggagctgcgggaccccggcagcttcctgctgatctacctgaatgagttccacagcgctgtgggcgcctacaccttccaggccagcggccaggccctgtgccggggctgggtggacaccatctacaatgcccagaaccagctgcagcagctgcgggcccaggagcccccaggcagccagcagcccctgcagagcctggaggaggaggaggatgagcaggaggaggaggaggaggaggaggaggaggaggaggagggagaagattctggcaccagcgctgccagcagccccaccatcatgaggaagagcagcggcagcccagacagccagcactgtgccagtgatggcagcacagagaccctggccatggtggtggtggagcccggggacaccctgagcagccctgagtttgattctggccccttcagcagccagagtgatgagaccagcctgagcaccacagccagcagcgccacccccaccagcgagctgctgcccctgggccctgtggatggccgcagctgcagcatggattctgcctacggcaccctgagccccaccagcctgcaggactttgtggcccctggccccatggccgagctggtgccccgggcccctgagagcccccgggtgcccagccccccacccagcccccggctgcggcggaggacccctgtgcagctgctgagctgccccccccacctgctgaagagcaagtctgaggccagcctgctgcagctgctggccggggccggcacccacggcacccccagcgcccccagccgcagcctgtctgagctgtgcctggccgtgcctgccccagcccaggaggccgaccccggccctgccctgcccaaccaggaccaccctgctgcctag

SEQ ID NO: 164379 - DNA, 3021 bp, Artificial Sequence; identical to SEQ ID NO: 164377
  Description of Artificial Sequence: Synthetic coding sequence

SEQ ID NO: 164380 - DNA, 3132 bp, Artificial Sequence
  Description of Artificial Sequence: Synthetic coding sequence
atggacaagggccgggccgccaaggtgtgccaccacgccgactgccagcagctgcaccggcggggccccctgaacctgtgtgaggcctgtgacagcaagttccacagcaccatgcactatgatggccacgtgcgctttgacctgcccccccagggctctgtgctggccagaaatgtgtccaccaggagctgcccccccaggaccagccctgctgtggacctggaggaggaggaggaggagagctctgtggatggcaagggggacaggaagagcacaggcctgaagctgagcaagaagaaggccaggagaagacacacagatgaccccagcaaggagtgcttcaccctgaagtttgacctgaatgtggacatcgagacagagatcgtgcctgccatgaagaagaagagcctgggggaggtgctgctgcctgtgtttgagaggaagggcatcgccctgggcaaggtggacatctacctggaccagagcaacacccccctgagcctgacctttgaggcctacagatttggaggccactacctgcgggtgaaggccccagccaagccaggagatgagggcaaggtggagcagggcatgaaggacagcaagagcctgagcctgcccatcctgcggcctgctggcaccggccccccagccctggagcgggtggatgcccagagcagaagagagagcctggacatcctggcccctggaagaagaaggaagaacatgtctgagttcctgggggaggccagcatccctggccaggagccccccacccccagcagctgcagcctgcccagcggcagcagcggcagcaccaacacaggagacagctggaagaacagagctgccagccgcttcagcggcttcttcagcagcggccccagcaccagcgccttcggccgggaggtggacaagatggagcagctggagggcaagctgcacacctacagcctgtttggcctgccccggctgccccggggcctgcgctttgaccatgacagctgggaggaggagtatgatgaagatgaagatgaggacaatgcctgcctgcggctggaggacagctggagggagctgattgatggccacgagaagctgacccggcggcagtgccaccagcaggaggccgtgtgggagctgctgcacacagaggccagctacatcaggaagctgcgggtcatcatcaacctcttcctgtgctgcctgctgaacctgcaggagagcggcctgctgtgtgaggtggaggccgagcggctcttcagcaacatccctgagatcgcccagctgcaccggcggctgtgggcctctgtgatggcccctgtgctggagaaggcccggaggacccgggccctgctgcagcccggggacttcctgaagggcttcaagatgtttggcagcctcttcaagccctacatccgctactgcatggaggaggagggctgcatggagtacatgaggggcctgctgcgggacaatgacctcttccgggcctacatcacctgggccgagaagcacccccagtgccagaggctgaagctgagtgacatgctggccaagccccaccagaggctgaccaagtaccccctgctgctgaagtctgtgctgaggaagacagaggagccccgggccaaggaggccgtggtggccatgattggctctgtggagcgcttcatccaccacgtgaatgcctgcatgaggcagaggcaggagcggcagaggctggccgctgtggtgtccagaattgatgcctatgaggtggtggagagcagcagtgatgaggtggacaagctgctgaaggagttcctgcacctggacctgacagcccccatccctggggccagccctgaggagacccggcagctgctgctggagggcagcctgaggatgaaggagggcaaggacagcaagatggatgtgtactgcttcctgttcacagacctgctgctggtgaccaaggctgtgaagaaggccgagaggaccagggtcatccggccccccctgctggtggacaagatcgtgtgccgggagctgcgggaccccggcagcttcctgctgatctacctgaatgagttccacagcgctgtgggcgcctacaccttccaggccagcggccaggccctgtgccggggctgggtggacaccatctacaatgcccagaaccagctgcagcagctgcgggcccaggagcccccaggcagccagcagcccctgcagagcctggaggaggaggaggatgagcaggaggaggaggaggaggaggaggaggaggaggaggagggggaggacagcggcaccagcgctgccagcagccccaccatcatgaggaagagcagcggcagcccagacagccagcactgtgccagtgatggcagcacagagaccctggccatggtggtggtggagcccggggacaccctgagcagccctgagtttgacagcggccccttcagcagccagagtgatgagaccagcctgagcaccacagccagcagcgccacccccaccagcgagctgctgcccctgggccctgtggatggccgcagctgcagcatggacagcgcctacggcaccctgagccccaccagcctgcaggactttgtggcccctggccccatggccgagctggtgccccgggcccctgagagcccccgggtgcccagccccccacccagcccccggctgcggcggaggacccctgtgcagctgctgagctgccccccccacctgctgaagagcaagtctgaggccagcctgctgcagctgctggccggggccggcacccacggcaccccatctgcccccagccgcagcctgtctgagctgtgcctggccgtgcctgcccctggcatccgcacccagggcagcccccaggaggccggccccagctgggactgccgcggggcccccagccctggcagcggccctggcctggtgggctgcctggccggggagcctgctggcagccacaggaagagatgtggggacctgcccagcggggccagcccccgggtgcagcctgagcccccacctggggtgtctgcccagcacaggaagctgaccctggcccagctgtaccgcatccgcaccaccctgctgctgaacagcaccctgacagccagcgaggtgtag

SEQ ID NO: 164381 - DNA, 3021 bp, Artificial Sequence; identical to SEQ ID NO: 164377
  Description of Artificial Sequence: Synthetic coding sequence

SEQ ID NO: 164382 - DNA, 2559 bp, Artificial Sequence
  Description of Artificial Sequence: Synthetic coding sequence
atgaacagcgtgctgaccaagcacggcagccccccaagatcctggctgagcctgtgcagcggcacagatgaccagagccctgctgagaagaagggcctgcgctgccagaacccagcctgcatggacaagggccgggccgccaaggtgtgccaccacgccgactgccagcagctgcaccggcggggccccctgaacctgtgtgaggcctgtgacagcaagttccacagcaccatgcactatgatggccacgtgcgctttgacctgcccccccagggctctgtgctggccagaaatgtgtccaccaggagctgcccccccaggaccagccctgctgtggacctggaggaggaggaggaggagagctctgtggatggcaagggggacaggaagagcacaggcctgaagctgagcaagaagaaggccaggagaagacacacagatgaccccagcaaggagtgcttcaccctgaagtttgacctgaatgtggacatcgagacagagatcgtgcctgccatgaagaagaagagcctgggggaggtgctgctgcctgtgtttgagaggaagggcatcgccctgggcaaggtggacatctacctggaccagagcaacacccccctgagcctgacctttgaggcctacagatttggaggccactacctgcgggtgaaggccccagccaagccaggagatgagggcaaggtggagcagggcatgaaggacagcaagagcctgagcctgcccatcctgcggcctgctggcaccggccccccagccctggagcgggtggatgcccagagcagaagagagagcctggacatcctggcccctggaagaagaaggaagaacatgtctgagttcctgggggaggccagcatccctggccaggagccccccacccccagcagctgcagcctgcccagcggcagcagcggcagcaccaacacaggagacagctggaagaacagagctgccagccgcttcagcggcttcttcagcagcggccccagcaccagcgccttcggccgggaggtggacaagatggagcagctggagggcaagctgcacacctacagcctgtttggcctgccccggctgccccggggcctgcgctttgaccatgacagctgggaggaggagtatgatgaagatgaagatgaggacaatgcctgcctgcggctggaggacagctggagggagctgattgatggccacgagaagctgacccggcggcagtgccaccagcaggaggccgtgtgggagctgctgcacacagaggccagctacatcaggaagctgcgggtcatcatcaacctcttcctgtgctgcctgctgaacctgcaggagagcggcctgctgtgtgaggtggaggccgagcggctcttcagcaacatccctgagatcgcccagctgcaccggcggctgtgggcctctgtgatggcccctgtgctggagaaggcccggaggacccgggccctgctgcagcccggggacttcctgaagggcttcaagatgtttggcagcctcttcaagccctacatccgctactgcatggaggaggagggctgcatggagtacatgaggggcctgctgcgggacaatgacctcttccgggcctacatcacctgggccgagaagcacccccagtgccagaggctgaagctgagtgacatgctggccaagccccaccagaggctgaccaagtaccccctgctgctgaagtctgtgctgaggaagacagaggagccccgggccaaggaggccgtggtggccatgattggctctgtggagcgcttcatccaccacgtgaatgcctgcatgaggcagaggcaggagcggcagaggctggccgctgtggtgtccagaattgatgcctatgaggtggtggagagcagcagtgatgaggtggacaagctgctgaaggagttcctgcacctggacctgacagcccccatccctggggccagccctgaggagacccggcagctgctgctggagggcagcctgaggatgaaggagggcaaggacagcaagatggatgtgtactgcttcctgttcacagacctgctgctggtgaccaaggctgtgaagaaggccgagaggaccagggtcatccggccccccctgctggtggacaagatcgtgtgccgggagctgcgggaccccggcagcttcctgctgatctacctgaatgagttccacagcgctgtgggcgcctacaccttccaggccagcggccaggccctgtgccggggctgggtggacaccatctacaatgcccagaaccagctgcagcagctgcgggcccaggagcccccaggcagccagcagcccctgcagagcctggaggaggaggaggatgagcaggaggaggaggaggaggaggaggaggaggaggaggagggggaggacagcggcaccagcgctgccagcagccccaccatcatgaggaagagcagcggcagcccagacagccagcactggaagctgaccctggcccagctgtaccgcatccgcaccaccctgctgctgaacagcaccctgacagccagcgaggtgtag

SEQ ID NO: 164383 - DNA, 3252 bp, Artificial Sequence
  Description of Artificial Sequence: Synthetic coding sequence
atgaacagcgtgctgaccaagcacggcagccccccaagatcctggctgagcctgtgcagcggcacagatgaccagagccctgctgagaagaagggcctgcgctgccagaacccagcctgcatggacaagggccgggccgccaaggtgtgccaccacgccgactgccagcagctgcaccggcggggccccctgaacctgtgtgaggcctgtgacagcaagttccacagcaccatgcactatgatggccacgtgcgctttgacctgcccccccagggctctgtgctggccagaaatgtgtccaccaggagctgcccccccaggaccagccctgctgtggacctggaggaggaggaggaggagagctctgtggatggcaagggggacaggaagagcacaggcctgaagctgagcaagaagaaggccaggagaagacacacagatgaccccagcaaggagtgcttcaccctgaagtttgacctgaatgtggacatcgagacagagatcgtgcctgccatgaagaagaagagcctgggggaggtgctgctgcctgtgtttgagaggaagggcatcgccctgggcaaggtggacatctacctggaccagagcaacacccccctgagcctgacctttgaggcctacagatttggaggccactacctgcgggtgaaggccccagccaagccaggagatgagggcaaggtggagcagggcatgaaggacagcaagagcctgagcctgcccatcctgcggcctgctggcaccggccccccagccctggagcgggtggatgcccagagcagaagagagagcctggacatcctggcccctggaagaagaaggaagaacatgtctgagttcctgggggaggccagcatccctggccaggagccccccacccccagcagctgcagcctgcccagcggcagcagcggcagcaccaacacaggagacagctggaagaacagagctgccagccgcttcagcggcttcttcagcagcggccccagcaccagcgccttcggccgggaggtggacaagatggagcagctggagggcaagctgcacacctacagcctgtttggcctgccccggctgccccggggcctgcgctttgaccatgacagctgggaggaggagtatgatgaagatgaagatgaggacaatgcctgcctgcggctggaggacagctggagggagctgattgatggccacgagaagctgacccggcggcagtgccaccagcaggaggccgtgtgggagctgctgcacacagaggccagctacatcaggaagctgcgggtcatcatcaacctcttcctgtgctgcctgctgaacctgcaggagagcggcctgctgtgtgaggtggaggccgagcggctcttcagcaacatccctgagatcgcccagctgcaccggcggctgtgggcctctgtgatggcccctgtgctggagaaggcccggaggacccgggccctgctgcagcccggggacttcctgaagggcttcaagatgtttggcagcctcttcaagccctacatccgctactgcatggaggaggagggctgcatggagtacatgaggggcctgctgcgggacaatgacctcttccgggcctacatcacctgggccgagaagcacccccagtgccagaggctgaagctgagtgacatgctggccaagccccaccagaggctgaccaagtaccccctgctgctgaagtctgtgctgaggaagacagaggagccccgggccaaggaggccgtggtggccatgattggctctgtggagcgcttcatccaccacgtgaatgcctgcatgaggcagaggcaggagcggcagaggctggccgctgtggtgtccagaattgatgcctatgaggtggtggagagcagcagtgatgaggtggacaagctgctgaaggagttcctgcacctggacctgacagcccccatccctggggccagccctgaggagacccggcagctgctgctggagggcagcctgaggatgaaggagggcaaggacagcaagatggatgtgtactgcttcctgttcacagacctgctgctggtgaccaaggctgtgaagaaggccgagaggaccagggtcatccggccccccctgctggtggacaagatcgtgtgccgggagctgcgggaccccggcagcttcctgctgatctacctgaatgagttccacagcgctgtgggcgcctacaccttccaggccagcggccaggccctgtgccggggctgggtggacaccatctacaatgcccagaaccagctgcagcagctgcgggcccaggagcccccaggcagccagcagcccctgcagagcctggaggaggaggaggatgagcaggaggaggaggaggaggaggaggaggaggaggaggagggggaggacagcggcaccagcgctgccagcagccccaccatcatgaggaagagcagcggcagcccagacagccagcactgtgccagtgatggcagcacagagaccctggccatggtggtggtggagcccggggacaccctgagcagccctgagtttgacagcggccccttcagcagccagagtgatgagaccagcctgagcaccacagccagcagcgccacccccaccagcgagctgctgcccctgggccctgtggatggccgcagctgcagcatggacagcgcctacggcaccctgagccccaccagcctgcaggactttgtggcccctggccccatggccgagctggtgccccgggcccctgagagcccccgggtgcccagccccccacccagcccccggctgcggcggaggacccctgtgcagctgctgagctgccccccccacctgctgaagagcaagtctgaggccagcctgctgcagctgctggccggggccggcacccacggcaccccatctgcccccagccgcagcctgtctgagctgtgcctggccgtgcctgcccctggcatccgcacccagggcagcccccaggaggccggccccagctgggactgccgcggggcccccagccctggcagcggccctggcctggtgggctgcctggccggggagcctgctggcagccacaggaagagatgtggggacctgcccagcggggccagcccccgggtgcagcctgagcccccacctggggtgtctgcccagcacaggaagctgaccctggcccagctgtaccgcatccgcaccaccctgctgctgaacagcaccctgacagccagcgaggtgtag

SEQ ID NO: 164384 - DNA, 3021 bp, Artificial Sequence; identical to SEQ ID NO: 164377
  Description of Artificial Sequence: Synthetic coding sequence

SEQ ID NO: 164385 - DNA, 3189 bp, Artificial Sequence
  Description of Artificial Sequence: Synthetic coding sequence
atggatgaccagagccctgctgagaagaagggcctgcgctgccagaacccagcctgcatggacaagggccgggccgccaaggtgtgccaccacgccgactgccagcagctgcacagaagaggccccctgaacctgtgtgaggcctgtgacagcaagttccacagcaccatgcactatgatggccacgtgcgctttgacctgcccccccagggctctgtgctggccagaaatgtgtccaccaggagctgcccccccaggaccagccctgctgtggacctggaggaggaggaggaggagagctctgtggatggaaaaggagacaggaagagcacaggcctgaagctgagcaagaagaaggcccggcggcggcacacagatgaccccagcaaagaatgcttcaccctgaagtttgacctgaatgtggacattgaaacagaaattgtgcctgccatgaagaagaagagcctgggggaggtgctgctgcctgtgtttgagaggaaaggaattgccctgggcaaggtggacatctacctggaccagagcaacacccccctgagcctgacctttgaggcctacagatttggaggccactacctgcgggtgaaggccccagccaagccaggagatgagggcaaggtggagcagggcatgaaggacagcaagagcctgagcctgcccatcctgcggcctgctggcactggacctccagccctggagcgggtggatgcccagagccggcgggagagcctggacatcctggcccctggaagaagaaggaagaacatgtctgagttcctgggggaggccagcatccctggccaggagccccccacccccagcagctgcagcctgcccagcggcagcagcggcagcaccaacacaggagacagctggaagaacagagctgccagccgcttcagcggcttcttcagcagcggccccagcaccagcgccttcggccgggaggtggacaagatggagcagctggagggcaagctgcacacctacagcctgtttggcctgccccggctgccccggggcctgcgctttgaccatgacagctgggaggaggagtatgatgaagatgaagatgaagataatgcctgcctgcggctggaggacagctggagggagctgattgatggccacgagaagctgacccggcggcagtgccaccagcaggaggccgtgtgggagctgctgcacacagaggccagctacatcaggaagctgcgggtcatcatcaacctcttcctgtgctgcctgctgaacctgcaggagagcggcctgctgtgtgaggtggaggccgagcggctcttcagcaacatccctgagatcgcccagctgcaccggcggctgtgggcctctgtgatggcccctgtgctggagaaggcccggaggacccgggccctgctgcagcccggggacttcctgaagggcttcaagatgtttggcagcctcttcaagccctacatccgctactgcatggaggaggagggctgcatggagtacatgaggggcctgctgcgggacaatgacctcttccgggcctacatcacctgggccgagaagcacccccagtgccagaggctgaagctgagtgacatgctggccaagccccaccagaggctgaccaagtaccccctgctgctgaagtctgtgctgaggaagacagaggagccccgggccaaggaggccgtggtggccatgattggctctgtggagcgcttcatccaccacgtgaatgcctgcatgaggcagaggcaggagcggcagaggctggccgctgtggtgtccagaattgatgcctatgaggtggtggagagcagcagtgatgaggtggacaagctgctgaaggagttcctgcacctggacctgacagcccccatccctggggccagccctgaggagacccggcagctgctgctggagggcagcctgaggatgaaggagggcaaggacagcaagatggatgtgtactgcttcctgttcacagacctgctgctggtgaccaaggctgtgaagaaggccgagaggaccagggtcatccggccccccctgctggtggacaagatcgtgtgccgggagctgcgggaccccggcagcttcctgctgatctacctgaatgagttccacagcgctgtgggcgcctacaccttccaggccagcggccaggccctgtgccggggctgggtggacaccatctacaatgcccagaaccagctgcagcagctgcgggcccaggagcccccaggcagccagcagcccctgcagagcctggaggaggaggaggatgagcaggaggaggaggaggaggaggaggaggaggaggaggagggagaagattctggcaccagcgctgccagcagccccaccatcatgaggaagagcagcggcagcccagacagccagcactgtgccagtgatggcagcacagagaccctggccatggtggtggtggagcccggggacaccctgagcagccctgagtttgattctggccccttcagcagccagagtgatgagaccagcctgagcaccacagccagcagcgccacccccaccagcgagctgctgcccctgggccctgtggatggccgcagctgcagcatggattctgcctacggcaccctgagccccaccagcctgcaggactttgtggcccctggccccatggccgagctggtgccccgggcccctgagagcccccgggtgcccagccccccacccagcccccggctgcggcggaggacccctgtgcagctgctgagctgccccccccacctgctgaagagcaagtctgaggccagcctgctgcagctgctggccggggccggcacccacggcacccccagcgcccccagccgcagcctgtctgagctgtgcctggccgtgcctgcccctggcatccgcacccagggcagcccccaggaggccggccccagctgggactgccgcggggcccccagccctggcagcggccctggcctggtgggctgcctggccggggagcccgccggcagccacaggaagagatgtggggacctgcccagcggggccagcccccgggtgcagcctgagcccccacctggggtgtctgcccagcacaggaagctgaccctggcccagctgtaccgcatccgcaccaccctgctgctgaacagcaccctgacagccagcgaggtgtag

SEQ ID NO: 164386 - DNA, 3228 bp, Artificial Sequence
  Description of Artificial Sequence: Synthetic coding sequence
atgggcactggacctggggtgtctggccgcctggccgccagccggcccggccctggcctgcccctgcgggacagcgagcccagctgggccggcggccgggccagagatggagacagccaggtgtgccaccacgccgactgccagcagctgcaccggcggggccccctgaacctgtgtgaggcctgtgacagcaagttccacagcaccatgcactatgatggccacgtgcgctttgacctgcccccccagggctctgtgctggccagaaatgtgtccaccaggagctgcccccccaggaccagccctgctgtggacctggaggaggaggaggaggagagctctgtggatggcaagggggacaggaagagcacaggcctgaagctgagcaagaagaaggccaggagaagacacacagatgaccccagcaaggagtgcttcaccctgaagtttgacctgaatgtggacatcgagacagagatcgtgcctgccatgaagaagaagagcctgggggaggtgctgctgcctgtgtttgagaggaagggcatcgccctgggcaaggtggacatctacctggaccagagcaacacccccctgagcctgacctttgaggcctacagatttggaggccactacctgcgggtgaaggccccagccaagccaggagatgagggcaaggtggagcagggcatgaaggacagcaagagcctgagcctgcccatcctgcggcctgctggcaccggccccccagccctggagcgggtggatgcccagagcagaagagagagcctggacatcctggcccctggaagaagaaggaagaacatgtctgagttcctgggggaggccagcatccctggccaggagccccccacccccagcagctgcagcctgcccagcggcagcagcggcagcaccaacacaggagacagctggaagaacagagctgccagccgcttcagcggcttcttcagcagcggccccagcaccagcgccttcggccgggaggtggacaagatggagcagctggagggcaagctgcacacctacagcctgtttggcctgccccggctgccccggggcctgcgctttgaccatgacagctgggaggaggagtatgatgaagatgaagatgaggacaatgcctgcctgcggctggaggacagctggagggagctgattgatggccacgagaagctgacccggcggcagtgccaccagcaggaggccgtgtgggagctgctgcacacagaggccagctacatcaggaagctgcgggtcatcatcaacctcttcctgtgctgcctgctgaacctgcaggagagcggcctgctgtgtgaggtggaggccgagcggctcttcagcaacatccctgagatcgcccagctgcaccggcggctgtgggcctctgtgatggcccctgtgctggagaaggcccggaggacccgggccctgctgcagcccggggacttcctgaagggcttcaagatgtttggcagcctcttcaagccctacatccgctactgcatggaggaggagggctgcatggagtacatgaggggcctgctgcgggacaatgacctcttccgggcctacatcacctgggccgagaagcacccccagtgccagaggctgaagctgagtgacatgctggccaagccccaccagaggctgaccaagtaccccctgctgctgaagtctgtgctgaggaagacagaggagccccgggccaaggaggccgtggtggccatgattggctctgtggagcgcttcatccaccacgtgaatgcctgcatgaggcagaggcaggagcggcagaggctggccgctgtggtgtccagaattgatgcctatgaggtggtggagagcagcagtgatgaggtggacaagctgctgaaggagttcctgcacctggacctgacagcccccatccctggggccagccctgaggagacccggcagctgctgctggagggcagcctgaggatgaaggagggcaaggacagcaagatggatgtgtactgcttcctgttcacagacctgctgctggtgaccaaggctgtgaagaaggccgagaggaccagggtcatccggccccccctgctggtggacaagatcgtgtgccgggagctgcgggaccccggcagcttcctgctgatctacctgaatgagttccacagcgctgtgggcgcctacaccttccaggccagcggccaggccctgtgccggggctgggtggacaccatctacaatgcccagaaccagctgcagcagctgcgggcccaggagcccccaggcagccagcagcccctgcagagcctggaggaggaggaggatgagcaggaggaggaggaggaggaggaggaggaggaggaggagggggaggacagcggcaccagcgctgccagcagccccaccatcatgaggaagagcagcggcagcccagacagccagcactgtgccagtgatggcagcacagagaccctggccatggtggtggtggagcccggggacaccctgagcagccctgagtttgacagcggccccttcagcagccagagtgatgagaccagcctgagcaccacagccagcagcgccacccccaccagcgagctgctgcccctgggccctgtggatggccgcagctgcagcatggacagcgcctacggcaccctgagccccaccagcctgcaggactttgtggcccctggccccatggccgagctggtgccccgggcccctgagagcccccgggtgcccagccccccacccagcccccggctgcggcggaggacccctgtgcagctgctgagctgccccccccacctgctgaagagcaagtctgaggccagcctgctgcagctgctggccggggccggcacccacggcaccccatctgcccccagccgcagcctgtctgagctgtgcctggccgtgcctgcccctggcatccgcacccagggcagcccccaggaggccggccccagctgggactgccgcggggcccccagccctggcagcggccctggcctggtgggctgcctggccggggagcctgctggcagccacaggaagagatgtggggacctgcccagcggggccagcccccgggtgcagcctgagcccccacctggggtgtctgcccagcacaggaagctgaccctggcccagctgtaccgcatccgcaccaccctgctgctgaacagcaccctgacagccagcgaggtgtag

SEQ ID NO: 164387 - DNA, 2739 bp, Artificial Sequence
  Description of Artificial Sequence: Synthetic coding sequence
atgaagaagaagagcctgggggaggtgctgctgcctgtgtttgagaggaaaggaattgccctgggcaaggtggacatctacctggaccagagcaacacccccctgagcctgacctttgaggcctacagatttggaggccactacctgcgggtgaaggccccagccaagccaggagatgagggcaaggtggagcagggcatgaaggacagcaagagcctgagcctgcccatcctgcggcctgctggcactggacctccagccctggagcgggtggatgcccagagccggcgggagagcctggacatcctggcccctggaagaagaaggaagaacatgtctgagttcctgggggaggccagcatccctggccaggagccccccacccccagcagctgcagcctgcccagcggcagcagcggcagcaccaacacaggagacagctggaagaacagagctgccagccgcttcagcggcttcttcagcagcggccccagcaccagcgccttcggccgggaggtggacaagatggagcagctggagggcaagctgcacacctacagcctgtttggcctgccccggctgccccggggcctgcgctttgaccatgacagctgggaggaggagtatgatgaagatgaagatgaagataatgcctgcctgcggctggaggacagctggagggagctgattgatggccacgagaagctgacccggcggcagtgccaccagcaggaggccgtgtgggagctgctgcacacagaggccagctacatcaggaagctgcgggtcatcatcaacctcttcctgtgctgcctgctgaacctgcaggagagcggcctgctgtgtgaggtggaggccgagcggctcttcagcaacatccctgagatcgcccagctgcaccggcggctgtgggcctctgtgatggcccctgtgctggagaaggcccggaggacccgggccctgctgcagcccggggacttcctgaagggcttcaagatgtttggcagcctcttcaagccctacatccgctactgcatggaggaggagggctgcatggagtacatgaggggcctgctgcgggacaatgacctcttccgggcctacatcacctgggccgagaagcacccccagtgccagaggctgaagctgagtgacatgctggccaagccccaccagaggctgaccaagtaccccctgctgctgaagtctgtgctgaggaagacagaggagccccgggccaaggaggccgtggtggccatgattggctctgtggagcgcttcatccaccacgtgaatgcctgcatgaggcagaggcaggagcggcagaggctggccgctgtggtgtccagaattgatgcctatgaggtggtggagagcagcagtgatgaggtggacaagctgctgaaggagttcctgcacctggacctgacagcccccatccctggggccagccctgaggagacccggcagctgctgctggagggcagcctgaggatgaaggagggcaaggacagcaagatggatgtgtactgcttcctgttcacagacctgctgctggtgaccaaggctgtgaagaaggccgagaggaccagggtcatccggccccccctgctggtggacaagatcgtgtgccgggagctgcgggaccccggcagcttcctgctgatctacctgaatgagttccacagcgctgtgggcgcctacaccttccaggccagcggccaggccctgtgccggggctgggtggacaccatctacaatgcccagaaccagctgcagcagctgcgggcccaggagcccccaggcagccagcagcccctgcagagcctggaggaggaggaggatgagcaggaggaggaggaggaggaggaggaggaggaggaggagggagaagattctggcaccagcgctgccagcagccccaccatcatgaggaagagcagcggcagcccagacagccagcactgtgccagtgatggcagcacagagaccctggccatggtggtggtggagcccggggacaccctgagcagccctgagtttgattctggccccttcagcagccagagtgatgagaccagcctgagcaccacagccagcagcgccacccccaccagcgagctgctgcccctgggccctgtggatggccgcagctgcagcatggattctgcctacggcaccctgagccccaccagcctgcaggactttgtggcccctggccccatggccgagctggtgccccgggcccctgagagcccccgggtgcccagccccccacccagcccccggctgcggcggaggacccctgtgcagctgctgagctgccccccccacctgctgaagagcaagtctgaggccagcctgctgcagctgctggccggggccggcacccacggcacccccagcgcccccagccgcagcctgtctgagctgtgcctggccgtgcctgcccctggcatccgcacccagggcagcccccaggaggccggccccagctgggactgccgcggggcccccagccctggcagcggccctggcctggtgggctgcctggccggggagcccgccggcagccacaggaagagatgtggggacctgcccagcggggccagcccccgggtgcagcctgagcccccacctggggtgtctgcccagcacaggaagctgaccctggcccagctgtaccgcatccgcaccaccctgctgctgaacagcaccctgacagccagcgaggtgtag

SEQ ID NO: 164388 - DNA, 3258 bp, Artificial Sequence
  Description of Artificial Sequence: Synthetic coding sequence
atgagcctgggggagcggggcagcccccagaccttcggcggcagctctgtgtccaaaggaagtgatgctggccatgaccagagccctgctgagaagaagggcctgcgctgccagaacccagcctgcatggacaagggccgggccgccaaggtgtgccaccacgccgactgccagcagctgcaccggcggggccccctgaacctgtgtgaggcctgtgacagcaagttccacagcaccatgcactatgatggccacgtgcgctttgacctgcccccccagggctctgtgctggccagaaatgtgtccaccaggagctgcccccccaggaccagccctgctgtggacctggaggaggaggaggaggagagctctgtggatggcaagggggacaggaagagcacaggcctgaagctgagcaagaagaaggccaggagaagacacacagatgaccccagcaaggagtgcttcaccctgaagtttgacctgaatgtggacatcgagacagagatcgtgcctgccatgaagaagaagagcctgggggaggtgctgctgcctgtgtttgagaggaagggcatcgccctgggcaaggtggacatctacctggaccagagcaacacccccctgagcctgacctttgaggcctacagatttggaggccactacctgcgggtgaaggccccagccaagccaggagatgagggcaaggtggagcagggcatgaaggacagcaagagcctgagcctgcccatcctgcggcctgctggcaccggccccccagccctggagcgggtggatgcccagagcagaagagagagcctggacatcctggcccctggaagaagaaggaagaacatgtctgagttcctgggggaggccagcatccctggccaggagccccccacccccagcagctgcagcctgcccagcggcagcagcggcagcaccaacacaggagacagctggaagaacagagctgccagccgcttcagcggcttcttcagcagcggccccagcaccagcgccttcggccgggaggtggacaagatggagcagctggagggcaagctgcacacctacagcctgtttggcctgccccggctgccccggggcctgcgctttgaccatgacagctgggaggaggagtatgatgaagatgaagatgaggacaatgcctgcctgcggctggaggacagctggagggagctgattgatggccacgagaagctgacccggcggcagtgccaccagcaggaggccgtgtgggagctgctgcacacagaggccagctacatcaggaagctgcgggtcatcatcaacctcttcctgtgctgcctgctgaacctgcaggagagcggcctgctgtgtgaggtggaggccgagcggctcttcagcaacatccctgagatcgcccagctgcaccggcggctgtgggcctctgtgatggcccctgtgctggagaaggcccggaggacccgggccctgctgcagcccggggacttcctgaagggcttcaagatgtttggcagcctcttcaagccctacatccgctactgcatggaggaggagggctgcatggagtacatgaggggcctgctgcgggacaatgacctcttccgggcctacatcacctgggccgagaagcacccccagtgccagaggctgaagctgagtgacatgctggccaagccccaccagaggctgaccaagtaccccctgctgctgaagtctgtgctgaggaagacagaggagccccgggccaaggaggccgtggtggccatgattggctctgtggagcgcttcatccaccacgtgaatgcctgcatgaggcagaggcaggagcggcagaggctggccgctgtggtgtccagaattgatgcctatgaggtggtggagagcagcagtgatgaggtggacaagctgctgaaggagttcctgcacctggacctgacagcccccatccctggggccagccctgaggagacccggcagctgctgctggagggcagcctgaggatgaaggagggcaaggacagcaagatggatgtgtactgcttcctgttcacagacctgctgctggtgaccaaggctgtgaagaaggccgagaggaccagggtcatccggccccccctgctggtggacaagatcgtgtgccgggagctgcgggaccccggcagcttcctgctgatctacctgaatgagttccacagcgctgtgggcgcctacaccttccaggccagcggccaggccctgtgccggggctgggtggacaccatctacaatgcccagaaccagctgcagcagctgcgggcccaggagcccccaggcagccagcagcccctgcagagcctggaggaggaggaggatgagcaggaggaggaggaggaggaggaggaggaggaggaggagggggaggacagcggcaccagcgctgccagcagccccaccatcatgaggaagagcagcggcagcccagacagccagcactgtgccagtgatggcagcacagagaccctggccatggtggtggtggagcccggggacaccctgagcagccctgagtttgacagcggccccttcagcagccagagtgatgagaccagcctgagcaccacagccagcagcgccacccccaccagcgagctgctgcccctgggccctgtggatggccgcagctgcagcatggacagcgcctacggcaccctgagccccaccagcctgcaggactttgtggcccctggccccatggccgagctggtgccccgggcccctgagagcccccgggtgcccagccccccacccagcccccggctgcggcggaggacccctgtgcagctgctgagctgccccccccacctgctgaagagcaagtctgaggccagcctgctgcagctgctggccggggccggcacccacggcaccccatctgcccccagccgcagcctgtctgagctgtgcctggccgtgcctgcccctggcatccgcacccagggcagcccccaggaggccggccccagctgggactgccgcggggcccccagccctggcagcggccctggcctggtgggctgcctggccggggagcctgctggcagccacaggaagagatgtggggacctgcccagcggggccagcccccgggtgcagcctgagcccccacctggggtgtctgcccagcacaggaagctgaccctggcccagctgtaccgcatccgcaccaccctgctgctgaacagcaccctgacagccagcgaggtgtag

SEQ ID NO: 164389 - DNA, 2793 bp, Artificial Sequence; identical to SEQ ID NO: 164378
  Description of Artificial Sequence: Synthetic coding sequence

SEQ ID NO: 164390 - DNA, 2373 bp, Artificial Sequence
  Description of Artificial Sequence: Synthetic coding sequence
atgaaggccttcggcccccctcatgagggccccctgcagggcctggtggccagccgcatcgagacctatggaggccgccaccgggccagcgcccagagcacagctggccgcctgtacccccggggctaccctgtgctggaccccagcagaagaaggctgcagcagtatgtgccctttgcccggggcagcggccaggcccggggcctgagccccatgaggctgcgggaccctgagcctgagaagagacatggaggccacgtgggcgccggcctgctgcacagccccaagctgaaggagctgaccaaggcccacgagctggaggtgcggctgcacaccttctccatgtttggcatgccccggctgcccccagaggaccggcggcactgggagattggagagggcggggacagcggcctgaccatcgagaagtcctggagggagctggtgcccggccacaaggagatgagccaggagctgtgccaccagcaggaggccctgtgggagctgctgaccacagagctgatctacgtgaggaagctgaagatcatgacagacctgctggccgccggcctgctgaacctgcagagggtgggcctgctgatggaggtgtctgctgagaccctgtttggaaatgtgcccagcctcatccgcacccaccgctccttctgggatgaggtgctgggccccaccctggaggagacccgggccagcggccagcccctggaccccatcggcctgcagagcggcttcctgaccttcggccagcgcttccacccctacgtgcagtactgcctgcgggtgaagcagaccatggcctatgcccgggagcagcaggagaccaaccccctcttccacgcctttgtgcagtggtgtgagaagcacaagaggagcggccggcagatgctgtgtgacctgctgatcaagccccaccagaggatcaccaagtaccccctgctgctgcatgctgtgctgaagaggagccctgaggcccgggcccaggaggccctgaatgccatgattgaggccgtggagagcttcctgcggcacatcaatggccaggtgcggcagggcgaggagcaggagagcctggccgccgccgcccagagaattggcccctatgaggtgctggagcccccatctgatgaggtggagaagaacctgcggcccttcagcaccctggacctgaccagccccatgctgggcgtggccagcgagcacacccggcagctgctgctggagggccctgtgcgggtgaaggagggccgggagggcaagctggatgtgtacctgttcctgttcagtgatgtgctgctggtgaccaagccccagaggaaggctgacaaggccaaggtgatccggccccccctgatgctggagaagctggtgtgccagcccctgcgggaccccaacagcttcctgctgatccacctgacagagttccagtgtgtgtcctctgccctgctggtgcactgccccagccccacagaccgggcccagtggctggagaagacccagcaggcccaggccgccctgcagaagctgaaggccgaggagtatgtgcagcagaagcgggagctgctgaccctgtacagagaccaggaccgggagagccccagcacccggcccagcacccccagcctggagggcagccagagcagcgctgagggccgcaccccagagttcagcaccatcatcccccacctggtggtgacagaggacacagatgaagatgcccccctggtgcctgatgacaccagtgacagcggctacggcaccctcatccctggcacccccaccggcagccgcagccccctgagccggctgcggcagagggccctgcggcgggacccccggctgaccttcagcaccctggagctgcgggacatccccctgcggccccaccccccagacccccaggccccccagaggagaagtgcccctgagctgcctgagggcatcctgaagggcggcagcctgccccaggaggacccccccacctggagcgaggaggaggatggagccagcgagagaggaaatgtggtggtggagaccctgcaccgggcccggctgcggggccagctgcccagcagccccacccatgctgacagcgctggggagagcccctgggagagcagcggggaggaggaggaggagggccccctcttcctgaaggccggccacaccagcctgcggcccatgagagctgaggacatgctgcgggagatccgggaggagctggccagccagagaattgaaggagctgaggagccccgggacagccggcccaggaagctgacccgggcccagctgcagaggatgaggggcccccacatcatccagctggacacccccctgagcgccagcgaggtgtag

SEQ ID NO: 164391 - DNA, 963 bp, Artificial Sequence
  Description of Artificial Sequence: Synthetic coding sequence
atgtgcccccgggagggcggccgggccagcaccatccaccagaagacagagaaggccttcggccagctgctgtgccagcccctgggggagcccaagatccagcaccccctgaaggccgccctgcagaagctgaaggccgaggagtatgtgcagcagaagcgggagctgctgaccctgtacagagaccaggaccgggagagccccagcacccggcccagcacccccagcctggagggcagccagagcagcgctgagggccgcaccccagagttcagcaccatcatcccccacctggtggtgacagaggacacagatgaagatgcccccctggtgcctgatgacaccagtgacagcggctacggcaccctcatccctggcacccccaccggcagccgcagccccctgagccggctgcggcagagggccctgcggcgggacccccggctgaccttcagcaccctggagctgcgggacatccccctgcggccccaccccccagacccccaggccccccagaggagaagtgcccctgagctgcctgagggcatcctgaagggcggcagcctgccccaggaggacccccccacctggagcgaggaggaggatggagccagcgagagaggaaatgtggtggtggagaccctgcaccgggcccggctgcggggccagctgcccagcagccccacccatgctgacagcgctggggagagcccctgggagagcagcggggaggaggaggaggagggccccctcttcctgaaggccggccacaccagcctgcggcccatgagagctgaggacatgctgcgggagatccgggaggagctggccagccagagaattgaaggagctgaggagccccgggacagccggcccaggaagctgacccgggcccagctgcagaggatgaggggcccccacatcatccagctggacacccccctgagcgccagcgaggtgtag

SEQ ID NO: 164392 - DNA, 2373 bp, Artificial Sequence; identical to SEQ ID NO: 164390
  Description of Artificial Sequence: Synthetic coding sequence

SEQ ID NO: 164393 - DNA, 2277 bp, Artificial Sequence
  Description of Artificial Sequence: Synthetic coding sequence
atgggctgccgcctgcacgcccctggagagaaggccgcccatgaccccagcagaagaaggctgcagcagtatgtgccctttgcccggggcagcggccaggcccggggcctgagccccatgaggctgcgggaccctgagcctgagaagagacatggaggccacgtgggcgccggcctgctgcacagccccaagctgaaggagctgaccaaggcccacgagctggaggtgcggctgcacaccttctccatgtttggcatgccccggctgcccccagaggaccggcggcactgggagattggagagggcggggacagcggcctgaccatcgagaagtcctggagggagctggtgcccggccacaaggagatgagccaggagctgtgccaccagcaggaggccctgtgggagctgctgaccacagagctgatctacgtgaggaagctgaagatcatgacagacctgctggccgccggcctgctgaacctgcagagggtgggcctgctgatggaggtgtctgctgagaccctgtttggaaatgtgcccagcctcatccgcacccaccgctccttctgggatgaggtgctgggccccaccctggaggagacccgggccagcggccagcccctggaccccatcggcctgcagagcggcttcctgaccttcggccagcgcttccacccctacgtgcagtactgcctgcgggtgaagcagaccatggcctatgcccgggagcagcaggagaccaaccccctcttccacgcctttgtgcagtggtgtgagaagcacaagaggagcggccggcagatgctgtgtgacctgctgatcaagccccaccagaggatcaccaagtaccccctgctgctgcatgctgtgctgaagaggagccctgaggcccgggcccaggaggccctgaatgccatgattgaggccgtggagagcttcctgcggcacatcaatggccaggtgcggcagggcgaggagcaggagagcctggccgccgccgcccagagaattggcccctatgaggtgctggagcccccatctgatgaggtggagaagaacctgcggcccttcagcaccctggacctgaccagccccatgctgggcgtggccagcgagcacacccggcagctgctgctggagggccctgtgcgggtgaaggagggccgggagggcaagctggatgtgtacctgttcctgttcagtgatgtgctgctggtgaccaagccccagaggaaggctgacaaggccaaggtgatccggccccccctgatgctggagaagctggtgtgccagcccctgcgggaccccaacagcttcctgctgatccacctgacagagttccagtgtgtgtcctctgccctgctggtgcactgccccagccccacagaccgggcccagtggctggagaagacccagcaggcccaggccgccctgcagaagctgaaggccgaggagtatgtgcagcagaagcgggagctgctgaccctgtacagagaccaggaccgggagagccccagcacccggcccagcacccccagcctggagggcagccagagcagcgctgagggccgcaccccagagttcagcaccatcatcccccacctggtggtgacagaggacacagatgaagatgcccccctggtgcctgatgacaccagtgacagcggctacggcaccctcatccctggcacccccaccggcagccgcagccccctgagccggctgcggcagagggccctgcggcgggacccccggctgaccttcagcaccctggagctgcgggacatccccctgcggccccaccccccagacccccaggccccccagaggagaagtgcccctgagctgcctgagggcatcctgaagggcggcagcctgccccaggaggacccccccacctggagcgaggaggaggatggagccagcgagagaggaaatgtggtggtggagaccctgcaccgggcccggctgcggggccagctgcccagcagccccacccatgctgacagcgctggggagagcccctgggagagcagcggggaggaggaggaggagggccccctcttcctgaaggccggccacaccagcctgcggcccatgagagctgaggacatgctgcgggagatccgggaggagctggccagccagagaattgaaggagctgaggagccccgggacagccggcccaggaagctgacccgggcccagctgcagaggatgaggggcccccacatcatccagctggacacccccctgagcgccagcgaggtgtag

SEQ ID NO: 164394 - DNA, 4482 bp, Artificial Sequence
  Description of Artificial Sequence: Synthetic coding sequence
atggccgagctgtctgagcctgagggccctgtggactggaaggagcgctgtgtggccctggagagccagctgatgaagttccgggtgcaggccagcaagatccgggagctgctggccgagaagatgcagcagctggagcggcaggtgattgatgctgagcggcaggccgagaaggccttccagcaggtgcaggtgatggaggacaagctgaaggccgccaacatccagaccagcgagagcgagacccggctgtacaacaagtgccaggacctggagagcctcatccaggagaaggatgatgtgatccagaacctggagctgcagctggaggagcagaagcagatccgcatccaggaggccaagatcatcgaggagaaggccgccaagatcaaggagtgggtgacagtgaagctgaatgagctggagctggagaaccagaacctgcggctcatcaaccagaaccagacagaggagatccgcaccatgcagagcaagctgcaggaggtgcagggcaagaagagcagcacagtgtccaccctgaagctgtctgagggccagaggctgagcagcctgaccttcggctgcttcctgagccgggcccggagccccccccaggtggtgaagtctgaggagatgagcaagatcagcagcaaggagcctgagttcacagagggcaaggacatggaggagatggagatccctgagaagtctgtggacaaccaggtgctggagaacaacagaggccagaggaccctgcaccagaccccctgtggcagcgagcagaacaggaagaccaggaccagctttgccacagatggcggcatcagccagaacagcggggcccctgtgtctgactggagcagtgatgaagaagatggcagcaagggccgcagcaagagccgctgcaccagcaccctgagcagccacaccagcgaggagggcgtgcagtgcagcaggatgggcagcgagatgtacctgacagccagtgatgacagcagcagcatctttgaggaggagaccttcggcatcaagaggcctgagcacaagaagctgtacagctggcagcaggaggcccagtggaaggccctgaacagccccctgggcaaaggaaacagcgagctgagcaagaaggagcaggacagcagcagtgatgagctgaacaagaagttccagagccagaggctggactacagcagcagcagcagcgaggccaacacccccagccccatcctgaccccagccctgatgcccaagcaccccaacagcctgagcggcaagggcacccagctggtgcccagcagccacctgcccccacccaagctgcgcatccccaacgtgttcagcatctctgtggccctggccaagaggcacctgagccagccccagctgagcagtgacaggatgtttggcaccaacagaaatgccatctccatgatccggcccctgcggccccaggagacagacctggacctggtggatggagacagcacagaggtgctggagaacatggacaccagctgtgatgatggcctcttctcctatgacagcctggacagccccaacagtgatgaccaggagcactgtgacagcgccaagaaggtggcctacagcaagccacccaccccacccctgcaccgcttccccagctgggagagccgcatctatgctgtggccaagagcggcatccgcatgtctgaggccttcaacatggagagcgtgaacaagaacagcgctgccaccctgagctacaccaccagcggcctgtacaccagcctcatctacaagaacatgaccacccctgtgtacaccaccctgaagggcaaggccacccagatcagcagcagccccttcctggatgacagcagcggcagcgaggaggaggacagcagccgcagcagcagcaggaccagcgagagtgacagccgcagccgcagcggccctggcagcccccgggccatgaagaggggcgtgtccctgagctctgtggccagcgagagtgactatgccatccccccagatgcctacagcacagacacagagtacagccagcctgagcagaagctgcccaagacctgcagcagcagcagtgacaacgggaagaatgagcccctggagaagagcggctacctgctgaagatgtctgggaaggtgaagtcctggaagaggcgctggtttgtgctgaagggcggggagctgctgtactacaagagccccagtgatgtgatcaggaagccccagggccacatcgagctgagcgccagctgcagcatcctgcggggggacaacaagcagacagtgcagctgaccacagagaagcacacctactacctgacagctgacagccccaacatcctggaggagtggatcaaggtgctgcagaatgtgctgcgggtgcaggccgccaaccccctgagcctgcagcctgagggcaagcccaccatgaagggcctgctgaccaaggtgaagcacggctacagcaagagggtgtggtgcaccctcatcggcaagaccctgtactacttccgcagccaggaggacaagttccccctgggccagatcaagctgtgggaggccaaggtggaggaggtggacaggagctgtgacagtgatgaagattatgaggccagcggccgcagcctgctgagcacccactacaccatcgtcatccaccccaaggaccagggccccacctacctgctgattggcagcaagcatgagaaggacacctggctgtaccacctgactgtggccgccggcagcaacaacgtgaatgtgggcagcgagtttgagcagctggtgtgcaagctgctgaacattgatggagagcccagcagccagatctggaggcaccccaccctgtgccacagcaaggagggcatcatcagccccctgaccaccctgcccagcgaggccctgcagacagaggccatcaagctgttcaagacctgccagctgttcatcaatgctgctgtggacagccctgccatcgactaccacatcagcctggcccagagcgccctgcagatctgcctgacccaccctgagctgcagaatgagatctgctgccagctgatcaagcagacccggcggcggcagccccagaaccagcccggccccctgcagggctggcagctgctggccctgtgtgtgggcctcttcctgccccaccaccccttcctgtggctgctgcggctgcacctgaagagaaatgctgacagcaggacagaatttgggaagtatgccatctactgccagagatgtgtggagaggacccagcagaatggagaccgggaggcccggcccagcaggatggagatcctgagcaccctgctgaggaacccctaccaccacagcctgcccttcagcatccctgtgcacttcatgaatggcatctaccaggtggtgggctttgatgccagcaccaccgtggaggagttcctgaacaccctgaaccaggacaccggcatgaggaagccagcccagagcggctttgccctcttcacagatgaccccagcggccgggacctggagcactgcctgcagggcaacatcaagatctgtgacatcatcagcaagtgggagcaggccagcaaggagcagcagcccgggaaatgtgagggcaccaggacagtgcggctgacctacaagaacagactctacttctctgtgcaggcccggggggagacagaccgggagaagctgctgctgatgtaccagaccaatgaccagatcatcaatggcctcttccccctgaacaaggacctggccctggagatggccgccctgctgagccaggtggagatcggggactttgagcggcccttcagcaccccagctggccacgtgaccaaccagtgcaaggtgaaccagaccctgaagcaggtgattgagaagttctaccccaagcgctacagagatggctgcagcgaggagcagctgcggcagctgtgccagaggctgagcacccgctggatggccctgcggggccacagcgctgctgactgtgtgcgcatctacctgactgtggccaggaagtggcccttctttggagccaagctgttcctggccaagcccatcacccccagcagcctgggcagcaccttcctgtggctggccgtgcatgaagatggcctgagcctgctggagtacaacagcatgaggctgattgtgtcctatgtgtacaagagcctgatgaccttcggcggctaccaggatgacttcatggtggtgatcaacaacacccacagcaaggacaagcccacagagaagctgctgtttgccatggccaagcccaagatcctggagatcaccctgctgattgccagctacatcaacaacttccaccagcagaaggccgccttccaccacctgagcgccccagccctgctgagcgcccagacccggggcccccaggccaggatgatgggcagccagcccctgctgagcagcagccggcccaccaagggccccaccctgctgtag

SEQ ID NO: 164395 - DNA, 2904 bp, Artificial Sequence
  Description of Artificial Sequence: Synthetic coding sequence
atggactggaccccccggctgcccagccgccacatcatcagcgagctggagcacctgacctttgtgaacacagatgtgggccgctgccgggcctggctgcggctggccctgaatgatggcctgatggagtgctacctgaagctgctgctgcaggagcaggcccggctgcacgagtactaccagcccacagccctgctgagagatgctgaggagggggagttcctgctgtccttcctgcagggcctgaccagcctgagctttgagctgagctacaagagcgccatcctgaatgagtggaccctgacccccctggccctgagcggcctgtgccccctgtctgagctggaccccctgagcaccagcggggctgagctgcagaggaaggagagcctggacagcatcagccacagcagcggctctgaagatattgaggtgcaccacagcggccacaagatcagaagaaaccagaagctgacagccagcagcctgagcctggacacagccagcagcagccagctgagctgcagcctgaacagcgacagctgcctgctgcaggagaatggcagcaagagcccagaccactgtgaggagcccatgagctgtgacagcgacctgggcacagccaatgcagaagattctgacaggagcctgcaggaggtgctgctggagttcagcaaggcccaggtgaacagcgtgcccaccaacggcctgagccaggagacagagatccccaccccccaggccagcctgagcctgcacggcctgaacaccagcacctacctgcactgtgaggccccagctgagcccctgcctgcccaggccgccagcggcacccaggatggagtgcacgtgcaggagccccggccccaggcccccagccccctggacctgcagcagcctgtggagagcaccagcggccagcagcccagcagcacagtgtctgaaacagcccgggaggtgggccagggcaatggcctgcagaaggcccaggcccatgatggagctggcctgaagctggtggtgagcagccccaccagccccaagaacaagtcctggatcagtgaagatgacttctaccggcccagccgggagcagcccctggagagcgccagtgaccaccccatcgccagctaccggggcaccccaggcagccggcccggcctgcaccgccacttcagccaggagcccaggaagaactgcagcctgggcgccctggaccaggcctgtgtgcccagccctggaagacggcaggcccaggccgcccccagccagggccacaagagcttccgggtggtgcaccggcggcagatgggcctgagcaaccccttccggggcctgatgaagctgggcaccgtggagcggcggggggccatgggcatctggaaggagctgttctgtgagctgagccccctggagttccggctgtacctgagcaatgaggagcacacctgtgtggagaactgcagcctgctgcgctgtgagagcgtgggccctgcccacagtgatggccgctttgagctggtgttcagcggcaagaagctggccctgcgggccagcagccaggatgaagctgaggactggctggacagagtgcgggaggccctgcagaaggtgcggccccagcaggaggatgagtgggtgaatgtgcagtacccagaccagcctgaggagcccccagaggccccccagggctgcctgagccccagcgacctgctgtctgagcctgctgccctgcagggcacccagtttgactggagcagcgcccaggtgcctgagccagatgccatcaaggagagcctgctgtacctgtacatggacaggacctggatgccctacatcttcagcctgagcctggaggccctgaagtgcttccgcatcagaaataatgagaagatgctgagtgacagccatggagtggagaccatccgggacatcctgcctgacaccagcctgggcggccccagcttcttcaagatcatcacagccaaggctgtgctgaagctgcaggccggaaatgctgaggaggccgccctgtggagggacctggtgaggaaggtgctggccagctacctggagacagctgaggaggccgtgaccctgggcggcagcctggatgagaactgccaggaggtgctgaagtttgccacccgggagaatggcttcctgctgcagtacctggtggccatccccatggagaagggcctggacagccagggctgcttctgtgccggctgcagccggcagatcggcttctcctttgtgcggcccaagctgtgtgccttcagcggcctgtactactgtgacatctgccaccaggatgatgccagcgtcatcccagcccgcatcatccacaactgggacctgaccaagaggcccatctgccggcaggccctgaagttcctgacccagatccgggcccagcccctcatcaacctgcagatggtgaatgccagcctgtatgagcacgtggagaggatgcacctgattggaagaagaagagagcagctgaagctgctgggggactacctgggcctgtgccgcagcggggccctgaaggagctgagcaagaggctgaaccacaggaactacctgctggagagcccccaccgcttctctgtggccgacctgcagcagattgctgatggagtgtatgagggcttcctgaaggccctgattgaatttgccagccagcacgtgtaccactgtgacctgtgcacccagaggggcttcatctgccagatctgccagcaccacgacatcatcttcccctttgaatttgacaccaccgtgcgctgtgccgagtgcaagacagtgttccaccagagctgccaggccgtggtgaagaagggctgcccccgctgtgcccggcggaggaagtaccaggagcagaacatctttgcctag

SEQ ID NO: 164396 - DNA, 3171 bp, Artificial Sequence
  Description of Artificial Sequence: Synthetic coding sequence
atgctgtctgtggtggagaatggcctggacccccaggccgccatccctgtgatcaagaagaagctggtgggctctgtgaaggccctgcagaagcagtatgtgtccctggacacagtggtgaccagtgaagatggagatgccaacaccatgtgcagcgccctggaggccgtgttcatccacggcctgcacgccaagcacatccgggcagaggccggcggcaagaggaagaagagcgcccaccagaagcccctgccccagcctgtgttctggcccctgctgaaggctgtgacccacaagcacatcatcagcgagctggagcacctgacctttgtgaacacagatgtgggccgctgccgggcctggctgcggctggccctgaatgatggcctgatggagtgctacctgaagctgctgctgcaggagcaggcccggctgcacgagtactaccagcccacagccctgctgagagatgctgaggagggggagttcctgctgtccttcctgcagggcctgaccagcctgagctttgagctgagctacaagagcgccatcctgaatgagtggaccctgacccccctggccctgagcggcctgtgccccctgtctgagctggaccccctgagcaccagcggggctgagctgcagaggaaggagagcctggacagcatcagccacagcagcggcagcgaggacatcgaggtgcaccacagcggccacaagatcagaagaaaccagaagctgacagccagcagcctgagcctggacacagccagcagcagccagctgagctgcagcctgaacagcgacagctgcctgctgcaggagaatggcagcaagagcccagaccactgtgaggagcccatgagctgtgacagcgacctgggcacagccaatgctgaggacagcgacaggagcctgcaggaggtgctgctggagttcagcaaggcccaggtgaacagcgtgcccaccaacggcctgagccaggagacagagatccccaccccccaggccagcctgagcctgcacggcctgaacaccagcacctacctgcactgtgaggccccagctgagcccctgcctgcccaggccgccagcggcacccaggatggagtgcacgtgcaggagccccggccccaggcccccagccccctggacctgcagcagcctgtggagagcaccagcggccagcagcccagcagcacagtgtctgaaacagcccgggaggtgggccagggcaatggcctgcagaaggcccaggcccatgatggagctggcctgaagctggtggtgagcagccccaccagccccaagaacaagtcctggatcagtgaagatgacttctaccggcccagccgggagcagcccctggagagcgccagtgaccaccccatcgccagctaccggggcaccccaggcagcaggcctggcctgcaccgccacttcagccaggagcccaggaagaactgcagcctgggcgccctggaccaggcctgtgtgcccagccctggccggcggcaggcccaggccgcccccagccagggccacaagagcttccgggtggtgcaccggcggcagatgggcctgagcaaccccttccggggcctgatgaagctgggcaccgtggagaggagaggagccatgggcatctggaaggagctgttctgtgagctgagccccctggagttccggctgtacctgagcaatgaggagcacacctgtgtggagaactgcagcctgctgcgctgtgagagcgtgggccctgcccacagtgatggccgctttgagctggtgttttctgggaagaagctggccctgcgggccagcagccaggatgaagctgaggactggctggacagagtgcgggaggccctgcagaaggtgcggccccagcaggaggatgagtgggtgaatgtgcagtacccagaccagcctgaggagcccccagaggccccccagggctgcctgagccccagcgacctgctgtctgagcctgctgccctgcagggcacccagtttgactggagcagcgcccaggtgcctgagccagatgccatcaaggagagcctgctgtacctgtacatggacaggacctggatgccctacatcttcagcctgagcctggaggccctgaagtgcttccgcatccggaacaatgagaagatgctgagtgacagccacggcgtggagaccatccgggacatcctgcctgacaccagcctgggcggccccagcttcttcaagatcatcacagccaaggctgtgctgaagctgcaggccggaaatgctgaggaggccgccctgtggagggacctggtgaggaaggtgctggccagctacctggagacagctgaggaggccgtgaccctgggcggcagcctggatgagaactgccaggaggtgctgaagtttgccaccagagaaaatggcttcctgctgcagtacctggtggccatccccatggagaagggcctggacagccagggctgcttctgtgccggctgcagccggcagatcggcttctcctttgtgcggcccaagctgtgtgccttcagcggcctgtactactgtgacatctgccaccaggatgatgccagcgtcatcccagcccgcatcatccacaactgggacctgaccaagaggcccatctgccggcaggccctgaagttcctgacccagatccgggcccagcccctcatcaacctgcagatggtgaatgccagcctgtatgaacatgtggagaggatgcacctgattggaagaagaagagagcagctgaagctgctgggggactacctgggcctgtgccgcagcggggccctgaaggagctgagcaagaggctgaaccacaggaactacctgctggagagcccccaccgcttctctgtggccgacctgcagcagattgctgatggagtgtatgagggcttcctgaaggccctgattgaatttgccagccagcacgtgtaccactgtgacctgtgcacccagaggggcttcatctgccagatctgccagcaccacgacatcatcttcccctttgaatttgacaccaccgtgcgctgtgccgagtgcaagacagtgttccaccagagctgccaggccgtggtgaagaagggctgcccccgctgtgcccggcggaggaagtaccaggagcagaacatctttgcctag

SEQ ID NO: 164397 - DNA, 3003 bp, Artificial Sequence
  Description of Artificial Sequence: Synthetic coding sequence
atggtggagtgctttgaaagtggcggcacccggctgagcctgagcagcttcaacgtgtcctgtgacagcctgcgggagcagctgcgggagtggcgctgcttccagtggtggaggatggactggaccccccggctgcccagccgccacatcatcagcgagctggagcacctgacctttgtgaacacagatgtgggccgctgccgggcctggctgcggctggccctgaatgatggcctgatggagtgctacctgaagctgctgctgcaggagcaggcccggctgcacgagtactaccagcccacagccctgctgagagatgctgaggagggggagttcctgctgtccttcctgcagggcctgaccagcctgagctttgagctgagctacaagagcgccatcctgaatgagtggaccctgacccccctggccctgagcggcctgtgccccctgtctgagctggaccccctgagcaccagcggggctgagctgcagaggaaggagagcctggacagcatcagccacagcagcggctctgaagatattgaggtgcaccacagcggccacaagatcagaagaaaccagaagctgacagccagcagcctgagcctggacacagccagcagcagccagctgagctgcagcctgaacagcgacagctgcctgctgcaggagaatggcagcaagagcccagaccactgtgaggagcccatgagctgtgacagcgacctgggcacagccaatgcagaagattctgacaggagcctgcaggaggtgctgctggagttcagcaaggcccaggtgaacagcgtgcccaccaacggcctgagccaggagacagagatccccaccccccaggccagcctgagcctgcacggcctgaacaccagcacctacctgcactgtgaggccccagctgagcccctgcctgcccaggccgccagcggcacccaggatggagtgcacgtgcaggagccccggccccaggcccccagccccctggacctgcagcagcctgtggagagcaccagcggccagcagcccagcagcacagtgtctgaaacagcccgggaggtgggccagggcaatggcctgcagaaggcccaggcccatgatggagctggcctgaagctggtggtgagcagccccaccagccccaagaacaagtcctggatcagtgaagatgacttctaccggcccagccgggagcagcccctggagagcgccagtgaccaccccatcgccagctaccggggcaccccaggcagccggcccggcctgcaccgccacttcagccaggagcccaggaagaactgcagcctgggcgccctggaccaggcctgtgtgcccagccctggaagacggcaggcccaggccgcccccagccagggccacaagagcttccgggtggtgcaccggcggcagatgggcctgagcaaccccttccggggcctgatgaagctgggcaccgtggagcggcggggggccatgggcatctggaaggagctgttctgtgagctgagccccctggagttccggctgtacctgagcaatgaggagcacacctgtgtggagaactgcagcctgctgcgctgtgagagcgtgggccctgcccacagtgatggccgctttgagctggtgttcagcggcaagaagctggccctgcgggccagcagccaggatgaagctgaggactggctggacagagtgcgggaggccctgcagaaggtgcggccccagcaggaggatgagtgggtgaatgtgcagtacccagaccagcctgaggagcccccagaggccccccagggctgcctgagccccagcgacctgctgtctgagcctgctgccctgcagggcacccagtttgactggagcagcgcccaggtgcctgagccagatgccatcaaggagagcctgctgtacctgtacatggacaggacctggatgccctacatcttcagcctgagcctggaggccctgaagtgcttccgcatcagaaataatgagaagatgctgagtgacagccatggagtggagaccatccgggacatcctgcctgacaccagcctgggcggccccagcttcttcaagatcatcacagccaaggctgtgctgaagctgcaggccggaaatgctgaggaggccgccctgtggagggacctggtgaggaaggtgctggccagctacctggagacagctgaggaggccgtgaccctgggcggcagcctggatgagaactgccaggaggtgctgaagtttgccacccgggagaatggcttcctgctgcagtacctggtggccatccccatggagaagggcctggacagccagggctgcttctgtgccggctgcagccggcagatcggcttctcctttgtgcggcccaagctgtgtgccttcagcggcctgtactactgtgacatctgccaccaggatgatgccagcgtcatcccagcccgcatcatccacaactgggacctgaccaagaggcccatctgccggcaggccctgaagttcctgacccagatccgggcccagcccctcatcaacctgcagatggtgaatgccagcctgtatgagcacgtggagaggatgcacctgattggaagaagaagagagcagctgaagctgctgggggactacctgggcctgtgccgcagcggggccctgaaggagctgagcaagaggctgaaccacaggaactacctgctggagagcccccaccgcttctctgtggccgacctgcagcagattgctgatggagtgtatgagggcttcagccccaaggtgcccagcgaggccgccggcctgcggccctggggcgcccggagccctgaggccgccagcgccttccgctgcatcgacagcagccggctgcccagcctgaggaaggtggtgcccaccctcttcctgaagtgctacttcatgcagtacacagtgcccagcgagcagggcagcggccctgaggagagcctgcagtgcatcgagggcattgctgctgtgtag

SEQ ID NO: 164398 - DNA, 5466 bp, Artificial Sequence
  Description of Artificial Sequence: Synthetic coding sequence
atgagctgtgagaggaagggcctgtctgagctgcggtctgagctgtacttcctgattgcccgcttcctggaggatggcccctgccagcaggccgcccaggtgctgatccgggaggtggccgagaaggagctgctgcccaggagaacagactggacaggcaaggagcaccccaggacctaccagaacctggtgaagtactaccgccacctggccccagaccacctgctgcagatctgccaccggctgggccccctgctggagcaggagatcccccagagcgtgcctggggtgcagaccctgctgggcgccggccggcagagcctgctgcggaccaacaagagctgcaagcacgtggtgtggaagggcagcgccctggccgccctgcactgcggccggcccccagagagccctgtgaactacggcagccccccatccattgctgacaccctcttcagcaggaagctgaatggcaagtaccgcctggagcggctggtgcccacagctgtgtaccagcacatgaagatgcacaagaggatcctgggccacctgagctctgtgtactgtgtgacctttgacagaacaggccgccgcatcttcaccggcagtgatgactgcctggtgaagatctgggccacagatgatggccgcctgctggccaccctgcggggccatgctgctgagatcagtgacatggctgtgaactatgagaacaccatgattgctgctggcagctgtgacaagatgatccgggtgtggtgcctgcggacctgtgcccccctggccgtgctgcagggccacagcgccagcatcaccagcctgcagttcagccccctgtgcagcggcagcaagcgctacctgagcagcactggagcagatggcaccatctgcttctggctgtgggatgctggcaccctgaagatcaaccccaggcctgccaagttcacagagcggcccaggcctggggtgcagatgatctgcagcagcttctctgctgggggcatgttcctggccaccggcagcacagaccacatcatccgggtgtacttcttcggcagcggccagcctgagaagatcagcgagctggagttccacacagacaaggtggacagcatccagttcagcaacaccagcaacagatttgtgtctggcagcagagatggaacagcccgcatctggcagttcaagaggcgggagtggaagagcatcctgctggacatggccaccaggcctgctggccagaacctgcagggcatcgaggacaagatcaccaagatgaaggtgaccatggtggcctgggacagacatgacaacacagtcatcacagctgtgaacaacatgaccctgaaggtgtggaacagctacacaggccagctgatccacgtgctgatgggccatgaagatgaggtgtttgtgctggagccccacccctttgacccccgggtgctcttctctgctggccatgatggaaatgtcatcgtgtgggacctggcccggggcgtgaagatccgcagctacttcaacatgattgagggccagggccacggggctgtgtttgactgcaagtgcagcccagatggccagcactttgcctgcacagacagccacggccacctgctgatctttggatttggcagcagcagcaaatatgacaagattgctgaccagatgttcttccacagcgactaccggcccctcatcagagatgccaacaactttgtgctggatgagcagacccagcaggccccccacctgatgcccccacccttcctggtggatgtggatggcaacccccaccccagccgctaccagaggctggtgcccggccgggagaactgccgggaggagcagctgatcccccagatgggcgtgaccagcagcggcctgaaccaggtgctgagccagcaggccaaccaggagatcagccccctggacagcatgatccagaggctgcagcaggagcaggacctgcggcgctctggagaggccgtcatcagcaacaccagccggctgagccggggcagcatcagcagcaccagcgaggtgcacagcccccccaacgtgggcctgcggcgcagcggccagattgaaggagtgcggcagatgcacagcaatgcccccaggtctgagatcgccacagagcgggacctggtggcctggagcagaagagtggtggtgcctgagctgtctgctggggtggccagccggcaggaggagtggaggacagccaagggggaggaggagatcaagacctacagaagtgaggagaagaggaagcacctgactgtgcccaaggagaacaagatccccaccgtgtccaagaaccacgcccacgagcacttcctggacctgggggagagcaagaagcagcagaccaaccagcacaactaccgcaccaggtctgccctggaggagaccccccggcccagcgaggagattgaaaatggcagcagcagcagtgatgaaggagaggtggtggccgtgtctgggggcaccagcgaggaggaggagcgggcctggcacagtgatggcagcagcagtgactacagcagtgactacagcgactggacagcagatgctggcatcaacctgcagccccccaagaaggtgcccaagaacaagaccaagaaggccgagagcagcagtgatgaggaggaggagagcgagaagcagaagcagaagcagatcaagaaggagaagaagaaggtgaatgaggagaaggatggccccatcagccccaagaagaagaagcccaaggagaggaagcagaagaggctggccgtgggggagctgacagaaaatggcctgaccctggaggagtggctgcccagcacctggatcacagacaccatcccccggcgctgcccctttgtgccccagatgggagatgaggtgtactacttccggcagggccacgaggcctacgtggagatggccaggaagaacaagatctacagcatcaaccccaagaagcagccctggcacaagatggagctgcgggagcaggagctgatgaagatcgtgggcatcaagtatgaggtgggcctgcccaccctgtgctgcctgaagctggccttcctggaccctgacaccgggaagctgaccggcggcagcttcaccatgaagtaccatgacatgccagatgtgattgacttcctggtgctgcggcagcagtttgatgatgccaagtaccgccgctggaacatcggggaccgcttccgctctgtgattgatgatgcctggtggtttggcaccatcgagagccaggagcccctgcagctggagtacccagacagcctcttccagtgctacaacgtgtgctgggacaatggagacacagagaagatgagcccctgggacatggagctgatccccaacaatgctgtgtttcctgaggagctgggcacctctgtgcccctgacagatggagaatgtcgcagcctcatctacaagcccctggatggagagtggggcaccaaccccagagatgaggagtgtgagcgcatcgtggccggcatcaaccagctgatgaccctggacatcgccagcgcctttgtggcccctgtggacctgcaggcctaccccatgtactgcaccgtggtggcctaccccacagacctgagcaccatcaagcagaggctggagaaccgcttctacagaagagtgagcagcctgatgtgggaggtgcgctacatcgagcacaacaccaggaccttcaatgaacctggcagccccatcgtgaagagcgccaagtttgtgacagacctgctgctgcacttcatcaaggaccagacctgctacaacatcatccccctgtacaacagcatgaagaagaaggtgctgagtgacagtgaagatgaggagaaggatgctgatgtgcccggcaccagcaccaggaagaggaaggaccaccagccccggcggcggctgaggaacagagcccagagctatgacatccaggcctggaagaagcagtgtgaggagctgctgaacctgatcttccagtgtgaggacagcgagcccttccggcagcctgtggacctgctggagtacccagactacagagacatcatcgacacccccatggactttgccaccgtgcgggagaccctggaggccggcaactatgagagccccatggagctgtgcaaggatgtgcggctcatcttcagcaacagcaaggcctacacccccagcaagaggagccgcatctacagcatgagcctgcggctgagcgccttctttgaggagcacatcagctctgtgctgagtgactacaagagcgccctgcgcttccacaagaggaacaccatcaccaagaggaggaagaagaggaacagaagcagctctgtgagcagcagcgctgccagcagccctgagaggaagaagaggatcctgaagccccagctgaagtctgagagcagcaccagcgccttcagcacccccaccaggagcatcccccccaggcacaatgctgcccagatcaatggcaagacagagagcagctctgtggtgaggaccaggagcaacagagtggtggtggaccctgtggtgacagagcagcccagcaccagcagcgctgccaagaccttcatcaccaaggccaatgccagcgccatccctgggaagaccatcctggagaacagcgtgaagcacagcaaggccctgaacaccctgagcagccctggccagagcagcttcagccacggcaccaggaacaacagcgccaaggagaacatggagaaggagaagcctgtgaagaggaagatgaagagctctgtgctgcccaaggccagcaccctgagcaagagcagcgctgtgattgagcagggcgactgcaagaacaatgccctggtgcccggcaccatccaggtgaatggacatggaggccagcccagcaagctggtgaagaggggccctggcaggaagcccaaggtggaggtgaacaccaacagcggggagatcatccacaagaagaggggcaggaagcccaagaagctgcagtatgccaagccagaggacctggagcagaacaacgtgcaccccatcagagatgaggtgctgcccagcagcacctgcaacttcctgtctgagaccaacaacgtgaaggaggacctgctgcagaagaagaacagaggaggcaggaagcccaagaggaagatgaagacccagaagctggatgctgacctgctggtgcctgcctctgtgaaggtgctgcggcgcagcaacaggaagaagattgatgaccccattgatgaggaggaggagtttgaggagctgaagggcagcgagccccacatgaggaccaggaaccagggcagaagaacagccttctacaatgaagatgattctgaggaggagcagaggcagctgctgtttgaggacaccagcctgaccttcggcaccagcagccggggccgggtgaggaagctgacagagaaggccaaggccaacctgattggctggtag

SEQ ID NO: 164399 - DNA, 1197 bp, Artificial Sequence
  Description of Artificial Sequence: Synthetic coding sequence
atgaagaagaaggtgctgagtgacagtgaagatgaggagaaggatgctgatgtgcccggcaccagcaccaggaagaggaaggaccaccagccccggcggcggctgaggaacagagcccagagctatgacatccaggcctggaagaagcagtgtgaggagctgctgaacctgatcttccagtgtgaggacagcgagcccttccggcagcctgtggacctgctggagtacccagactacagagacatcatcgacacccccatggactttgccaccgtgcgggagaccctggaggccggcaactatgagagccccatggagctgtgcaaggatgtgcggctcatcttcagcaacagcaaggcctacacccccagcaagaggagccgcatctacagcatgagcctgcggctgagcgccttctttgaggagcacatcagctctgtgctgagtgactacaagagcgccctgcgcttccacaagaggaacaccatcaccaagaggaggaagaagaggaacagaagcagctctgtgagcagcagcgctgccagcagccctgagaggaagaagaggatcctgaagccccagctgaagtctgagagcagcaccagcgccttcagcacccccaccaggagcatcccccccaggcacaatgctgcccagatcaatggcaagacagagagcagctctgtggtgaggaccaggagcaacagagtggtggtggaccctgtggtgacagagcagcccagcaccagcagcgctgccaagaccttcatcaccaaggccaatgccagcgccatccctgggaagaccatcctggagaacagcgtgaagcacagcaaggccctgaacaccctgagcagccctggccagagcagcttcagccacggcaccaggaacaacagcgccaaggagaacatggagaaggagaagcctgtgaagaggaagatgaagagctctgtgctgcccaaggccagcaccctgagcaagagcagcgctgtgattgagcagggcgactgcaagaacaatgccctggtgcccggcaccatccaggtgaatggacatggaggccagcccagcaagctggtgaagaggggccctggcaggaagcccaaggtggaggtgaacatcgtggtgaagctgtacaccaggaaaggagtggagagccccaagagctacagcatgcagagccagaagatctag

SEQ ID NO: 164400 - DNA, 1206 bp, Artificial Sequence
  Description of Artificial Sequence: Synthetic coding sequence
atgaggcgggccccagctgctgagcggctgctggagctgggcttccccccaagatgtggccggcaggagccccccttccccctgggcgtgacccggggctggggccgctggcccatccagaagaggcgggagggcgcccggcctgtgcccttcagcgagaggagccaggaggatggccggggccctgctgcccggagcagcggcaccctgtggaggatccgcacccggctgagcctgtgccgggaccctgagcccccaccacccctgtgcctgctgcgggtgtccctgctgtgtgccctgcgggccggcggccggggcagccgctggggagaagatggagcccggctgctgctgctgcccccagcccgggctgctggaaatggagaggccgagcccagcggcggccccagctatgccggccgcatgctggagagcagcggctgcaaggccctgaaggagggcgtgctggagaagagaagtgatggcctgctgcagctgtggaagaagaagtgctgcatcctgacagaggagggcctgctgctgatcccccccaagcagctgcagcaccagcagcagcagcagcagcagcagcagcagcagcagcagcagcagcccggccagggccctgctgagcccagccagcccagcggccctgctgtggccagcctggagccccctgtgaagctgaaggagctgcacttcagcaacatgaagacagtggactgtgtggagaggaagggcaagtacatgtacttcaccgtggtgatggccgagggcaaggagattgacttccgctgcccccaggaccagggctggaatgctgagatcaccctgcagatggtgcagtacaagaaccggcaggccatcctggccgtgaagagcacccggcagaagcagcagcacctggtgcagcagcagccccccagccagccccagccccagccccagctgcagccccagccccagccccagccccagccccagccccagccccagagccagccccagccccagccccagcccaagccccagccccagcagctgcacccctacccccacccccacccccacccccacagccacccccacagccacccccacccccacccccacccccacccccaccagatcccccacccccacccccagccccacagccagccccacggccaccggctgctgcggagcaccagcaacagcgcctag

SEQ ID NO: 164401 - DNA, 660 bp, Artificial Sequence
  Description of Artificial Sequence: Synthetic coding sequence
atgctggagagcagcggctgcaaggccctgaaggagggcgtgctggagaagagaagtgatggcctgctgcagctgtggaagaagaagtgctgcatcctgacagaggagggcctgctgctgatcccccccaagcagctgcagcaccagcagcagcagcagcagcagcagcagcagcagcagcagcagcagcccggccagggccctgctgagcccagccagcccagcggccctgctgtggccagcctggagccccctgtgaagctgaaggagctgcacttcagcaacatgaagacagtggactgtgtggagaggaagggcaagtacatgtacttcaccgtggtgatggccgagggcaaggagattgacttccgctgcccccaggaccagggctggaatgctgagatcaccctgcagatggtgcagtacaagaaccggcaggccatcctggccgtgaagagcacccggcagaagcagcagcacctggtgcagcagcagctgcacccctacccccacccccacccccacccccacagccacccccacagccacccccacccccacccccacccccacccccaccagatcccccacccccacccccagccccacagccagccccacggccaccggctgctgcggagcaccagcaacagcgcctag

SEQ ID NO: 164402 - DNA, 459 bp, Artificial Sequence
  Description of Artificial Sequence: Synthetic coding sequence
atgaagagcccagatgaggtgctgcgggagggggagctggagaagagaagtgacagcctcttccagctgtggaagaagaagaggggcgtgctgaccagtgaccggctgagcctcttccctgccagcccccgggcccggcccaaggagctgcgcttccacagcatcctgaaggtggactgtgtggagaggacaggcaagtatgtgtacttcaccatcgtgaccacagaccacaaggagattgacttccgctgtgccggggagagctgctggaatgctgccatcgccctggccctgattgacttccagaacagaagagccctgcaggacttccgcagccggcaggagaggacagccccagctgccccagcagaagatgctgtggccgctgctgctgctgcccccagcgagcccagcgagcccagccggcccagcccccagcccaagcccaggaccccctag

SEQ ID NO: 164403 - DNA, 3960 bp, Artificial Sequence
  Description of Artificial Sequence: Synthetic coding sequence
atggatgccctgaacagaaaccagatcggccctggctgccagacccagaccatggtgcagaagggccccctggacctgattgaaacaggcaagggcctgaaggtgcagacagacaagccccacctggtgtccctgggcagcggccgcctgagcacagccatcaccctgctgcccctggaggagggccgcaccgtcatcggcagcgctgcccgggacatcagcctgcagggccctggcctggcccctgagcactgctacatcgagaacctgcggggcaccctgaccctgtacccctgtggaaatgcctgcaccattgatggcctgcctgtgcggcagcccacccggctgacccagggctgcatgctgtgcctgggccagagcaccttcctgcgcttcaaccaccctgctgaggccaagtggatgaagtccatgatcccagctgggggccgggcccctggccccccctacagccctgtgcctgctgagagcgagagcctggtgaatggaaaccacaccccccagacagccacccggggccccagcgcctgtgccagccacagcagcctggtgagcagcattgagaaggacctgcaggagatcatggacagcctggtgctggaggagcctggagctgctgggaagaagccagctgccaccagccccctgagccccatggccaatggaggccgctacctgctgagcccccccaccagccctggggccatgtctgtgggcagcagctatgagaacaccagccctgccttcagccccctgagcagccctgccagcagcggcagctgtgccagccacagccccagcggccaggagcccggccccagcgtgccccccctggtgcctgcccggagcagcagctaccacctggccctgcagcccccccagagccggcccagcggggcccggtctgagagcccccggctgagcaggaagggcggccacgagcggccccccagccctggcctgcggggcctgctgacagacagccctgctgccaccgtgctggccgaggcccggcgggccacagagagcccccggctgggcggccagctgcctgtggtggccatcagcctgtctgagtacccagccagcggggccctgagccagcccaccagcatccctggcagccccaagttccagccccctgtgcctgcccccaggaacaagattggcaccctgcaggaccggccccccagccccttccgggagcccccaggcagcgagcgggtgctgaccaccagccccagccggcagctggtgggccgcaccttcagtgatggcctggccaccaggaccctgcagcccccagagagcccccggctgggccggcggggcctggacagcatgagggagctgccccccctgagccccagcctgagccggcgggccctgagccccctgcccaccaggaccaccccagaccccaagctgaaccgggaggtggccgagagcccccggccccggcgctgggccgcccacggggccagccctgaggacttcagcctgaccctgggcgcccggggccgccgcaccaggagccccagccccaccctgggggagagcctggccccccacaagggcagcttcagcggccgcctgagccctgcctacagcctgggcagcctgaccggggccagcccctgccagagcccctgtgtgcagaggaagctgagcagcggggacctgcgggtgcctgtgacccgggagaggaagaacagcatcacagagatcagtgacaatgaagatgacctgctggagtaccaccggcggcagaggcaggagcggctgcgggagcaggagatggagcggctggagcggcagaggctggagaccatcctgaacctgtgtgccgagtacagcagagcagatggcggccctgaggccggggagctgcccagcattggagaggccacagctgccctggccctggccggcagaagacccagccggggcctggccggggccagcggccgcagcagcgaggagcccggggtggccacccagaggctgtgggagagcatggagaggagtgatgaggagaacctgaaggaggagtgcagcagcacagagagcacccagcaggagcatgaagatgcccccagcaccaagctgcagggcgaggtgctggccctggaggaggagcgggcccaggtgctgggccacgtggagcagctgaaggtgcgggtgaaggagctggagcagcagctgcaggagagcgcccgggaggccgagatggagcgggccctgctgcagggcgagcgggaggccgagcgggccctgctgcagaaggagcagaaggctgtggaccagctgcaggagaagctggtggccctggagaccggcatccagaaggagcgggacaaggaggccgaggccctggagacagagaccaagctgtttgaggacctggagttccagcagctggagcgggagagccgggtggaggaggagcgggagctggccggccagggcctgctgcggagcaaggccgagctgctgcggagcatcgccaagaggaaggagcggctggccatcctggacagccaggccggccagatccgggcccaggccgtgcaggagagcgagcggctggcccgggacaagaatgccagcctgcagctgctgcagaaggagaaggagaagctgactgtgctggagcggcgctaccacagcctgaccggcggccggcccttccccaagaccaccagcaccctgaaggaggtgtaccgcagcaagatggatggagaggccaccagccccctgcccaggaccaggagcggccccctgcccagcagcagcggcagcagcagcagcagcagccagctgtctgtggccaccctgggccgcagccccagccccaagagcgccctgctgacccagaatggcaccggcagcctgcccaggaacctggccgccaccctgcaggacatcgagaccaagaggcagctggccctgcagcagaagggccagcaggtgattgaggagcagaggcggcggctggccgagctgaagcagaaggctgctgctgaggcccagtgccagtgggatgccctgcacggggccgcccccttccctgctggccccagcggcttcccccccctgatgcaccacagcatcctgcaccacctgcctgctggccgggagcggggggaggagggggagcacgcctatgacaccctgagcctggagagcagtgacagcatggagaccagcatcagcactggaggcaacagcgcctgcagcccagacaacatgagcagcgccagcggcctggacatgggcaagattgaggagatggagaagatgctgaaggaggcccatgctgagaagaaccggctgatggagagccgggagcgggagatggagctgcggcggcaggccctggaggaggagaggagaagaagagagcaggtggagcggcggctgcagagcgagagcgcccggcggcagcagctggtggagaaggaggtgaagatgagggagaagcagttcagccaggcccggcccctgacccgctacctgcccatcaggaaggaggactttgacctgaagacccacatcgagagcagcggccatggagtggacacctgcctgcacgtggtgctgagcagcaaggtgtgccggggctacctggtgaagatgggcggcaagatcaagtcctggaagaagcgctggtttgtgtttgaccggctgaagaggaccctgagctactacgtggacaagcatgagaccaagctgaagggcgtcatctacttccaggccatcgaggaggtgtactatgaccacctgcggtctgctgccaagagccccaacccagccctgaccttctgtgtgaagacccatgaccggctgtactacatggtggcccccagcgctgaggccatgaggatctggatggatgtgattgtgactggagctgagggctacacccagttcatgaactag

SEQ ID NO: 164404 - DNA, 2193 bp, Artificial Sequence
  Description of Artificial Sequence: Synthetic coding sequence
atggagaggagtgatgaggagaacctgaaggaggagtgcagcagcacagagagcacccagcaggagcatgaagatgcccccagcaccaagctgcagggcgaggtgctggccctggaggaggagcgggcccaggtgctgggccacgtggagcagctgaaggtgcgggtgaaggagctggagcagcagctgcaggagagcgcccgggaggccgagatggagcgggccctgctgcagggcgagcgggaggccgagcgggccctgctgcagaaggagcagaaggctgtggaccagctgcaggagaagctggtggccctggagaccggcatccagaaggagcgggacaaggagcgggcagagctggccgccggccgccgccacctggcccggcaggccctgtatgcagagctgcagacccagctggacaactgcccagagagcgtgcgggagcagctgcaggagcagctgcggcgggaggccgaggccctggagacagagaccaagctgtttgaggacctggagttccagcagctggagcgggagagccgggtggaggaggagcgggagctggccggccagggcctgctgcggagcaaggccgagctgctgcggagcatcgccaagaggaaggagcggctggccatcctggacagccaggccggccagatccgggcccaggccgtgcaggagagcgagcggctggcccgggacaagaatgccagcctgcagctgctgcagaaggagaaggagaagctgactgtgctggagcggcgctaccacagcctgaccggcggccggcccttccccaagaccaccagcaccctgaaggagatggagaagctgctgctgcctgctgtggacctggagcagtggtaccaggagctgatggccggcctgggcaccggccctgctgctgccagcccccacagcagccccccacccctgcctgccaaggccagccggcagctgcaggtgtaccgcagcaagatggatggagaggccaccagccccctgcccaggaccaggagcggccccctgcccagcagcagcggcagcagcagcagcagcagccagctgtctgtggccaccctgggccgcagccccagccccaagagcgccctgctgacccagaatggaacaggcagcctgcccaggaacctggccgccaccctgcaggacatcgagaccaagaggcagctggccctgcagcagaagggccagcaggtgattgaggagcagaggcggcggctggccgagctgaagcagaaggctgctgctgaggcccagtgccagtgggatgccctgcatggagctgcccccttccctgctggccccagcggcttcccccccctgatgcaccacagcatcctgcaccacctgcctgctggccgggagcggggggaggagggggagcacgcctatgacaccctgagcctggagagcagtgacagcatggagaccagcatcagcactggaggcaacagcgcctgcagcccagacaacatgagcagcgccagcggcctggacatgggcaagattgaggagatggagaagatgctgaaggaggcccacgccgagaagaaccggctgatggagagccgggagcgggagatggagctgcggcggcaggccctggaggaggagaggagaagaagagagcaggtggagcggcggctgcagagcgagagcgcccggcggcagcagctggtggagaaggaggtgaagatgagggagaagcagttcagccaggcccggcccctgacccgctacctgcccatcagaaaagaagattttgacctgaagacccacatcgagagcagcggccacggcgtggacacctgcctgcacgtggtgctgagcagcaaggtgtgccggggctacctggtgaagatgggcggcaagatcaagtcctggaagaagcgctggtttgtgtttgaccggctgaagaggaccctgagctactacgtggacaagcatgagaccaagctgaagggcgtcatctacttccaggccatcgaggaggtgtactatgaccacctgcggtctgctgccaagagccccaacccagccctgaccttctgtgtgaagacccatgaccggctgtactacatggtggcccccagcgctgaggccatgaggatctggatggatgtgattgtgactggagctgagggctacacccagttcatgaactag

SEQ ID NO: 164405 - DNA, 4134 bp, Artificial Sequence
  Description of Artificial Sequence: Synthetic coding sequence
atggatgccctgaacagaaaccagatcggccctggctgccagacccagaccatggtgcagaagggccccctggacctgattgaaacaggcaagggcctgaaggtgcagacagacaagccccacctggtgtccctgggcagcggccgcctgagcacagccatcaccctgctgcccctggaggagggccgcaccgtcatcggcagcgctgcccgggacatcagcctgcagggccctggcctggcccctgagcactgctacatcgagaacctgcggggcaccctgaccctgtacccctgtggaaatgcctgcaccattgatggcctgcctgtgcggcagcccacccggctgacccagggctgcatgctgtgcctgggccagagcaccttcctgcgcttcaaccaccctgctgaggccaagtggatgaagtccatgatcccagctgggggccgggcccctggccccccctacagccctgtgcctgctgagagcgagagcctggtgaatggaaaccacaccccccagacagccacccggggccccagcgcctgtgccagccacagcagcctggtgagcagcattgagaaggacctgcaggagatcatggacagcctggtgctggaggagcctggagctgctgggaagaagccagctgccaccagccccctgagccccatggccaatggaggccgctacctgctgagcccccccaccagccctggggccatgtctgtgggcagcagctatgagaacaccagccctgccttcagccccctgagcagccctgccagcagcggcagctgtgccagccacagccccagcggccaggagcccggccccagcgtgccccccctggtgcctgcccggagcagcagctaccacctggccctgcagcccccccagagccggcccagcggggcccggtctgagagcccccggctgagcaggaagggcggccacgagcggccccccagccctggcctgcggggcctgctgacagacagccctgctgccaccgtgctggccgaggcccggcgggccacagagagcccccggctgggcggccagctgcctgtggtggccatcagcctgtctgagtacccagccagcggggccctgagccagcccaccagcatccctggcagccccaagttccagccccctgtgcctgcccccaggaacaagattggcaccctgcaggaccggccccccagccccttccgggagcccccaggcagcgagcgggtgctgaccaccagccccagccggcagctggtgggccgcaccttcagtgatggcctggccaccaggaccctgcagcccccagagagcccccggctgggccggcggggcctggacagcatgagggagctgccccccctgagccccagcctgagccggcgggccctgagccccctgcccaccaggaccaccccagaccccaagctgaaccgggaggtggccgagagcccccggccccggcgctgggccgcccacggggccagccctgaggacttcagcctgaccctgggcgcccggggccgccgcaccaggagccccagccccaccctgggggagagcctggccccccacaagggcagcttcagcggccgcctgagccctgcctacagcctgggcagcctgaccggggccagcccctgccagagcccctgtgtgcagaggaagctgagcagcggggacctgcgggtgcctgtgacccgggagaggaagaacagcatcacagagatcagtgacaatgaagatgacctgctggagtaccaccggcggcagaggcaggagcggctgcgggagcaggagatggagcggctggagcggcagaggctggagaccatcctgaacctgtgtgccgagtacagcagagcagatggcggccctgaggccggggagctgcccagcattggagaggccacagctgccctggccctggccggcagaagacccagccggggcctggccggggccagcggccgcagcagcgaggagcccggggtggccacccagaggctgtgggagagcatggagaggagtgatgaggagaacctgaaggaggagtgcagcagcacagagagcacccagcaggagcatgaagatgcccccagcaccaagctgcagggcgaggtgctggccctggaggaggagcgggcccaggtgctgggccacgtggagcagctgaaggtgcgggtgaaggagctggagcagcagctgcaggagagcgcccgggaggccgagatggagcgggccctgctgcagggcgagcgggaggccgagcgggccctgctgcagaaggagcagaaggctgtggaccagctgcaggagaagctggtggccctggagaccggcatccagaaggagcgggacaaggaggccgaggccctggagacagagaccaagctgtttgaggacctggagttccagcagctggagcgggagagccgggtggaggaggagcgggagctggccggccagggcctgctgcggagcaaggccgagctgctgcggagcatcgccaagaggaaggagcggctggccatcctggacagccaggccggccagatccgggcccaggccgtgcaggagagcgagcggctggcccgggacaagaatgccagcctgcagctgctgcagaaggagaaggagaagctgactgtgctggagcggcgctaccacagcctgaccggcggccggcccttccccaagaccaccagcaccctgaaggagatggagaagctgctgctgcctgctgtggacctggagcagtggtaccaggagctgatggccggcctgggcaccggccctgctgctgccagcccccacagcagccccccacccctgcctgccaaggccagccggcagctgcaggtgtaccgcagcaagatggatggagaggccaccagccccctgcccaggaccaggagcggccccctgcccagcagcagcggcagcagcagcagcagcagccagctgtctgtggccaccctgggccgcagccccagccccaagagcgccctgctgacccagaatggaacaggcagcctgcccaggaacctggccgccaccctgcaggacatcgagaccaagaggcagctggccctgcagcagaagggccagcaggtgattgaggagcagaggcggcggctggccgagctgaagcagaaggctgctgctgaggcccagtgccagtgggatgccctgcatggagctgcccccttccctgctggccccagcggcttcccccccctgatgcaccacagcatcctgcaccacctgcctgctggccgggagcggggggaggagggggagcacgcctatgacaccctgagcctggagagcagtgacagcatggagaccagcatcagcactggaggcaacagcgcctgcagcccagacaacatgagcagcgccagcggcctggacatgggcaagattgaggagatggagaagatgctgaaggaggcccacgccgagaagaaccggctgatggagagccgggagcgggagatggagctgcggcggcaggccctggaggaggagaggagaagaagagagcaggtggagcggcggctgcagagcgagagcgcccggcggcagcagctggtggagaaggaggtgaagatgagggagaagcagttcagccaggcccggcccctgacccgctacctgcccatcagaaaagaagattttgacctgaagacccacatcgagagcagcggccacggcgtggacacctgcctgcacgtggtgctgagcagcaaggtgtgccggggctacctggtgaagatgggcggcaagatcaagtcctggaagaagcgctggtttgtgtttgaccggctgaagaggaccctgagctactacgtggacaagcatgagaccaagctgaagggcgtcatctacttccaggccatcgaggaggtgtactatgaccacctgcggtctgctgccaagaagcgcttcttccgcttcaccatggtgacagagagccccaacccagccctgaccttctgtgtgaagacccatgaccggctgtactacatggtggcccccagcgctgaggccatgaggatctggatggatgtgattgtgactggagctgagggctacacccagttcatgaactag

SEQ ID NO: 164406 - DNA, 3423 bp, Artificial Sequence
  Description of Artificial Sequence: Synthetic coding sequence
atgtctgtgggcagcagctatgagaacaccagccctgccttcagccccctgagcagccctgccagcagcggcagctgtgccagccacagccccagcggccaggagcccggccccagcgtgccccccctggtgcctgcccggagcagcagctaccacctggccctgcagcccccccagagccggcccagcggggcccggtctgagagcccccggctgagcaggaaaggaggccacgagaggcctcccagccctggcctgcggggcctgctgacagacagccctgctgccaccgtgctggccgaggcccggcgggccacagagagcccccggctgggcggccagctgcctgtggtggccatcagcctgtctgagtacccagccagcggggccctgagccagcccaccagcatccctggcagccccaagttccagccccctgtgcctgcccccaggaacaagattggcaccctgcaggacaggcctcccagccccttccgggagcccccaggcagcgagcgggtgctgaccaccagccccagccggcagctggtgggccgcaccttcagtgatggcctggccaccaggaccctgcagcccccagagagcccccggctgggcagaagaggcctggacagcatgagggagctgccccccctgagccccagcctgagcagaagagccctgagccccctgcccaccaggaccaccccagaccccaagctgaaccgggaggtggccgagagcccccggccccggcgctgggccgcccatggagccagccctgaggacttcagcctgaccctgggcgcccggggccgccgcaccaggagccccagccccaccctgggggagagcctggccccccacaagggcagcttcagcggccgcctgagccctgcctacagcctgggcagcctgactggagccagcccctgccagagcccctgtgtgcagaggaagctgagcagcggggacctgcgggtgcctgtgacccgggagaggaagaacagcatcacagagatcagtgacaatgaagatgacctgctggagtaccaccggcggcagaggcaggagcggctgcgggagcaggagatggagcggctggagcggcagaggctggagaccatcctgaacctgtgtgccgagtacagcagagcagatggcggccctgaggccggggagctgcccagcatcggggaggccacagctgccctggccctggccggccggcggcccagccggggcctggccggggccagcggccgcagcagcgaggagcccggggtggccacccagaggctgtgggagagcatggagaggagtgatgaggagaacctgaaggaggagtgcagcagcacagagagcacccagcaggagcatgaagatgcccccagcaccaagctgcagggcgaggtgctggccctggaggaggagcgggcccaggtgctgggccacgtggagcagctgaaggtgcgggtgaaggagctggagcagcagctgcaggagagcgcccgggaggccgagatggagcgggccctgctgcagggcgagcgggaggccgagcgggccctgctgcagaaggagcagaaggctgtggaccagctgcaggagaagctggtggccctggagaccggcatccagaaggagcgggacaaggaggccgaggccctggagacagagaccaagctgtttgaggacctggagttccagcagctggagcgggagagccgggtggaggaggagcgggagctggccggccagggcctgctgcggagcaaggccgagctgctgcggagcatcgccaagaggaaggagcggctggccatcctggacagccaggccggccagatccgggcccaggccgtgcaggagagcgagcggctggcccgggacaagaatgccagcctgcagctgctgcagaaggagaaggagaagctgactgtgctggagcggcgctaccacagcctgactggaggccggcccttccccaagaccaccagcaccctgaaggagatggagaagctgctgctgcctgctgtggacctggagcagtggtaccaggagctgatggccggcctgggcactggacctgctgctgccagcccccacagcagccccccacccctgcctgccaaggccagccggcagctgcaggtgtaccgcagcaagatggatggagaggccaccagccccctgcccaggaccaggagcggccccctgcccagcagcagcggcagcagcagcagcagcagccagctgtctgtggccaccctgggccgcagccccagccccaagagcgccctgctgacccagaatggcaccggcagcctgcccaggaacctggccgccaccctgcaggacatcgagaccaagaggcagctggccctgcagcagaaggtggagagcctgcctgctgagcccctgcccacagatgatcctgctggccagcaggtgattgaggagcagaggcggcggctggccgagctgaagcagaaggctgctgctgaggcccagtgccagtgggatgccctgcatggagctgcccccttccctgctggccccagcggcttcccccccctgatgcaccacagcatcctgcaccacctgcctgctggccgggagcggggggaggagggggagcacgcctatgacaccctgagcctggagagcagtgacagcatggagaccagcatcagcactggaggcaacagcgcctgcagcccagacaacatgagcagcgccagcggcctggacatgggcaagattgaggagatggagaagatgctgaaggaggcccacgccgagaagaaccggctgatggagagccgggagcgggagatggagctgcggcggcaggccctggaggaggagaggagaagaagagagcaggtggagcggcggctgcagagcgagagcgcccggcggcagcagctggtggagaaggaggtgaagatgagggagaagcagttcagccaggcccggcccctgacccgctacctgcccatcagaaaagaagattttgacctgaagacccacatcgagagcagcggccacggcgtggacacctgcctgcacgtggtgctgagcagcaaggtgtgccggggctacctggtgaagatgggcggcaagatcaagtcctggaagaagcgctggtttgtgtttgaccggctgaagaggaccctgagctactacgtggacaagcatgagaccaagctgaagggcgtcatctacttccaggccatcgaggaggtgtactatgaccacctgcggtctgctgccaagagccccaacccagccctgaccttctgtgtgaagacccatgaccggctgtactacatggtggcccccagcgctgaggccatgaggatctggatggatgtgattgtgactggagctgagggctacacccagttcatgaactag

SEQ ID NO: 164407 - DNA, 306 bp, Artificial Sequence
  Description of Artificial Sequence: Synthetic coding sequence
atgggcggcaagatcaagtcctggaagaagcgctggtttgtgtttgaccggctgaagaggaccctgagctactacgtggacaagcatgagaccaagctgaagggcgtcatctacttccaggccatcgaggaggtgtactatgaccacctgcggtctgctgccaagagccccaacccagccctgaccttctgtgtgaagacccatgaccggctgtactacatggtggcccccagcgctgaggccatgaggatctggatggatgtgattgtgactggagctgagggctacacccagttcatgaactag

SEQ ID NO: 164408 - DNA, 1119 bp, Artificial Sequence
  Description of Artificial Sequence: Synthetic coding sequence
atggatgccctgaacagaaaccagatcggccctggctgccagacccagaccatggtgcagaagggccccctggacctgattgaaacaggcaagggcctgaaggtgcagacagacaagccccacctggtgtccctgggcagcggccgcctgagcacagccatcaccctgctgcccctggaggagggccgcaccgtcatcggcagcgctgcccgggacatcagcctgcagggccctggcctggcccctgagcactgctacatcgagaacctgcggggcaccctgaccctgtacccctgtggaaatgcctgcaccattgatggcctgcctgtgcggcagcccacccggctgacccagggctgcatgctgtgcctgggccagagcaccttcctgcgcttcaaccaccctgctgaggccaagtggatgaagtccatgatcccagctgggggccgggcccctggccccccctacagccctgtgcctgagagcgagagcctggtgaatggaaaccacaccccccagacagccacccggggccccagcgcctgtgccagccacagcagcctggtgagcagcattgagaaggacctgcaggagatcatggacagcctggtgctggaggagcccggggctgctgggaagaagccagctgccaccagccccctgagccccatggccaacggcggccgctacctgctgagcccccccaccagccctggggccatgtctgtgggcagcagctatgagaacaccagccctgccttcagccccctgagcagccctgccagcagcggcagctgtgccagccacagccccagcggccaggagcccggccccagcgtgccccccctggtgcctgcccggagcagcagctaccacctggccctgcagcccccccagagccggcccagcggggcccggtctgagagcccccggctgagcaggaaaggaggccacgagaggcctcccagccctggcctgcggggcctgctgacagacagccctgctgccaccgtgctggccgaggcccggcgggccacagagagcccccggctgggcggccagctgcctgtggtggccatcagcctgtctgagtacccagctgcccggcgctgcacctag

SEQ ID NO: 164409 - DNA, 744 bp, Artificial Sequence
  Description of Artificial Sequence: Synthetic coding sequence
atggatgccctgaacagaaaccagatcggccctggctgccagacccagaccatggtgcagaagggccccctggacctgattgaaacaggcaagggcctgaaggtgcagacagacaagccccacctggtgtccctgggcagcggccgcctgagcacagccatcaccctgctgcccctggaggagggccgcaccgtcatcggcagcgctgcccgggacatcagcctgcagggccctggcctggcccctgagcactgctacatcgagaacctgcggggcaccctgaccctgtacccctgtggaaatgcctgcaccattgatggcctgcctgtgcggcagcccacccggctgacccagggctgcatgctgtgcctgggccagagcaccttcctgcgcttcaaccaccctgctgaggccaagtggatgaagtccatgatcccagctgggggccgggcccctggccccccctacagccctgtgcctgctgagagcgagagcctggtgaatggaaaccacaccccccagacagccacccggggccccagcgcctgtgccagccacagcagcctggtgagcagcattgagaaggacctgcaggagatcatggacagcctggtgctggaggagcctggagctgctgggaagaagccagctgccaccagccccctgagccccatggccaatggaggccgctacctgctgagcccccccaccagccctggccacgtgtgtggcctgcagctgtag

SEQ ID NO: 164410 - DNA, 14055 bp, Artificial Sequence
  Description of Artificial Sequence: Synthetic coding sequence
atggtggccggcatgctgatgccccgggaccagctgcgggccatctatgaggtgctcttccgggagggcgtgatggtggccaagaaggacagaagacccaggagcctgcacccccacgtgcctggggtgaccaacctgcaggtgatgagggccatggccagcctgcgggcccggggcctggtgcgggagacctttgcctggtgccacttctactggtacctgaccaatgaaggaattgcccacctgcggcagtacctgcacctgcccccagagatcgtgcctgccagcctgcagagggtgagaagacctgtggccatggtgatgcctgcccggaggacccctcatgtgcaggccgtgcagggccccctgggcagcccccccaagaggggccccctgcccacagaggagcagagggtgtacagaaggaaggagctggaggaggtgtccccagagacccctgtggtgcctgccaccacccagaggaccctggcccggcccggccctgagcccgccccagccacagatgagcgggacagagtgcagaagaagaccttcaccaagtgggtgaacaagcacctgatcaaggcccagaggcacatcagtgacctgtatgaggacctgagagatggccacaacctgatcagcctgctggaggtgctgagcggggacagcctgccccgggagaagggccgcatgaggttccacaagctgcagaatgtgcagatcgccctggactacctgcggcaccggcaggtgaagctggtgaacatcagaaatgatgacattgctgatggcaaccccaagctgaccctgggcctcatctggaccatcatcctgcacttccagatcagtgacatccaggtgtctggccagagcgaggacatgacagccaaggagaagctgctgctgtggagccagaggatggtggagggctaccagggcctgcgctgtgacaacttcaccagctcctggagagatggccgcctcttcaatgccatcatccaccgccacaagcccctgctgattgacatgaacaaggtgtaccggcagaccaacctggagaacctggaccaggccttctctgtggccgagcgggacctgggcgtgacccggctgctggaccctgaagatgtggatgtgccccagccagatgagaagagcatcatcacctacgtgagcagcctgtatgatgccatgccccgggtgcctgatgtgcaggatggagtgcgggccaatgagctgcagctgcgctggcaggagtaccgggagctggtgctgctgctgctgcagtggatgaggcaccacacagctgcctttgaggagcggcgcttccccagcagctttgaggagattgagatcctgtggagccagttcctgaagttcaaggagatggagctgcctgccaaggaggccgacaagaacagaagcaagggcatctaccagagcctggagggcgctgtgcaggccggccagctgaaggtgcccccaggctaccaccccctggatgtggagaaggagtggggcaagctgcacgtggccatcctggagcgggagaagcagctgcggagtgaatttgagcggctggagtgcctgcagagaattgtgaccaagctgcagatggaggccggcctgtgtgaggagcagctgaaccaggctgatgccctgctgcagagtgatgtgcggctgctggccgccggcaaggtgccccagagagctggggaggtggagcgggacctggacaaggctgacagcatgatccggctgctcttcaatgatgtgcagaccctgaaggatggccgccacccccagggcgagcagatgtacagaagagtgtaccgcctgcacgagcggctggtggccatcagaacagagtacaacctgcggctgaaggccggcgtggccgccccagccacccaggtggcccaggtgaccctgcagagcgtgcagaggaggcctgagctggaggacagcaccctgcgctacctgcaggacctgctggcctgggtggaggagaaccagcaccgggtggatggagctgagtggggcgtggacctgcccagcgtggaggcccagctgggcagccaccggggcctgcaccagagcattgaggagttccgggccaagattgagcgggcccggagtgatgagggccagctgagccctgccaccaggggggcctacagagactgcctgggccgcctggacctgcagtatgccaagctgctgaacagcagcaaggcccggctgcggagcctggagagcctgcacagctttgtggccgccgccaccaaggagctgatgtggctgaatgagaaggaggaggaggaggtgggctttgactggagcgacaggaacaccaacatgacagccaagaaggagagctacagcgccctgatgagggagctggagctgaaggagaagaagatcaaggagctgcagaatgctggggaccggctgctgcgggaggaccacccagcccggcccaccgtggagagcttccaggccgccctgcagacccagtggagctggatgctgcagctgtgctgctgcatcgaggcccacctgaaggaaaatgctgcctacttccagttcttcagtgatgtgcgggaggccgagggccagctgcagaagctgcaggaggccctgcggaggaagtacagctgtgacagaagtgccaccgtgacccggctggaggacctgctgcaggatgcccaggatgagaaggagcagctgaatgagtacaagggccacctgagcggcctggccaagagggccaaggctgtggtgcagctgaagcccaggcacccagcccaccccatgaggggccgcctgcccctgctggccgtgtgtgactacaagcaggtggaggtgacagtgcacaagggagatgagtgccagctggtgggccctgcccagcccagccactggaaggtgctgagcagcagcggcagcgaggccgctgtgcccagcgtgtgcttcctggtgcccccacccaaccaggaggcccaggaggccgtgacccggctggaggcccagcaccaggccctggtgaccctgtggcaccagctgcacgtggacatgaagagcctgctggcctggcagagcctgcggagagatgtgcagctgatccgctcctggagcctggccaccttccgcaccctgaagccagaggagcagaggcaggccctgcacagcctggagctgcactaccaggccttcctgcgggacagccaggatgctgggggctttggacctgaggaccggctgatggccgagcgggagtatggcagctgcagccaccactaccagcagctgctgcagagcctggagcagggcgcccaggaggagagccgctgccagcgctgcatcagcgagctgaaggacatccggctgcagctggaggcctgtgagaccaggacagtgcaccggctgcggctgcccctggacaaggagcccgccagagaatgtgcccagagaattgctgagcagcagaaggcccaggccgaggtggagggcctgggcaaaggagtggcccggctgtctgctgaggccgagaaggtgctggccctgcctgagcccagccctgctgcccccaccctgcggtctgagctggagctgaccctgggcaagctggagcaggtgcgcagcctgagcgccatctacctggagaagctgaagaccatcagcctggtgatccggggcacccagggcgctgaggaggtgctgcgggcccacgaggagcagctgaaggaggcccaggccgtgcctgccaccctgcctgagctggaggccaccaaggccagcctgaagaagctgcgggcccaggccgaggcccagcagcccacctttgatgccctgagagatgagctgcggggggcccaggaggtgggggagcggctgcagcagagacatggagagagagatgtggaggtggagcgctggagggagcgggtggcccagctgctggagcgctggcaggccgtgctggcccagacagatgtgcggcagcgggagctggagcagctgggccggcagctgcgctactaccgggagagcgctgaccccctgggcgcctggctgcaggatgcccggcggcggcaggagcagatccaggccatgcccctggccgacagccaggccgtgcgggagcagctgcggcaggagcaggccctgctggaggagattgagcggcacggggagaaggtggaggagtgccagagatttgccaagcagtacatcaatgccatcaaggactatgagctgcagctggtgacctacaaggcccagctggagcctgtggccagccctgccaagaagcccaaggtgcagagcggcagcgagagcgtcatccaggagtatgtggacctgcggacccactacagcgagctgaccaccctgaccagccagtacatcaagttcatcagcgagaccctgcggaggatggaggaggaggagcggctggccgagcagcagagagctgaggagcgggagcggctggccgaggtggaggccgccctggagaagcagaggcagctggccgaggcccacgcccaggccaaggcccaggccgagcgggaggccaaggagctgcagcagaggatgcaggaggaggtggtgcggcgggaggaggccgctgtggatgcccagcagcagaagaggagcatccaggaggagctgcagcagctgcggcagagcagcgaggccgagatccaggccaaggcccggcaggccgaggccgctgagaggagccggctgagaattgaggaggagatccgggtggtgcggctgcagctggaggccacagagcggcagaggggcggcgctgagggggagctgcaggccctgcgggcccgggcagaggaggccgaggcccagaagaggcaggcccaggaggaggccgagcggctgcggcggcaggtgcaggatgagagccagaggaagaggcaggccgaggtggagctggccagccgggtgaaggccgaggccgaggccgcccgggagaagcagagggccctgcaggccctggaggagctgcggctgcaggccgaggaggccgagcggcggctgcggcaggccgaggtggagcgggcccggcaggtgcaggtggccctggagacagcccagaggtctgctgaggccgagctgcagagcaagagggccagctttgctgagaagacagcccagctggagaggagcctgcaggaggagcacgtggccgtggcccagctgcgggaggaggccgagcggcgggcccagcagcaggccgaggccgagcgggcccgggaggaggccgagcgggagctggagcgctggcagctgaaggccaatgaggccctgcggctgcggctgcaggccgaggaggtggcccagcagaagagcctggcccaggccgaggccgagaagcagaaggaggaggccgagcgggaggcccggcggcggggcaaggccgaggagcaggccgtgcggcagcgggagctggccgagcaggagctggagaagcagaggcagctggccgagggcacagcccagcagaggctggccgctgagcaggagctgatccggctgcgggcagagacagagcagggcgagcagcagaggcagctgctggaggaggagctggcccggctgcagcgggaggccgccgccgccacccagaagaggcaggagctggaggccgagctggccaaggtgcgggcagagatggaggtgctgctggccagcaaggcccgggcagaggaggagagccgcagcaccagcgagaagagcaagcagaggctggaggccgaggccggccgcttccgggagctggccgaggaggccgcccggctgcgggccctggccgaggaggccaagaggcagaggcagctggccgaggaggatgctgcccggcagagagctgaggccgagcgggtgctggccgagaagctggccgccatcggggaggccacccggctgaagacagaagctgagatcgccctgaaggagaaggaggctgaaaatgaaaggctgcggcggctggccgaggatgaggccttccagaggcggcggctggaggagcaggccgcccagcacaaggctgacatcgaggagcggctggcccagctgaggaaggccagtgacagcgagctggagcggcagaagggcctggtggaggacaccctgcggcagaggcggcaggtggaggaggagatcctggccctgaaggccagctttgagaaggctgctgctgggaaggccgagctggagctggagctgggccgcatccgcagcaatgctgaggacaccctgcggagcaaggagcaggccgagctggaggccgcccggcagaggcagctggccgctgaggaggagaggagaagaagagaagctgaggagcgggtgcagaagagcctggccgctgaggaggaggccgcccggcagaggaaggccgccctggaggaggtggagcggctgaaggccaaggtggaggaggcccggcggctgcgggagagagctgagcaggagagcgcccggcagctgcagctggcccaggaggccgcccagaagaggctgcaggccgaggagaaggcccacgcctttgctgtgcagcagaaggagcaggagctgcagcagaccctgcagcaggagcagagcgtgctggaccagctgcggggggaggccgaggccgcccggcgggctgctgaggaggccgaggaggcccgggtgcaggccgagcgggaggccgcccagagccggcggcaggtggaggaggccgagcggctgaagcagagcgctgaggagcaggcccaggcccgggcccaggcccaggccgctgctgagaagctgaggaaggaggccgagcaggaggccgcccggcgggcccaggccgagcaggccgccctgcggcagaagcaggccgcagatgctgagatggagaagcacaagaagtttgctgagcagaccctgcggcagaaggcccaggtggagcaggagctgaccaccctgcggctgcagctggaggagacagaccaccagaagaacctgctggatgaggagctgcagaggctgaaggccgaggccacagaggccgcccggcagaggagccaggtggaggaggagctgttctctgtgcgggtgcagatggaggagctgagcaagctgaaggcccgcatcgaggctgaaaatagagccctgatcctgcgggacaaggacaacacccagcgcttcctgcaggaggaggccgagaagatgaagcaggtggccgaggaggccgcccggctgtctgtggccgcccaggaggccgcccggctgcggcagctggccgaggaggacctggcccagcagagggccctggccgagaagatgctgaaggagaagatgcaggccgtgcaggaggccacccggctgaaggccgaggccgagctgctgcagcagcagaaggagctggcccaggagcaggcccggcggctgcaggaggacaaggagcagatggcccagcagctggccgaggagacccagggcttccagaggaccctggaggccgagcggcagaggcagctggagatgtctgctgaggccgagcggctgaagctgcgggtggccgagatgagccgggcccaggcccgggcagaggaggatgcccagcgcttcaggaagcaggccgaggagatcggggagaagctgcacaggacagagctggccacccaggagaaggtgaccctggtgcagaccctggagatccagaggcagcagagcgaccatgatgctgagcggctgcgggaggccatcgccgagctggagcgggagaaggagaagctgcagcaggaggccaagctgctgcagctgaagtctgaggagatgcagacagtgcagcaggagcagctgctgcaggagacccaggccctgcagcagagcttcctgtctgagaaggacagcctgctgcagcgggagcgcttcatcgagcaggagaaggccaagctggagcagctgttccaggatgaggtggccaaggcccagcagctgcgggaggagcagcagaggcagcagcagcagatggagcaggagcggcagaggctggtggcctccatggaggaggcccggcggcggcagcatgaagctgaggagggcgtgcggaggaagcaggaggagctgcagcagctggagcagcagaggcggcagcaggaggagctgctggccgaggagaaccagaggctgcgggagcagctgcagctgctggaggagcagcaccgggccgccctggcccacagcgaggaggtgacagccagccaggtggccgccaccaagaccctgcccaacggcagagatgccctggatggccctgctgctgaggccgagcctgagcacagctttgatggcctgcggaggaaggtgtctgcccagaggctgcaggaggccggcatcctgtctgctgaggagctgcagaggctggcccagggccacaccaccgtggatgagctggccaggagagaagatgtgcgccactacctgcagggccgcagcagcattgctggcctgctgctgaaggccaccaatgagaagctgtctgtgtatgctgccctgcagaggcagctgctgagccctggaacagccctgatcctgctggaggcccaggccgccagcggcttcctgctggaccctgtgaggaacagaaggctgactgtgaatgaggccgtgaaggagggcgtggtgggccctgagctgcaccacaagctgctgtctgctgagagagctgtgacaggctacaaggacccctacacaggccagcagatcagcctcttccaggccatgcagaagggcctcatcgtgcgggagcacggcatccggctgctggaggcccagatcgccactggaggagtgattgatcctgtgcacagccaccgggtgcctgtggatgtggcctaccgccggggctactttgatgaggagatgaacagagtgctggccgaccccagtgatgacaccaagggcttctttgaccccaacacccatgagaacctgacctacctgcagctgctggagcgctgtgtggaggaccctgagaccggcctgtgcctgctgcccctgacagacaaggccgccaagggcggggagctggtgtacacagacagcgaggccagagatgtgtttgagaaggccaccgtgtctgccccctttgggaagttccagggcaagacagtgaccatctgggagatcatcaacagcgagtacttcaccgctgagcagaggcgggacctgctgcggcagttcagaacaggccgcatcaccgtggagaagatcatcaagatcatcatcaccgtggtggaggagcaggagcagaagggccgcctgtgctttgagggcctgcggagcctggtgcctgctgctgagctgctggagagccgggtgattgaccgggagctgtaccagcagctgcagagaggagagaggtctgtgagagatgtggccgaggtggacacagtgcggcgggccctgcggggggccaacgtgattgctggggtgtggctggaggaggccggccagaagctgagcatctacaatgccctgaagaaggacctgctgcccagcgacatggctgtggccctgctggaggcccaggccggcaccggccacatcattgatcctgccaccagcgcccggctgactgtggatgaggccgtgcgggccggcctggtgggccctgagttccacgagaagctgctgtctgctgagaaggctgtgacaggctacagagacccctacacaggccagagcgtgtccctcttccaggccctgaagaagggcctcatcccccgggagcagggcctgcggctgctggatgcccagctgagcactggaggcatcgtggaccccagcaagagccaccgggtgcccctggatgtggcctgtgcccggggctgcctggatgaggagaccagccgggccctgagcgcccccagggcagatgccaaggcctacagcgaccccagcactggagagcccgccacctatggagagctgcagcagcgctgcaggccagaccagctgaccggcctgagcctgctgcccctgtctgagaaggccgcccgggcccggcaggaggagctgtacagcgagctgcaggcccgggagacctttgagaagacccctgtggaggtgcctgtgggcggcttcaagggccgcacagtgacagtgtgggagctgatcagcagcgagtacttcaccgctgagcagaggcaggagctgctgcggcagttcagaacaggcaaggtgacagtggagaaggtgatcaagatcctgatcaccatcgtggaggaggtggagaccctgcggcaggagcggctgtccttcagcggcctgcgggcccctgtgcctgccagcgagctgctggccagcggcgtgctgagccgggcccagtttgagcagctgaaggatggcaagaccaccgtgaaggacctgtctgagctgggctctgtgaggaccctgctgcagggcagcggctgcctggccggcatctacctggaggacaccaaggagaaggtgtccatctatgaggccatgagaagaggcctgctgcgggccaccacagctgccctgctgctggaggcccaggccgccaccggcttcctggtggaccctgtgaggaaccagaggctgtatgtgcatgaagctgtgaaggccggcgtggtgggccctgagctgcacgagcagctgctgtctgctgagaaggctgtgacaggctacagagacccctacagcggcagcaccatcagcctcttccaggccatgcagaagggcctggtgctgcggcagcacggcatccggctgctggaggcccagatcgccaccggcggcatcatcgaccctgtgcacagccaccgggtgcctgtggatgtggcctaccagaggggctacttcagcgaggagatgaacagagtgctggccgaccccagtgatgacaccaagggcttctttgaccccaacacccatgagaacctgacctaccggcagctgctggagcgctgtgtggaggaccctgagaccggcctgcggctgctgcccctgaagggagctgagaaggccgaggtggtggagaccacccaggtgtacacagaggaggagacccggcgggcctttgaggagacccagattgacatccctgggggcggcagccatggaggcagcaccatgagcctgtgggaggtgatgcagagcgacctgatccctgaggagcagagggcccagctgatggctgacttccaggccggccgggtgaccaaggagaggatgatcatcatcatcatcgagatcatcgagaagacagagatcatccggcagcagggcctggccagctatgactatgtgagaagaaggctgacagctgaggacctgtttgaggcccgcatcatcagcctggagacctacaacctgctgcgggagggcaccaggagcctgcgggaggccctggaggccgagagcgcctggtgctacctgtatggcaccggctctgtggccggcgtgtacctgcccggcagccggcagaccctgagcatctaccaggccctgaagaagggcctgctgtctgctgaggtggcccggctgctgctggaggcccaggccgccaccggcttcctgctggaccctgtgaagggggagcggctgactgtggatgaggccgtgaggaagggcctggtgggccctgagctgcatgaccggctgctgtctgctgagagagctgtgacaggctacagagacccctacacagagcagaccatcagcctcttccaggccatgaagaaggagctgatccccacagaggaggccctgcggctgctggatgcccagctggccactggaggcatcgtggacccccggctgggcttccacctgcccctggaggtggcctaccagaggggctacctgaacaaggacacccatgaccagctgtctgagcccagcgaggtgcgctcctatgtggaccccagcacagatgagcggctgagctacacccagctgctgcggcgctgcagaagagatgatggcaccggccagctgctgctgcccctgagtgatgccaggaagctgaccttccggggcctgaggaagcagatcaccatggaggagctggtgcgcagccaggtgatggatgaggccacagccctgcagctgcgggagggcctgaccagcattgaggaggtgaccaagaacctgcagaagttcctggagggcaccagctgcatcgccggcgtgtttgtggatgccaccaaggagcggctgtctgtgtaccaggccatgaagaagggcatcatccggcctggaacagcctttgagctgctggaggcccaggccgccaccggctacgtgattgaccccatcaagggcctgaagctgactgtggaggaggccgtgaggatgggcatcgtgggccctgagttcaaggacaagctgctgtctgctgagagagctgtgacaggctacaaggacccctacagcggcaagctgatcagcctcttccaggccatgaagaagggcctcatcctgaaggaccacggcatccggctgctggaggcccagatcgccaccggcggcatcatcgaccctgaggagagccaccggctgcctgtggaggtggcctacaagaggggcctgtttgatgaggagatgaatgagatcctgacagaccccagtgatgacaccaagggcttctttgaccccaacacagaggagaacctgacctacctgcagctgatggagcgctgcatcacagacccccagacaggcctgtgcctgctgcccctgaaggagaagaagcgggagaggaagaccagcagcaagagctctgtgaggaagagaagagtggtgattgtggaccctgagaccgggaaggagatgtctgtgtatgaggcctacaggaagggcctgattgaccaccagacctacctggagctgtctgagcaggagtgtgagtgggaggagatcaccatcagcagcagtgatggagtggtgaagtccatgatcatcgaccggcgcagcggccggcagtatgacattgatgatgccatcgccaagaacctgattgacagaagtgccctggaccagtacagagctggcaccctgagcatcacagaatttgctgacatgctgtctggaaatgccggcggcttccgcagccgcagcagctctgtgggcagcagcagcagctaccccatcagccctgctgtgtccaggacccagctggcctcctggagcgaccccacagaggagaccggccctgtggccggcatcctggacacagagaccctggagaaggtgtccatcacagaggccatgcacaggaacctggtggacaacatcaccggccagaggctgctggaggcccaggcctgcacaggaggcatcatcgaccccagcactggagagcgcttccctgtgacagatgctgtgaacaagggcctggtggacaagatcatggtggaccgcatcaacctggcccagaaggccttctgtggctttgaggaccccaggaccaagaccaagatgtctgctgcccaggccctgaagaagggctggctgtactatgaggccggccagcgcttcctggaggtgcagtacctgactggaggcctgattgaaccagacaccccaggccgggtgcccctggatgaggccctgcagaggggcaccgtggatgccaggacagcccagaagctgagagatgtgggcgcctacagcaagtacctgacctgccccaagaccaagctgaagatctcctacaaggatgccctggaccgctccatggtggaggagggcaccggcctgcggctgctggaggccgccgcccagagcaccaagggctactacagcccctacagcgtgtctggcagcggcagcacagctggcagcaggacaggcagcaggacaggcagccgggccggcagcagaagaggcagctttgatgccaccggcagcggcttctccatgaccttcagcagcagcagctacagcagcagcggctacggccgccgctatgccagcggcagcagcgccagcctgggcggccctgagagcgctgtggcctag

SEQ ID NO: 164411 - DNA, 13644 bp, Artificial Sequence
  Description of Artificial Sequence: Synthetic coding sequence
atgagccagcaccagctgcgggtgccccagcctgagggcctgggcaggaagaggaccagcagcgaggacaacctgtacctggccgtgctgcgggccagcgagggcaagaaggatgagcgggacagagtgcagaagaagaccttcaccaagtgggtgaacaagcacctgatcaaggcccagaggcacatcagtgacctgtatgaggacctgagagatggccacaacctgatcagcctgctggaggtgctgagcggggacagcctgccccgggagaagggccgcatgaggttccacaagctgcagaatgtgcagatcgccctggactacctgcggcaccggcaggtgaagctggtgaacatcagaaatgatgacattgctgatggcaaccccaagctgaccctgggcctcatctggaccatcatcctgcacttccagatcagtgacatccaggtgtctggccagagcgaggacatgacagccaaggagaagctgctgctgtggagccagaggatggtggagggctaccagggcctgcgctgtgacaacttcaccagctcctggagagatggccgcctcttcaatgccatcatccaccgccacaagcccctgctgattgacatgaacaaggtgtaccggcagaccaacctggagaacctggaccaggccttctctgtggccgagcgggacctgggcgtgacccggctgctggaccctgaagatgtggatgtgccccagccagatgagaagagcatcatcacctacgtgagcagcctgtatgatgccatgccccgggtgcctgatgtgcaggatggagtgcgggccaatgagctgcagctgcgctggcaggagtaccgggagctggtgctgctgctgctgcagtggatgaggcaccacacagctgcctttgaggagcggcgcttccccagcagctttgaggagattgagatcctgtggagccagttcctgaagttcaaggagatggagctgcctgccaaggaggccgacaagaacagaagcaagggcatctaccagagcctggagggcgctgtgcaggccggccagctgaaggtgcccccaggctaccaccccctggatgtggagaaggagtggggcaagctgcacgtggccatcctggagcgggagaagcagctgcggagtgaatttgagcggctggagtgcctgcagagaattgtgaccaagctgcagatggaggccggcctgtgtgaggagcagctgaaccaggctgatgccctgctgcagagtgatgtgcggctgctggccgccggcaaggtgccccagagagctggggaggtggagcgggacctggacaaggctgacagcatgatccggctgctcttcaatgatgtgcagaccctgaaggatggccgccacccccagggcgagcagatgtaccgccgggtgtaccgcctgcacgagcggctggtggccatcagaacagagtacaacctgcggctgaaggccggcgtggccgccccagccacccaggtggcccaggtgaccctgcagagcgtgcagaggaggcctgagctggaggacagcaccctgcgctacctgcaggacctgctggcctgggtggaggagaaccagcaccgggtggatggagctgagtggggcgtggacctgcccagcgtggaggcccagctgggcagccaccggggcctgcaccagagcattgaggagttccgggccaagattgaaagagcccggagtgatgagggccagctgagccctgccaccaggggggcctacagagactgcctgggccgcctggacctgcagtatgccaagctgctgaacagcagcaaggcccggctgcggagcctggagagcctgcacagctttgtggccgccgccaccaaggagctgatgtggctgaatgagaaggaggaggaggaggtgggctttgactggagcgacaggaacaccaacatgacagccaagaaggagagctacagcgccctgatgagggagctggagctgaaggagaagaagatcaaggagctgcagaatgctggggaccggctgctgcgggaggaccacccagcccggcccaccgtggagagcttccaggccgccctgcagacccagtggagctggatgctgcagctgtgctgctgcatcgaggcccacctgaaggaaaatgctgcctacttccagttcttcagtgatgtgcgggaggccgagggccagctgcagaagctgcaggaggccctgcggaggaagtacagctgtgacagaagtgccaccgtgacccggctggaggacctgctgcaggatgcccaggatgagaaggagcagctgaatgagtacaagggccacctgagcggcctggccaagagggccaaggctgtggtgcagctgaagcccaggcacccagcccaccccatgaggggccgcctgcccctgctggccgtgtgtgactacaagcaggtggaggtgacagtgcacaagggagatgagtgccagctggtgggccctgcccagcccagccactggaaggtgctgagcagcagcggcagcgaggccgctgtgcccagcgtgtgcttcctggtgcccccacccaaccaggaggcccaggaggccgtgacccggctggaggcccagcaccaggccctggtgaccctgtggcaccagctgcacgtggacatgaagagcctgctggcctggcagagcctgcggagagatgtgcagctgatccgctcctggagcctggccaccttccgcaccctgaagccagaggagcagaggcaggccctgcacagcctggagctgcactaccaggccttcctgcgggacagccaggatgctgggggcttcggcccagaagatcggctgatggccgagcgggagtatggcagctgcagccaccactaccagcagctgctgcagagcctggagcagggcgcccaggaggagagccgctgccagcgctgcatcagcgagctgaaggacatccggctgcagctggaggcctgtgagaccaggacagtgcaccggctgcggctgcccctggacaaggagcccgcccgggagtgtgcccagagaattgctgagcagcagaaggcccaggccgaggtggagggcctgggcaagggcgtggcccggctgtctgctgaggccgagaaggtgctggccctgcctgagcccagccctgctgcccccaccctgcggtctgagctggagctgaccctgggcaagctggagcaggtgcgcagcctgagcgccatctacctggagaagctgaagaccatcagcctggtgatccggggcacccagggcgctgaggaggtgctgcgggcccacgaggagcagctgaaggaggcccaggccgtgcctgccaccctgcctgagctggaggccaccaaggccagcctgaagaagctgcgggcccaggccgaggcccagcagcccacctttgatgccctgagagatgagctgcggggggcccaggaggtgggggagcggctgcagcagagacatggagagagagatgtggaggtggagcgctggagggagcgggtggcccagctgctggagcgctggcaggccgtgctggcccagacagatgtgcggcagcgggagctggagcagctgggccggcagctgcgctactaccgggagagcgctgaccccctgggcgcctggctgcaggatgcccggcggcggcaggagcagatccaggccatgcccctggccgacagccaggccgtgcgggagcagctgcggcaggagcaggccctgctggaggagattgaaagacatggagagaaggtggaggagtgccagagatttgccaagcagtacatcaatgccatcaaggactatgagctgcagctggtgacctacaaggcccagctggagcctgtggccagccctgccaagaagcccaaggtgcagagcggcagcgagagcgtcatccaggagtatgtggacctgcggacccactacagcgagctgaccaccctgaccagccagtacatcaagttcatcagcgagaccctgcggaggatggaggaggaggagcggctggccgagcagcagagagctgaggagcgggagcggctggccgaggtggaggccgccctggagaagcagaggcagctggccgaggcccacgcccaggccaaggcccaggccgagcgggaggccaaggagctgcagcagaggatgcaggaggaggtggtgagaagagaggaggccgctgtggatgcccagcagcagaagaggagcatccaggaggagctgcagcagctgcggcagagcagcgaggccgagatccaggccaaggcccggcaggccgaggccgctgagaggagccggctgcgcatcgaggaggagatccgggtggtgcggctgcagctggaggccacagagcggcagagaggaggagctgagggggagctgcaggccctgcgggcccgggcagaggaggccgaggcccagaagaggcaggcccaggaggaggccgagcggctgcggcggcaggtgcaggatgagagccagaggaagaggcaggccgaggtggagctggccagccgggtgaaggccgaggccgaggccgcccgggagaagcagagggccctgcaggccctggaggagctgcggctgcaggccgaggaggccgagcggcggctgcggcaggccgaggtggagcgggcccggcaggtgcaggtggccctggagacagcccagaggtctgctgaggccgagctgcagagcaagagggccagctttgctgagaagacagcccagctggagaggagcctgcaggaggagcacgtggccgtggcccagctgcgggaggaggccgagcggcgggcccagcagcaggccgaggccgagcgggcccgggaggaggccgagcgggagctggagcgctggcagctgaaggccaatgaggccctgcggctgcggctgcaggccgaggaggtggcccagcagaagagcctggcccaggccgaggccgagaagcagaaggaggaggccgagcgggaggccaggagaagaggcaaggccgaggagcaggccgtgcggcagcgggagctggccgagcaggagctggagaagcagaggcagctggccgagggcacagcccagcagaggctggccgctgagcaggagctgatccggctgcgggcagagacagagcagggcgagcagcagaggcagctgctggaggaggagctggcccggctgcagcgggaggccgctgctgccacccagaagaggcaggagctggaggccgagctggccaaggtgcgggcagagatggaggtgctgctggccagcaaggcccgggcagaggaggagagccgcagcaccagcgagaagagcaagcagaggctggaggccgaggccggccgcttccgggagctggccgaggaggccgcccggctgcgggccctggccgaggaggccaagaggcagaggcagctggccgaggaggatgctgcccggcagagagctgaggccgagcgggtgctggccgagaagctggccgccatcggggaggccacccggctgaagacagaggccgagatcgccctgaaggagaaggaggccgagaatgaaaggctgcggcggctggctgaagatgaggccttccagaggcggcggctggaggagcaggccgcccagcacaaggctgacatcgaggagcggctggcccagctgaggaaggccagtgacagcgagctggagcggcagaagggcctggtggaggacaccctgcggcagaggcggcaggtggaggaggagatcctggccctgaaggccagctttgagaaggctgctgctgggaaggccgagctggagctggagctgggccgcatccgcagcaatgctgaggacaccctgcggagcaaggagcaggccgagctggaggccgcccggcagaggcagctggccgctgaggaggagaggagaagaagagaggccgaggagcgggtgcagaagagcctggccgctgaggaggaggccgcccggcagaggaaggccgccctggaggaggtggagcggctgaaggccaaggtggaggaggcccggcggctgcgggagcgggcagagcaggagagcgcccggcagctgcagctggcccaggaggccgcccagaagaggctgcaggccgaggagaaggcccacgcctttgctgtgcagcagaaggagcaggagctgcagcagaccctgcagcaggagcagagcgtgctggaccagctgcggggggaggccgaggccgccaggagagctgctgaggaggccgaggaggcccgggtgcaggccgagcgggaggccgcccagagccggcggcaggtggaggaggccgagcggctgaagcagagcgctgaggagcaggcccaggcccgggcccaggcccaggccgctgctgagaagctgaggaaggaggccgagcaggaggccgcccggcgggcccaggccgagcaggccgccctgcggcagaagcaggccgcagatgctgagatggagaagcacaagaagtttgctgagcagaccctgcggcagaaggcccaggtggagcaggagctgaccaccctgcggctgcagctggaggagacagaccaccagaagaacctgctggatgaggagctgcagaggctgaaggccgaggccacagaagctgcccggcagaggagccaggtggaggaggagctgttctctgtgcgggtgcagatggaggagctgagcaagctgaaggccagaattgaagctgagaacagagccctgatcctgcgggacaaggacaacacccagcgcttcctgcaggaggaggccgagaagatgaagcaggtggccgaggaggccgcccggctgtctgtggccgcccaggaggccgcccggctgcggcagctggccgaggaggacctggcccagcagagggccctggccgagaagatgctgaaggagaagatgcaggccgtgcaggaggccacccggctgaaggccgaggccgagctgctgcagcagcagaaggagctggcccaggagcaggcccggcggctgcaggaggacaaggagcagatggcccagcagctggccgaggagacccagggcttccagaggaccctggaggccgagcggcagaggcagctggagatgtctgctgaggccgagcggctgaagctgcgggtggccgagatgagccgggcccaggcccgggcagaagaagatgcccagcgcttcaggaagcaggccgaggagattggagagaagctgcacaggacagagctggccacccaggagaaggtgaccctggtgcagaccctggagatccagaggcagcagagcgaccatgatgctgagcggctgcgggaggccatcgccgagctggagcgggagaaggagaagctgcagcaggaggccaagctgctgcagctgaagtctgaggagatgcagacagtgcagcaggagcagctgctgcaggagacccaggccctgcagcagagcttcctgtctgagaaggacagcctgctgcagcgggagcgcttcatcgagcaggagaaggccaagctggagcagctgttccaggatgaggtggccaaggcccagcagctgcgggaggagcagcagaggcagcagcagcagatggagcaggagcggcagaggctggtggcctccatggaggaggcccggcggcggcagcacgaggccgaggagggcgtgcggaggaagcaggaggagctgcagcagctggagcagcagaggcggcagcaggaggagctgctggccgaggagaaccagaggctgcgggagcagctgcagctgctggaggagcagcacagagctgccctggcccacagcgaggaggtgacagccagccaggtggccgccaccaagaccctgcccaacggcagagatgccctggatggccctgctgctgaggccgagcctgagcacagctttgatggcctgcggaggaaggtgtctgcccagaggctgcaggaggccggcatcctgtctgctgaggagctgcagaggctggcccagggccacaccaccgtggatgagctggcccggcgggaggatgtgcgccactacctgcagggccgcagcagcattgctggcctgctgctgaaggccaccaatgagaagctgtctgtgtatgctgccctgcagaggcagctgctgagccctggaacagccctgatcctgctggaggcccaggccgccagcggcttcctgctggaccctgtgaggaacagaaggctgactgtgaatgaagctgtgaaggagggcgtggtgggccctgagctgcaccacaagctgctgtctgctgagagagctgtgacaggctacaaggacccctacacaggccagcagatcagcctcttccaggccatgcagaagggcctgattgtgcgggagcacggcatccggctgctggaggcccagatcgccaccggcggcgtcatcgaccctgtgcacagccaccgggtgcctgtggatgtggcctacagaagaggctactttgatgaggagatgaacagagtgctggccgaccccagtgatgacaccaagggcttctttgaccccaacacccatgagaacctgacctacctgcagctgctggagcgctgtgtggaggaccctgagaccggcctgtgcctgctgcccctgacagacaaggccgccaagggcggggagctggtgtacacagattctgaggccagagatgtgtttgagaaggccaccgtgtctgccccctttgggaagttccagggcaagacagtgaccatctgggagatcatcaacagcgagtacttcaccgctgagcagaggcgggacctgctgcggcagttcagaacaggccgcatcaccgtggagaagatcatcaagatcatcatcaccgtggtggaggagcaggagcagaagggccgcctgtgctttgagggcctgcggagcctggtgcctgctgctgagctgctggagagcagggtcatcgaccgggagctgtaccagcagctgcagagaggagagaggtctgtgagagatgtggccgaggtggacacagtgagaagagccctgcggggggccaacgtgattgctggggtgtggctggaggaggccggccagaagctgagcatctacaatgccctgaagaaggacctgctgcccagcgacatggctgtggccctgctggaggcccaggccggcaccggccacatcatcgaccctgccaccagcgcccggctgactgtggatgaagctgtgcgggccggcctggtgggccctgagttccacgagaagctgctgtctgctgagaaggctgtgacaggctacagagacccctacacaggccagagcgtgtccctcttccaggccctgaagaagggcctcatcccccgggagcagggcctgcggctgctggatgcccagctgagcactggaggcatcgtggaccccagcaagagccaccgggtgcccctggatgtggcctgtgcccggggctgcctggatgaggagaccagccgggccctgagcgcccccagggcagatgccaaggcctacagcgaccccagcactggagagcccgccacctacggggagctgcagcagcgctgcaggccagaccagctgaccggcctgagcctgctgcccctgtctgagaaggccgcccgggcccggcaggaggagctgtacagcgagctgcaggcccgggagacctttgagaagacccctgtggaggtgcctgtgggcggcttcaagggccgcacagtgacagtgtgggagctgatcagcagcgagtacttcaccgctgagcagaggcaggagctgctgcggcagttcagaacaggcaaggtgacagtggagaaggtgatcaagatcctgatcaccatcgtggaggaggtggagaccctgcggcaggagcggctgtccttcagcggcctgcgggcccctgtgcctgccagcgagctgctggccagcggcgtgctgagccgggcccagtttgagcagctgaaggatggcaagaccaccgtgaaggacctgtctgagctgggctctgtgaggaccctgctgcagggcagcggctgcctggccggcatctacctggaggacaccaaggagaaggtgtccatctatgaggccatgaggcggggcctgctgcgggccaccacagctgccctgctgctggaggcccaggccgccaccggcttcctggtggaccctgtgaggaaccagaggctgtatgtgcatgaggccgtgaaggccggcgtggtgggccctgagctgcacgagcagctgctgtctgctgagaaggctgtgacaggctacagagacccctacagcggcagcaccatcagcctcttccaggccatgcagaagggcctggtgctgcggcagcacggcatccggctgctggaggcccagatcgccactggaggcatcattgatcctgtgcacagccaccgggtgcctgtggatgtggcctaccagaggggctacttcagcgaggagatgaacagagtgctggccgaccccagtgatgacaccaagggcttctttgaccccaacacccatgagaacctgacctaccggcagctgctggagcgctgtgtggaggaccctgagaccggcctgcggctgctgcccctgaagggagctgagaaggccgaggtggtggagaccacccaggtgtacacagaggaggagacccggcgggcctttgaggagacccagattgacatccctgggggcggcagccacggcggcagcaccatgagcctgtgggaggtgatgcagagcgacctgatccctgaggagcagagggcccagctgatggctgacttccaggccggccgggtgaccaaggagaggatgatcatcatcatcatcgagatcatcgagaagacagagatcatccggcagcagggcctggccagctatgactatgtgagaagaaggctgacagctgaggacctgtttgaggcccgcatcatcagcctggagacctacaacctgctgcgggagggcaccaggagcctgcgggaggccctggaggccgagagcgcctggtgctacctgtatggaactggatctgtggccggcgtgtacctgcccggcagccggcagaccctgagcatctaccaggccctgaagaagggcctgctgtctgctgaggtggcccggctgctgctggaggcccaggccgccaccggcttcctgctggaccctgtgaagggggagcggctgactgtggatgaagctgtgaggaagggcctggtgggccctgagctgcatgaccggctgctgtctgctgagagagctgtgacaggctacagagacccctacacagagcagaccatcagcctcttccaggccatgaagaaggagctgatccccacagaggaggccctgcggctgctggatgcccagctggccaccggcggcatcgtggacccccggctgggcttccacctgcccctggaggtggcctaccagaggggctacctgaacaaggacacccatgaccagctgtctgagcccagcgaggtgcgctcctatgtggaccccagcacagatgagcggctgagctacacccagctgctgcggcgctgcagaagagatgatggcaccggccagctgctgctgcccctgagtgatgccaggaagctgaccttccggggcctgaggaagcagatcaccatggaggagctggtgcgcagccaggtgatggatgaggccacagccctgcagctgcgggagggcctgaccagcattgaggaggtgaccaagaacctgcagaagttcctggagggcaccagctgcatcgccggcgtgtttgtggatgccaccaaggagcggctgtctgtgtaccaggccatgaagaagggcatcatccggcccggcacagcctttgagctgctggaggcccaggccgccaccggctacgtgattgaccccatcaagggcctgaagctgactgtggaggaggccgtgaggatgggcatcgtgggccctgagttcaaggacaagctgctgtctgctgagagagctgtgacaggctacaaggacccctacagcggcaagctgatcagcctcttccaggccatgaagaagggcctcatcctgaaggaccacggcatccggctgctggaggcccagatcgccactggaggcatcattgatcctgaggagagccaccggctgcctgtggaggtggcctacaagaggggcctgtttgatgaggagatgaatgagatcctgacagaccccagtgatgacaccaagggcttctttgaccccaacacagaggagaacctgacctacctgcagctgatggagcgctgcatcacagacccccagacaggcctgtgcctgctgcccctgaaggagaagaagcgggagaggaagaccagcagcaagagctctgtgaggaagagaagagtggtgattgtggaccctgagaccgggaaggagatgtctgtgtatgaggcctacaggaagggcctgattgaccaccagacctacctggagctgtctgagcaggagtgtgagtgggaggagatcaccatcagcagcagtgatggagtggtgaagtccatgatcatcgacagaagaagtggccggcagtatgacattgatgatgccatcgccaagaacctgattgacagaagtgccctggaccagtaccgggccggcaccctgagcatcacagaatttgctgacatgctgtctggaaatgctgggggcttccgcagccgcagcagctctgtgggcagcagcagcagctaccccatcagccctgctgtgtccaggacccagctggcctcctggagcgaccccacagaggagactggacctgtggccggcatcctggacacagagaccctggagaaggtgtccatcacagaggccatgcacaggaacctggtggacaacatcaccggccagaggctgctggaggcccaggcctgcaccggcggcatcatcgaccccagcactggagagcgcttccctgtgacagatgctgtgaacaagggcctggtggacaagatcatggtggaccgcatcaacctggcccagaaggccttctgtggctttgaggaccccaggaccaagaccaagatgtctgctgcccaggccctgaagaagggctggctgtactatgaagctggccagcgcttcctggaggtgcagtacctgaccggcggcctcatcgagccagacaccccaggccgggtgcccctggatgaggccctgcagaggggcaccgtggatgccaggacagcccagaagctgagagatgtgggcgcctacagcaagtacctgacctgccccaagaccaagctgaagatctcctacaaggatgccctggaccgctccatggtggaggagggcaccggcctgcggctgctggaggccgccgcccagagcaccaagggctactacagcccctacagcgtgtctggcagcggcagcacagctggcagcaggacaggcagcaggacaggcagcagagctggcagccggcggggcagctttgatgccactggaagtggcttctccatgaccttcagcagcagcagctacagcagcagcggctatggaagaagatatgccagcggcagcagcgccagcctgggcggccctgagagcgctgtggcctag

SEQ ID NO: 164412 - DNA, 13644 bp, Artificial Sequence
  Description of Artificial Sequence: Synthetic coding sequence
atggagcccagcggcagcctcttccccagcctggtggtggtgggccacgtggtgaccctggccgctgtgtggcactggaggcggggccgccgctgggcccaggatgagcaggatgagcgggacagagtgcagaagaagaccttcaccaagtgggtgaacaagcacctgatcaaggcccagaggcacatcagtgacctgtatgaggacctgagagatggccacaacctgatcagcctgctggaggtgctgagcggggacagcctgccccgggagaagggccgcatgaggttccacaagctgcagaatgtgcagatcgccctggactacctgcggcaccggcaggtgaagctggtgaacatcagaaatgatgacattgctgatggcaaccccaagctgaccctgggcctcatctggaccatcatcctgcacttccagatcagtgacatccaggtgtctggccagagcgaggacatgacagccaaggagaagctgctgctgtggagccagaggatggtggagggctaccagggcctgcgctgtgacaacttcaccagctcctggagagatggccgcctcttcaatgccatcatccaccgccacaagcccctgctgattgacatgaacaaggtgtaccggcagaccaacctggagaacctggaccaggccttctctgtggccgagcgggacctgggcgtgacccggctgctggaccctgaagatgtggatgtgccccagccagatgagaagagcatcatcacctacgtgagcagcctgtatgatgccatgccccgggtgcctgatgtgcaggatggagtgcgggccaatgagctgcagctgcgctggcaggagtaccgggagctggtgctgctgctgctgcagtggatgaggcaccacacagctgcctttgaggagcggcgcttccccagcagctttgaggagattgagatcctgtggagccagttcctgaagttcaaggagatggagctgcctgccaaggaggccgacaagaacagaagcaagggcatctaccagagcctggagggcgctgtgcaggccggccagctgaaggtgcccccaggctaccaccccctggatgtggagaaggagtggggcaagctgcacgtggccatcctggagcgggagaagcagctgcggagtgaatttgagcggctggagtgcctgcagagaattgtgaccaagctgcagatggaggccggcctgtgtgaggagcagctgaaccaggctgatgccctgctgcagagtgatgtgcggctgctggccgccggcaaggtgccccagagagctggggaggtggagcgggacctggacaaggctgacagcatgatccggctgctcttcaatgatgtgcagaccctgaaggatggccgccacccccagggcgagcagatgtaccgccgggtgtaccgcctgcacgagcggctggtggccatcagaacagagtacaacctgcggctgaaggccggcgtggccgccccagccacccaggtggcccaggtgaccctgcagagcgtgcagaggaggcctgagctggaggacagcaccctgcgctacctgcaggacctgctggcctgggtggaggagaaccagcaccgggtggatggagctgagtggggcgtggacctgcccagcgtggaggcccagctgggcagccaccggggcctgcaccagagcattgaggagttccgggccaagattgaaagagcccggagtgatgagggccagctgagccctgccaccaggggggcctacagagactgcctgggccgcctggacctgcagtatgccaagctgctgaacagcagcaaggcccggctgcggagcctggagagcctgcacagctttgtggccgccgccaccaaggagctgatgtggctgaatgagaaggaggaggaggaggtgggctttgactggagcgacaggaacaccaacatgacagccaagaaggagagctacagcgccctgatgagggagctggagctgaaggagaagaagatcaaggagctgcagaatgctggggaccggctgctgcgggaggaccacccagcccggcccaccgtggagagcttccaggccgccctgcagacccagtggagctggatgctgcagctgtgctgctgcatcgaggcccacctgaaggaaaatgctgcctacttccagttcttcagtgatgtgcgggaggccgagggccagctgcagaagctgcaggaggccctgcggaggaagtacagctgtgacagaagtgccaccgtgacccggctggaggacctgctgcaggatgcccaggatgagaaggagcagctgaatgagtacaagggccacctgagcggcctggccaagagggccaaggctgtggtgcagctgaagcccaggcacccagcccaccccatgaggggccgcctgcccctgctggccgtgtgtgactacaagcaggtggaggtgacagtgcacaagggagatgagtgccagctggtgggccctgcccagcccagccactggaaggtgctgagcagcagcggcagcgaggccgctgtgcccagcgtgtgcttcctggtgcccccacccaaccaggaggcccaggaggccgtgacccggctggaggcccagcaccaggccctggtgaccctgtggcaccagctgcacgtggacatgaagagcctgctggcctggcagagcctgcggagagatgtgcagctgatccgctcctggagcctggccaccttccgcaccctgaagccagaggagcagaggcaggccctgcacagcctggagctgcactaccaggccttcctgcgggacagccaggatgctgggggcttcggcccagaagatcggctgatggccgagcgggagtatggcagctgcagccaccactaccagcagctgctgcagagcctggagcagggcgcccaggaggagagccgctgccagcgctgcatcagcgagctgaaggacatccggctgcagctggaggcctgtgagaccaggacagtgcaccggctgcggctgcccctggacaaggagcccgcccgggagtgtgcccagagaattgctgagcagcagaaggcccaggccgaggtggagggcctgggcaagggcgtggcccggctgtctgctgaggccgagaaggtgctggccctgcctgagcccagccctgctgcccccaccctgcggtctgagctggagctgaccctgggcaagctggagcaggtgcgcagcctgagcgccatctacctggagaagctgaagaccatcagcctggtgatccggggcacccagggcgctgaggaggtgctgcgggcccacgaggagcagctgaaggaggcccaggccgtgcctgccaccctgcctgagctggaggccaccaaggccagcctgaagaagctgcgggcccaggccgaggcccagcagcccacctttgatgccctgagagatgagctgcggggggcccaggaggtgggggagcggctgcagcagagacatggagagagagatgtggaggtggagcgctggagggagcgggtggcccagctgctggagcgctggcaggccgtgctggcccagacagatgtgcggcagcgggagctggagcagctgggccggcagctgcgctactaccgggagagcgctgaccccctgggcgcctggctgcaggatgcccggcggcggcaggagcagatccaggccatgcccctggccgacagccaggccgtgcgggagcagctgcggcaggagcaggccctgctggaggagattgaaagacatggagagaaggtggaggagtgccagagatttgccaagcagtacatcaatgccatcaaggactatgagctgcagctggtgacctacaaggcccagctggagcctgtggccagccctgccaagaagcccaaggtgcagagcggcagcgagagcgtcatccaggagtatgtggacctgcggacccactacagcgagctgaccaccctgaccagccagtacatcaagttcatcagcgagaccctgcggaggatggaggaggaggagcggctggccgagcagcagagagctgaggagcgggagcggctggccgaggtggaggccgccctggagaagcagaggcagctggccgaggcccacgcccaggccaaggcccaggccgagcgggaggccaaggagctgcagcagaggatgcaggaggaggtggtgagaagagaggaggccgctgtggatgcccagcagcagaagaggagcatccaggaggagctgcagcagctgcggcagagcagcgaggccgagatccaggccaaggcccggcaggccgaggccgctgagaggagccggctgcgcatcgaggaggagatccgggtggtgcggctgcagctggaggccacagagcggcagagaggaggagctgagggggagctgcaggccctgcgggcccgggcagaggaggccgaggcccagaagaggcaggcccaggaggaggccgagcggctgcggcggcaggtgcaggatgagagccagaggaagaggcaggccgaggtggagctggccagccgggtgaaggccgaggccgaggccgcccgggagaagcagagggccctgcaggccctggaggagctgcggctgcaggccgaggaggccgagcggcggctgcggcaggccgaggtggagcgggcccggcaggtgcaggtggccctggagacagcccagaggtctgctgaggccgagctgcagagcaagagggccagctttgctgagaagacagcccagctggagaggagcctgcaggaggagcacgtggccgtggcccagctgcgggaggaggccgagcggcgggcccagcagcaggccgaggccgagcgggcccgggaggaggccgagcgggagctggagcgctggcagctgaaggccaatgaggccctgcggctgcggctgcaggccgaggaggtggcccagcagaagagcctggcccaggccgaggccgagaagcagaaggaggaggccgagcgggaggccaggagaagaggcaaggccgaggagcaggccgtgcggcagcgggagctggccgagcaggagctggagaagcagaggcagctggccgagggcacagcccagcagaggctggccgctgagcaggagctgatccggctgcgggcagagacagagcagggcgagcagcagaggcagctgctggaggaggagctggcccggctgcagcgggaggccgctgctgccacccagaagaggcaggagctggaggccgagctggccaaggtgcgggcagagatggaggtgctgctggccagcaaggcccgggcagaggaggagagccgcagcaccagcgagaagagcaagcagaggctggaggccgaggccggccgcttccgggagctggccgaggaggccgcccggctgcgggccctggccgaggaggccaagaggcagaggcagctggccgaggaggatgctgcccggcagagagctgaggccgagcgggtgctggccgagaagctggccgccatcggggaggccacccggctgaagacagaggccgagatcgccctgaaggagaaggaggccgagaatgaaaggctgcggcggctggctgaagatgaggccttccagaggcggcggctggaggagcaggccgcccagcacaaggctgacatcgaggagcggctggcccagctgaggaaggccagtgacagcgagctggagcggcagaagggcctggtggaggacaccctgcggcagaggcggcaggtggaggaggagatcctggccctgaaggccagctttgagaaggctgctgctgggaaggccgagctggagctggagctgggccgcatccgcagcaatgctgaggacaccctgcggagcaaggagcaggccgagctggaggccgcccggcagaggcagctggccgctgaggaggagaggagaagaagagaggccgaggagcgggtgcagaagagcctggccgctgaggaggaggccgcccggcagaggaaggccgccctggaggaggtggagcggctgaaggccaaggtggaggaggcccggcggctgcgggagcgggcagagcaggagagcgcccggcagctgcagctggcccaggaggccgcccagaagaggctgcaggccgaggagaaggcccacgcctttgctgtgcagcagaaggagcaggagctgcagcagaccctgcagcaggagcagagcgtgctggaccagctgcggggggaggccgaggccgccaggagagctgctgaggaggccgaggaggcccgggtgcaggccgagcgggaggccgcccagagccggcggcaggtggaggaggccgagcggctgaagcagagcgctgaggagcaggcccaggcccgggcccaggcccaggccgctgctgagaagctgaggaaggaggccgagcaggaggccgcccggcgggcccaggccgagcaggccgccctgcggcagaagcaggccgcagatgctgagatggagaagcacaagaagtttgctgagcagaccctgcggcagaaggcccaggtggagcaggagctgaccaccctgcggctgcagctggaggagacagaccaccagaagaacctgctggatgaggagctgcagaggctgaaggccgaggccacagaagctgcccggcagaggagccaggtggaggaggagctgttctctgtgcgggtgcagatggaggagctgagcaagctgaaggccagaattgaagctgagaacagagccctgatcctgcgggacaaggacaacacccagcgcttcctgcaggaggaggccgagaagatgaagcaggtggccgaggaggccgcccggctgtctgtggccgcccaggaggccgcccggctgcggcagctggccgaggaggacctggcccagcagagggccctggccgagaagatgctgaaggagaagatgcaggccgtgcaggaggccacccggctgaaggccgaggccgagctgctgcagcagcagaaggagctggcccaggagcaggcccggcggctgcaggaggacaaggagcagatggcccagcagctggccgaggagacccagggcttccagaggaccctggaggccgagcggcagaggcagctggagatgtctgctgaggccgagcggctgaagctgcgggtggccgagatgagccgggcccaggcccgggcagaagaagatgcccagcgcttcaggaagcaggccgaggagattggagagaagctgcacaggacagagctggccacccaggagaaggtgaccctggtgcagaccctggagatccagaggcagcagagcgaccatgatgctgagcggctgcgggaggccatcgccgagctggagcgggagaaggagaagctgcagcaggaggccaagctgctgcagctgaagtctgaggagatgcagacagtgcagcaggagcagctgctgcaggagacccaggccctgcagcagagcttcctgtctgagaaggacagcctgctgcagcgggagcgcttcatcgagcaggagaaggccaagctggagcagctgttccaggatgaggtggccaaggcccagcagctgcgggaggagcagcagaggcagcagcagcagatggagcaggagcggcagaggctggtggcctccatggaggaggcccggcggcggcagcacgaggccgaggagggcgtgcggaggaagcaggaggagctgcagcagctggagcagcagaggcggcagcaggaggagctgctggccgaggagaaccagaggctgcgggagcagctgcagctgctggaggagcagcacagagctgccctggcccacagcgaggaggtgacagccagccaggtggccgccaccaagaccctgcccaacggcagagatgccctggatggccctgctgctgaggccgagcctgagcacagctttgatggcctgcggaggaaggtgtctgcccagaggctgcaggaggccggcatcctgtctgctgaggagctgcagaggctggcccagggccacaccaccgtggatgagctggcccggcgggaggatgtgcgccactacctgcagggccgcagcagcattgctggcctgctgctgaaggccaccaatgagaagctgtctgtgtatgctgccctgcagaggcagctgctgagccctggaacagccctgatcctgctggaggcccaggccgccagcggcttcctgctggaccctgtgaggaacagaaggctgactgtgaatgaagctgtgaaggagggcgtggtgggccctgagctgcaccacaagctgctgtctgctgagagagctgtgacaggctacaaggacccctacacaggccagcagatcagcctcttccaggccatgcagaagggcctgattgtgcgggagcacggcatccggctgctggaggcccagatcgccaccggcggcgtcatcgaccctgtgcacagccaccgggtgcctgtggatgtggcctacagaagaggctactttgatgaggagatgaacagagtgctggccgaccccagtgatgacaccaagggcttctttgaccccaacacccatgagaacctgacctacctgcagctgctggagcgctgtgtggaggaccctgagaccggcctgtgcctgctgcccctgacagacaaggccgccaagggcggggagctggtgtacacagattctgaggccagagatgtgtttgagaaggccaccgtgtctgccccctttgggaagttccagggcaagacagtgaccatctgggagatcatcaacagcgagtacttcaccgctgagcagaggcgggacctgctgcggcagttcagaacaggccgcatcaccgtggagaagatcatcaagatcatcatcaccgtggtggaggagcaggagcagaagggccgcctgtgctttgagggcctgcggagcctggtgcctgctgctgagctgctggagagcagggtcatcgaccgggagctgtaccagcagctgcagagaggagagaggtctgtgagagatgtggccgaggtggacacagtgagaagagccctgcggggggccaacgtgattgctggggtgtggctggaggaggccggccagaagctgagcatctacaatgccctgaagaaggacctgctgcccagcgacatggctgtggccctgctggaggcccaggccggcaccggccacatcatcgaccctgccaccagcgcccggctgactgtggatgaagctgtgcgggccggcctggtgggccctgagttccacgagaagctgctgtctgctgagaaggctgtgacaggctacagagacccctacacaggccagagcgtgtccctcttccaggccctgaagaagggcctcatcccccgggagcagggcctgcggctgctggatgcccagctgagcactggaggcatcgtggaccccagcaagagccaccgggtgcccctggatgtggcctgtgcccggggctgcctggatgaggagaccagccgggccctgagcgcccccagggcagatgccaaggcctacagcgaccccagcactggagagcccgccacctacggggagctgcagcagcgctgcaggccagaccagctgaccggcctgagcctgctgcccctgtctgagaaggccgcccgggcccggcaggaggagctgtacagcgagctgcaggcccgggagacctttgagaagacccctgtggaggtgcctgtgggcggcttcaagggccgcacagtgacagtgtgggagctgatcagcagcgagtacttcaccgctgagcagaggcaggagctgctgcggcagttcagaacaggcaaggtgacagtggagaaggtgatcaagatcctgatcaccatcgtggaggaggtggagaccctgcggcaggagcggctgtccttcagcggcctgcgggcccctgtgcctgccagcgagctgctggccagcggcgtgctgagccgggcccagtttgagcagctgaaggatggcaagaccaccgtgaaggacctgtctgagctgggctctgtgaggaccctgctgcagggcagcggctgcctggccggcatctacctggaggacaccaaggagaaggtgtccatctatgaggccatgaggcggggcctgctgcgggccaccacagctgccctgctgctggaggcccaggccgccaccggcttcctggtggaccctgtgaggaaccagaggctgtatgtgcatgaggccgtgaaggccggcgtggtgggccctgagctgcacgagcagctgctgtctgctgagaaggctgtgacaggctacagagacccctacagcggcagcaccatcagcctcttccaggccatgcagaagggcctggtgctgcggcagcacggcatccggctgctggaggcccagatcgccactggaggcatcattgatcctgtgcacagccaccgggtgcctgtggatgtggcctaccagaggggctacttcagcgaggagatgaacagagtgctggccgaccccagtgatgacaccaagggcttctttgaccccaacacccatgagaacctgacctaccggcagctgctggagcgctgtgtggaggaccctgagaccggcctgcggctgctgcccctgaagggagctgagaaggccgaggtggtggagaccacccaggtgtacacagaggaggagacccggcgggcctttgaggagacccagattgacatccctgggggcggcagccacggcggcagcaccatgagcctgtgggaggtgatgcagagcgacctgatccctgaggagcagagggcccagctgatggctgacttccaggccggccgggtgaccaaggagaggatgatcatcatcatcatcgagatcatcgagaagacagagatcatccggcagcagggcctggccagctatgactatgtgagaagaaggctgacagctgaggacctgtttgaggcccgcatcatcagcctggagacctacaacctgctgcgggagggcaccaggagcctgcgggaggccctggaggccgagagcgcctggtgctacctgtatggaactggatctgtggccggcgtgtacctgcccggcagccggcagaccctgagcatctaccaggccctgaagaagggcctgctgtctgctgaggtggcccggctgctgctggaggcccaggccgccaccggcttcctgctggaccctgtgaagggggagcggctgactgtggatgaagctgtgaggaagggcctggtgggccctgagctgcatgaccggctgctgtctgctgagagagctgtgacaggctacagagacccctacacagagcagaccatcagcctcttccaggccatgaagaaggagctgatccccacagaggaggccctgcggctgctggatgcccagctggccaccggcggcatcgtggacccccggctgggcttccacctgcccctggaggtggcctaccagaggggctacctgaacaaggacacccatgaccagctgtctgagcccagcgaggtgcgctcctatgtggaccccagcacagatgagcggctgagctacacccagctgctgcggcgctgcagaagagatgatggcaccggccagctgctgctgcccctgagtgatgccaggaagctgaccttccggggcctgaggaagcagatcaccatggaggagctggtgcgcagccaggtgatggatgaggccacagccctgcagctgcgggagggcctgaccagcattgaggaggtgaccaagaacctgcagaagttcctggagggcaccagctgcatcgccggcgtgtttgtggatgccaccaaggagcggctgtctgtgtaccaggccatgaagaagggcatcatccggcccggcacagcctttgagctgctggaggcccaggccgccaccggctacgtgattgaccccatcaagggcctgaagctgactgtggaggaggccgtgaggatgggcatcgtgggccctgagttcaaggacaagctgctgtctgctgagagagctgtgacaggctacaaggacccctacagcggcaagctgatcagcctcttccaggccatgaagaagggcctcatcctgaaggaccacggcatccggctgctggaggcccagatcgccactggaggcatcattgatcctgaggagagccaccggctgcctgtggaggtggcctacaagaggggcctgtttgatgaggagatgaatgagatcctgacagaccccagtgatgacaccaagggcttctttgaccccaacacagaggagaacctgacctacctgcagctgatggagcgctgcatcacagacccccagacaggcctgtgcctgctgcccctgaaggagaagaagcgggagaggaagaccagcagcaagagctctgtgaggaagagaagagtggtgattgtggaccctgagaccgggaaggagatgtctgtgtatgaggcctacaggaagggcctgattgaccaccagacctacctggagctgtctgagcaggagtgtgagtgggaggagatcaccatcagcagcagtgatggagtggtgaagtccatgatcatcgacagaagaagtggccggcagtatgacattgatgatgccatcgccaagaacctgattgacagaagtgccctggaccagtaccgggccggcaccctgagcatcacagaatttgctgacatgctgtctggaaatgctgggggcttccgcagccgcagcagctctgtgggcagcagcagcagctaccccatcagccctgctgtgtccaggacccagctggcctcctggagcgaccccacagaggagactggacctgtggccggcatcctggacacagagaccctggagaaggtgtccatcacagaggccatgcacaggaacctggtggacaacatcaccggccagaggctgctggaggcccaggcctgcaccggcggcatcatcgaccccagcactggagagcgcttccctgtgacagatgctgtgaacaagggcctggtggacaagatcatggtggaccgcatcaacctggcccagaaggccttctgtggctttgaggaccccaggaccaagaccaagatgtctgctgcccaggccctgaagaagggctggctgtactatgaagctggccagcgcttcctggaggtgcagtacctgaccggcggcctcatcgagccagacaccccaggccgggtgcccctggatgaggccctgcagaggggcaccgtggatgccaggacagcccagaagctgagagatgtgggcgcctacagcaagtacctgacctgccccaagaccaagctgaagatctcctacaaggatgccctggaccgctccatggtggaggagggcaccggcctgcggctgctggaggccgccgcccagagcaccaagggctactacagcccctacagcgtgtctggcagcggcagcacagctggcagcaggacaggcagcaggacaggcagcagagctggcagccggcggggcagctttgatgccactggaagtggcttctccatgaccttcagcagcagcagctacagcagcagcggctatggaagaagatatgccagcggcagcagcgccagcctgggcggccctgagagcgctgtggcctag

SEQ ID NO: 164413 - DNA, 13578 bp, Artificial Sequence
  Description of Artificial Sequence: Synthetic coding sequence
atggaccccagccgggccatccagaatgagatcagcagcctgaaggatgagcgggacagagtgcagaagaagaccttcaccaagtgggtgaacaagcacctgatcaaggcccagaggcacatcagtgacctgtatgaggacctgagagatggccacaacctgatcagcctgctggaggtgctgagcggggacagcctgccccgggagaagggccgcatgaggttccacaagctgcagaatgtgcagatcgccctggactacctgcggcaccggcaggtgaagctggtgaacatcagaaatgatgacattgctgatggcaaccccaagctgaccctgggcctcatctggaccatcatcctgcacttccagatcagtgacatccaggtgtctggccagagcgaggacatgacagccaaggagaagctgctgctgtggagccagaggatggtggagggctaccagggcctgcgctgtgacaacttcaccagctcctggagagatggccgcctcttcaatgccatcatccaccgccacaagcccctgctgattgacatgaacaaggtgtaccggcagaccaacctggagaacctggaccaggccttctctgtggccgagcgggacctgggcgtgacccggctgctggaccctgaagatgtggatgtgccccagccagatgagaagagcatcatcacctacgtgagcagcctgtatgatgccatgccccgggtgcctgatgtgcaggatggagtgcgggccaatgagctgcagctgcgctggcaggagtaccgggagctggtgctgctgctgctgcagtggatgaggcaccacacagctgcctttgaggagcggcgcttccccagcagctttgaggagattgagatcctgtggagccagttcctgaagttcaaggagatggagctgcctgccaaggaggccgacaagaacagaagcaagggcatctaccagagcctggagggcgctgtgcaggccggccagctgaaggtgcccccaggctaccaccccctggatgtggagaaggagtggggcaagctgcacgtggccatcctggagcgggagaagcagctgcggagtgaatttgagcggctggagtgcctgcagagaattgtgaccaagctgcagatggaggccggcctgtgtgaggagcagctgaaccaggctgatgccctgctgcagagtgatgtgcggctgctggccgccggcaaggtgccccagagagctggggaggtggagcgggacctggacaaggctgacagcatgatccggctgctcttcaatgatgtgcagaccctgaaggatggccgccacccccagggcgagcagatgtaccgccgggtgtaccgcctgcacgagcggctggtggccatcagaacagagtacaacctgcggctgaaggccggcgtggccgccccagccacccaggtggcccaggtgaccctgcagagcgtgcagaggaggcctgagctggaggacagcaccctgcgctacctgcaggacctgctggcctgggtggaggagaaccagcaccgggtggatggagctgagtggggcgtggacctgcccagcgtggaggcccagctgggcagccaccggggcctgcaccagagcattgaggagttccgggccaagattgaaagagcccggagtgatgagggccagctgagccctgccaccaggggggcctacagagactgcctgggccgcctggacctgcagtatgccaagctgctgaacagcagcaaggcccggctgcggagcctggagagcctgcacagctttgtggccgccgccaccaaggagctgatgtggctgaatgagaaggaggaggaggaggtgggctttgactggagcgacaggaacaccaacatgacagccaagaaggagagctacagcgccctgatgagggagctggagctgaaggagaagaagatcaaggagctgcagaatgctggggaccggctgctgcgggaggaccacccagcccggcccaccgtggagagcttccaggccgccctgcagacccagtggagctggatgctgcagctgtgctgctgcatcgaggcccacctgaaggaaaatgctgcctacttccagttcttcagtgatgtgcgggaggccgagggccagctgcagaagctgcaggaggccctgcggaggaagtacagctgtgacagaagtgccaccgtgacccggctggaggacctgctgcaggatgcccaggatgagaaggagcagctgaatgagtacaagggccacctgagcggcctggccaagagggccaaggctgtggtgcagctgaagcccaggcacccagcccaccccatgaggggccgcctgcccctgctggccgtgtgtgactacaagcaggtggaggtgacagtgcacaagggagatgagtgccagctggtgggccctgcccagcccagccactggaaggtgctgagcagcagcggcagcgaggccgctgtgcccagcgtgtgcttcctggtgcccccacccaaccaggaggcccaggaggccgtgacccggctggaggcccagcaccaggccctggtgaccctgtggcaccagctgcacgtggacatgaagagcctgctggcctggcagagcctgcggagagatgtgcagctgatccgctcctggagcctggccaccttccgcaccctgaagccagaggagcagaggcaggccctgcacagcctggagctgcactaccaggccttcctgcgggacagccaggatgctgggggcttcggcccagaagatcggctgatggccgagcgggagtatggcagctgcagccaccactaccagcagctgctgcagagcctggagcagggcgcccaggaggagagccgctgccagcgctgcatcagcgagctgaaggacatccggctgcagctggaggcctgtgagaccaggacagtgcaccggctgcggctgcccctggacaaggagcccgcccgggagtgtgcccagagaattgctgagcagcagaaggcccaggccgaggtggagggcctgggcaagggcgtggcccggctgtctgctgaggccgagaaggtgctggccctgcctgagcccagccctgctgcccccaccctgcggtctgagctggagctgaccctgggcaagctggagcaggtgcgcagcctgagcgccatctacctggagaagctgaagaccatcagcctggtgatccggggcacccagggcgctgaggaggtgctgcgggcccacgaggagcagctgaaggaggcccaggccgtgcctgccaccctgcctgagctggaggccaccaaggccagcctgaagaagctgcgggcccaggccgaggcccagcagcccacctttgatgccctgagagatgagctgcggggggcccaggaggtgggggagcggctgcagcagagacatggagagagagatgtggaggtggagcgctggagggagcgggtggcccagctgctggagcgctggcaggccgtgctggcccagacagatgtgcggcagcgggagctggagcagctgggccggcagctgcgctactaccgggagagcgctgaccccctgggcgcctggctgcaggatgcccggcggcggcaggagcagatccaggccatgcccctggccgacagccaggccgtgcgggagcagctgcggcaggagcaggccctgctggaggagattgaaagacatggagagaaggtggaggagtgccagagatttgccaagcagtacatcaatgccatcaaggactatgagctgcagctggtgacctacaaggcccagctggagcctgtggccagccctgccaagaagcccaaggtgcagagcggcagcgagagcgtcatccaggagtatgtggacctgcggacccactacagcgagctgaccaccctgaccagccagtacatcaagttcatcagcgagaccctgcggaggatggaggaggaggagcggctggccgagcagcagagagctgaggagcgggagcggctggccgaggtggaggccgccctggagaagcagaggcagctggccgaggcccacgcccaggccaaggcccaggccgagcgggaggccaaggagctgcagcagaggatgcaggaggaggtggtgagaagagaggaggccgctgtggatgcccagcagcagaagaggagcatccaggaggagctgcagcagctgcggcagagcagcgaggccgagatccaggccaaggcccggcaggccgaggccgctgagaggagccggctgcgcatcgaggaggagatccgggtggtgcggctgcagctggaggccacagagcggcagagaggaggagctgagggggagctgcaggccctgcgggcccgggcagaggaggccgaggcccagaagaggcaggcccaggaggaggccgagcggctgcggcggcaggtgcaggatgagagccagaggaagaggcaggccgaggtggagctggccagccgggtgaaggccgaggccgaggccgcccgggagaagcagagggccctgcaggccctggaggagctgcggctgcaggccgaggaggccgagcggcggctgcggcaggccgaggtggagcgggcccggcaggtgcaggtggccctggagacagcccagaggtctgctgaggccgagctgcagagcaagagggccagctttgctgagaagacagcccagctggagaggagcctgcaggaggagcacgtggccgtggcccagctgcgggaggaggccgagcggcgggcccagcagcaggccgaggccgagcgggcccgggaggaggccgagcgggagctggagcgctggcagctgaaggccaatgaggccctgcggctgcggctgcaggccgaggaggtggcccagcagaagagcctggcccaggccgaggccgagaagcagaaggaggaggccgagcgggaggccaggagaagaggcaaggccgaggagcaggccgtgcggcagcgggagctggccgagcaggagctggagaagcagaggcagctggccgagggcacagcccagcagaggctggccgctgagcaggagctgatccggctgcgggcagagacagagcagggcgagcagcagaggcagctgctggaggaggagctggcccggctgcagcgggaggccgctgctgccacccagaagaggcaggagctggaggccgagctggccaaggtgcgggcagagatggaggtgctgctggccagcaaggcccgggcagaggaggagagccgcagcaccagcgagaagagcaagcagaggctggaggccgaggccggccgcttccgggagctggccgaggaggccgcccggctgcgggccctggccgaggaggccaagaggcagaggcagctggccgaggaggatgctgcccggcagagagctgaggccgagcgggtgctggccgagaagctggccgccatcggggaggccacccggctgaagacagaggccgagatcgccctgaaggagaaggaggccgagaatgaaaggctgcggcggctggctgaagatgaggccttccagaggcggcggctggaggagcaggccgcccagcacaaggctgacatcgaggagcggctggcccagctgaggaaggccagtgacagcgagctggagcggcagaagggcctggtggaggacaccctgcggcagaggcggcaggtggaggaggagatcctggccctgaaggccagctttgagaaggctgctgctgggaaggccgagctggagctggagctgggccgcatccgcagcaatgctgaggacaccctgcggagcaaggagcaggccgagctggaggccgcccggcagaggcagctggccgctgaggaggagaggagaagaagagaggccgaggagcgggtgcagaagagcctggccgctgaggaggaggccgcccggcagaggaaggccgccctggaggaggtggagcggctgaaggccaaggtggaggaggcccggcggctgcgggagcgggcagagcaggagagcgcccggcagctgcagctggcccaggaggccgcccagaagaggctgcaggccgaggagaaggcccacgcctttgctgtgcagcagaaggagcaggagctgcagcagaccctgcagcaggagcagagcgtgctggaccagctgcggggggaggccgaggccgccaggagagctgctgaggaggccgaggaggcccgggtgcaggccgagcgggaggccgcccagagccggcggcaggtggaggaggccgagcggctgaagcagagcgctgaggagcaggcccaggcccgggcccaggcccaggccgctgctgagaagctgaggaaggaggccgagcaggaggccgcccggcgggcccaggccgagcaggccgccctgcggcagaagcaggccgcagatgctgagatggagaagcacaagaagtttgctgagcagaccctgcggcagaaggcccaggtggagcaggagctgaccaccctgcggctgcagctggaggagacagaccaccagaagaacctgctggatgaggagctgcagaggctgaaggccgaggccacagaagctgcccggcagaggagccaggtggaggaggagctgttctctgtgcgggtgcagatggaggagctgagcaagctgaaggccagaattgaagctgagaacagagccctgatcctgcgggacaaggacaacacccagcgcttcctgcaggaggaggccgagaagatgaagcaggtggccgaggaggccgcccggctgtctgtggccgcccaggaggccgcccggctgcggcagctggccgaggaggacctggcccagcagagggccctggccgagaagatgctgaaggagaagatgcaggccgtgcaggaggccacccggctgaaggccgaggccgagctgctgcagcagcagaaggagctggcccaggagcaggcccggcggctgcaggaggacaaggagcagatggcccagcagctggccgaggagacccagggcttccagaggaccctggaggccgagcggcagaggcagctggagatgtctgctgaggccgagcggctgaagctgcgggtggccgagatgagccgggcccaggcccgggcagaagaagatgcccagcgcttcaggaagcaggccgaggagattggagagaagctgcacaggacagagctggccacccaggagaaggtgaccctggtgcagaccctggagatccagaggcagcagagcgaccatgatgctgagcggctgcgggaggccatcgccgagctggagcgggagaaggagaagctgcagcaggaggccaagctgctgcagctgaagtctgaggagatgcagacagtgcagcaggagcagctgctgcaggagacccaggccctgcagcagagcttcctgtctgagaaggacagcctgctgcagcgggagcgcttcatcgagcaggagaaggccaagctggagcagctgttccaggatgaggtggccaaggcccagcagctgcgggaggagcagcagaggcagcagcagcagatggagcaggagcggcagaggctggtggcctccatggaggaggcccggcggcggcagcacgaggccgaggagggcgtgcggaggaagcaggaggagctgcagcagctggagcagcagaggcggcagcaggaggagctgctggccgaggagaaccagaggctgcgggagcagctgcagctgctggaggagcagcacagagctgccctggcccacagcgaggaggtgacagccagccaggtggccgccaccaagaccctgcccaacggcagagatgccctggatggccctgctgctgaggccgagcctgagcacagctttgatggcctgcggaggaaggtgtctgcccagaggctgcaggaggccggcatcctgtctgctgaggagctgcagaggctggcccagggccacaccaccgtggatgagctggcccggcgggaggatgtgcgccactacctgcagggccgcagcagcattgctggcctgctgctgaaggccaccaatgagaagctgtctgtgtatgctgccctgcagaggcagctgctgagccctggaacagccctgatcctgctggaggcccaggccgccagcggcttcctgctggaccctgtgaggaacagaaggctgactgtgaatgaagctgtgaaggagggcgtggtgggccctgagctgcaccacaagctgctgtctgctgagagagctgtgacaggctacaaggacccctacacaggccagcagatcagcctcttccaggccatgcagaagggcctgattgtgcgggagcacggcatccggctgctggaggcccagatcgccaccggcggcgtcatcgaccctgtgcacagccaccgggtgcctgtggatgtggcctacagaagaggctactttgatgaggagatgaacagagtgctggccgaccccagtgatgacaccaagggcttctttgaccccaacacccatgagaacctgacctacctgcagctgctggagcgctgtgtggaggaccctgagaccggcctgtgcctgctgcccctgacagacaaggccgccaagggcggggagctggtgtacacagattctgaggccagagatgtgtttgagaaggccaccgtgtctgccccctttgggaagttccagggcaagacagtgaccatctgggagatcatcaacagcgagtacttcaccgctgagcagaggcgggacctgctgcggcagttcagaacaggccgcatcaccgtggagaagatcatcaagatcatcatcaccgtggtggaggagcaggagcagaagggccgcctgtgctttgagggcctgcggagcctggtgcctgctgctgagctgctggagagcagggtcatcgaccgggagctgtaccagcagctgcagagaggagagaggtctgtgagagatgtggccgaggtggacacagtgagaagagccctgcggggggccaacgtgattgctggggtgtggctggaggaggccggccagaagctgagcatctacaatgccctgaagaaggacctgctgcccagcgacatggctgtggccctgctggaggcccaggccggcaccggccacatcatcgaccctgccaccagcgcccggctgactgtggatgaagctgtgcgggccggcctggtgggccctgagttccacgagaagctgctgtctgctgagaaggctgtgacaggctacagagacccctacacaggccagagcgtgtccctcttccaggccctgaagaagggcctcatcccccgggagcagggcctgcggctgctggatgcccagctgagcactggaggcatcgtggaccccagcaagagccaccgggtgcccctggatgtggcctgtgcccggggctgcctggatgaggagaccagccgggccctgagcgcccccagggcagatgccaaggcctacagcgaccccagcactggagagcccgccacctacggggagctgcagcagcgctgcaggccagaccagctgaccggcctgagcctgctgcccctgtctgagaaggccgcccgggcccggcaggaggagctgtacagcgagctgcaggcccgggagacctttgagaagacccctgtggaggtgcctgtgggcggcttcaagggccgcacagtgacagtgtgggagctgatcagcagcgagtacttcaccgctgagcagaggcaggagctgctgcggcagttcagaacaggcaaggtgacagtggagaaggtgatcaagatcctgatcaccatcgtggaggaggtggagaccctgcggcaggagcggctgtccttcagcggcctgcgggcccctgtgcctgccagcgagctgctggccagcggcgtgctgagccgggcccagtttgagcagctgaaggatggcaagaccaccgtgaaggacctgtctgagctgggctctgtgaggaccctgctgcagggcagcggctgcctggccggcatctacctggaggacaccaaggagaaggtgtccatctatgaggccatgaggcggggcctgctgcgggccaccacagctgccctgctgctggaggcccaggccgccaccggcttcctggtggaccctgtgaggaaccagaggctgtatgtgcatgaggccgtgaaggccggcgtggtgggccctgagctgcacgagcagctgctgtctgctgagaaggctgtgacaggctacagagacccctacagcggcagcaccatcagcctcttccaggccatgcagaagggcctggtgctgcggcagcacggcatccggctgctggaggcccagatcgccactggaggcatcattgatcctgtgcacagccaccgggtgcctgtggatgtggcctaccagaggggctacttcagcgaggagatgaacagagtgctggccgaccccagtgatgacaccaagggcttctttgaccccaacacccatgagaacctgacctaccggcagctgctggagcgctgtgtggaggaccctgagaccggcctgcggctgctgcccctgaagggagctgagaaggccgaggtggtggagaccacccaggtgtacacagaggaggagacccggcgggcctttgaggagacccagattgacatccctgggggcggcagccacggcggcagcaccatgagcctgtgggaggtgatgcagagcgacctgatccctgaggagcagagggcccagctgatggctgacttccaggccggccgggtgaccaaggagaggatgatcatcatcatcatcgagatcatcgagaagacagagatcatccggcagcagggcctggccagctatgactatgtgagaagaaggctgacagctgaggacctgtttgaggcccgcatcatcagcctggagacctacaacctgctgcgggagggcaccaggagcctgcgggaggccctggaggccgagagcgcctggtgctacctgtatggaactggatctgtggccggcgtgtacctgcccggcagccggcagaccctgagcatctaccaggccctgaagaagggcctgctgtctgctgaggtggcccggctgctgctggaggcccaggccgccaccggcttcctgctggaccctgtgaagggggagcggctgactgtggatgaagctgtgaggaagggcctggtgggccctgagctgcatgaccggctgctgtctgctgagagagctgtgacaggctacagagacccctacacagagcagaccatcagcctcttccaggccatgaagaaggagctgatccccacagaggaggccctgcggctgctggatgcccagctggccaccggcggcatcgtggacccccggctgggcttccacctgcccctggaggtggcctaccagaggggctacctgaacaaggacacccatgaccagctgtctgagcccagcgaggtgcgctcctatgtggaccccagcacagatgagcggctgagctacacccagctgctgcggcgctgcagaagagatgatggcaccggccagctgctgctgcccctgagtgatgccaggaagctgaccttccggggcctgaggaagcagatcaccatggaggagctggtgcgcagccaggtgatggatgaggccacagccctgcagctgcgggagggcctgaccagcattgaggaggtgaccaagaacctgcagaagttcctggagggcaccagctgcatcgccggcgtgtttgtggatgccaccaaggagcggctgtctgtgtaccaggccatgaagaagggcatcatccggcccggcacagcctttgagctgctggaggcccaggccgccaccggctacgtgattgaccccatcaagggcctgaagctgactgtggaggaggccgtgaggatgggcatcgtgggccctgagttcaaggacaagctgctgtctgctgagagagctgtgacaggctacaaggacccctacagcggcaagctgatcagcctcttccaggccatgaagaagggcctcatcctgaaggaccacggcatccggctgctggaggcccagatcgccactggaggcatcattgatcctgaggagagccaccggctgcctgtggaggtggcctacaagaggggcctgtttgatgaggagatgaatgagatcctgacagaccccagtgatgacaccaagggcttctttgaccccaacacagaggagaacctgacctacctgcagctgatggagcgctgcatcacagacccccagacaggcctgtgcctgctgcccctgaaggagaagaagcgggagaggaagaccagcagcaagagctctgtgaggaagagaagagtggtgattgtggaccctgagaccgggaaggagatgtctgtgtatgaggcctacaggaagggcctgattgaccaccagacctacctggagctgtctgagcaggagtgtgagtgggaggagatcaccatcagcagcagtgatggagtggtgaagtccatgatcatcgacagaagaagtggccggcagtatgacattgatgatgccatcgccaagaacctgattgacagaagtgccctggaccagtaccgggccggcaccctgagcatcacagaatttgctgacatgctgtctggaaatgctgggggcttccgcagccgcagcagctctgtgggcagcagcagcagctaccccatcagccctgctgtgtccaggacccagctggcctcctggagcgaccccacagaggagactggacctgtggccggcatcctggacacagagaccctggagaaggtgtccatcacagaggccatgcacaggaacctggtggacaacatcaccggccagaggctgctggaggcccaggcctgcaccggcggcatcatcgaccccagcactggagagcgcttccctgtgacagatgctgtgaacaagggcctggtggacaagatcatggtggaccgcatcaacctggcccagaaggccttctgtggctttgaggaccccaggaccaagaccaagatgtctgctgcccaggccctgaagaagggctggctgtactatgaagctggccagcgcttcctggaggtgcagtacctgaccggcggcctcatcgagccagacaccccaggccgggtgcccctggatgaggccctgcagaggggcaccgtggatgccaggacagcccagaagctgagagatgtgggcgcctacagcaagtacctgacctgccccaagaccaagctgaagatctcctacaaggatgccctggaccgctccatggtggaggagggcaccggcctgcggctgctggaggccgccgcccagagcaccaagggctactacagcccctacagcgtgtctggcagcggcagcacagctggcagcaggacaggcagcaggacaggcagcagagctggcagccggcggggcagctttgatgccactggaagtggcttctccatgaccttcagcagcagcagctacagcagcagcggctatggaagaagatatgccagcggcagcagcgccagcctgggcggccctgagagcgctgtggcctag

SEQ ID NO: 164414 - DNA, 13602 bp, Artificial Sequence
  Description of Artificial Sequence: Synthetic coding sequence
atggccggccccctgcctgatgagcaggacttcatccaggcctatgaggaggtgcgggagaagtacaaggatgagcgggacagagtgcagaagaagaccttcaccaagtgggtgaacaagcacctgatcaaggcccagaggcacatcagtgacctgtatgaggacctgagagatggccacaacctgatcagcctgctggaggtgctgagcggggacagcctgccccgggagaagggccgcatgaggttccacaagctgcagaatgtgcagatcgccctggactacctgcggcaccggcaggtgaagctggtgaacatcagaaatgatgacattgctgatggcaaccccaagctgaccctgggcctcatctggaccatcatcctgcacttccagatcagtgacatccaggtgtctggccagagcgaggacatgacagccaaggagaagctgctgctgtggagccagaggatggtggagggctaccagggcctgcgctgtgacaacttcaccagctcctggagagatggccgcctcttcaatgccatcatccaccgccacaagcccctgctgattgacatgaacaaggtgtaccggcagaccaacctggagaacctggaccaggccttctctgtggccgagcgggacctgggcgtgacccggctgctggaccctgaagatgtggatgtgccccagccagatgagaagagcatcatcacctacgtgagcagcctgtatgatgccatgccccgggtgcctgatgtgcaggatggagtgcgggccaatgagctgcagctgcgctggcaggagtaccgggagctggtgctgctgctgctgcagtggatgaggcaccacacagctgcctttgaggagcggcgcttccccagcagctttgaggagattgagatcctgtggagccagttcctgaagttcaaggagatggagctgcctgccaaggaggccgacaagaacagaagcaagggcatctaccagagcctggagggcgctgtgcaggccggccagctgaaggtgcccccaggctaccaccccctggatgtggagaaggagtggggcaagctgcacgtggccatcctggagcgggagaagcagctgcggagtgaatttgagcggctggagtgcctgcagagaattgtgaccaagctgcagatggaggccggcctgtgtgaggagcagctgaaccaggctgatgccctgctgcagagtgatgtgcggctgctggccgccggcaaggtgccccagagagctggggaggtggagcgggacctggacaaggctgacagcatgatccggctgctcttcaatgatgtgcagaccctgaaggatggccgccacccccagggcgagcagatgtaccgccgggtgtaccgcctgcacgagcggctggtggccatcagaacagagtacaacctgcggctgaaggccggcgtggccgccccagccacccaggtggcccaggtgaccctgcagagcgtgcagaggaggcctgagctggaggacagcaccctgcgctacctgcaggacctgctggcctgggtggaggagaaccagcaccgggtggatggagctgagtggggcgtggacctgcccagcgtggaggcccagctgggcagccaccggggcctgcaccagagcattgaggagttccgggccaagattgaaagagcccggagtgatgagggccagctgagccctgccaccaggggggcctacagagactgcctgggccgcctggacctgcagtatgccaagctgctgaacagcagcaaggcccggctgcggagcctggagagcctgcacagctttgtggccgccgccaccaaggagctgatgtggctgaatgagaaggaggaggaggaggtgggctttgactggagcgacaggaacaccaacatgacagccaagaaggagagctacagcgccctgatgagggagctggagctgaaggagaagaagatcaaggagctgcagaatgctggggaccggctgctgcgggaggaccacccagcccggcccaccgtggagagcttccaggccgccctgcagacccagtggagctggatgctgcagctgtgctgctgcatcgaggcccacctgaaggaaaatgctgcctacttccagttcttcagtgatgtgcgggaggccgagggccagctgcagaagctgcaggaggccctgcggaggaagtacagctgtgacagaagtgccaccgtgacccggctggaggacctgctgcaggatgcccaggatgagaaggagcagctgaatgagtacaagggccacctgagcggcctggccaagagggccaaggctgtggtgcagctgaagcccaggcacccagcccaccccatgaggggccgcctgcccctgctggccgtgtgtgactacaagcaggtggaggtgacagtgcacaagggagatgagtgccagctggtgggccctgcccagcccagccactggaaggtgctgagcagcagcggcagcgaggccgctgtgcccagcgtgtgcttcctggtgcccccacccaaccaggaggcccaggaggccgtgacccggctggaggcccagcaccaggccctggtgaccctgtggcaccagctgcacgtggacatgaagagcctgctggcctggcagagcctgcggagagatgtgcagctgatccgctcctggagcctggccaccttccgcaccctgaagccagaggagcagaggcaggccctgcacagcctggagctgcactaccaggccttcctgcgggacagccaggatgctgggggcttcggcccagaagatcggctgatggccgagcgggagtatggcagctgcagccaccactaccagcagctgctgcagagcctggagcagggcgcccaggaggagagccgctgccagcgctgcatcagcgagctgaaggacatccggctgcagctggaggcctgtgagaccaggacagtgcaccggctgcggctgcccctggacaaggagcccgcccgggagtgtgcccagagaattgctgagcagcagaaggcccaggccgaggtggagggcctgggcaagggcgtggcccggctgtctgctgaggccgagaaggtgctggccctgcctgagcccagccctgctgcccccaccctgcggtctgagctggagctgaccctgggcaagctggagcaggtgcgcagcctgagcgccatctacctggagaagctgaagaccatcagcctggtgatccggggcacccagggcgctgaggaggtgctgcgggcccacgaggagcagctgaaggaggcccaggccgtgcctgccaccctgcctgagctggaggccaccaaggccagcctgaagaagctgcgggcccaggccgaggcccagcagcccacctttgatgccctgagagatgagctgcggggggcccaggaggtgggggagcggctgcagcagagacatggagagagagatgtggaggtggagcgctggagggagcgggtggcccagctgctggagcgctggcaggccgtgctggcccagacagatgtgcggcagcgggagctggagcagctgggccggcagctgcgctactaccgggagagcgctgaccccctgggcgcctggctgcaggatgcccggcggcggcaggagcagatccaggccatgcccctggccgacagccaggccgtgcgggagcagctgcggcaggagcaggccctgctggaggagattgaaagacatggagagaaggtggaggagtgccagagatttgccaagcagtacatcaatgccatcaaggactatgagctgcagctggtgacctacaaggcccagctggagcctgtggccagccctgccaagaagcccaaggtgcagagcggcagcgagagcgtcatccaggagtatgtggacctgcggacccactacagcgagctgaccaccctgaccagccagtacatcaagttcatcagcgagaccctgcggaggatggaggaggaggagcggctggccgagcagcagagagctgaggagcgggagcggctggccgaggtggaggccgccctggagaagcagaggcagctggccgaggcccacgcccaggccaaggcccaggccgagcgggaggccaaggagctgcagcagaggatgcaggaggaggtggtgagaagagaggaggccgctgtggatgcccagcagcagaagaggagcatccaggaggagctgcagcagctgcggcagagcagcgaggccgagatccaggccaaggcccggcaggccgaggccgctgagaggagccggctgcgcatcgaggaggagatccgggtggtgcggctgcagctggaggccacagagcggcagagaggaggagctgagggggagctgcaggccctgcgggcccgggcagaggaggccgaggcccagaagaggcaggcccaggaggaggccgagcggctgcggcggcaggtgcaggatgagagccagaggaagaggcaggccgaggtggagctggccagccgggtgaaggccgaggccgaggccgcccgggagaagcagagggccctgcaggccctggaggagctgcggctgcaggccgaggaggccgagcggcggctgcggcaggccgaggtggagcgggcccggcaggtgcaggtggccctggagacagcccagaggtctgctgaggccgagctgcagagcaagagggccagctttgctgagaagacagcccagctggagaggagcctgcaggaggagcacgtggccgtggcccagctgcgggaggaggccgagcggcgggcccagcagcaggccgaggccgagcgggcccgggaggaggccgagcgggagctggagcgctggcagctgaaggccaatgaggccctgcggctgcggctgcaggccgaggaggtggcccagcagaagagcctggcccaggccgaggccgagaagcagaaggaggaggccgagcgggaggccaggagaagaggcaaggccgaggagcaggccgtgcggcagcgggagctggccgagcaggagctggagaagcagaggcagctggccgagggcacagcccagcagaggctggccgctgagcaggagctgatccggctgcgggcagagacagagcagggcgagcagcagaggcagctgctggaggaggagctggcccggctgcagcgggaggccgctgctgccacccagaagaggcaggagctggaggccgagctggccaaggtgcgggcagagatggaggtgctgctggccagcaaggcccgggcagaggaggagagccgcagcaccagcgagaagagcaagcagaggctggaggccgaggccggccgcttccgggagctggccgaggaggccgcccggctgcgggccctggccgaggaggccaagaggcagaggcagctggccgaggaggatgctgcccggcagagagctgaggccgagcgggtgctggccgagaagctggccgccatcggggaggccacccggctgaagacagaggccgagatcgccctgaaggagaaggaggccgagaatgaaaggctgcggcggctggctgaagatgaggccttccagaggcggcggctggaggagcaggccgcccagcacaaggctgacatcgaggagcggctggcccagctgaggaaggccagtgacagcgagctggagcggcagaagggcctggtggaggacaccctgcggcagaggcggcaggtggaggaggagatcctggccctgaaggccagctttgagaaggctgctgctgggaaggccgagctggagctggagctgggccgcatccgcagcaatgctgaggacaccctgcggagcaaggagcaggccgagctggaggccgcccggcagaggcagctggccgctgaggaggagaggagaagaagagaggccgaggagcgggtgcagaagagcctggccgctgaggaggaggccgcccggcagaggaaggccgccctggaggaggtggagcggctgaaggccaaggtggaggaggcccggcggctgcgggagcgggcagagcaggagagcgcccggcagctgcagctggcccaggaggccgcccagaagaggctgcaggccgaggagaaggcccacgcctttgctgtgcagcagaaggagcaggagctgcagcagaccctgcagcaggagcagagcgtgctggaccagctgcggggggaggccgaggccgccaggagagctgctgaggaggccgaggaggcccgggtgcaggccgagcgggaggccgcccagagccggcggcaggtggaggaggccgagcggctgaagcagagcgctgaggagcaggcccaggcccgggcccaggcccaggccgctgctgagaagctgaggaaggaggccgagcaggaggccgcccggcgggcccaggccgagcaggccgccctgcggcagaagcaggccgcagatgctgagatggagaagcacaagaagtttgctgagcagaccctgcggcagaaggcccaggtggagcaggagctgaccaccctgcggctgcagctggaggagacagaccaccagaagaacctgctggatgaggagctgcagaggctgaaggccgaggccacagaagctgcccggcagaggagccaggtggaggaggagctgttctctgtgcgggtgcagatggaggagctgagcaagctgaaggccagaattgaagctgagaacagagccctgatcctgcgggacaaggacaacacccagcgcttcctgcaggaggaggccgagaagatgaagcaggtggccgaggaggccgcccggctgtctgtggccgcccaggaggccgcccggctgcggcagctggccgaggaggacctggcccagcagagggccctggccgagaagatgctgaaggagaagatgcaggccgtgcaggaggccacccggctgaaggccgaggccgagctgctgcagcagcagaaggagctggcccaggagcaggcccggcggctgcaggaggacaaggagcagatggcccagcagctggccgaggagacccagggcttccagaggaccctggaggccgagcggcagaggcagctggagatgtctgctgaggccgagcggctgaagctgcgggtggccgagatgagccgggcccaggcccgggcagaagaagatgcccagcgcttcaggaagcaggccgaggagattggagagaagctgcacaggacagagctggccacccaggagaaggtgaccctggtgcagaccctggagatccagaggcagcagagcgaccatgatgctgagcggctgcgggaggccatcgccgagctggagcgggagaaggagaagctgcagcaggaggccaagctgctgcagctgaagtctgaggagatgcagacagtgcagcaggagcagctgctgcaggagacccaggccctgcagcagagcttcctgtctgagaaggacagcctgctgcagcgggagcgcttcatcgagcaggagaaggccaagctggagcagctgttccaggatgaggtggccaaggcccagcagctgcgggaggagcagcagaggcagcagcagcagatggagcaggagcggcagaggctggtggcctccatggaggaggcccggcggcggcagcacgaggccgaggagggcgtgcggaggaagcaggaggagctgcagcagctggagcagcagaggcggcagcaggaggagctgctggccgaggagaaccagaggctgcgggagcagctgcagctgctggaggagcagcacagagctgccctggcccacagcgaggaggtgacagccagccaggtggccgccaccaagaccctgcccaacggcagagatgccctggatggccctgctgctgaggccgagcctgagcacagctttgatggcctgcggaggaaggtgtctgcccagaggctgcaggaggccggcatcctgtctgctgaggagctgcagaggctggcccagggccacaccaccgtggatgagctggcccggcgggaggatgtgcgccactacctgcagggccgcagcagcattgctggcctgctgctgaaggccaccaatgagaagctgtctgtgtatgctgccctgcagaggcagctgctgagccctggaacagccctgatcctgctggaggcccaggccgccagcggcttcctgctggaccctgtgaggaacagaaggctgactgtgaatgaagctgtgaaggagggcgtggtgggccctgagctgcaccacaagctgctgtctgctgagagagctgtgacaggctacaaggacccctacacaggccagcagatcagcctcttccaggccatgcagaagggcctgattgtgcgggagcacggcatccggctgctggaggcccagatcgccaccggcggcgtcatcgaccctgtgcacagccaccgggtgcctgtggatgtggcctacagaagaggctactttgatgaggagatgaacagagtgctggccgaccccagtgatgacaccaagggcttctttgaccccaacacccatgagaacctgacctacctgcagctgctggagcgctgtgtggaggaccctgagaccggcctgtgcctgctgcccctgacagacaaggccgccaagggcggggagctggtgtacacagattctgaggccagagatgtgtttgagaaggccaccgtgtctgccccctttgggaagttccagggcaagacagtgaccatctgggagatcatcaacagcgagtacttcaccgctgagcagaggcgggacctgctgcggcagttcagaacaggccgcatcaccgtggagaagatcatcaagatcatcatcaccgtggtggaggagcaggagcagaagggccgcctgtgctttgagggcctgcggagcctggtgcctgctgctgagctgctggagagcagggtcatcgaccgggagctgtaccagcagctgcagagaggagagaggtctgtgagagatgtggccgaggtggacacagtgagaagagccctgcggggggccaacgtgattgctggggtgtggctggaggaggccggccagaagctgagcatctacaatgccctgaagaaggacctgctgcccagcgacatggctgtggccctgctggaggcccaggccggcaccggccacatcatcgaccctgccaccagcgcccggctgactgtggatgaagctgtgcgggccggcctggtgggccctgagttccacgagaagctgctgtctgctgagaaggctgtgacaggctacagagacccctacacaggccagagcgtgtccctcttccaggccctgaagaagggcctcatcccccgggagcagggcctgcggctgctggatgcccagctgagcactggaggcatcgtggaccccagcaagagccaccgggtgcccctggatgtggcctgtgcccggggctgcctggatgaggagaccagccgggccctgagcgcccccagggcagatgccaaggcctacagcgaccccagcactggagagcccgccacctacggggagctgcagcagcgctgcaggccagaccagctgaccggcctgagcctgctgcccctgtctgagaaggccgcccgggcccggcaggaggagctgtacagcgagctgcaggcccgggagacctttgagaagacccctgtggaggtgcctgtgggcggcttcaagggccgcacagtgacagtgtgggagctgatcagcagcgagtacttcaccgctgagcagaggcaggagctgctgcggcagttcagaacaggcaaggtgacagtggagaaggtgatcaagatcctgatcaccatcgtggaggaggtggagaccctgcggcaggagcggctgtccttcagcggcctgcgggcccctgtgcctgccagcgagctgctggccagcggcgtgctgagccgggcccagtttgagcagctgaaggatggcaagaccaccgtgaaggacctgtctgagctgggctctgtgaggaccctgctgcagggcagcggctgcctggccggcatctacctggaggacaccaaggagaaggtgtccatctatgaggccatgaggcggggcctgctgcgggccaccacagctgccctgctgctggaggcccaggccgccaccggcttcctggtggaccctgtgaggaaccagaggctgtatgtgcatgaggccgtgaaggccggcgtggtgggccctgagctgcacgagcagctgctgtctgctgagaaggctgtgacaggctacagagacccctacagcggcagcaccatcagcctcttccaggccatgcagaagggcctggtgctgcggcagcacggcatccggctgctggaggcccagatcgccactggaggcatcattgatcctgtgcacagccaccgggtgcctgtggatgtggcctaccagaggggctacttcagcgaggagatgaacagagtgctggccgaccccagtgatgacaccaagggcttctttgaccccaacacccatgagaacctgacctaccggcagctgctggagcgctgtgtggaggaccctgagaccggcctgcggctgctgcccctgaagggagctgagaaggccgaggtggtggagaccacccaggtgtacacagaggaggagacccggcgggcctttgaggagacccagattgacatccctgggggcggcagccacggcggcagcaccatgagcctgtgggaggtgatgcagagcgacctgatccctgaggagcagagggcccagctgatggctgacttccaggccggccgggtgaccaaggagaggatgatcatcatcatcatcgagatcatcgagaagacagagatcatccggcagcagggcctggccagctatgactatgtgagaagaaggctgacagctgaggacctgtttgaggcccgcatcatcagcctggagacctacaacctgctgcgggagggcaccaggagcctgcgggaggccctggaggccgagagcgcctggtgctacctgtatggaactggatctgtggccggcgtgtacctgcccggcagccggcagaccctgagcatctaccaggccctgaagaagggcctgctgtctgctgaggtggcccggctgctgctggaggcccaggccgccaccggcttcctgctggaccctgtgaagggggagcggctgactgtggatgaagctgtgaggaagggcctggtgggccctgagctgcatgaccggctgctgtctgctgagagagctgtgacaggctacagagacccctacacagagcagaccatcagcctcttccaggccatgaagaaggagctgatccccacagaggaggccctgcggctgctggatgcccagctggccaccggcggcatcgtggacccccggctgggcttccacctgcccctggaggtggcctaccagaggggctacctgaacaaggacacccatgaccagctgtctgagcccagcgaggtgcgctcctatgtggaccccagcacagatgagcggctgagctacacccagctgctgcggcgctgcagaagagatgatggcaccggccagctgctgctgcccctgagtgatgccaggaagctgaccttccggggcctgaggaagcagatcaccatggaggagctggtgcgcagccaggtgatggatgaggccacagccctgcagctgcgggagggcctgaccagcattgaggaggtgaccaagaacctgcagaagttcctggagggcaccagctgcatcgccggcgtgtttgtggatgccaccaaggagcggctgtctgtgtaccaggccatgaagaagggcatcatccggcccggcacagcctttgagctgctggaggcccaggccgccaccggctacgtgattgaccccatcaagggcctgaagctgactgtggaggaggccgtgaggatgggcatcgtgggccctgagttcaaggacaagctgctgtctgctgagagagctgtgacaggctacaaggacccctacagcggcaagctgatcagcctcttccaggccatgaagaagggcctcatcctgaaggaccacggcatccggctgctggaggcccagatcgccactggaggcatcattgatcctgaggagagccaccggctgcctgtggaggtggcctacaagaggggcctgtttgatgaggagatgaatgagatcctgacagaccccagtgatgacaccaagggcttctttgaccccaacacagaggagaacctgacctacctgcagctgatggagcgctgcatcacagacccccagacaggcctgtgcctgctgcccctgaaggagaagaagcgggagaggaagaccagcagcaagagctctgtgaggaagagaagagtggtgattgtggaccctgagaccgggaaggagatgtctgtgtatgaggcctacaggaagggcctgattgaccaccagacctacctggagctgtctgagcaggagtgtgagtgggaggagatcaccatcagcagcagtgatggagtggtgaagtccatgatcatcgacagaagaagtggccggcagtatgacattgatgatgccatcgccaagaacctgattgacagaagtgccctggaccagtaccgggccggcaccctgagcatcacagaatttgctgacatgctgtctggaaatgctgggggcttccgcagccgcagcagctctgtgggcagcagcagcagctaccccatcagccctgctgtgtccaggacccagctggcctcctggagcgaccccacagaggagactggacctgtggccggcatcctggacacagagaccctggagaaggtgtccatcacagaggccatgcacaggaacctggtggacaacatcaccggccagaggctgctggaggcccaggcctgcaccggcggcatcatcgaccccagcactggagagcgcttccctgtgacagatgctgtgaacaagggcctggtggacaagatcatggtggaccgcatcaacctggcccagaaggccttctgtggctttgaggaccccaggaccaagaccaagatgtctgctgcccaggccctgaagaagggctggctgtactatgaagctggccagcgcttcctggaggtgcagtacctgaccggcggcctcatcgagccagacaccccaggccgggtgcccctggatgaggccctgcagaggggcaccgtggatgccaggacagcccagaagctgagagatgtgggcgcctacagcaagtacctgacctgccccaagaccaagctgaagatctcctacaaggatgccctggaccgctccatggtggaggagggcaccggcctgcggctgctggaggccgccgcccagagcaccaagggctactacagcccctacagcgtgtctggcagcggcagcacagctggcagcaggacaggcagcaggacaggcagcagagctggcagccggcggggcagctttgatgccactggaagtggcttctccatgaccttcagcagcagcagctacagcagcagcggctatggaagaagatatgccagcggcagcagcgccagcctgggcggccctgagagcgctgtggcctag

SEQ ID NO: 164415 - DNA, 13656 bp, Artificial Sequence
  Description of Artificial Sequence: Synthetic coding sequence
atgtctggggccggcggggcctttgccagcccccgggaggtgctgctggagcggccctgctggctggatggcggctgtgagcccgcccggcggggctacctgtaccagcagctgtgctgcgtggatgagcgggacagagtgcagaagaagaccttcaccaagtgggtgaacaagcacctgatcaaggcccagaggcacatcagtgacctgtatgaggacctgagagatggccacaacctgatcagcctgctggaggtgctgagcggggacagcctgccccgggagaagggccgcatgaggttccacaagctgcagaatgtgcagatcgccctggactacctgcggcaccggcaggtgaagctggtgaacatcagaaatgatgacattgctgatggcaaccccaagctgaccctgggcctcatctggaccatcatcctgcacttccagatcagtgacatccaggtgtctggccagagcgaggacatgacagccaaggagaagctgctgctgtggagccagaggatggtggagggctaccagggcctgcgctgtgacaacttcaccagctcctggagagatggccgcctcttcaatgccatcatccaccgccacaagcccctgctgattgacatgaacaaggtgtaccggcagaccaacctggagaacctggaccaggccttctctgtggccgagcgggacctgggcgtgacccggctgctggaccctgaagatgtggatgtgccccagccagatgagaagagcatcatcacctacgtgagcagcctgtatgatgccatgccccgggtgcctgatgtgcaggatggagtgcgggccaatgagctgcagctgcgctggcaggagtaccgggagctggtgctgctgctgctgcagtggatgaggcaccacacagctgcctttgaggagcggcgcttccccagcagctttgaggagattgagatcctgtggagccagttcctgaagttcaaggagatggagctgcctgccaaggaggccgacaagaacagaagcaagggcatctaccagagcctggagggcgctgtgcaggccggccagctgaaggtgcccccaggctaccaccccctggatgtggagaaggagtggggcaagctgcacgtggccatcctggagcgggagaagcagctgcggagtgaatttgagcggctggagtgcctgcagagaattgtgaccaagctgcagatggaggccggcctgtgtgaggagcagctgaaccaggctgatgccctgctgcagagtgatgtgcggctgctggccgccggcaaggtgccccagagagctggggaggtggagcgggacctggacaaggctgacagcatgatccggctgctcttcaatgatgtgcagaccctgaaggatggccgccacccccagggcgagcagatgtaccgccgggtgtaccgcctgcacgagcggctggtggccatcagaacagagtacaacctgcggctgaaggccggcgtggccgccccagccacccaggtggcccaggtgaccctgcagagcgtgcagaggaggcctgagctggaggacagcaccctgcgctacctgcaggacctgctggcctgggtggaggagaaccagcaccgggtggatggagctgagtggggcgtggacctgcccagcgtggaggcccagctgggcagccaccggggcctgcaccagagcattgaggagttccgggccaagattgaaagagcccggagtgatgagggccagctgagccctgccaccaggggggcctacagagactgcctgggccgcctggacctgcagtatgccaagctgctgaacagcagcaaggcccggctgcggagcctggagagcctgcacagctttgtggccgccgccaccaaggagctgatgtggctgaatgagaaggaggaggaggaggtgggctttgactggagcgacaggaacaccaacatgacagccaagaaggagagctacagcgccctgatgagggagctggagctgaaggagaagaagatcaaggagctgcagaatgctggggaccggctgctgcgggaggaccacccagcccggcccaccgtggagagcttccaggccgccctgcagacccagtggagctggatgctgcagctgtgctgctgcatcgaggcccacctgaaggaaaatgctgcctacttccagttcttcagtgatgtgcgggaggccgagggccagctgcagaagctgcaggaggccctgcggaggaagtacagctgtgacagaagtgccaccgtgacccggctggaggacctgctgcaggatgcccaggatgagaaggagcagctgaatgagtacaagggccacctgagcggcctggccaagagggccaaggctgtggtgcagctgaagcccaggcacccagcccaccccatgaggggccgcctgcccctgctggccgtgtgtgactacaagcaggtggaggtgacagtgcacaagggagatgagtgccagctggtgggccctgcccagcccagccactggaaggtgctgagcagcagcggcagcgaggccgctgtgcccagcgtgtgcttcctggtgcccccacccaaccaggaggcccaggaggccgtgacccggctggaggcccagcaccaggccctggtgaccctgtggcaccagctgcacgtggacatgaagagcctgctggcctggcagagcctgcggagagatgtgcagctgatccgctcctggagcctggccaccttccgcaccctgaagccagaggagcagaggcaggccctgcacagcctggagctgcactaccaggccttcctgcgggacagccaggatgctgggggcttcggcccagaagatcggctgatggccgagcgggagtatggcagctgcagccaccactaccagcagctgctgcagagcctggagcagggcgcccaggaggagagccgctgccagcgctgcatcagcgagctgaaggacatccggctgcagctggaggcctgtgagaccaggacagtgcaccggctgcggctgcccctggacaaggagcccgcccgggagtgtgcccagagaattgctgagcagcagaaggcccaggccgaggtggagggcctgggcaagggcgtggcccggctgtctgctgaggccgagaaggtgctggccctgcctgagcccagccctgctgcccccaccctgcggtctgagctggagctgaccctgggcaagctggagcaggtgcgcagcctgagcgccatctacctggagaagctgaagaccatcagcctggtgatccggggcacccagggcgctgaggaggtgctgcgggcccacgaggagcagctgaaggaggcccaggccgtgcctgccaccctgcctgagctggaggccaccaaggccagcctgaagaagctgcgggcccaggccgaggcccagcagcccacctttgatgccctgagagatgagctgcggggggcccaggaggtgggggagcggctgcagcagagacatggagagagagatgtggaggtggagcgctggagggagcgggtggcccagctgctggagcgctggcaggccgtgctggcccagacagatgtgcggcagcgggagctggagcagctgggccggcagctgcgctactaccgggagagcgctgaccccctgggcgcctggctgcaggatgcccggcggcggcaggagcagatccaggccatgcccctggccgacagccaggccgtgcgggagcagctgcggcaggagcaggccctgctggaggagattgaaagacatggagagaaggtggaggagtgccagagatttgccaagcagtacatcaatgccatcaaggactatgagctgcagctggtgacctacaaggcccagctggagcctgtggccagccctgccaagaagcccaaggtgcagagcggcagcgagagcgtcatccaggagtatgtggacctgcggacccactacagcgagctgaccaccctgaccagccagtacatcaagttcatcagcgagaccctgcggaggatggaggaggaggagcggctggccgagcagcagagagctgaggagcgggagcggctggccgaggtggaggccgccctggagaagcagaggcagctggccgaggcccacgcccaggccaaggcccaggccgagcgggaggccaaggagctgcagcagaggatgcaggaggaggtggtgagaagagaggaggccgctgtggatgcccagcagcagaagaggagcatccaggaggagctgcagcagctgcggcagagcagcgaggccgagatccaggccaaggcccggcaggccgaggccgctgagaggagccggctgcgcatcgaggaggagatccgggtggtgcggctgcagctggaggccacagagcggcagagaggaggagctgagggggagctgcaggccctgcgggcccgggcagaggaggccgaggcccagaagaggcaggcccaggaggaggccgagcggctgcggcggcaggtgcaggatgagagccagaggaagaggcaggccgaggtggagctggccagccgggtgaaggccgaggccgaggccgcccgggagaagcagagggccctgcaggccctggaggagctgcggctgcaggccgaggaggccgagcggcggctgcggcaggccgaggtggagcgggcccggcaggtgcaggtggccctggagacagcccagaggtctgctgaggccgagctgcagagcaagagggccagctttgctgagaagacagcccagctggagaggagcctgcaggaggagcacgtggccgtggcccagctgcgggaggaggccgagcggcgggcccagcagcaggccgaggccgagcgggcccgggaggaggccgagcgggagctggagcgctggcagctgaaggccaatgaggccctgcggctgcggctgcaggccgaggaggtggcccagcagaagagcctggcccaggccgaggccgagaagcagaaggaggaggccgagcgggaggccaggagaagaggcaaggccgaggagcaggccgtgcggcagcgggagctggccgagcaggagctggagaagcagaggcagctggccgagggcacagcccagcagaggctggccgctgagcaggagctgatccggctgcgggcagagacagagcagggcgagcagcagaggcagctgctggaggaggagctggcccggctgcagcgggaggccgctgctgccacccagaagaggcaggagctggaggccgagctggccaaggtgcgggcagagatggaggtgctgctggccagcaaggcccgggcagaggaggagagccgcagcaccagcgagaagagcaagcagaggctggaggccgaggccggccgcttccgggagctggccgaggaggccgcccggctgcgggccctggccgaggaggccaagaggcagaggcagctggccgaggaggatgctgcccggcagagagctgaggccgagcgggtgctggccgagaagctggccgccatcggggaggccacccggctgaagacagaggccgagatcgccctgaaggagaaggaggccgagaatgaaaggctgcggcggctggctgaagatgaggccttccagaggcggcggctggaggagcaggccgcccagcacaaggctgacatcgaggagcggctggcccagctgaggaaggccagtgacagcgagctggagcggcagaagggcctggtggaggacaccctgcggcagaggcggcaggtggaggaggagatcctggccctgaaggccagctttgagaaggctgctgctgggaaggccgagctggagctggagctgggccgcatccgcagcaatgctgaggacaccctgcggagcaaggagcaggccgagctggaggccgcccggcagaggcagctggccgctgaggaggagaggagaagaagagaggccgaggagcgggtgcagaagagcctggccgctgaggaggaggccgcccggcagaggaaggccgccctggaggaggtggagcggctgaaggccaaggtggaggaggcccggcggctgcgggagcgggcagagcaggagagcgcccggcagctgcagctggcccaggaggccgcccagaagaggctgcaggccgaggagaaggcccacgcctttgctgtgcagcagaaggagcaggagctgcagcagaccctgcagcaggagcagagcgtgctggaccagctgcggggggaggccgaggccgccaggagagctgctgaggaggccgaggaggcccgggtgcaggccgagcgggaggccgcccagagccggcggcaggtggaggaggccgagcggctgaagcagagcgctgaggagcaggcccaggcccgggcccaggcccaggccgctgctgagaagctgaggaaggaggccgagcaggaggccgcccggcgggcccaggccgagcaggccgccctgcggcagaagcaggccgcagatgctgagatggagaagcacaagaagtttgctgagcagaccctgcggcagaaggcccaggtggagcaggagctgaccaccctgcggctgcagctggaggagacagaccaccagaagaacctgctggatgaggagctgcagaggctgaaggccgaggccacagaagctgcccggcagaggagccaggtggaggaggagctgttctctgtgcgggtgcagatggaggagctgagcaagctgaaggccagaattgaagctgagaacagagccctgatcctgcgggacaaggacaacacccagcgcttcctgcaggaggaggccgagaagatgaagcaggtggccgaggaggccgcccggctgtctgtggccgcccaggaggccgcccggctgcggcagctggccgaggaggacctggcccagcagagggccctggccgagaagatgctgaaggagaagatgcaggccgtgcaggaggccacccggctgaaggccgaggccgagctgctgcagcagcagaaggagctggcccaggagcaggcccggcggctgcaggaggacaaggagcagatggcccagcagctggccgaggagacccagggcttccagaggaccctggaggccgagcggcagaggcagctggagatgtctgctgaggccgagcggctgaagctgcgggtggccgagatgagccgggcccaggcccgggcagaagaagatgcccagcgcttcaggaagcaggccgaggagattggagagaagctgcacaggacagagctggccacccaggagaaggtgaccctggtgcagaccctggagatccagaggcagcagagcgaccatgatgctgagcggctgcgggaggccatcgccgagctggagcgggagaaggagaagctgcagcaggaggccaagctgctgcagctgaagtctgaggagatgcagacagtgcagcaggagcagctgctgcaggagacccaggccctgcagcagagcttcctgtctgagaaggacagcctgctgcagcgggagcgcttcatcgagcaggagaaggccaagctggagcagctgttccaggatgaggtggccaaggcccagcagctgcgggaggagcagcagaggcagcagcagcagatggagcaggagcggcagaggctggtggcctccatggaggaggcccggcggcggcagcacgaggccgaggagggcgtgcggaggaagcaggaggagctgcagcagctggagcagcagaggcggcagcaggaggagctgctggccgaggagaaccagaggctgcgggagcagctgcagctgctggaggagcagcacagagctgccctggcccacagcgaggaggtgacagccagccaggtggccgccaccaagaccctgcccaacggcagagatgccctggatggccctgctgctgaggccgagcctgagcacagctttgatggcctgcggaggaaggtgtctgcccagaggctgcaggaggccggcatcctgtctgctgaggagctgcagaggctggcccagggccacaccaccgtggatgagctggcccggcgggaggatgtgcgccactacctgcagggccgcagcagcattgctggcctgctgctgaaggccaccaatgagaagctgtctgtgtatgctgccctgcagaggcagctgctgagccctggaacagccctgatcctgctggaggcccaggccgccagcggcttcctgctggaccctgtgaggaacagaaggctgactgtgaatgaagctgtgaaggagggcgtggtgggccctgagctgcaccacaagctgctgtctgctgagagagctgtgacaggctacaaggacccctacacaggccagcagatcagcctcttccaggccatgcagaagggcctgattgtgcgggagcacggcatccggctgctggaggcccagatcgccaccggcggcgtcatcgaccctgtgcacagccaccgggtgcctgtggatgtggcctacagaagaggctactttgatgaggagatgaacagagtgctggccgaccccagtgatgacaccaagggcttctttgaccccaacacccatgagaacctgacctacctgcagctgctggagcgctgtgtggaggaccctgagaccggcctgtgcctgctgcccctgacagacaaggccgccaagggcggggagctggtgtacacagattctgaggccagagatgtgtttgagaaggccaccgtgtctgccccctttgggaagttccagggcaagacagtgaccatctgggagatcatcaacagcgagtacttcaccgctgagcagaggcgggacctgctgcggcagttcagaacaggccgcatcaccgtggagaagatcatcaagatcatcatcaccgtggtggaggagcaggagcagaagggccgcctgtgctttgagggcctgcggagcctggtgcctgctgctgagctgctggagagcagggtcatcgaccgggagctgtaccagcagctgcagagaggagagaggtctgtgagagatgtggccgaggtggacacagtgagaagagccctgcggggggccaacgtgattgctggggtgtggctggaggaggccggccagaagctgagcatctacaatgccctgaagaaggacctgctgcccagcgacatggctgtggccctgctggaggcccaggccggcaccggccacatcatcgaccctgccaccagcgcccggctgactgtggatgaagctgtgcgggccggcctggtgggccctgagttccacgagaagctgctgtctgctgagaaggctgtgacaggctacagagacccctacacaggccagagcgtgtccctcttccaggccctgaagaagggcctcatcccccgggagcagggcctgcggctgctggatgcccagctgagcactggaggcatcgtggaccccagcaagagccaccgggtgcccctggatgtggcctgtgcccggggctgcctggatgaggagaccagccgggccctgagcgcccccagggcagatgccaaggcctacagcgaccccagcactggagagcccgccacctacggggagctgcagcagcgctgcaggccagaccagctgaccggcctgagcctgctgcccctgtctgagaaggccgcccgggcccggcaggaggagctgtacagcgagctgcaggcccgggagacctttgagaagacccctgtggaggtgcctgtgggcggcttcaagggccgcacagtgacagtgtgggagctgatcagcagcgagtacttcaccgctgagcagaggcaggagctgctgcggcagttcagaacaggcaaggtgacagtggagaaggtgatcaagatcctgatcaccatcgtggaggaggtggagaccctgcggcaggagcggctgtccttcagcggcctgcgggcccctgtgcctgccagcgagctgctggccagcggcgtgctgagccgggcccagtttgagcagctgaaggatggcaagaccaccgtgaaggacctgtctgagctgggctctgtgaggaccctgctgcagggcagcggctgcctggccggcatctacctggaggacaccaaggagaaggtgtccatctatgaggccatgaggcggggcctgctgcgggccaccacagctgccctgctgctggaggcccaggccgccaccggcttcctggtggaccctgtgaggaaccagaggctgtatgtgcatgaggccgtgaaggccggcgtggtgggccctgagctgcacgagcagctgctgtctgctgagaaggctgtgacaggctacagagacccctacagcggcagcaccatcagcctcttccaggccatgcagaagggcctggtgctgcggcagcacggcatccggctgctggaggcccagatcgccactggaggcatcattgatcctgtgcacagccaccgggtgcctgtggatgtggcctaccagaggggctacttcagcgaggagatgaacagagtgctggccgaccccagtgatgacaccaagggcttctttgaccccaacacccatgagaacctgacctaccggcagctgctggagcgctgtgtggaggaccctgagaccggcctgcggctgctgcccctgaagggagctgagaaggccgaggtggtggagaccacccaggtgtacacagaggaggagacccggcgggcctttgaggagacccagattgacatccctgggggcggcagccacggcggcagcaccatgagcctgtgggaggtgatgcagagcgacctgatccctgaggagcagagggcccagctgatggctgacttccaggccggccgggtgaccaaggagaggatgatcatcatcatcatcgagatcatcgagaagacagagatcatccggcagcagggcctggccagctatgactatgtgagaagaaggctgacagctgaggacctgtttgaggcccgcatcatcagcctggagacctacaacctgctgcgggagggcaccaggagcctgcgggaggccctggaggccgagagcgcctggtgctacctgtatggaactggatctgtggccggcgtgtacctgcccggcagccggcagaccctgagcatctaccaggccctgaagaagggcctgctgtctgctgaggtggcccggctgctgctggaggcccaggccgccaccggcttcctgctggaccctgtgaagggggagcggctgactgtggatgaagctgtgaggaagggcctggtgggccctgagctgcatgaccggctgctgtctgctgagagagctgtgacaggctacagagacccctacacagagcagaccatcagcctcttccaggccatgaagaaggagctgatccccacagaggaggccctgcggctgctggatgcccagctggccaccggcggcatcgtggacccccggctgggcttccacctgcccctggaggtggcctaccagaggggctacctgaacaaggacacccatgaccagctgtctgagcccagcgaggtgcgctcctatgtggaccccagcacagatgagcggctgagctacacccagctgctgcggcgctgcagaagagatgatggcaccggccagctgctgctgcccctgagtgatgccaggaagctgaccttccggggcctgaggaagcagatcaccatggaggagctggtgcgcagccaggtgatggatgaggccacagccctgcagctgcgggagggcctgaccagcattgaggaggtgaccaagaacctgcagaagttcctggagggcaccagctgcatcgccggcgtgtttgtggatgccaccaaggagcggctgtctgtgtaccaggccatgaagaagggcatcatccggcccggcacagcctttgagctgctggaggcccaggccgccaccggctacgtgattgaccccatcaagggcctgaagctgactgtggaggaggccgtgaggatgggcatcgtgggccctgagttcaaggacaagctgctgtctgctgagagagctgtgacaggctacaaggacccctacagcggcaagctgatcagcctcttccaggccatgaagaagggcctcatcctgaaggaccacggcatccggctgctggaggcccagatcgccactggaggcatcattgatcctgaggagagccaccggctgcctgtggaggtggcctacaagaggggcctgtttgatgaggagatgaatgagatcctgacagaccccagtgatgacaccaagggcttctttgaccccaacacagaggagaacctgacctacctgcagctgatggagcgctgcatcacagacccccagacaggcctgtgcctgctgcccctgaaggagaagaagcgggagaggaagaccagcagcaagagctctgtgaggaagagaagagtggtgattgtggaccctgagaccgggaaggagatgtctgtgtatgaggcctacaggaagggcctgattgaccaccagacctacctggagctgtctgagcaggagtgtgagtgggaggagatcaccatcagcagcagtgatggagtggtgaagtccatgatcatcgacagaagaagtggccggcagtatgacattgatgatgccatcgccaagaacctgattgacagaagtgccctggaccagtaccgggccggcaccctgagcatcacagaatttgctgacatgctgtctggaaatgctgggggcttccgcagccgcagcagctctgtgggcagcagcagcagctaccccatcagccctgctgtgtccaggacccagctggcctcctggagcgaccccacagaggagactggacctgtggccggcatcctggacacagagaccctggagaaggtgtccatcacagaggccatgcacaggaacctggtggacaacatcaccggccagaggctgctggaggcccaggcctgcaccggcggcatcatcgaccccagcactggagagcgcttccctgtgacagatgctgtgaacaagggcctggtggacaagatcatggtggaccgcatcaacctggcccagaaggccttctgtggctttgaggaccccaggaccaagaccaagatgtctgctgcccaggccctgaagaagggctggctgtactatgaagctggccagcgcttcctggaggtgcagtacctgaccggcggcctcatcgagccagacaccccaggccgggtgcccctggatgaggccctgcagaggggcaccgtggatgccaggacagcccagaagctgagagatgtgggcgcctacagcaagtacctgacctgccccaagaccaagctgaagatctcctacaaggatgccctggaccgctccatggtggaggagggcaccggcctgcggctgctggaggccgccgcccagagcaccaagggctactacagcccctacagcgtgtctggcagcggcagcacagctggcagcaggacaggcagcaggacaggcagcagagctggcagccggcggggcagctttgatgccactggaagtggcttctccatgaccttcagcagcagcagctacagcagcagcggctatggaagaagatatgccagcggcagcagcgccagcctgggcggccctgagagcgctgtggcctag

SEQ ID NO: 164416 - DNA, 13548 bp, Artificial Sequence
  Description of Artificial Sequence: Synthetic coding sequence
atgaagatcgtgcctgatgagcgggacagagtgcagaagaagaccttcaccaagtgggtgaacaagcacctgatcaaggcccagaggcacatcagtgacctgtatgaggacctgagagatggccacaacctgatcagcctgctggaggtgctgagcggggacagcctgccccgggagaagggccgcatgaggttccacaagctgcagaatgtgcagatcgccctggactacctgcggcaccggcaggtgaagctggtgaacatcagaaatgatgacattgctgatggcaaccccaagctgaccctgggcctcatctggaccatcatcctgcacttccagatcagtgacatccaggtgtctggccagagcgaggacatgacagccaaggagaagctgctgctgtggagccagaggatggtggagggctaccagggcctgcgctgtgacaacttcaccagctcctggagagatggccgcctcttcaatgccatcatccaccgccacaagcccctgctgattgacatgaacaaggtgtaccggcagaccaacctggagaacctggaccaggccttctctgtggccgagcgggacctgggcgtgacccggctgctggaccctgaagatgtggatgtgccccagccagatgagaagagcatcatcacctacgtgagcagcctgtatgatgccatgccccgggtgcctgatgtgcaggatggagtgcgggccaatgagctgcagctgcgctggcaggagtaccgggagctggtgctgctgctgctgcagtggatgaggcaccacacagctgcctttgaggagcggcgcttccccagcagctttgaggagattgagatcctgtggagccagttcctgaagttcaaggagatggagctgcctgccaaggaggccgacaagaacagaagcaagggcatctaccagagcctggagggcgctgtgcaggccggccagctgaaggtgcccccaggctaccaccccctggatgtggagaaggagtggggcaagctgcacgtggccatcctggagcgggagaagcagctgcggagtgaatttgagcggctggagtgcctgcagagaattgtgaccaagctgcagatggaggccggcctgtgtgaggagcagctgaaccaggctgatgccctgctgcagagtgatgtgcggctgctggccgccggcaaggtgccccagagagctggggaggtggagcgggacctggacaaggctgacagcatgatccggctgctcttcaatgatgtgcagaccctgaaggatggccgccacccccagggcgagcagatgtaccgccgggtgtaccgcctgcacgagcggctggtggccatcagaacagagtacaacctgcggctgaaggccggcgtggccgccccagccacccaggtggcccaggtgaccctgcagagcgtgcagaggaggcctgagctggaggacagcaccctgcgctacctgcaggacctgctggcctgggtggaggagaaccagcaccgggtggatggagctgagtggggcgtggacctgcccagcgtggaggcccagctgggcagccaccggggcctgcaccagagcattgaggagttccgggccaagattgaaagagcccggagtgatgagggccagctgagccctgccaccaggggggcctacagagactgcctgggccgcctggacctgcagtatgccaagctgctgaacagcagcaaggcccggctgcggagcctggagagcctgcacagctttgtggccgccgccaccaaggagctgatgtggctgaatgagaaggaggaggaggaggtgggctttgactggagcgacaggaacaccaacatgacagccaagaaggagagctacagcgccctgatgagggagctggagctgaaggagaagaagatcaaggagctgcagaatgctggggaccggctgctgcgggaggaccacccagcccggcccaccgtggagagcttccaggccgccctgcagacccagtggagctggatgctgcagctgtgctgctgcatcgaggcccacctgaaggaaaatgctgcctacttccagttcttcagtgatgtgcgggaggccgagggccagctgcagaagctgcaggaggccctgcggaggaagtacagctgtgacagaagtgccaccgtgacccggctggaggacctgctgcaggatgcccaggatgagaaggagcagctgaatgagtacaagggccacctgagcggcctggccaagagggccaaggctgtggtgcagctgaagcccaggcacccagcccaccccatgaggggccgcctgcccctgctggccgtgtgtgactacaagcaggtggaggtgacagtgcacaagggagatgagtgccagctggtgggccctgcccagcccagccactggaaggtgctgagcagcagcggcagcgaggccgctgtgcccagcgtgtgcttcctggtgcccccacccaaccaggaggcccaggaggccgtgacccggctggaggcccagcaccaggccctggtgaccctgtggcaccagctgcacgtggacatgaagagcctgctggcctggcagagcctgcggagagatgtgcagctgatccgctcctggagcctggccaccttccgcaccctgaagccagaggagcagaggcaggccctgcacagcctggagctgcactaccaggccttcctgcgggacagccaggatgctgggggcttcggcccagaagatcggctgatggccgagcgggagtatggcagctgcagccaccactaccagcagctgctgcagagcctggagcagggcgcccaggaggagagccgctgccagcgctgcatcagcgagctgaaggacatccggctgcagctggaggcctgtgagaccaggacagtgcaccggctgcggctgcccctggacaaggagcccgcccgggagtgtgcccagagaattgctgagcagcagaaggcccaggccgaggtggagggcctgggcaagggcgtggcccggctgtctgctgaggccgagaaggtgctggccctgcctgagcccagccctgctgcccccaccctgcggtctgagctggagctgaccctgggcaagctggagcaggtgcgcagcctgagcgccatctacctggagaagctgaagaccatcagcctggtgatccggggcacccagggcgctgaggaggtgctgcgggcccacgaggagcagctgaaggaggcccaggccgtgcctgccaccctgcctgagctggaggccaccaaggccagcctgaagaagctgcgggcccaggccgaggcccagcagcccacctttgatgccctgagagatgagctgcggggggcccaggaggtgggggagcggctgcagcagagacatggagagagagatgtggaggtggagcgctggagggagcgggtggcccagctgctggagcgctggcaggccgtgctggcccagacagatgtgcggcagcgggagctggagcagctgggccggcagctgcgctactaccgggagagcgctgaccccctgggcgcctggctgcaggatgcccggcggcggcaggagcagatccaggccatgcccctggccgacagccaggccgtgcgggagcagctgcggcaggagcaggccctgctggaggagattgaaagacatggagagaaggtggaggagtgccagagatttgccaagcagtacatcaatgccatcaaggactatgagctgcagctggtgacctacaaggcccagctggagcctgtggccagccctgccaagaagcccaaggtgcagagcggcagcgagagcgtcatccaggagtatgtggacctgcggacccactacagcgagctgaccaccctgaccagccagtacatcaagttcatcagcgagaccctgcggaggatggaggaggaggagcggctggccgagcagcagagagctgaggagcgggagcggctggccgaggtggaggccgccctggagaagcagaggcagctggccgaggcccacgcccaggccaaggcccaggccgagcgggaggccaaggagctgcagcagaggatgcaggaggaggtggtgagaagagaggaggccgctgtggatgcccagcagcagaagaggagcatccaggaggagctgcagcagctgcggcagagcagcgaggccgagatccaggccaaggcccggcaggccgaggccgctgagaggagccggctgcgcatcgaggaggagatccgggtggtgcggctgcagctggaggccacagagcggcagagaggaggagctgagggggagctgcaggccctgcgggcccgggcagaggaggccgaggcccagaagaggcaggcccaggaggaggccgagcggctgcggcggcaggtgcaggatgagagccagaggaagaggcaggccgaggtggagctggccagccgggtgaaggccgaggccgaggccgcccgggagaagcagagggccctgcaggccctggaggagctgcggctgcaggccgaggaggccgagcggcggctgcggcaggccgaggtggagcgggcccggcaggtgcaggtggccctggagacagcccagaggtctgctgaggccgagctgcagagcaagagggccagctttgctgagaagacagcccagctggagaggagcctgcaggaggagcacgtggccgtggcccagctgcgggaggaggccgagcggcgggcccagcagcaggccgaggccgagcgggcccgggaggaggccgagcgggagctggagcgctggcagctgaaggccaatgaggccctgcggctgcggctgcaggccgaggaggtggcccagcagaagagcctggcccaggccgaggccgagaagcagaaggaggaggccgagcgggaggccaggagaagaggcaaggccgaggagcaggccgtgcggcagcgggagctggccgagcaggagctggagaagcagaggcagctggccgagggcacagcccagcagaggctggccgctgagcaggagctgatccggctgcgggcagagacagagcagggcgagcagcagaggcagctgctggaggaggagctggcccggctgcagcgggaggccgctgctgccacccagaagaggcaggagctggaggccgagctggccaaggtgcgggcagagatggaggtgctgctggccagcaaggcccgggcagaggaggagagccgcagcaccagcgagaagagcaagcagaggctggaggccgaggccggccgcttccgggagctggccgaggaggccgcccggctgcgggccctggccgaggaggccaagaggcagaggcagctggccgaggaggatgctgcccggcagagagctgaggccgagcgggtgctggccgagaagctggccgccatcggggaggccacccggctgaagacagaggccgagatcgccctgaaggagaaggaggccgagaatgaaaggctgcggcggctggctgaagatgaggccttccagaggcggcggctggaggagcaggccgcccagcacaaggctgacatcgaggagcggctggcccagctgaggaaggccagtgacagcgagctggagcggcagaagggcctggtggaggacaccctgcggcagaggcggcaggtggaggaggagatcctggccctgaaggccagctttgagaaggctgctgctgggaaggccgagctggagctggagctgggccgcatccgcagcaatgctgaggacaccctgcggagcaaggagcaggccgagctggaggccgcccggcagaggcagctggccgctgaggaggagaggagaagaagagaggccgaggagcgggtgcagaagagcctggccgctgaggaggaggccgcccggcagaggaaggccgccctggaggaggtggagcggctgaaggccaaggtggaggaggcccggcggctgcgggagcgggcagagcaggagagcgcccggcagctgcagctggcccaggaggccgcccagaagaggctgcaggccgaggagaaggcccacgcctttgctgtgcagcagaaggagcaggagctgcagcagaccctgcagcaggagcagagcgtgctggaccagctgcggggggaggccgaggccgccaggagagctgctgaggaggccgaggaggcccgggtgcaggccgagcgggaggccgcccagagccggcggcaggtggaggaggccgagcggctgaagcagagcgctgaggagcaggcccaggcccgggcccaggcccaggccgctgctgagaagctgaggaaggaggccgagcaggaggccgcccggcgggcccaggccgagcaggccgccctgcggcagaagcaggccgcagatgctgagatggagaagcacaagaagtttgctgagcagaccctgcggcagaaggcccaggtggagcaggagctgaccaccctgcggctgcagctggaggagacagaccaccagaagaacctgctggatgaggagctgcagaggctgaaggccgaggccacagaagctgcccggcagaggagccaggtggaggaggagctgttctctgtgcgggtgcagatggaggagctgagcaagctgaaggccagaattgaagctgagaacagagccctgatcctgcgggacaaggacaacacccagcgcttcctgcaggaggaggccgagaagatgaagcaggtggccgaggaggccgcccggctgtctgtggccgcccaggaggccgcccggctgcggcagctggccgaggaggacctggcccagcagagggccctggccgagaagatgctgaaggagaagatgcaggccgtgcaggaggccacccggctgaaggccgaggccgagctgctgcagcagcagaaggagctggcccaggagcaggcccggcggctgcaggaggacaaggagcagatggcccagcagctggccgaggagacccagggcttccagaggaccctggaggccgagcggcagaggcagctggagatgtctgctgaggccgagcggctgaagctgcgggtggccgagatgagccgggcccaggcccgggcagaagaagatgcccagcgcttcaggaagcaggccgaggagattggagagaagctgcacaggacagagctggccacccaggagaaggtgaccctggtgcagaccctggagatccagaggcagcagagcgaccatgatgctgagcggctgcgggaggccatcgccgagctggagcgggagaaggagaagctgcagcaggaggccaagctgctgcagctgaagtctgaggagatgcagacagtgcagcaggagcagctgctgcaggagacccaggccctgcagcagagcttcctgtctgagaaggacagcctgctgcagcgggagcgcttcatcgagcaggagaaggccaagctggagcagctgttccaggatgaggtggccaaggcccagcagctgcgggaggagcagcagaggcagcagcagcagatggagcaggagcggcagaggctggtggcctccatggaggaggcccggcggcggcagcacgaggccgaggagggcgtgcggaggaagcaggaggagctgcagcagctggagcagcagaggcggcagcaggaggagctgctggccgaggagaaccagaggctgcgggagcagctgcagctgctggaggagcagcacagagctgccctggcccacagcgaggaggtgacagccagccaggtggccgccaccaagaccctgcccaacggcagagatgccctggatggccctgctgctgaggccgagcctgagcacagctttgatggcctgcggaggaaggtgtctgcccagaggctgcaggaggccggcatcctgtctgctgaggagctgcagaggctggcccagggccacaccaccgtggatgagctggcccggcgggaggatgtgcgccactacctgcagggccgcagcagcattgctggcctgctgctgaaggccaccaatgagaagctgtctgtgtatgctgccctgcagaggcagctgctgagccctggaacagccctgatcctgctggaggcccaggccgccagcggcttcctgctggaccctgtgaggaacagaaggctgactgtgaatgaagctgtgaaggagggcgtggtgggccctgagctgcaccacaagctgctgtctgctgagagagctgtgacaggctacaaggacccctacacaggccagcagatcagcctcttccaggccatgcagaagggcctgattgtgcgggagcacggcatccggctgctggaggcccagatcgccaccggcggcgtcatcgaccctgtgcacagccaccgggtgcctgtggatgtggcctacagaagaggctactttgatgaggagatgaacagagtgctggccgaccccagtgatgacaccaagggcttctttgaccccaacacccatgagaacctgacctacctgcagctgctggagcgctgtgtggaggaccctgagaccggcctgtgcctgctgcccctgacagacaaggccgccaagggcggggagctggtgtacacagattctgaggccagagatgtgtttgagaaggccaccgtgtctgccccctttgggaagttccagggcaagacagtgaccatctgggagatcatcaacagcgagtacttcaccgctgagcagaggcgggacctgctgcggcagttcagaacaggccgcatcaccgtggagaagatcatcaagatcatcatcaccgtggtggaggagcaggagcagaagggccgcctgtgctttgagggcctgcggagcctggtgcctgctgctgagctgctggagagcagggtcatcgaccgggagctgtaccagcagctgcagagaggagagaggtctgtgagagatgtggccgaggtggacacagtgagaagagccctgcggggggccaacgtgattgctggggtgtggctggaggaggccggccagaagctgagcatctacaatgccctgaagaaggacctgctgcccagcgacatggctgtggccctgctggaggcccaggccggcaccggccacatcatcgaccctgccaccagcgcccggctgactgtggatgaagctgtgcgggccggcctggtgggccctgagttccacgagaagctgctgtctgctgagaaggctgtgacaggctacagagacccctacacaggccagagcgtgtccctcttccaggccctgaagaagggcctcatcccccgggagcagggcctgcggctgctggatgcccagctgagcactggaggcatcgtggaccccagcaagagccaccgggtgcccctggatgtggcctgtgcccggggctgcctggatgaggagaccagccgggccctgagcgcccccagggcagatgccaaggcctacagcgaccccagcactggagagcccgccacctacggggagctgcagcagcgctgcaggccagaccagctgaccggcctgagcctgctgcccctgtctgagaaggccgcccgggcccggcaggaggagctgtacagcgagctgcaggcccgggagacctttgagaagacccctgtggaggtgcctgtgggcggcttcaagggccgcacagtgacagtgtgggagctgatcagcagcgagtacttcaccgctgagcagaggcaggagctgctgcggcagttcagaacaggcaaggtgacagtggagaaggtgatcaagatcctgatcaccatcgtggaggaggtggagaccctgcggcaggagcggctgtccttcagcggcctgcgggcccctgtgcctgccagcgagctgctggccagcggcgtgctgagccgggcccagtttgagcagctgaaggatggcaagaccaccgtgaaggacctgtctgagctgggctctgtgaggaccctgctgcagggcagcggctgcctggccggcatctacctggaggacaccaaggagaaggtgtccatctatgaggccatgaggcggggcctgctgcgggccaccacagctgccctgctgctggaggcccaggccgccaccggcttcctggtggaccctgtgaggaaccagaggctgtatgtgcatgaggccgtgaaggccggcgtggtgggccctgagctgcacgagcagctgctgtctgctgagaaggctgtgacaggctacagagacccctacagcggcagcaccatcagcctcttccaggccatgcagaagggcctggtgctgcggcagcacggcatccggctgctggaggcccagatcgccactggaggcatcattgatcctgtgcacagccaccgggtgcctgtggatgtggcctaccagaggggctacttcagcgaggagatgaacagagtgctggccgaccccagtgatgacaccaagggcttctttgaccccaacacccatgagaacctgacctaccggcagctgctggagcgctgtgtggaggaccctgagaccggcctgcggctgctgcccctgaagggagctgagaaggccgaggtggtggagaccacccaggtgtacacagaggaggagacccggcgggcctttgaggagacccagattgacatccctgggggcggcagccacggcggcagcaccatgagcctgtgggaggtgatgcagagcgacctgatccctgaggagcagagggcccagctgatggctgacttccaggccggccgggtgaccaaggagaggatgatcatcatcatcatcgagatcatcgagaagacagagatcatccggcagcagggcctggccagctatgactatgtgagaagaaggctgacagctgaggacctgtttgaggcccgcatcatcagcctggagacctacaacctgctgcgggagggcaccaggagcctgcgggaggccctggaggccgagagcgcctggtgctacctgtatggaactggatctgtggccggcgtgtacctgcccggcagccggcagaccctgagcatctaccaggccctgaagaagggcctgctgtctgctgaggtggcccggctgctgctggaggcccaggccgccaccggcttcctgctggaccctgtgaagggggagcggctgactgtggatgaagctgtgaggaagggcctggtgggccctgagctgcatgaccggctgctgtctgctgagagagctgtgacaggctacagagacccctacacagagcagaccatcagcctcttccaggccatgaagaaggagctgatccccacagaggaggccctgcggctgctggatgcccagctggccaccggcggcatcgtggacccccggctgggcttccacctgcccctggaggtggcctaccagaggggctacctgaacaaggacacccatgaccagctgtctgagcccagcgaggtgcgctcctatgtggaccccagcacagatgagcggctgagctacacccagctgctgcggcgctgcagaagagatgatggcaccggccagctgctgctgcccctgagtgatgccaggaagctgaccttccggggcctgaggaagcagatcaccatggaggagctggtgcgcagccaggtgatggatgaggccacagccctgcagctgcgggagggcctgaccagcattgaggaggtgaccaagaacctgcagaagttcctggagggcaccagctgcatcgccggcgtgtttgtggatgccaccaaggagcggctgtctgtgtaccaggccatgaagaagggcatcatccggcccggcacagcctttgagctgctggaggcccaggccgccaccggctacgtgattgaccccatcaagggcctgaagctgactgtggaggaggccgtgaggatgggcatcgtgggccctgagttcaaggacaagctgctgtctgctgagagagctgtgacaggctacaaggacccctacagcggcaagctgatcagcctcttccaggccatgaagaagggcctcatcctgaaggaccacggcatccggctgctggaggcccagatcgccactggaggcatcattgatcctgaggagagccaccggctgcctgtggaggtggcctacaagaggggcctgtttgatgaggagatgaatgagatcctgacagaccccagtgatgacaccaagggcttctttgaccccaacacagaggagaacctgacctacctgcagctgatggagcgctgcatcacagacccccagacaggcctgtgcctgctgcccctgaaggagaagaagcgggagaggaagaccagcagcaagagctctgtgaggaagagaagagtggtgattgtggaccctgagaccgggaaggagatgtctgtgtatgaggcctacaggaagggcctgattgaccaccagacctacctggagctgtctgagcaggagtgtgagtgggaggagatcaccatcagcagcagtgatggagtggtgaagtccatgatcatcgacagaagaagtggccggcagtatgacattgatgatgccatcgccaagaacctgattgacagaagtgccctggaccagtaccgggccggcaccctgagcatcacagaatttgctgacatgctgtctggaaatgctgggggcttccgcagccgcagcagctctgtgggcagcagcagcagctaccccatcagccctgctgtgtccaggacccagctggcctcctggagcgaccccacagaggagactggacctgtggccggcatcctggacacagagaccctggagaaggtgtccatcacagaggccatgcacaggaacctggtggacaacatcaccggccagaggctgctggaggcccaggcctgcaccggcggcatcatcgaccccagcactggagagcgcttccctgtgacagatgctgtgaacaagggcctggtggacaagatcatggtggaccgcatcaacctggcccagaaggccttctgtggctttgaggaccccaggaccaagaccaagatgtctgctgcccaggccctgaagaagggctggctgtactatgaagctggccagcgcttcctggaggtgcagtacctgaccggcggcctcatcgagccagacaccccaggccgggtgcccctggatgaggccctgcagaggggcaccgtggatgccaggacagcccagaagctgagagatgtgggcgcctacagcaagtacctgacctgccccaagaccaagctgaagatctcctacaaggatgccctggaccgctccatggtggaggagggcaccggcctgcggctgctggaggccgccgcccagagcaccaagggctactacagcccctacagcgtgtctggcagcggcagcacagctggcagcaggacaggcagcaggacaggcagcagagctggcagccggcggggcagctttgatgccactggaagtggcttctccatgaccttcagcagcagcagctacagcagcagcggctatggaagaagatatgccagcggcagcagcgccagcctgggcggccctgagagcgctgtggcctag

SEQ ID NO: 164417 - DNA, 13725 bp, Artificial Sequence
  Description of Artificial Sequence: Synthetic coding sequence
atgtctggagaagatgctgaggtgcgggctgtgtctgaagatgtgtccaatggcagcagcggcagccccagccctggggacaccctgccctggaacctgggcaagacccagaggagccgccgcagcggcggcggggccggcagcaatggatctgtgctggaccctgctgagagagctgtgatcagaattgctgatgagcgggacagagtgcagaagaagaccttcaccaagtgggtgaacaagcacctgatcaaggcccagaggcacatcagtgacctgtatgaggacctgagagatggccacaacctgatcagcctgctggaggtgctgagcggggacagcctgccccgggagaagggccgcatgaggttccacaagctgcagaatgtgcagatcgccctggactacctgcggcaccggcaggtgaagctggtgaacatcagaaatgatgacattgctgatggcaaccccaagctgaccctgggcctcatctggaccatcatcctgcacttccagatcagtgacatccaggtgtctggccagagcgaggacatgacagccaaggagaagctgctgctgtggagccagaggatggtggagggctaccagggcctgcgctgtgacaacttcaccagctcctggagagatggccgcctcttcaatgccatcatccaccgccacaagcccctgctgattgacatgaacaaggtgtaccggcagaccaacctggagaacctggaccaggccttctctgtggccgagcgggacctgggcgtgacccggctgctggaccctgaagatgtggatgtgccccagccagatgagaagagcatcatcacctacgtgagcagcctgtatgatgccatgccccgggtgcctgatgtgcaggatggagtgcgggccaatgagctgcagctgcgctggcaggagtaccgggagctggtgctgctgctgctgcagtggatgaggcaccacacagctgcctttgaggagcggcgcttccccagcagctttgaggagattgagatcctgtggagccagttcctgaagttcaaggagatggagctgcctgccaaggaggccgacaagaacagaagcaagggcatctaccagagcctggagggcgctgtgcaggccggccagctgaaggtgcccccaggctaccaccccctggatgtggagaaggagtggggcaagctgcacgtggccatcctggagcgggagaagcagctgcggagtgaatttgagcggctggagtgcctgcagagaattgtgaccaagctgcagatggaggccggcctgtgtgaggagcagctgaaccaggctgatgccctgctgcagagtgatgtgcggctgctggccgccggcaaggtgccccagagagctggggaggtggagcgggacctggacaaggctgacagcatgatccggctgctcttcaatgatgtgcagaccctgaaggatggccgccacccccagggcgagcagatgtacagaagagtgtaccgcctgcacgagcggctggtggccatcagaacagagtacaacctgcggctgaaggccggcgtggccgccccagccacccaggtggcccaggtgaccctgcagagcgtgcagaggaggcctgagctggaggacagcaccctgcgctacctgcaggacctgctggcctgggtggaggagaaccagcaccgggtggatggagctgagtggggcgtggacctgcccagcgtggaggcccagctgggcagccaccggggcctgcaccagagcattgaggagttccgggccaagattgagcgggcccggagtgatgagggccagctgagccctgccaccaggggggcctacagagactgcctgggccgcctggacctgcagtatgccaagctgctgaacagcagcaaggcccggctgcggagcctggagagcctgcacagctttgtggccgccgccaccaaggagctgatgtggctgaatgagaaggaggaggaggaggtgggctttgactggagcgacaggaacaccaacatgacagccaagaaggagagctacagcgccctgatgagggagctggagctgaaggagaagaagatcaaggagctgcagaatgctggggaccggctgctgcgggaggaccacccagcccggcccaccgtggagagcttccaggccgccctgcagacccagtggagctggatgctgcagctgtgctgctgcatcgaggcccacctgaaggaaaatgctgcctacttccagttcttcagtgatgtgcgggaggccgagggccagctgcagaagctgcaggaggccctgcggaggaagtacagctgtgacagaagtgccaccgtgacccggctggaggacctgctgcaggatgcccaggatgagaaggagcagctgaatgagtacaagggccacctgagcggcctggccaagagggccaaggctgtggtgcagctgaagcccaggcacccagcccaccccatgaggggccgcctgcccctgctggccgtgtgtgactacaagcaggtggaggtgacagtgcacaagggagatgagtgccagctggtgggccctgcccagcccagccactggaaggtgctgagcagcagcggcagcgaggccgctgtgcccagcgtgtgcttcctggtgcccccacccaaccaggaggcccaggaggccgtgacccggctggaggcccagcaccaggccctggtgaccctgtggcaccagctgcacgtggacatgaagagcctgctggcctggcagagcctgcggagagatgtgcagctgatccgctcctggagcctggccaccttccgcaccctgaagccagaggagcagaggcaggccctgcacagcctggagctgcactaccaggccttcctgcgggacagccaggatgctgggggctttggacctgaggaccggctgatggccgagcgggagtatggcagctgcagccaccactaccagcagctgctgcagagcctggagcagggcgcccaggaggagagccgctgccagcgctgcatcagcgagctgaaggacatccggctgcagctggaggcctgtgagaccaggacagtgcaccggctgcggctgcccctggacaaggagcccgccagagaatgtgcccagagaattgctgagcagcagaaggcccaggccgaggtggagggcctgggcaaaggagtggcccggctgtctgctgaggccgagaaggtgctggccctgcctgagcccagccctgctgcccccaccctgcggtctgagctggagctgaccctgggcaagctggagcaggtgcgcagcctgagcgccatctacctggagaagctgaagaccatcagcctggtgatccggggcacccagggcgctgaggaggtgctgcgggcccacgaggagcagctgaaggaggcccaggccgtgcctgccaccctgcctgagctggaggccaccaaggccagcctgaagaagctgcgggcccaggccgaggcccagcagcccacctttgatgccctgagagatgagctgcggggggcccaggaggtgggggagcggctgcagcagagacatggagagagagatgtggaggtggagcgctggagggagcgggtggcccagctgctggagcgctggcaggccgtgctggcccagacagatgtgcggcagcgggagctggagcagctgggccggcagctgcgctactaccgggagagcgctgaccccctgggcgcctggctgcaggatgcccggcggcggcaggagcagatccaggccatgcccctggccgacagccaggccgtgcgggagcagctgcggcaggagcaggccctgctggaggagattgagcggcacggggagaaggtggaggagtgccagagatttgccaagcagtacatcaatgccatcaaggactatgagctgcagctggtgacctacaaggcccagctggagcctgtggccagccctgccaagaagcccaaggtgcagagcggcagcgagagcgtcatccaggagtatgtggacctgcggacccactacagcgagctgaccaccctgaccagccagtacatcaagttcatcagcgagaccctgcggaggatggaggaggaggagcggctggccgagcagcagagagctgaggagcgggagcggctggccgaggtggaggccgccctggagaagcagaggcagctggccgaggcccacgcccaggccaaggcccaggccgagcgggaggccaaggagctgcagcagaggatgcaggaggaggtggtgcggcgggaggaggccgctgtggatgcccagcagcagaagaggagcatccaggaggagctgcagcagctgcggcagagcagcgaggccgagatccaggccaaggcccggcaggccgaggccgctgagaggagccggctgagaattgaggaggagatccgggtggtgcggctgcagctggaggccacagagcggcagaggggcggcgctgagggggagctgcaggccctgcgggcccgggcagaggaggccgaggcccagaagaggcaggcccaggaggaggccgagcggctgcggcggcaggtgcaggatgagagccagaggaagaggcaggccgaggtggagctggccagccgggtgaaggccgaggccgaggccgcccgggagaagcagagggccctgcaggccctggaggagctgcggctgcaggccgaggaggccgagcggcggctgcggcaggccgaggtggagcgggcccggcaggtgcaggtggccctggagacagcccagaggtctgctgaggccgagctgcagagcaagagggccagctttgctgagaagacagcccagctggagaggagcctgcaggaggagcacgtggccgtggcccagctgcgggaggaggccgagcggcgggcccagcagcaggccgaggccgagcgggcccgggaggaggccgagcgggagctggagcgctggcagctgaaggccaatgaggccctgcggctgcggctgcaggccgaggaggtggcccagcagaagagcctggcccaggccgaggccgagaagcagaaggaggaggccgagcgggaggcccggcggcggggcaaggccgaggagcaggccgtgcggcagcgggagctggccgagcaggagctggagaagcagaggcagctggccgagggcacagcccagcagaggctggccgctgagcaggagctgatccggctgcgggcagagacagagcagggcgagcagcagaggcagctgctggaggaggagctggcccggctgcagcgggaggccgccgccgccacccagaagaggcaggagctggaggccgagctggccaaggtgcgggcagagatggaggtgctgctggccagcaaggcccgggcagaggaggagagccgcagcaccagcgagaagagcaagcagaggctggaggccgaggccggccgcttccgggagctggccgaggaggccgcccggctgcgggccctggccgaggaggccaagaggcagaggcagctggccgaggaggatgctgcccggcagagagctgaggccgagcgggtgctggccgagaagctggccgccatcggggaggccacccggctgaagacagaagctgagatcgccctgaaggagaaggaggctgaaaatgaaaggctgcggcggctggccgaggatgaggccttccagaggcggcggctggaggagcaggccgcccagcacaaggctgacatcgaggagcggctggcccagctgaggaaggccagtgacagcgagctggagcggcagaagggcctggtggaggacaccctgcggcagaggcggcaggtggaggaggagatcctggccctgaaggccagctttgagaaggctgctgctgggaaggccgagctggagctggagctgggccgcatccgcagcaatgctgaggacaccctgcggagcaaggagcaggccgagctggaggccgcccggcagaggcagctggccgctgaggaggagaggagaagaagagaagctgaggagcgggtgcagaagagcctggccgctgaggaggaggccgcccggcagaggaaggccgccctggaggaggtggagcggctgaaggccaaggtggaggaggcccggcggctgcgggagagagctgagcaggagagcgcccggcagctgcagctggcccaggaggccgcccagaagaggctgcaggccgaggagaaggcccacgcctttgctgtgcagcagaaggagcaggagctgcagcagaccctgcagcaggagcagagcgtgctggaccagctgcggggggaggccgaggccgcccggcgggctgctgaggaggccgaggaggcccgggtgcaggccgagcgggaggccgcccagagccggcggcaggtggaggaggccgagcggctgaagcagagcgctgaggagcaggcccaggcccgggcccaggcccaggccgctgctgagaagctgaggaaggaggccgagcaggaggccgcccggcgggcccaggccgagcaggccgccctgcggcagaagcaggccgcagatgctgagatggagaagcacaagaagtttgctgagcagaccctgcggcagaaggcccaggtggagcaggagctgaccaccctgcggctgcagctggaggagacagaccaccagaagaacctgctggatgaggagctgcagaggctgaaggccgaggccacagaggccgcccggcagaggagccaggtggaggaggagctgttctctgtgcgggtgcagatggaggagctgagcaagctgaaggcccgcatcgaggctgaaaatagagccctgatcctgcgggacaaggacaacacccagcgcttcctgcaggaggaggccgagaagatgaagcaggtggccgaggaggccgcccggctgtctgtggccgcccaggaggccgcccggctgcggcagctggccgaggaggacctggcccagcagagggccctggccgagaagatgctgaaggagaagatgcaggccgtgcaggaggccacccggctgaaggccgaggccgagctgctgcagcagcagaaggagctggcccaggagcaggcccggcggctgcaggaggacaaggagcagatggcccagcagctggccgaggagacccagggcttccagaggaccctggaggccgagcggcagaggcagctggagatgtctgctgaggccgagcggctgaagctgcgggtggccgagatgagccgggcccaggcccgggcagaggaggatgcccagcgcttcaggaagcaggccgaggagatcggggagaagctgcacaggacagagctggccacccaggagaaggtgaccctggtgcagaccctggagatccagaggcagcagagcgaccatgatgctgagcggctgcgggaggccatcgccgagctggagcgggagaaggagaagctgcagcaggaggccaagctgctgcagctgaagtctgaggagatgcagacagtgcagcaggagcagctgctgcaggagacccaggccctgcagcagagcttcctgtctgagaaggacagcctgctgcagcgggagcgcttcatcgagcaggagaaggccaagctggagcagctgttccaggatgaggtggccaaggcccagcagctgcgggaggagcagcagaggcagcagcagcagatggagcaggagcggcagaggctggtggcctccatggaggaggcccggcggcggcagcatgaagctgaggagggcgtgcggaggaagcaggaggagctgcagcagctggagcagcagaggcggcagcaggaggagctgctggccgaggagaaccagaggctgcgggagcagctgcagctgctggaggagcagcaccgggccgccctggcccacagcgaggaggtgacagccagccaggtggccgccaccaagaccctgcccaacggcagagatgccctggatggccctgctgctgaggccgagcctgagcacagctttgatggcctgcggaggaaggtgtctgcccagaggctgcaggaggccggcatcctgtctgctgaggagctgcagaggctggcccagggccacaccaccgtggatgagctggccaggagagaagatgtgcgccactacctgcagggccgcagcagcattgctggcctgctgctgaaggccaccaatgagaagctgtctgtgtatgctgccctgcagaggcagctgctgagccctggaacagccctgatcctgctggaggcccaggccgccagcggcttcctgctggaccctgtgaggaacagaaggctgactgtgaatgaggccgtgaaggagggcgtggtgggccctgagctgcaccacaagctgctgtctgctgagagagctgtgacaggctacaaggacccctacacaggccagcagatcagcctcttccaggccatgcagaagggcctcatcgtgcgggagcacggcatccggctgctggaggcccagatcgccactggaggagtgattgatcctgtgcacagccaccgggtgcctgtggatgtggcctaccgccggggctactttgatgaggagatgaacagagtgctggccgaccccagtgatgacaccaagggcttctttgaccccaacacccatgagaacctgacctacctgcagctgctggagcgctgtgtggaggaccctgagaccggcctgtgcctgctgcccctgacagacaaggccgccaagggcggggagctggtgtacacagacagcgaggccagagatgtgtttgagaaggccaccgtgtctgccccctttgggaagttccagggcaagacagtgaccatctgggagatcatcaacagcgagtacttcaccgctgagcagaggcgggacctgctgcggcagttcagaacaggccgcatcaccgtggagaagatcatcaagatcatcatcaccgtggtggaggagcaggagcagaagggccgcctgtgctttgagggcctgcggagcctggtgcctgctgctgagctgctggagagccgggtgattgaccgggagctgtaccagcagctgcagagaggagagaggtctgtgagagatgtggccgaggtggacacagtgcggcgggccctgcggggggccaacgtgattgctggggtgtggctggaggaggccggccagaagctgagcatctacaatgccctgaagaaggacctgctgcccagcgacatggctgtggccctgctggaggcccaggccggcaccggccacatcattgatcctgccaccagcgcccggctgactgtggatgaggccgtgcgggccggcctggtgggccctgagttccacgagaagctgctgtctgctgagaaggctgtgacaggctacagagacccctacacaggccagagcgtgtccctcttccaggccctgaagaagggcctcatcccccgggagcagggcctgcggctgctggatgcccagctgagcactggaggcatcgtggaccccagcaagagccaccgggtgcccctggatgtggcctgtgcccggggctgcctggatgaggagaccagccgggccctgagcgcccccagggcagatgccaaggcctacagcgaccccagcactggagagcccgccacctatggagagctgcagcagcgctgcaggccagaccagctgaccggcctgagcctgctgcccctgtctgagaaggccgcccgggcccggcaggaggagctgtacagcgagctgcaggcccgggagacctttgagaagacccctgtggaggtgcctgtgggcggcttcaagggccgcacagtgacagtgtgggagctgatcagcagcgagtacttcaccgctgagcagaggcaggagctgctgcggcagttcagaacaggcaaggtgacagtggagaaggtgatcaagatcctgatcaccatcgtggaggaggtggagaccctgcggcaggagcggctgtccttcagcggcctgcgggcccctgtgcctgccagcgagctgctggccagcggcgtgctgagccgggcccagtttgagcagctgaaggatggcaagaccaccgtgaaggacctgtctgagctgggctctgtgaggaccctgctgcagggcagcggctgcctggccggcatctacctggaggacaccaaggagaaggtgtccatctatgaggccatgagaagaggcctgctgcgggccaccacagctgccctgctgctggaggcccaggccgccaccggcttcctggtggaccctgtgaggaaccagaggctgtatgtgcatgaagctgtgaaggccggcgtggtgggccctgagctgcacgagcagctgctgtctgctgagaaggctgtgacaggctacagagacccctacagcggcagcaccatcagcctcttccaggccatgcagaagggcctggtgctgcggcagcacggcatccggctgctggaggcccagatcgccaccggcggcatcatcgaccctgtgcacagccaccgggtgcctgtggatgtggcctaccagaggggctacttcagcgaggagatgaacagagtgctggccgaccccagtgatgacaccaagggcttctttgaccccaacacccatgagaacctgacctaccggcagctgctggagcgctgtgtggaggaccctgagaccggcctgcggctgctgcccctgaagggagctgagaaggccgaggtggtggagaccacccaggtgtacacagaggaggagacccggcgggcctttgaggagacccagattgacatccctgggggcggcagccatggaggcagcaccatgagcctgtgggaggtgatgcagagcgacctgatccctgaggagcagagggcccagctgatggctgacttccaggccggccgggtgaccaaggagaggatgatcatcatcatcatcgagatcatcgagaagacagagatcatccggcagcagggcctggccagctatgactatgtgagaagaaggctgacagctgaggacctgtttgaggcccgcatcatcagcctggagacctacaacctgctgcgggagggcaccaggagcctgcgggaggccctggaggccgagagcgcctggtgctacctgtatggcaccggctctgtggccggcgtgtacctgcccggcagccggcagaccctgagcatctaccaggccctgaagaagggcctgctgtctgctgaggtggcccggctgctgctggaggcccaggccgccaccggcttcctgctggaccctgtgaagggggagcggctgactgtggatgaggccgtgaggaagggcctggtgggccctgagctgcatgaccggctgctgtctgctgagagagctgtgacaggctacagagacccctacacagagcagaccatcagcctcttccaggccatgaagaaggagctgatccccacagaggaggccctgcggctgctggatgcccagctggccactggaggcatcgtggacccccggctgggcttccacctgcccctggaggtggcctaccagaggggctacctgaacaaggacacccatgaccagctgtctgagcccagcgaggtgcgctcctatgtggaccccagcacagatgagcggctgagctacacccagctgctgcggcgctgcagaagagatgatggcaccggccagctgctgctgcccctgagtgatgccaggaagctgaccttccggggcctgaggaagcagatcaccatggaggagctggtgcgcagccaggtgatggatgaggccacagccctgcagctgcgggagggcctgaccagcattgaggaggtgaccaagaacctgcagaagttcctggagggcaccagctgcatcgccggcgtgtttgtggatgccaccaaggagcggctgtctgtgtaccaggccatgaagaagggcatcatccggcctggaacagcctttgagctgctggaggcccaggccgccaccggctacgtgattgaccccatcaagggcctgaagctgactgtggaggaggccgtgaggatgggcatcgtgggccctgagttcaaggacaagctgctgtctgctgagagagctgtgacaggctacaaggacccctacagcggcaagctgatcagcctcttccaggccatgaagaagggcctcatcctgaaggaccacggcatccggctgctggaggcccagatcgccaccggcggcatcatcgaccctgaggagagccaccggctgcctgtggaggtggcctacaagaggggcctgtttgatgaggagatgaatgagatcctgacagaccccagtgatgacaccaagggcttctttgaccccaacacagaggagaacctgacctacctgcagctgatggagcgctgcatcacagacccccagacaggcctgtgcctgctgcccctgaaggagaagaagcgggagaggaagaccagcagcaagagctctgtgaggaagagaagagtggtgattgtggaccctgagaccgggaaggagatgtctgtgtatgaggcctacaggaagggcctgattgaccaccagacctacctggagctgtctgagcaggagtgtgagtgggaggagatcaccatcagcagcagtgatggagtggtgaagtccatgatcatcgaccggcgcagcggccggcagtatgacattgatgatgccatcgccaagaacctgattgacagaagtgccctggaccagtacagagctggcaccctgagcatcacagaatttgctgacatgctgtctggaaatgccggcggcttccgcagccgcagcagctctgtgggcagcagcagcagctaccccatcagccctgctgtgtccaggacccagctggcctcctggagcgaccccacagaggagaccggccctgtggccggcatcctggacacagagaccctggagaaggtgtccatcacagaggccatgcacaggaacctggtggacaacatcaccggccagaggctgctggaggcccaggcctgcacaggaggcatcatcgaccccagcactggagagcgcttccctgtgacagatgctgtgaacaagggcctggtggacaagatcatggtggaccgcatcaacctggcccagaaggccttctgtggctttgaggaccccaggaccaagaccaagatgtctgctgcccaggccctgaagaagggctggctgtactatgaggccggccagcgcttcctggaggtgcagtacctgactggaggcctgattgaaccagacaccccaggccgggtgcccctggatgaggccctgcagaggggcaccgtggatgccaggacagcccagaagctgagagatgtgggcgcctacagcaagtacctgacctgccccaagaccaagctgaagatctcctacaaggatgccctggaccgctccatggtggaggagggcaccggcctgcggctgctggaggccgccgcccagagcaccaagggctactacagcccctacagcgtgtctggcagcggcagcacagctggcagcaggacaggcagcaggacaggcagccgggccggcagcagaagaggcagctttgatgccaccggcagcggcttctccatgaccttcagcagcagcagctacagcagcagcggctacggccgccgctatgccagcggcagcagcgccagcctgggcggccctgagagcgctgtggcctag

SEQ ID NO: 164418 - DNA, 13713 bp, Artificial Sequence
  Description of Artificial Sequence: Synthetic coding sequence
atgtctggagaagatgctgaggtgcgggctgtgtctgaagatgtgtccaatggcagcagcggcagccccagccctggggacaccctgccctggaacctgggcaagacccagaggagccgccgcagcggcggcggggccggcagcaatggatctgtgctggaccctgctgagagagctgtgatcagaattgctgatgagcgggacagagtgcagaagaagaccttcaccaagtgggtgaacaagcacctgatcaaggcccagaggcacatcagtgacctgtatgaggacctgagagatggccacaacctgatcagcctgctggaggtgctgagcggggacagcctgccccgggagaagggccgcatgaggttccacaagctgcagaatgtgcagatcgccctggactacctgcggcaccggcaggtgaagctggtgaacatcagaaatgatgacattgctgatggcaaccccaagctgaccctgggcctcatctggaccatcatcctgcacttccagatcagtgacatccaggtgtctggccagagcgaggacatgacagccaaggagaagctgctgctgtggagccagaggatggtggagggctaccagggcctgcgctgtgacaacttcaccagctcctggagagatggccgcctcttcaatgccatcatccaccgccacaagcccctgctgattgacatgaacaaggtgtaccggcagaccaacctggagaacctggaccaggccttctctgtggccgagcgggacctgggcgtgacccggctgctggaccctgaagatgtggatgtgccccagccagatgagaagagcatcatcacctacgtgagcagcctgtatgatgccatgccccgggtgcctgatgtgcaggatggagagctgcagctgcgctggcaggagtaccgggagctggtgctgctgctgctgcagtggatgaggcaccacacagctgcctttgaggagcggcgcttccccagcagctttgaggagattgagatcctgtggagccagttcctgaagttcaaggagatggagctgcctgccaaggaggccgacaagaacagaagcaagggcatctaccagagcctggagggcgctgtgcaggccggccagctgaaggtgcccccaggctaccaccccctggatgtggagaaggagtggggcaagctgcacgtggccatcctggagcgggagaagcagctgcggagtgaatttgagcggctggagtgcctgcagagaattgtgaccaagctgcagatggaggccggcctgtgtgaggagcagctgaaccaggctgatgccctgctgcagagtgatgtgcggctgctggccgccggcaaggtgccccagagagctggggaggtggagcgggacctggacaaggctgacagcatgatccggctgctcttcaatgatgtgcagaccctgaaggatggccgccacccccagggcgagcagatgtacagaagagtgtaccgcctgcacgagcggctggtggccatcagaacagagtacaacctgcggctgaaggccggcgtggccgccccagccacccaggtggcccaggtgaccctgcagagcgtgcagaggaggcctgagctggaggacagcaccctgcgctacctgcaggacctgctggcctgggtggaggagaaccagcaccgggtggatggagctgagtggggcgtggacctgcccagcgtggaggcccagctgggcagccaccggggcctgcaccagagcattgaggagttccgggccaagattgagcgggcccggagtgatgagggccagctgagccctgccaccaggggggcctacagagactgcctgggccgcctggacctgcagtatgccaagctgctgaacagcagcaaggcccggctgcggagcctggagagcctgcacagctttgtggccgccgccaccaaggagctgatgtggctgaatgagaaggaggaggaggaggtgggctttgactggagcgacaggaacaccaacatgacagccaagaaggagagctacagcgccctgatgagggagctggagctgaaggagaagaagatcaaggagctgcagaatgctggggaccggctgctgcgggaggaccacccagcccggcccaccgtggagagcttccaggccgccctgcagacccagtggagctggatgctgcagctgtgctgctgcatcgaggcccacctgaaggaaaatgctgcctacttccagttcttcagtgatgtgcgggaggccgagggccagctgcagaagctgcaggaggccctgcggaggaagtacagctgtgacagaagtgccaccgtgacccggctggaggacctgctgcaggatgcccaggatgagaaggagcagctgaatgagtacaagggccacctgagcggcctggccaagagggccaaggctgtggtgcagctgaagcccaggcacccagcccaccccatgaggggccgcctgcccctgctggccgtgtgtgactacaagcaggtggaggtgacagtgcacaagggagatgagtgccagctggtgggccctgcccagcccagccactggaaggtgctgagcagcagcggcagcgaggccgctgtgcccagcgtgtgcttcctggtgcccccacccaaccaggaggcccaggaggccgtgacccggctggaggcccagcaccaggccctggtgaccctgtggcaccagctgcacgtggacatgaagagcctgctggcctggcagagcctgcggagagatgtgcagctgatccgctcctggagcctggccaccttccgcaccctgaagccagaggagcagaggcaggccctgcacagcctggagctgcactaccaggccttcctgcgggacagccaggatgctgggggctttggacctgaggaccggctgatggccgagcgggagtatggcagctgcagccaccactaccagcagctgctgcagagcctggagcagggcgcccaggaggagagccgctgccagcgctgcatcagcgagctgaaggacatccggctgcagctggaggcctgtgagaccaggacagtgcaccggctgcggctgcccctggacaaggagcccgccagagaatgtgcccagagaattgctgagcagcagaaggcccaggccgaggtggagggcctgggcaaaggagtggcccggctgtctgctgaggccgagaaggtgctggccctgcctgagcccagccctgctgcccccaccctgcggtctgagctggagctgaccctgggcaagctggagcaggtgcgcagcctgagcgccatctacctggagaagctgaagaccatcagcctggtgatccggggcacccagggcgctgaggaggtgctgcgggcccacgaggagcagctgaaggaggcccaggccgtgcctgccaccctgcctgagctggaggccaccaaggccagcctgaagaagctgcgggcccaggccgaggcccagcagcccacctttgatgccctgagagatgagctgcggggggcccaggaggtgggggagcggctgcagcagagacatggagagagagatgtggaggtggagcgctggagggagcgggtggcccagctgctggagcgctggcaggccgtgctggcccagacagatgtgcggcagcgggagctggagcagctgggccggcagctgcgctactaccgggagagcgctgaccccctgggcgcctggctgcaggatgcccggcggcggcaggagcagatccaggccatgcccctggccgacagccaggccgtgcgggagcagctgcggcaggagcaggccctgctggaggagattgagcggcacggggagaaggtggaggagtgccagagatttgccaagcagtacatcaatgccatcaaggactatgagctgcagctggtgacctacaaggcccagctggagcctgtggccagccctgccaagaagcccaaggtgcagagcggcagcgagagcgtcatccaggagtatgtggacctgcggacccactacagcgagctgaccaccctgaccagccagtacatcaagttcatcagcgagaccctgcggaggatggaggaggaggagcggctggccgagcagcagagagctgaggagcgggagcggctggccgaggtggaggccgccctggagaagcagaggcagctggccgaggcccacgcccaggccaaggcccaggccgagcgggaggccaaggagctgcagcagaggatgcaggaggaggtggtgcggcgggaggaggccgctgtggatgcccagcagcagaagaggagcatccaggaggagctgcagcagctgcggcagagcagcgaggccgagatccaggccaaggcccggcaggccgaggccgctgagaggagccggctgagaattgaggaggagatccgggtggtgcggctgcagctggaggccacagagcggcagaggggcggcgctgagggggagctgcaggccctgcgggcccgggcagaggaggccgaggcccagaagaggcaggcccaggaggaggccgagcggctgcggcggcaggtgcaggatgagagccagaggaagaggcaggccgaggtggagctggccagccgggtgaaggccgaggccgaggccgcccgggagaagcagagggccctgcaggccctggaggagctgcggctgcaggccgaggaggccgagcggcggctgcggcaggccgaggtggagcgggcccggcaggtgcaggtggccctggagacagcccagaggtctgctgaggccgagctgcagagcaagagggccagctttgctgagaagacagcccagctggagaggagcctgcaggaggagcacgtggccgtggcccagctgcgggaggaggccgagcggcgggcccagcagcaggccgaggccgagcgggcccgggaggaggccgagcgggagctggagcgctggcagctgaaggccaatgaggccctgcggctgcggctgcaggccgaggaggtggcccagcagaagagcctggcccaggccgaggccgagaagcagaaggaggaggccgagcgggaggcccggcggcggggcaaggccgaggagcaggccgtgcggcagcgggagctggccgagcaggagctggagaagcagaggcagctggccgagggcacagcccagcagaggctggccgctgagcaggagctgatccggctgcgggcagagacagagcagggcgagcagcagaggcagctgctggaggaggagctggcccggctgcagcgggaggccgccgccgccacccagaagaggcaggagctggaggccgagctggccaaggtgcgggcagagatggaggtgctgctggccagcaaggcccgggcagaggaggagagccgcagcaccagcgagaagagcaagcagaggctggaggccgaggccggccgcttccgggagctggccgaggaggccgcccggctgcgggccctggccgaggaggccaagaggcagaggcagctggccgaggaggatgctgcccggcagagagctgaggccgagcgggtgctggccgagaagctggccgccatcggggaggccacccggctgaagacagaagctgagatcgccctgaaggagaaggaggctgaaaatgaaaggctgcggcggctggccgaggatgaggccttccagaggcggcggctggaggagcaggccgcccagcacaaggctgacatcgaggagcggctggcccagctgaggaaggccagtgacagcgagctggagcggcagaagggcctggtggaggacaccctgcggcagaggcggcaggtggaggaggagatcctggccctgaaggccagctttgagaaggctgctgctgggaaggccgagctggagctggagctgggccgcatccgcagcaatgctgaggacaccctgcggagcaaggagcaggccgagctggaggccgcccggcagaggcagctggccgctgaggaggagaggagaagaagagaagctgaggagcgggtgcagaagagcctggccgctgaggaggaggccgcccggcagaggaaggccgccctggaggaggtggagcggctgaaggccaaggtggaggaggcccggcggctgcgggagagagctgagcaggagagcgcccggcagctgcagctggcccaggaggccgcccagaagaggctgcaggccgaggagaaggcccacgcctttgctgtgcagcagaaggagcaggagctgcagcagaccctgcagcaggagcagagcgtgctggaccagctgcggggggaggccgaggccgcccggcgggctgctgaggaggccgaggaggcccgggtgcaggccgagcgggaggccgcccagagccggcggcaggtggaggaggccgagcggctgaagcagagcgctgaggagcaggcccaggcccgggcccaggcccaggccgctgctgagaagctgaggaaggaggccgagcaggaggccgcccggcgggcccaggccgagcaggccgccctgcggcagaagcaggccgcagatgctgagatggagaagcacaagaagtttgctgagcagaccctgcggcagaaggcccaggtggagcaggagctgaccaccctgcggctgcagctggaggagacagaccaccagaagaacctgctggatgaggagctgcagaggctgaaggccgaggccacagaggccgcccggcagaggagccaggtggaggaggagctgttctctgtgcgggtgcagatggaggagctgagcaagctgaaggcccgcatcgaggctgaaaatagagccctgatcctgcgggacaaggacaacacccagcgcttcctgcaggaggaggccgagaagatgaagcaggtggccgaggaggccgcccggctgtctgtggccgcccaggaggccgcccggctgcggcagctggccgaggaggacctggcccagcagagggccctggccgagaagatgctgaaggagaagatgcaggccgtgcaggaggccacccggctgaaggccgaggccgagctgctgcagcagcagaaggagctggcccaggagcaggcccggcggctgcaggaggacaaggagcagatggcccagcagctggccgaggagacccagggcttccagaggaccctggaggccgagcggcagaggcagctggagatgtctgctgaggccgagcggctgaagctgcgggtggccgagatgagccgggcccaggcccgggcagaggaggatgcccagcgcttcaggaagcaggccgaggagatcggggagaagctgcacaggacagagctggccacccaggagaaggtgaccctggtgcagaccctggagatccagaggcagcagagcgaccatgatgctgagcggctgcgggaggccatcgccgagctggagcgggagaaggagaagctgcagcaggaggccaagctgctgcagctgaagtctgaggagatgcagacagtgcagcaggagcagctgctgcaggagacccaggccctgcagcagagcttcctgtctgagaaggacagcctgctgcagcgggagcgcttcatcgagcaggagaaggccaagctggagcagctgttccaggatgaggtggccaaggcccagcagctgcgggaggagcagcagaggcagcagcagcagatggagcaggagcggcagaggctggtggcctccatggaggaggcccggcggcggcagcatgaagctgaggagggcgtgcggaggaagcaggaggagctgcagcagctggagcagcagaggcggcagcaggaggagctgctggccgaggagaaccagaggctgcgggagcagctgcagctgctggaggagcagcaccgggccgccctggcccacagcgaggaggtgacagccagccaggtggccgccaccaagaccctgcccaacggcagagatgccctggatggccctgctgctgaggccgagcctgagcacagctttgatggcctgcggaggaaggtgtctgcccagaggctgcaggaggccggcatcctgtctgctgaggagctgcagaggctggcccagggccacaccaccgtggatgagctggccaggagagaagatgtgcgccactacctgcagggccgcagcagcattgctggcctgctgctgaaggccaccaatgagaagctgtctgtgtatgctgccctgcagaggcagctgctgagccctggaacagccctgatcctgctggaggcccaggccgccagcggcttcctgctggaccctgtgaggaacagaaggctgactgtgaatgaggccgtgaaggagggcgtggtgggccctgagctgcaccacaagctgctgtctgctgagagagctgtgacaggctacaaggacccctacacaggccagcagatcagcctcttccaggccatgcagaagggcctcatcgtgcgggagcacggcatccggctgctggaggcccagatcgccactggaggagtgattgatcctgtgcacagccaccgggtgcctgtggatgtggcctaccgccggggctactttgatgaggagatgaacagagtgctggccgaccccagtgatgacaccaagggcttctttgaccccaacacccatgagaacctgacctacctgcagctgctggagcgctgtgtggaggaccctgagaccggcctgtgcctgctgcccctgacagacaaggccgccaagggcggggagctggtgtacacagacagcgaggccagagatgtgtttgagaaggccaccgtgtctgccccctttgggaagttccagggcaagacagtgaccatctgggagatcatcaacagcgagtacttcaccgctgagcagaggcgggacctgctgcggcagttcagaacaggccgcatcaccgtggagaagatcatcaagatcatcatcaccgtggtggaggagcaggagcagaagggccgcctgtgctttgagggcctgcggagcctggtgcctgctgctgagctgctggagagccgggtgattgaccgggagctgtaccagcagctgcagagaggagagaggtctgtgagagatgtggccgaggtggacacagtgcggcgggccctgcggggggccaacgtgattgctggggtgtggctggaggaggccggccagaagctgagcatctacaatgccctgaagaaggacctgctgcccagcgacatggctgtggccctgctggaggcccaggccggcaccggccacatcattgatcctgccaccagcgcccggctgactgtggatgaggccgtgcgggccggcctggtgggccctgagttccacgagaagctgctgtctgctgagaaggctgtgacaggctacagagacccctacacaggccagagcgtgtccctcttccaggccctgaagaagggcctcatcccccgggagcagggcctgcggctgctggatgcccagctgagcactggaggcatcgtggaccccagcaagagccaccgggtgcccctggatgtggcctgtgcccggggctgcctggatgaggagaccagccgggccctgagcgcccccagggcagatgccaaggcctacagcgaccccagcactggagagcccgccacctatggagagctgcagcagcgctgcaggccagaccagctgaccggcctgagcctgctgcccctgtctgagaaggccgcccgggcccggcaggaggagctgtacagcgagctgcaggcccgggagacctttgagaagacccctgtggaggtgcctgtgggcggcttcaagggccgcacagtgacagtgtgggagctgatcagcagcgagtacttcaccgctgagcagaggcaggagctgctgcggcagttcagaacaggcaaggtgacagtggagaaggtgatcaagatcctgatcaccatcgtggaggaggtggagaccctgcggcaggagcggctgtccttcagcggcctgcgggcccctgtgcctgccagcgagctgctggccagcggcgtgctgagccgggcccagtttgagcagctgaaggatggcaagaccaccgtgaaggacctgtctgagctgggctctgtgaggaccctgctgcagggcagcggctgcctggccggcatctacctggaggacaccaaggagaaggtgtccatctatgaggccatgagaagaggcctgctgcgggccaccacagctgccctgctgctggaggcccaggccgccaccggcttcctggtggaccctgtgaggaaccagaggctgtatgtgcatgaagctgtgaaggccggcgtggtgggccctgagctgcacgagcagctgctgtctgctgagaaggctgtgacaggctacagagacccctacagcggcagcaccatcagcctcttccaggccatgcagaagggcctggtgctgcggcagcacggcatccggctgctggaggcccagatcgccaccggcggcatcatcgaccctgtgcacagccaccgggtgcctgtggatgtggcctaccagaggggctacttcagcgaggagatgaacagagtgctggccgaccccagtgatgacaccaagggcttctttgaccccaacacccatgagaacctgacctaccggcagctgctggagcgctgtgtggaggaccctgagaccggcctgcggctgctgcccctgaagggagctgagaaggccgaggtggtggagaccacccaggtgtacacagaggaggagacccggcgggcctttgaggagacccagattgacatccctgggggcggcagccatggaggcagcaccatgagcctgtgggaggtgatgcagagcgacctgatccctgaggagcagagggcccagctgatggctgacttccaggccggccgggtgaccaaggagaggatgatcatcatcatcatcgagatcatcgagaagacagagatcatccggcagcagggcctggccagctatgactatgtgagaagaaggctgacagctgaggacctgtttgaggcccgcatcatcagcctggagacctacaacctgctgcgggagggcaccaggagcctgcgggaggccctggaggccgagagcgcctggtgctacctgtatggcaccggctctgtggccggcgtgtacctgcccggcagccggcagaccctgagcatctaccaggccctgaagaagggcctgctgtctgctgaggtggcccggctgctgctggaggcccaggccgccaccggcttcctgctggaccctgtgaagggggagcggctgactgtggatgaggccgtgaggaagggcctggtgggccctgagctgcatgaccggctgctgtctgctgagagagctgtgacaggctacagagacccctacacagagcagaccatcagcctcttccaggccatgaagaaggagctgatccccacagaggaggccctgcggctgctggatgcccagctggccactggaggcatcgtggacccccggctgggcttccacctgcccctggaggtggcctaccagaggggctacctgaacaaggacacccatgaccagctgtctgagcccagcgaggtgcgctcctatgtggaccccagcacagatgagcggctgagctacacccagctgctgcggcgctgcagaagagatgatggcaccggccagctgctgctgcccctgagtgatgccaggaagctgaccttccggggcctgaggaagcagatcaccatggaggagctggtgcgcagccaggtgatggatgaggccacagccctgcagctgcgggagggcctgaccagcattgaggaggtgaccaagaacctgcagaagttcctggagggcaccagctgcatcgccggcgtgtttgtggatgccaccaaggagcggctgtctgtgtaccaggccatgaagaagggcatcatccggcctggaacagcctttgagctgctggaggcccaggccgccaccggctacgtgattgaccccatcaagggcctgaagctgactgtggaggaggccgtgaggatgggcatcgtgggccctgagttcaaggacaagctgctgtctgctgagagagctgtgacaggctacaaggacccctacagcggcaagctgatcagcctcttccaggccatgaagaagggcctcatcctgaaggaccacggcatccggctgctggaggcccagatcgccaccggcggcatcatcgaccctgaggagagccaccggctgcctgtggaggtggcctacaagaggggcctgtttgatgaggagatgaatgagatcctgacagaccccagtgatgacaccaagggcttctttgaccccaacacagaggagaacctgacctacctgcagctgatggagcgctgcatcacagacccccagacaggcctgtgcctgctgcccctgaaggagaagaagcgggagaggaagaccagcagcaagagctctgtgaggaagagaagagtggtgattgtggaccctgagaccgggaaggagatgtctgtgtatgaggcctacaggaagggcctgattgaccaccagacctacctggagctgtctgagcaggagtgtgagtgggaggagatcaccatcagcagcagtgatggagtggtgaagtccatgatcatcgaccggcgcagcggccggcagtatgacattgatgatgccatcgccaagaacctgattgacagaagtgccctggaccagtacagagctggcaccctgagcatcacagaatttgctgacatgctgtctggaaatgccggcggcttccgcagccgcagcagctctgtgggcagcagcagcagctaccccatcagccctgctgtgtccaggacccagctggcctcctggagcgaccccacagaggagaccggccctgtggccggcatcctggacacagagaccctggagaaggtgtccatcacagaggccatgcacaggaacctggtggacaacatcaccggccagaggctgctggaggcccaggcctgcacaggaggcatcatcgaccccagcactggagagcgcttccctgtgacagatgctgtgaacaagggcctggtggacaagatcatggtggaccgcatcaacctggcccagaaggccttctgtggctttgaggaccccaggaccaagaccaagatgtctgctgcccaggccctgaagaagggctggctgtactatgaggccggccagcgcttcctggaggtgcagtacctgactggaggcctgattgaaccagacaccccaggccgggtgcccctggatgaggccctgcagaggggcaccgtggatgccaggacagcccagaagctgagagatgtgggcgcctacagcaagtacctgacctgccccaagaccaagctgaagatctcctacaaggatgccctggaccgctccatggtggaggagggcaccggcctgcggctgctggaggccgccgcccagagcaccaagggctactacagcccctacagcgtgtctggcagcggcagcacagctggcagcaggacaggcagcaggacaggcagccgggccggcagcagaagaggcagctttgatgccaccggcagcggcttctccatgaccttcagcagcagcagctacagcagcagcggctacggccgccgctatgccagcggcagcagcgccagcctgggcggccctgagagcgctgtggcctag

SEQ ID NO: 164419 - DNA, 1503 bp, Artificial Sequence
  Description of Artificial Sequence: Synthetic coding sequence
atggccaccgtcatccctggggacctgtctgaggtgcgggacacccagaaggtgcccagcggcaagaggaagagaggagagaccaagcccaggaagaacttcccctgccagctgtgtgacaaggccttcaacagcgtggagaagctgaaggtgcacagctacagccacactggagagcggccctacaagtgcatccagcaggactgcaccaaggcctttgtgtccaagtacaagctgcagaggcacatggccacccacagccctgagaagacccacaagtgcaactactgtgagaagatgttccacaggaaggaccacctgaagaaccacctgcacacccatgaccccaacaaggagaccttcaagtgtgaagaatgtgggaagaactacaacaccaagctgggcttcaagaggcacctggccctgcacgccgccaccagcggggacctgacctgcaaggtgtgcctgcagacctttgagagcactggagtgctgctggagcacctgaagagccatgctgggaagagcagtggaggagtgaaggagaagaagcaccagtgtgagcactgtgaccggcgcttctacaccaggaaggatgtgagaagacacatggtggtgcacacaggcaggaaggacttcctgtgccagtactgtgcccagcgcttcggcaggaaggaccacctgaccaggcacatgaagaagagccacaaccaggagctgctgaaggtgaagacagagcctgtggacttcctggaccccttcacctgcaatgtgtctgtgcccatcaaggatgagctgctgcctgtgatgagcctgcccagcagcgagctgctgagcaagcccttcaccaacaccctgcagctgaacctgtacaacacccccttccagagcatgcagagcagcggcagcgcccaccagatgatcaccaccctgcccctgggcatgacctgccccatcgacatggacacagtgcaccccagccaccacctgtccttcaagtaccccttcagcagcaccagctatgccatcagcatccctgagaaggagcagcccctgaagggggagattgagagctacctgatggagctgcagggcggcgtgcccagcagcagccaggacagccaggccagcagcagcagcaagctgggcctggacccccagatcggcagcctggatgatggagctggggacctgagcctgagcaagagcagcatcagcatcagtgaccccctgaacaccccagccctggacttcagccagctgttcaacttcatccccctgaatggccccccctacaaccccctgtctgtgggcagcctgggcatgagctacagccaggaggaggcccacagctctgtgtcccagctgcccccccagacccaggacctgcaggaccctgccaacaccatcggcctgggcagcctgcacagcctgtctgctgccttcaccagcagcctgagcaccagcaccaccctgccccgcttccaccaggccttccagtag

SEQ ID NO: 164420 - DNA, 1257 bp, Artificial Sequence
  Description of Artificial Sequence: Synthetic coding sequence
atggccacccacagccctgagaagacccacaagtgcaactactgtgagaagatgttccacaggaaggaccacctgaagaaccacctgcacacccatgaccccaacaaggagaccttcaagtgtgaagaatgtgggaagaactacaacaccaagctgggcttcaagaggcacctggccctgcacgccgccaccagcggggacctgacctgcaaggtgtgcctgcagacctttgagagcactggagtgctgctggagcacctgaagagccatgctgggaagagcagtggaggagtgaaggagaagaagcaccagtgtgagcactgtgaccggcgcttctacaccaggaaggatgtgagaagacacatggtggtgcacacaggcaggaaggacttcctgtgccagtactgtgcccagcgcttcggcaggaaggaccacctgaccaggcacatgaagaagagccacaaccaggagctgctgaaggtgaagacagagcctgtggacttcctggaccccttcacctgcaatgtgtctgtgcccatcaaggatgagctgctgcctgtgatgagcctgcccagcagcgagctgctgagcaagcccttcaccaacaccctgcagctgaacctgtacaacacccccttccagagcatgcagagcagcggcagcgcccaccagatgatcaccaccctgcccctgggcatgacctgccccatcgacatggacacagtgcaccccagccaccacctgtccttcaagtaccccttcagcagcaccagctatgccatcagcatccctgagaaggagcagcccctgaagggggagattgagagctacctgatggagctgcagggcggcgtgcccagcagcagccaggacagccaggccagcagcagcagcaagctgggcctggacccccagatcggcagcctggatgatggagctggggacctgagcctgagcaagagcagcatcagcatcagtgaccccctgaacaccccagccctggacttcagccagctgttcaacttcatccccctgaatggccccccctacaaccccctgtctgtgggcagcctgggcatgagctacagccaggaggaggcccacagctctgtgtcccagctgcccccccagacccaggacctgcaggaccctgccaacaccatcggcctgggcagcctgcacagcctgtctgctgccttcaccagcagcctgagcaccagcaccaccctgccccgcttccaccaggccttccagtag

SEQ ID NO: 164421 - DNA, 1503 bp, Artificial Sequence; identical to SEQ ID NO: 164419
  Description of Artificial Sequence: Synthetic coding sequence

SEQ ID NO: 164422 - DNA, 1392 bp, Artificial Sequence
  Description of Artificial Sequence: Synthetic coding sequence
atggccaccttcccctgccagctgtgtgggaagaccttcctgaccctggagaagttcaccatccacaactacagccacagccgggagcggccctacaagtgtgtgcagcctgactgtgggaaggcctttgtgagccgctacaagctgatgaggcacatggccacccacagcccccagaagagccaccagtgtgcccactgtgagaagaccttcaacaggaaggaccacctgaagaaccacctgcagacccatgaccccaacaagatggccttcggctgtgaagaatgtgggaagaagtacaacaccatgctgggctacaagaggcacctggccctgcacgccgccagcagcggggacctgacctgtggggtgtgtgccctggagctgggcagcacagaggtgctgctggaccacctgaaggcccatgctgaggagaagcccccatctggcaccaaggagaagaagcaccagtgtgaccactgtgagcgctgcttctacaccaggaaggatgtgcggcggcacctggtggtgcacacaggctgcaaggacttcctgtgccagttctgtgcccagagatttggaaggaaggaccacctgaccaggcacaccaagaagacccacagccaggagctgatgaaggagagcctgcagacaggagacctgctgagcaccttccacaccatcagccccagcttccagctgaaggctgctgccctgccccccttccccctgggcgccagcgcccagaatggcctggccagcagcctgcctgctgaggtgcacagcctgaccctgagccccccagagcaggccgcccagcccatgcagcccctgcctgagagcctggccagcctgcaccccagcgtgtccccaggcagccccccaccacccctgcccaaccacaagtacaacaccaccagcaccagctacagccccctggccagcctgcccctgaaggctgacaccaagggcttctgcaacatcagcctgtttgaggacctgcccctgcaggagccccagagcccccagaagctgaaccctggctttgacctggccaagggaaatgctgggaaggtgaacctgcccaaggagctgcctgcagatgctgtgaacctgaccatcccagccagcctggacctgagccccctgctgggcttctggcagctgcccccaccagccacccagaacaccttcggcaacagcaccctggccctgggccctggagagagcctgccccaccggctgagctgcctgggccagcagcagcaggagccccccctggccatgggcaccgtgtccctgggccagctgcccctgccccccatcccccacgtgttttctgctggcaccggcagcgccatcctgccccacttccaccacgccttcagatag

SEQ ID NO: 164423 - DNA, 1392 bp, Artificial Sequence; identical to SEQ ID NO: 164422
  Description of Artificial Sequence: Synthetic coding sequence

SEQ ID NO: 164424 - DNA, 1392 bp, Artificial Sequence; identical to SEQ ID NO: 164422
  Description of Artificial Sequence: Synthetic coding sequence

SEQ ID NO: 164425 - DNA, 1236 bp, Artificial Sequence
  Description of Artificial Sequence: Synthetic coding sequence
atggccacccacagcccccagaagagccaccagtgtgcccactgtgagaagaccttcaacaggaaggaccacctgaagaaccacctgcagacccatgaccccaacaagatggccttcggctgtgaagaatgtgggaagaagtacaacaccatgctgggctacaagaggcacctggccctgcacgccgccagcagcggggacctgacctgtggggtgtgtgccctggagctgggcagcacagaggtgctgctggaccacctgaaggcccatgctgaggagaagcccccatctggcaccaaggagaagaagcaccagtgtgaccactgtgagcgctgcttctacaccaggaaggatgtgcggcggcacctggtggtgcacacaggctgcaaggacttcctgtgccagttctgtgcccagagatttggaaggaaggaccacctgaccaggcacaccaagaagacccacagccaggagctgatgaaggagagcctgcagacaggagacctgctgagcaccttccacaccatcagccccagcttccagctgaaggctgctgccctgccccccttccccctgggcgccagcgcccagaatggcctggccagcagcctgcctgctgaggtgcacagcctgaccctgagccccccagagcaggccgcccagcccatgcagcccctgcctgagagcctggccagcctgcaccccagcgtgtccccaggcagccccccaccacccctgcccaaccacaagtacaacaccaccagcaccagctacagccccctggccagcctgcccctgaaggctgacaccaagggcttctgcaacatcagcctgtttgaggacctgcccctgcaggagccccagagcccccagaagctgaaccctggctttgacctggccaagggaaatgctgggaaggtgaacctgcccaaggagctgcctgcagatgctgtgaacctgaccatcccagccagcctggacctgagccccctgctgggcttctggcagctgcccccaccagccacccagaacaccttcggcaacagcaccctggccctgggccctggagagagcctgccccaccggctgagctgcctgggccagcagcagcaggagccccccctggccatgggcaccgtgtccctgggccagctgcccctgccccccatcccccacgtgttttctgctggcaccggcagcgccatcctgccccacttccaccacgccttcagatag

SEQ ID NO: 164426 - DNA, 1236 bp, Artificial Sequence; identical to SEQ ID NO: 164425
  Description of Artificial Sequence: Synthetic coding sequence

SEQ ID NO: 164427 - DNA, 1392 bp, Artificial Sequence; identical to SEQ ID NO: 164422
  Description of Artificial Sequence: Synthetic coding sequence

SEQ ID NO: 164428 - DNA, 1392 bp, Artificial Sequence; identical to SEQ ID NO: 164422
  Description of Artificial Sequence: Synthetic coding sequence

SEQ ID NO: 164429 - DNA, 531 bp, Artificial Sequence
  Description of Artificial Sequence: Synthetic coding sequence
atggccacccacagcccccagaagagccaccagtgtgcccactgtgagaagaccttcaacaggaaggaccacctgaagaaccacctgcagacccatgaccccaacaagatggccttcggctgtgaagaatgtgggaagaagtacaacaccatgctgggctacaagaggcacctggccctgcacgccgccagcagcggggacctgacctgtggggtgtgtgccctggagctgggcagcacagaggtgctgctggaccacctgaaggcccatgctgaggagaagcccccatctggcaccaaggagaagaagcaccagtgtgaccactgtgagcgctgcttctacaccaggaaggatgtgcggcggcacctggtggtgcacacaggctgcaaggacttcctgtgccagttctgtgcccagagatttggaaggaaggaccacctgaccaggcacaccaagaagacccacagccaggagctgatgaaggagagcctgcagacaggagacctgctgagcaccttccacaccatctag

SEQ ID NO: 164430 - DNA, 1392 bp, Artificial Sequence; identical to SEQ ID NO: 164422
  Description of Artificial Sequence: Synthetic coding sequence

SEQ ID NO: 164431 - DNA, 1236 bp, Artificial Sequence; identical to SEQ ID NO: 164425
  Description of Artificial Sequence: Synthetic coding sequence

SEQ ID NO: 164432 - DNA, 1392 bp, Artificial Sequence; identical to SEQ ID NO: 164422
  Description of Artificial Sequence: Synthetic coding sequence

SEQ ID NO: 164433 - DNA, 759 bp, Artificial Sequence
  Description of Artificial Sequence: Synthetic coding sequence
atgaaggagagcctgcagacaggagacctgctgagcaccttccacaccatcagccccagcttccagctgaaggccgccgccctgccccccttccccctgggcgccagcgcccagaatggcctggccagcagcctgcctgctgaggtgcacagcctgaccctgagccccccagagcaggccgcccagcccatgcagcccctgcctgagagcctggccagcctgcaccccagcgtgtccccaggcagccccccaccacccctgcccaaccacaagtacaacaccaccagcaccagctacagccccctggccagcctgcccctgaaggctgacaccaagggcttctgcaacatcagcctgtttgaggacctgcccctgcaggagccccagagcccccagaagctgaaccctggctttgacctggccaagggaaatgccggcaaggtgaacctgcccaaggagctgcctgcagatgctgtgaacctgaccatcccagccagcctggacctgagccccctgctgggcttctggcagctgcccccaccagccacccagaacacctttggaaacagcaccctggccctgggccctggagagagcctgccccaccggctgagctgcctgggccagcagcagcaggagccccccctggccatgggcaccgtgtccctgggccagctgcccctgccccccatcccccacgtgttttctgctggcactggaagtgccatcctgccccacttccaccacgccttcagatag

SEQ ID NO: 164434 - DNA, 1491 bp, Artificial Sequence
  Description of Artificial Sequence: Synthetic coding sequence
atgaccaccttcttcacctctgtgcccccctggatccaggatgccaagcaggaggaggaggtgggctggaagctggtgccccggccccggggccgggaggccgagagccaggtgaagtgccagtgtgagatcagcggcacccccttcagcaatggagagaagctgcggccccacagcctgccccagcctgagcagaggccctacagctgcccccagctgcactgcggcaaggcctttgccagcaagtacaagctgtaccgccacatggccacccacagcgcccagaagccccaccagtgcatgtactgtgacaagatgttccacaggaaggaccacctgaggaaccacctgcagacccatgaccccaacaaggaggccctgcactgcagtgaatgtgggaagaactacaacaccaagctgggctacagaagacacctggccatgcacgccgccagcagcggggacctgagctgcaaggtgtgcctgcagacctttgagagcacccaggccctgctggagcacctgaaggcccacagccggcgggtggccggcggggccaaggagaagaagcacccctgtgaccactgtgaccggcgcttctacaccaggaaggatgtgagaagacacctggtggtgcacacaggcaggaaggacttcctgtgccagtactgtgcccagcgcttcggcaggaaggaccacctgaccaggcatgtgaagaagagccacagccaggagctgctgaagatcaagacagagcctgtggacatgctgggcctgctgagctgcagcagcacagtgtctgtgaaggaggagctgagccctgtgctgtgcatggccagcagagatgtgatgggcaccaaggccttccctggcatgctgcccatgggcatgtacggggcccacatccccaccatgcccagcactggagtgccccacagcctggtgcacaacaccctgcccatgggcatgagctaccccctggagagcagccccatcagcagccctgcccagctgccccccaagtaccagctgggcagcaccagctacctgcctgacaagctgcccaaggtggaggtggacagcttcctggccgagctgcccggcagcctgagcctgagcagcgctgagccccagcctgccagcccccagcctgctgctgctgctgccctgctggatgaggccctgctggccaagagccctgccaacctgtctgaggccctgtgtgccgccaacgtggacttcagccacctgctgggcttcctgcccctgaacctgcccccctgcaaccccccaggggccaccggcggcctggtgatgggctacagccaggccgaggcccagcccctgctgaccaccctgcaggcccagccccaggacagccctggagctgggggccccctgaactttggccccctgcacagcctgccccctgtgttcaccagcggcctgagcagcaccaccctgccccgcttccaccaggccttccagtag

SEQ ID NO: 164435 - DNA, 507 bp, Artificial Sequence
  Description of Artificial Sequence: Synthetic coding sequence
atgcaggcccagcagtaccagcagcagaggaggaagtttgctgctgccttcctggccttcatcttcatcctggccgctgtggacacagctgaggccggcaagaaggagaagccagagaagaaggtgaagaagagtgactgtggggagtggcagtggagcgtgtgtgtgcccaccagcggggactgtggcctgggcacccgggagggcaccaggactggagctgagtgcaagcagaccatgaagacccagcgctgcaagatcccctgcaactggaagaagcagtttggagctgagtgcaagtaccagttccaggcctggggagaatgtgacctgaacacagccctgaagaccaggacaggcagcctgaagagggccctgcacaatgctgagtgccagaagacagtgaccatcagcaagccctgtgggaagctgaccaagcccaagccccaggccgagagcaagaagaagaagaaggagggcaagaagcaggagaagatgctggactag

SEQ ID NO: 164436 - DNA, 1518 bp, Artificial Sequence
  Description of Artificial Sequence: Synthetic coding sequence
atggtggaggaggtgcagaagcacagcgtgcacaccctggtgttccgcagcctgaagaggacccatgacatgtttgtggccgacaatggcaagcctgtgcccctggatgaggagagccacaagaggaagatggccatcaagctgagaaatgaatatggccctgtgctgcacatgcccaccagcaaagaaaacctgaaggagaagggcccccagaatgccacagacagctatgtgcacaagcagtacccagccaaccagggccaggaggtggagtactttgtggccggcgtggccctgacagctgacaccaagatccagaggatgcccagcgagagcgctgcccagagcctggccgtggccctgcccctgcagaccaaggcagatgccaacagaacagcccccagcggcagcgagtaccgccaccctggggccagtgaccggccccagcccacagccatgaacagcatcgtgatggagaccggcaacaccaagaacagcgccctgatggccaagaaggcccccaccatgcccaagccccagtggcaccccccctggaagctgtacagagtcatcagcggccacctgggctgggtgcgctgcatcgctgtggagcccggcaaccagtggtttgtgacaggcagcgctgacaggaccatcaagatctgggacctggccagcggcaagctgaagctgagcctgaccggccacatcagcacagtgcggggcgtcatcgtgtccaccaggagcccctacctgttcagctgtggggaggacaagcaggtgaagtgctgggacctggagtacaacaaggtgatccgccactaccacggccacctgtctgctgtgtatggcctggacctgcaccccaccattgatgtgctggtgacctgcagccgggacagcacagcccgcatctgggatgtgaggaccaaggcctctgtgcacaccctgagcggccacaccaatgctgtggccaccgtgcgctgccaggccgctgagccccagatcatcaccggcagccatgacaccaccatccggctgtgggacctggtggccggcaagaccagggtgaccctgaccaaccacaagaagtctgtgcgggctgtggtgctgcaccccaggcactacacctttgccagcggcagcccagacaacatcaagcagtggaagttcccagatggcagcttcatccagaacctgagcggccacaatgccatcatcaacaccctgactgtgaacagtgatggagtgctggtgtctggagctgacaatggcaccatgcacctgtgggactggaggacaggctacaacttccagagggtgcatgctgctgtgcagcccggcagcctggacagcgagagcggcatctttgcctgtgcctttgaccagagcgagagccggctgctgacagctgaggccgacaagaccatcaaggtgtaccgggaggatgacacagccacagaggagacccaccctgtgtcctggaagccagagatcatcaagaggaagcgcttctag

SEQ ID NO: 164437 - DNA, 1545 bp, Artificial Sequence
  Description of Artificial Sequence: Synthetic coding sequence
atgatctgtgaggtgcagaagcacagcgtgcacaccctggtgttccgcagcctgaagaggacccatgacatgtttgtggccgacaatggcaagcctgtgcccctggatgaggagagccacaagaggaagatggccatcaagctgagaaatgaatatggccctgtgctgcacatgcccaccagcaaagaaaacctgaaggagaagggcccccagaatgccacagacagctatgtgcacaagcagtacccagccaaccagggccaggaggtggagtactttgtggccggcacccacccctacccacctggccctggggtggccctgacagctgacaccaagatccagaggatgcccagcgagagcgctgcccagagcctggccgtggccctgcccctgcagaccaaggcagatgccaacagaacagcccccagcggcagcgagtaccgccaccctggggccagtgaccggccccagcccacagccatgaacagcatcgtgatggagactggaaacaccaagaacagcgccctgatggccaagaaggcccccaccatgcccaagccccagtggcaccccccctggaagctgtacagagtcatcagcggccacctgggctgggtgcgctgcatcgctgtggagcccggcaaccagtggtttgtgactggatctgctgacaggaccatcaagatctgggacctggccagcggcaagctgaagctgagcctgaccggccacatcagcacagtgcggggcgtgattgtgtccaccaggagcccctacctgttcagctgtggggaggacaagcaggtgaagtgctgggacctggagtacaacaaggtgatccgccactaccacggccacctgtctgctgtgtatggcctggacctgcaccccaccattgatgtgctggtgacctgcagccgggacagcacagcccgcatctgggatgtgaggaccaaggcctctgtgcacaccctgagcggccacaccaatgctgtggccaccgtgcgctgccaggccgctgagccccagatcatcaccggcagccatgacaccaccatccggctgtgggacctggtggccggcaagaccagggtgaccctgaccaaccacaagaagtctgtgcgggctgtggtgctgcaccccaggcactacacctttgccagcggcagcccagacaacatcaagcagtggaagttcccagatggcagcttcatccagaacctgagcggccacaatgccatcatcaacaccctgactgtgaacagtgatggagtgctggtgtctggagctgacaatggcaccatgcacctgtgggactggaggacaggctacaacttccagagggtgcacgccgctgtgcagcccggcagcctggacagcgagagcggcatctttgcctgtgcctttgaccagagcgagagccggctgctgacagctgaggccgacaagaccatcaaggtgtacagagaagatgacacagccacagaggagacccaccctgtgtcctggaagccagagatcatcaagaggaagcgcttctag

SEQ ID NO: 164438 - DNA, 1545 bp, Artificial Sequence
  Description of Artificial Sequence: Synthetic coding sequence
atggtggaggaggtgcagaagcacagcgtgcacaccctggtgttccgcagcctgaagaggacccatgacatgtttgtggccgacaatggcaagcctgtgcccctggatgaggagagccacaagaggaagatggccatcaagctgagaaatgaatatggccctgtgctgcacatgcccaccagcaaagaaaacctgaaggagaagggcccccagaatgccacagacagctatgtgcacaagcagtacccagccaaccagggccaggaggtggagtactttgtggccggcacccacccctacccacctggccctggggtggccctgacagctgacaccaagatccagaggatgcccagcgagagcgctgcccagagcctggccgtggccctgcccctgcagaccaaggcagatgccaacagaacagcccccagcggcagcgagtaccgccaccctggggccagtgaccggccccagcccacagccatgaacagcatcgtgatggagactggaaacaccaagaacagcgccctgatggccaagaaggcccccaccatgcccaagccccagtggcaccccccctggaagctgtacagagtcatcagcggccacctgggctgggtgcgctgcatcgctgtggagcccggcaaccagtggtttgtgactggatctgctgacaggaccatcaagatctgggacctggccagcggcaagctgaagctgagcctgaccggccacatcagcacagtgcggggcgtgattgtgtccaccaggagcccctacctgttcagctgtggggaggacaagcaggtgaagtgctgggacctggagtacaacaaggtgatccgccactaccacggccacctgtctgctgtgtatggcctggacctgcaccccaccattgatgtgctggtgacctgcagccgggacagcacagcccgcatctgggatgtgaggaccaaggcctctgtgcacaccctgagcggccacaccaatgctgtggccaccgtgcgctgccaggccgctgagccccagatcatcaccggcagccatgacaccaccatccggctgtgggacctggtggccggcaagaccagggtgaccctgaccaaccacaagaagtctgtgcgggctgtggtgctgcaccccaggcactacacctttgccagcggcagcccagacaacatcaagcagtggaagttcccagatggcagcttcatccagaacctgagcggccacaatgccatcatcaacaccctgactgtgaacagtgatggagtgctggtgtctggagctgacaatggcaccatgcacctgtgggactggaggacaggctacaacttccagagggtgcacgccgctgtgcagcccggcagcctggacagcgagagcggcatctttgcctgtgcctttgaccagagcgagagccggctgctgacagctgaggccgacaagaccatcaaggtgtacagagaagatgacacagccacagaggagacccaccctgtgtcctggaagccagagatcatcaagaggaagcgcttctag

SEQ ID NO: 164439 - DNA, 5622 bp, Artificial Sequence
  Description of Artificial Sequence: Synthetic coding sequence
atgtgggccgaggccggcctgccccgggccggcggcggcagccagccccccttccgcaccttcagcgccagtgactggggcctgacccacctggtggtgcatgagcagacaggagaggtgtatgtgggcgctgtgaaccgcatctacaagctgagcggcaacctgaccctgctgcgggcccacgtgactggacctgtggaggacaatgagaagtgctacccacctccttctgtgcagagctgcccccacggcctgggcagcacagacaacgtgaacaagctgctgctgctggactatgctgccaaccggctgctggcctgtggcagcgccagccagggcatctgccagttcctgcggctggatgacctcttcaagctgggggagccccaccacaggaaggagcactacctgagctctgtgcaggaggccggctccatggccggcgtgctgattgctggccccccaggccagggccaggccaagctgtttgtgggcacccccattgatggcaagtctgagtacttccccaccctgagcagccggcggctgatggccaatgaggaggatgctgacatgtttggatttgtgtaccaggatgaatttgtgagcagccagctgaagatccccagcgacaccctgagcaagtttcctgcctttgacatctactacgtgtacagcttccgctctgagcagtttgtgtactacctgaccctgcagctggacacccagctgaccagcccagatgctgctggggagcacttcttcaccagcaagatcgtgcggctgtgtgtggatgaccccaagttctacagctatgtggagttccccatcggctgtgagcaggccggcgtggagtaccgcctggtgcaggatgcctacctgagcaggcctggccgggccctggcccaccagctgggcctggctgaagatgaagatgtgctcttcaccgtgtttgcccagggccagaagaacagagtgaagccacccaaggagagcgccctgtgcctcttcaccctgcgggccatcaaggagaagatcaaggagcgcatccagagctgctacagaggagagggcaagctgagcctgccctggctgctgaacaaggagctgggctgcatcaacagccccctgcagattgatgatgacttctgtggccaggacttcaaccagcccctgggcggcaccgtgaccatcgagggcacccccctgtttgtggacaaggatgatggcctgacagctgtggccgcctatgactaccggggccgcacagtggtgtttgctggcaccaggagcggccgcatcaggaagatcctggtggacctgagcaaccctgggggccggcctgccctggcctatgagagcgtggtggcccaggagggcagccccatcctgcgggacctggtgctgagccccaaccaccagtacctgtatgccatgacagagaagcaggtgaccagggtgcctgtggagagctgtgtgcagtacaccagctgtgagctgtgcctgggcagccgggacccccactgcggctggtgtgtgctgcacagcatctgcagcagaagagatgcctgtgaaagagcagatgagccccagagatttgctgctgacctgctgcagtgtgtgcagctgactgtgcagcccagaaatgtgtctgtgaccatgagccaggtgcccctggtgctgcaggcctggaatgtgcctgacctgtctgctggggtgaactgcagctttgaggacttcacagaaagtgaatctgtgctggaggatggccgcatccactgccgcagccccagcgcccgggaggtggcccccatcacccggggccagggcgaccagagggtggtgaagctgtacctgaagagcaaggagaccgggaagaagtttgcctctgtggactttgtgttctacaactgcagcgtgcaccagagctgcctgagctgtgtgaatggcagcttcccctgccactggtgcaagtacagacatgtgtgcacccacaacgtggccgactgtgccttcctggagggccgggtgaatgtgtctgaggactgcccccagatcctgcccagcacccagatctacgtgcctgtgggcgtggtgaagcccatcaccctggccgccaggaacctgccccagccccagagcggccagaggggctatgagtgcctcttccacatccctggcagccctgcccgggtgacagccctgcgcttcaacagcagcagcctgcagtgccagaacagcagctacagctatgagggcaatgatgtgtctgacctgcctgtgaacctgtctgtggtgtggaatggaaactttgtgattgacaacccccagaacatccaggcccacctgtacaagtgcccagccctgcgggagagctgtggcctgtgcctgaaggctgaccccaggtttgaatgtggctggtgtgtggccgagcggcgctgcagcctgcggcaccactgtgccgctgacaccccagcctcctggatgcacgcccggcacggcagcagccgctgcacagaccccaagatcctgaagctgagccctgagaccggcccccggcagggcggcacccggctgaccatcaccggggagaacctgggcctgcgctttgaagatgtgcggctgggcgtgcgggtgggcaaggtgctgtgcagccctgtggagagcgagtacatctctgctgagcagatcgtgtgtgaaattggagatgccagctctgtgcgggcccatgatgccctggtggaggtgtgtgtgcgggactgcagcccccactaccgggccctgagccccaagcgcttcacctttgtgacccccaccttctacagagtgagccccagccggggccccctgagcggcggcacctggattggcatcgagggcagccacctgaatgccggcagtgatgtggccgtgtctgtgggcggccggccctgcagcttctcctggaggaacagccgggagatccgctgcctgaccccacctggccagagccctggcagcgcccccatcatcatcaacatcaacagagcccagctgaccaaccctgaggtgaagtacaactacacagaggaccccaccatcctgagaattgatcctgagtggagcatcaacagcggcggcaccctgctgactgtgacaggcaccaacctggccaccgtgcgggagccccgcatccgggccaagtatggaggcatcgagcgggagaatggctgcctggtgtacaatgacaccaccatggtgtgccgggcccccagcgtggccaaccctgtgcgcagccccccagagctgggggagaggccagatgagctgggctttgtgatggacaacgtgcgcagcctgctggtgctgaacagcaccagcttcctgtactacccagaccctgtgctggagcccctgagccccaccggcctgctggagctgaagcccagcagccccctcatcctgaagggcaggaacctgctgcccccagcccctggcaacagccggctgaactacacagtgctgattggcagcaccccctgcaccctgactgtgtctgagacccagctgctgtgtgaggcccccaacctgaccggccagcacaaggtgacagtgcgggccggcggctttgagttcagccctggcaccctgcaggtgtacagcgacagcctgctgaccctgcctgccatcgtgggcatcggcggcggcggcggcctgctgctgctggtgattgtggccgtgctgattgcctacaagaggaagagcagagatgctgacaggaccctgaagaggctgcagctgcagatggacaacctggagagccgggtggccctggagtgcaaggaggcctttgctgagctgcagacagacatccacgagctgaccaatgacctggatggagctggcatccccttcctggactaccgcacctacgccatgagggtgctcttccctggcatcgaggaccaccctgtgctgaaggagatggaggtgcaggccaacgtggagaagagcctgaccctgtttggccagctgctgaccaagaagcacttcctgctgaccttcatccgcaccctggaggcccagaggagcttctccatgagggacagaggaaatgtggccagcctcatcatgacagccctgcagggcgagatggagtatgccaccggggtgctgaagcagctgctgagtgacctgattgagaagaacctggagagcaagaaccaccccaagctgctgctgcggaggacagagagcgtggccgagaagatgctgaccaactggttcaccttcctgctgtacaagttcctgaaggaatgtgccggggagcccctcttcatgctgtactgtgccatcaagcagcagatggagaagggccccattgatgccatcaccggggaggcccgctacagcctgtctgaggacaagctgatccggcagcagattgactacaagaccctgaccctgaactgtgtgaacccagaaaatgaaaatgcccctgaggtgcctgtgaagggcctggactgtgacacagtgacccaggccaaggagaagctgctggatgctgcctacaagggcgtgccctacagccagaggcccaaggctgctgacatggacctggagtggaggcagggccgcatggcccgcatcatcctgcaggatgaagatgtgaccaccaagattgacaatgactggaagaggctgaacaccctggcccactaccaggtgacagatggcagctctgtggccctggtgcccaagcagaccagcgcctacaacatcagcaacagcagcaccttcaccaagagcctgagccgctatgagagcatgctgaggacagccagcagcccagacagcctgcggagcaggacccccatgatcaccccagacctggagagcggcaccaagctgtggcacctggtgaagaaccacgaccacctggaccagcgggagggggaccggggcagcaagatggtgtctgagatctacctgacccggctgctggccaccaagggcaccctgcagaagtttgtggatgacctgtttgagaccatcttcagcacagcccaccggggcagcgccctgcccctggccatcaagtacatgtttgacttcctggatgagcaggccgacaagcaccagatccatgatgctgatgtgcgccacacctggaagagcaactgcctgcccctgcgcttctgggtgaatgtcatcaagaacccccagtttgtgtttgacatccacaagaacagcatcacagatgcctgcctgtctgtggtggcccagaccttcatggacagctgcagcaccagcgagcacaagctgggcaaggacagccccagcaacaagctgctgtatgccaaggacatccccaactacaagtcctgggtggagcgctactatgctgacatcgccaagatgcctgccatcagtgaccaggacatgtctgcctacctggccgagcagagccggctgcacctgagccagttcaacagcatgtctgccctgcacgagatctacagctacatcaccaagtacaaggatgagatcctggccgccctggagaaggatgagcaggcccggcggcagaggctgcggagcaagctggagcaggtggtggacaccatggccctgagcagctag

SEQ ID NO: 164440 - DNA, 5691 bp, Artificial Sequence
  Description of Artificial Sequence: Synthetic coding sequence
atgcccctgccccccaggagcctgcaggtgctgctgctgctgctgctgctgctgctgctgctgcccggcatgtgggccgaggccggcctgcccagggctgggggcggcagccagccccccttccgcaccttcagcgccagtgactggggcctgacccacctggtggtgcatgagcagacaggagaggtgtatgtgggcgctgtgaaccgcatctacaagctgagcggcaacctgaccctgctgcgggcccacgtgacaggccctgtggaggacaatgagaagtgctaccccccacccagcgtgcagagctgcccccacggcctgggcagcacagacaacgtgaacaagctgctgctgctggactatgctgccaaccggctgctggcctgtggcagcgccagccagggcatctgccagttcctgcggctggatgacctcttcaagctgggggagccccaccacaggaaggagcactacctgagctctgtgcaggaggccggctccatggccggcgtgctgattgctggccccccaggccagggccaggccaagctgtttgtgggcacccccattgatggcaagtctgagtacttccccaccctgagcagccggcggctgatggccaatgaagaagatgctgacatgtttggatttgtgtaccaggatgaatttgtgagcagccagctgaagatccccagcgacaccctgagcaagtttcctgcctttgacatctactacgtgtacagcttccgctctgagcagtttgtgtactacctgaccctgcagctggacacccagctgaccagcccagatgctgctggggagcacttcttcaccagcaagatcgtgcggctgtgtgtggatgaccccaagttctacagctatgtggagttccccatcggctgtgagcaggccggcgtggagtaccgcctggtgcaggatgcctacctgagccggcccggccgggccctggcccaccagctgggcctggccgaggatgaagatgtgctcttcaccgtgtttgcccagggccagaagaacagagtgaagccacccaaggagagcgccctgtgcctcttcaccctgcgggccatcaaggagaagatcaaggagcgcatccagagctgctacagaggagagggcaagctgagcctgccctggctgctgaacaaggagctgggctgcatcaacagccccctgcagattgatgatgacttctgtggccaggacttcaaccagcccctgggcggcaccgtgaccatcgagggcacccccctgtttgtggacaaggatgatggcctgacagctgtggccgcctatgactaccggggccgcacagtggtgtttgctggcaccaggagcggccgcatcaggaagatcctggtggacctgagcaaccctgggggccgcccagccctggcctatgaatctgtggtggcccaggagggcagccccatcctgcgggacctggtgctgagccccaaccaccagtacctgtatgccatgacagagaagcaggtgaccagggtgcctgtggagagctgtgtgcagtacaccagctgtgagctgtgcctgggcagccgggacccccactgcggctggtgtgtgctgcacagcatctgcagcagaagagatgcctgtgagcgggcagatgagccccagagatttgctgctgacctgctgcagtgtgtgcagctgactgtgcagcccagaaatgtgtctgtgaccatgagccaggtgcccctggtgctgcaggcctggaatgtgcctgacctgtctgctggggtgaactgcagctttgaggacttcacagagagcgagagcgtgctggaggatggccgcatccactgccgcagccccagcgcccgggaggtggcccccatcacccggggccagggcgaccagagggtggtgaagctgtacctgaagagcaaggagaccgggaagaagtttgcctctgtggactttgtgttctacaactgcagcgtgcaccagagctgcctgagctgtgtgaatggcagcttcccctgccactggtgcaagtaccgccacgtgtgcacccacaacgtggccgactgtgccttcctggagggccgggtgaatgtgtctgaggactgcccccagatcctgcccagcacccagatctacgtgcctgtgggcgtggtgaagcccatcaccctggccgccaggaacctgccccagccccagagcggccagaggggctatgaatgtctcttccacatccctggcagccctgcccgggtgacagccctgcgcttcaacagcagcagcctgcagtgccagaacagcagctacagctatgagggcaatgatgtgtctgacctgcctgtgaacctgtctgtggtgtggaatggaaacttcgtcatcgacaacccccagaacatccaggcccacctgtacaagtgcccagccctgcgggagagctgtggcctgtgcctgaaggctgaccccaggtttgaatgtggctggtgtgtggccgagcggcgctgcagcctgcggcaccactgtgccgctgacaccccagcctcctggatgcacgcccggcacggcagcagccgctgcacagaccccaagatcctgaagctgagccctgagaccggcccccggcagggcggcacccggctgaccatcactggagagaacctgggcctgcgctttgaagatgtgcggctgggcgtgcgggtgggcaaggtgctgtgcagccctgtggagagcgagtacatctctgctgagcagatcgtgtgtgaaattggagatgccagctctgtgcgggcccatgatgccctggtggaggtgtgtgtgcgggactgcagcccccactaccgggccctgagccccaagcgcttcacctttgtgacccccaccttctacagagtgagccccagccggggccccctgagcggcggcacctggattggaattgagggcagccacctgaatgccggcagtgatgtggccgtgtctgtgggcggccggccctgcagcttctcctggaggaacagccgggagatccgctgcctgaccccacctggccagagccctggcagcgcccccatcatcatcaacatcaacagagcccagctgaccaaccctgaggtgaagtacaactacacagaggaccccaccatcctgagaattgatcctgagtggagcatcaacagcggcggcaccctgctgactgtgacaggcaccaacctggccaccgtgcgggagccccgcatccgggccaagtatggaggcatcgagagagaaaatggctgcctggtgtacaatgacaccaccatggtgtgccgggcccccagcgtggccaaccctgtgcgcagccccccagagctgggggagaggccagatgagctgggctttgtgatggacaacgtgcgcagcctgctggtgctgaacagcaccagcttcctgtactacccagaccctgtgctggagcccctgagccccaccggcctgctggagctgaagcccagcagccccctcatcctgaagggcaggaacctgctgcccccagcccctggcaacagccggctgaactacacagtgctgattggcagcaccccctgcaccctgactgtgtctgagacccagctgctgtgtgaggcccccaacctgaccggccagcacaaggtgacagtgcgggccggcggctttgagttcagccctggcaccctgcaggtgtacagcgacagcctgctgaccctgcctgccatcgtgggcattggaggcggcggcggcctgctgctgctggtgattgtggccgtgctgattgcctacaagaggaagagcagagatgctgacaggaccctgaagaggctgcagctgcagatggacaacctggagagccgggtggccctggagtgcaaggaggcctttgctgagctgcagacagacatccacgagctgaccaatgacctggatggagctggcatccccttcctggactaccgcacctacgccatgagggtgctcttccctggcatcgaggaccaccctgtgctgaaggagatggaggtgcaggccaacgtggagaagagcctgaccctgtttggccagctgctgaccaagaagcacttcctgctgaccttcatccgcaccctggaggcccagaggagcttctccatgagggacagaggaaatgtggccagcctcatcatgacagccctgcagggcgagatggagtatgccactggagtgctgaagcagctgctgagtgacctgattgagaagaacctggagagcaagaaccaccccaagctgctgctgcggaggacagaatctgtggccgagaagatgctgaccaactggttcaccttcctgctgtacaagttcctgaaggaatgtgccggggagcccctcttcatgctgtactgtgccatcaagcagcagatggagaagggccccattgatgccatcactggagaggcccgctacagcctgtctgaggacaagctgatccggcagcagattgactacaagaccctgaccctgaactgtgtgaacccagaaaatgaaaatgcccctgaggtgcctgtgaagggcctggactgtgacacagtgacccaggccaaggagaagctgctggatgctgcctacaagggcgtgccctacagccagaggcccaaggctgctgacatggacctggagtggaggcagggccgcatggcccgcatcatcctgcaggatgaagatgtgaccaccaagattgacaatgactggaagaggctgaacaccctggcccactaccaggtgacagatggcagctctgtggccctggtgcccaagcagaccagcgcctacaacatcagcaacagcagcaccttcaccaagagcctgagccgctatgaatccatgctgaggacagccagcagcccagacagcctgcggagcaggacccccatgatcaccccagacctggagagcggcaccaagctgtggcacctggtgaagaaccacgaccacctggaccagcgggagggggaccggggcagcaagatggtgtctgagatctacctgacccggctgctggccaccaagggcaccctgcagaagtttgtggatgacctgtttgagaccatcttcagcacagcccaccggggcagcgccctgcccctggccatcaagtacatgtttgacttcctggatgagcaggccgacaagcaccagatccatgatgctgatgtgcgccacacctggaagagcaactgcctgcccctgcgcttctgggtgaatgtcatcaagaacccccagtttgtgtttgacatccacaagaacagcatcacagatgcctgcctgtctgtggtggcccagaccttcatggacagctgcagcaccagcgagcacaagctgggcaaggacagccccagcaacaagctgctgtatgccaaggacatccccaactacaagtcctgggtggagcgctactatgctgacatcgccaagatgcctgccatcagtgaccaggacatgtctgcctacctggccgagcagagccggctgcacctgagccagttcaacagcatgtctgccctgcacgagatctacagctacatcaccaagtacaaggatgagatcctggccgccctggagaaggatgagcaggcccggcggcagaggctgcggagcaagctggagcaggtggtggacaccatggccctgagcagctag

SEQ ID NO: 164441 - DNA, 5685 bp, Artificial Sequence
  Description of Artificial Sequence: Synthetic coding sequence
atggagcagaggcggccctggccccgggccctggaggtggacagccgctctgtggtgctgctgtctgtggtgtgggtgctgctggcccccccagctgctggcatgccccagttcagcaccttccacagcgagaacagagactggaccttcaaccacctgactgtgcaccagggcactggagctgtgtatgtgggcgccatcaacagagtgtacaagctgaccggcaacctgaccatccaggtggcccacaagacaggccctgaggaggacaacaagagctgctacccacccctgattgtgcagccctgcagcgaggtgctgaccctgaccaacaacgtgaacaagctgctgatcatcgactacagtgaaaatcggctgctggcctgtggcagcctgtaccagggcgtgtgcaagctgctgcggctggatgacctcttcatcctggtggagcccagccacaagaaggagcactacctgagctctgtgaacaagacaggcaccatgtatggagtcatcgtgcgctctgagggggaggatggcaagctgttcatcggcacagctgtggatggcaagcaggactacttccccaccctgagcagcaggaagctgccccgggaccctgagagcagcgccatgctggactatgagctgcacagcgactttgtgagcagcctcatcaagatccccagcgacaccctggccctggtgagccactttgacatcttctacatctacggctttgccagcggcggctttgtgtacttcctgactgtgcagcctgagaccccagagggcgtggccatcaacagcgctggggacctcttctacaccagccgcatcgtgcggctgtgcaaggatgaccccaagttccacagctatgtgtccctgcccttcggctgcaccagggctggggtggagtaccgcctgctgcaggccgcctacctggccaagccaggggacagcctggcccaggccttcaacatcaccagccaggatgatgtgctgtttgccatcttcagcaagggccagaagcagtaccaccaccccccagatgattctgccctgtgtgccttccccatccgggccatcaacctgcagatcaaggagcggctgcagagctgctaccagggcgagggcaacctggagctgaactggctgctgggcaaggatgtgcagtgcaccaaggcccctgtgcccattgatgacaacttctgtggcctggacatcaaccagcccctgggcggcagcacccctgtggagggcctgaccctgtacaccaccagccgggacaggatgacctctgtggccagctatgtgtacaacggctacagcgtggtgtttgtgggcaccaagagcggcaagctgaagaagatccgggcagatggcccccctcatggaggagtgcagtatgagatggtgtctgtgctgaaggatggcagccccatcctgcgggacatggccttcagcattgaccagcgctacctgtatgtgatgtctgagcggcaggtgaccagggtgcctgtggagagctgtgagcagtacaccacctgtggagaatgtctgagcagcggggacccccactgcggctggtgtgccctgcacaacatgtgcagcagaagagacaagtgccagcaggcctgggagcccaacagatttgctgccagcatcagccagtgtgtgtccctggccgtgcaccccagcagcatctctgtgtctgagcacagccggctgctgagcctggtggtgtctgatgccccagacctgtctgctggcatcgcctgtgccttcggcaacctgacagaggtggagggccaggtgtctggcagccaggtgatctgcatcagccctggccccaaggatgtgcctgtgatccccctggaccaggactggtttggcctggagctgcagctgcggagcaaggagaccgggaagatctttgtgtccacagagttcaagttctacaactgcagcgcccaccagctgtgcctgagctgtgtgaacagcgccttccgctgccactggtgcaagtacagaaacctgtgcacccatgaccccaccacctgcagcttccaggagggccgcatcaacatcagcgaggactgcccccagctggtgcccacagaggagatcctgatccctgtgggggaggtgaagcccatcaccctgaaggccaggaacctgccccagccccagagcggccagaggggctatgaatgtgtgctgaacatccagggcgccatccaccgggtgcctgccctgcgcttcaacagcagctctgtgcagtgccagaacagcagctaccagtatgatggcatggacatcagcaacctggccgtggactttgctgtggtgtggaatggaaacttcatcatcgacaacccccaggacctgaaggtgcacctgtacaagtgtgccgcccagcgggagagctgtggcctgtgcctgaaggctgacaggaagtttgaatgtggctggtgcagcggggagcggcgctgcaccctgcaccagcactgcaccagccccagcagcccctggctggactggagcagccacaacgtgaagtgcagcaacccccagatcacagagatcctgactgtgtctggccccccagagggcggcaccagggtgaccatccatggagtgaacctgggcctggacttcagcgagatcgcccaccacgtgcaggtggccggcgtgccctgcacccccctgcctggagagtacatcatcgccgagcagatcgtgtgtgagatgggccacgccctggtgggcaccaccagcggccctgtgcggctgtgcatcggggagtgcaagccagagttcatgaccaagagccaccagcagtacacctttgtgaaccccagcgtgctgagcctgaaccccatccggggccctgagagcggcggcaccatggtgaccatcaccggccactacctgggcgccggcagctctgtggccgtgtacctgggcaaccagacctgtgagttctacggccgctccatgtctgagatcgtgtgtgtgtccccacccagcagcaatggcctgggccctgtgcctgtgtctgtgtctgtggaccgggcccacgtggacagcaacctgcagtttgagtacattgatgacccccgggtgcagagaattgagcctgagtggagcatcgccagcggccacacccccctgaccatcaccggcttcaacctggatgtgatccaggagccccgcatccgggtgaagttcaacgggaaggagagcgtgaatgtgtgcaaggtggtgaacaccaccaccctgacctgcctggcccccagcctgaccacagactaccggcccggcctggacacagtggagaggccagatgaatttggatttgtgttcaacaacgtgcagagcctgctgatctacaatgacaccaagttcatctactaccccaaccccacctttgagctgctgagccccactggagtgctggaccagaagccaggcagccccatcatcctgaagggcaagaacctgtgccccccagccagcggcggggccaagctgaactacacagtgctgattggagagaccccctgtgctgtgacagtgtctgagacccagctgctgtgtgagccccccaacctgaccggccagcacaaggtgatggtgcacgtgggcggcatggtgttcagccctggctctgtgtctgtcatcagtgacagcctgctgaccctgcctgccatcgtgtccattgctgctgggggcagcctgctgctgatcatcgtcatcatcgtgctgattgcctacaagaggaagagccgggagaatgacctgaccctgaagaggctgcagatgcagatggacaacctggagagccgggtggccctggagtgcaaggaggcctttgctgagctgcagacagacatcaatgagctgaccagtgacctggacaggagcggcatcccctacctggactaccgcacctacgccatgagggtgctcttccctggcatcgaggaccaccctgtgctgcgggagctggaggtgcagggcaatggccagcagcacgtggagaaggccctgaagctgtttgcccagctgatcaacaacaaggtgttcctgctgaccttcatccgcaccctggagctgcagaggagcttctccatgagggacagaggaaatgtggccagcctcatcatgacaggcctgcagggccgcctggagtatgccacagatgtgctgaagcagctgctgagtgacctgattgacaagaacctggagaacaagaaccaccccaagctgctgctgcggaggacagagagcgtggccgagaagatgctgaccaactggtttgccttcctgctgcacaagttcctgaaggaatgtgccggggagcccctcttcatgctgtactgtgccatcaagcagcagatggagaagggccccattgatgccatcaccggggaggcccgctacagcctgtctgaggacaagctgatccggcagcagatcgagtacaagaccctcatcctgaactgtgtgaacccagacaatgaaaacagccctgagatccctgtgaaggtgctgaactgtgacaccatcacccaggtgaaggagaagatcctggatgctgtgtacaagaatgtgccctacagccagaggcccagggctgtggacatggacctggagtggaggcagggccgcatcgcccgggtggtgctgcaggatgaggacatcaccaccaagattgaaggagactggaagaggctgaacaccctgatgcactaccaggtgtctgacagatctgtggtggccctggtgcccaagcagaccagcagctacaacatcccagccagcgccagcatcagcaggaccagcatcagccgctatgacagcagcttccgctacacaggcagcccagacagcctgcggagccgggcccccatgatcaccccagacctggagagcggcgtgaaggtgtggcacctggtgaagaaccacgaccacggggaccagaaggagggggaccggggcagcaagatggtgtctgagatctacctgacccggctgctggccaccaagggcaccctgcagaagtttgtggatgacctgtttgagaccctcttcagcacagtgcaccggggcagcgccctgcccctggccatcaagtacatgtttgacttcctggatgagcaggccgacagacacagcatccatgacacagatgtgcgccacacctggaagagcaactgcctgcccctgcgcttctgggtgaatgtcatcaagaacccccagtttgtgtttgacatccacaagggcagcatcacagatgcctgcctgtctgtggtggcccagaccttcatggacagctgcagcaccagcgagcaccggctgggcaaggacagccccagcaacaagctgctgtatgccaaggacatccccagctacaagtcctgggtggagcgctactatgctgacatcgccaagctgcctgccatcagtgaccaggacatgaatgcctacctggccgagcagagccggctgcatgctgtggagttcaacatgctgagcgccctgaatgagatctacagctatgtgtccaagtacagcgaggagctgattggagccctggagcaggatgagcaggcccggcggcagaggctggcctacaaggtggagcagctgatcaatgccatgagcattgagagctag

SEQ ID NO: 164442 - DNA, 5685 bp, Artificial Sequence
  Description of Artificial Sequence: Synthetic coding sequence
atgaaggccatgccctggaactggacctgcctgctgagccacctgctgatggtgggcatgggcagcagcaccctgctgacccggcagcctgcccccctgagccagaagcagaggagctttgtgaccttccggggggagcctgctgagggcttcaaccacctggtggtggatgagaggacaggccacatctacctgggcgctgtgaaccgcatctacaagctgagcagtgacctgaaggtgctggtgacccatgagaccggcccagatgaggacaaccccaagtgctacccaccccgcatcgtgcagacctgcaatgagcccctgaccaccaccaacaacgtgaacaagatgctgctgattgactacaaggagaacagactcatcgcctgtggcagcctgtaccagggcatctgcaagctgctgcggctggaggacctcttcaagctgggggagccctaccacaagaaggagcactacctgtctggagtgaatgaaagtggctctgtgtttggagtgattgtgtcctacagcaacctggatgacaagctgttcatcgccacagctgtggatggcaagccagagtacttccccaccatcagcagcaggaagctgaccaagaacagcgaggctgatggcatgtttgcctacgtgttccatgatgaatttgtggcctccatgatcaagatccccagcgacaccttcaccatcatcccagactttgacatctactacgtgtatggcttcagcagcggcaactttgtgtacttcctgaccctgcagcctgagatggtgagccccccaggcagcaccaccaaggagcaggtgtacaccagcaagctggtgcggctgtgcaaggaggacacagccttcaacagctatgtggaggtgcccatcggctgtgagaggtctggagtggagtaccgcctgctgcaggccgcctacctgagcaaggccggggctgtgctgggccgcaccctgggcgtgcacccagatgatgacctgctcttcaccgtcttcagcaagggccagaagaggaagatgaagagcctggatgaaagtgccctgtgcatcttcatcctgaagcagatcaatgaccgcatcaaggagcggctgcagagctgctacagaggagagggcaccctggacctggcctggctgaaggtgaaggacatcccctgcagcagcgccctgctgaccattgatgacaacttctgtggcctggacatgaatgcccccctgggcgtgtctgacatggtgcggggcatccctgtgttcacagaagatcgggacaggatgaccagcgtcatcgcctacgtgtacaagaaccacagcctggcctttgtgggcaccaagagcggcaagctgaagaagatccgggtggatggccccagaggaaatgccctgcagtatgagaccgtgcaggtggtggaccccggccctgtgctgcgggacatggccttcagcaaggaccacgagcagctgtacatcatgtctgagcggcagctgaccagggtgcctgtggagagctgtggccagtaccagagctgtggggagtgcctgggcagcggggacccccactgcggctggtgtgtgctgcacaacacctgcaccaggaaggagcgctgtgagaggagcaaggagcccaggagatttgccagcgagatgaagcagtgtgtgcggctgactgtgcaccccaacaacatctctgtgtcccagtacaacgtgctgctggtgctggagacctacaacgtgcctgagctgtctgctggggtgaactgcacctttgaggacctgtctgagatggatggcctggtggtgggcaaccagatccagtgctacagccctgctgccaaggaggtgccccgcatcatcacagaaaatggagaccaccacgtggtgcagctgcagctgaagagcaaggagaccggcatgacctttgccagcaccagctttgtgttctacaactgcagcgtgcacaacagctgcctgagctgtgtggagagcccctaccgctgccactggtgcaagtacagacatgtgtgcacccatgaccccaagacctgcagcttccaggagggccgggtgaagctgcctgaggactgcccccagctgctgcgggtggacaagatcctggtgcctgtggaggtgatcaagcccatcaccctgaaggccaagaacctgccccagccccagagcggccagaggggctatgagtgcatcctgaacatccagggcagcgagcagagggtgcctgccctgcgcttcaacagcagctctgtgcagtgccagaacaccagctacagctatgagggcatggagatcaacaacctgcctgtggagctgactgtggtgtggaatggccacttcaacatcgacaacccagcccagaacaaggtgcacctgtacaagtgtggggccatgagggagagctgtggcctgtgcctgaaggctgaccctgactttgcctgtggctggtgccagggccctggccagtgcaccctgcggcagcactgcccagcccaggagagccagtggctggagctgagcggggccaagagcaagtgcaccaacccccgcatcacagagatcatccctgtgacaggcccccgggagggcggcaccaaggtgaccatcagaggagagaacctgggcctggagttccgggacatcgccagccacgtgaaggtggccggcgtggagtgcagccccctggtggatggctacatcccagctgagcagatcgtgtgtgagatgggagaggccaagcccagccagcacgccggctttgtggagatctgtgtggccgtgtgcaggcctgagttcatggcccggagcagccagctgtactacttcatgaccctgaccctgagtgacctgaagcccagccggggccccatgtctgggggcacccaggtgaccatcaccggcaccaacctgaatgccggcagcaatgtggtggtgatgtttgggaagcagccctgcctcttccaccggcgcagccccagctacatcgtgtgcaacaccaccagcagtgatgaggtgctggagatgaaggtgtctgtgcaggtggaccgggccaagatccaccaggacctggtgttccagtatgtggaggaccccaccatcgtgagaattgagcctgagtggagcatcgtgtctggcaacacccccatcgctgtgtggggcacccacctggacctgatccagaacccccagatccgggccaagcatggaggcaaggagcacatcaacatctgtgaggtgctgaatgccacagagatgacctgccaggccccagccctggccctgggccctgaccaccagagcgacctgacagagaggcctgaggagtttggcttcatcctggacaacgtgcagagcctgctgatcctgaacaagaccaacttcacctactaccccaaccctgtgtttgaggccttcggccccagcggcatcctggagctgaagccaggcacccccatcatcctgaagggcaagaacctgatcccccctgtggccggcggcaatgtgaagctgaactacacagtgctggtgggggagaagccctgcaccgtgacagtgtctgatgtgcagctgctgtgtgagagccccaacctgattggccgccacaaggtgatggcccgggtgggcggcatggagtacagccctggcatggtgtacatcgccccagacagccccctgagcctgcctgccatcgtgtccattgctgtggccggcggcctgctgatcatcttcatcgtggccgtgctgattgcctacaagaggaagagccgggagagtgacctgaccctgaagaggctgcagatgcagatggacaacctggagagccgggtggccctggagtgcaaggaggcctttgctgagctgcagacagacatccacgagctgaccagtgacctggatggagctggcatccccttcctggactaccgcacctacaccatgagggtgctcttccctggcatcgaggaccaccctgtgctgcgggacctggaggtgcccggctaccggcaggagcgggtggagaagggcctgaagctgtttgcccagctgatcaacaacaaggtgttcctgctgtccttcatccgcaccctggagagccagaggagcttctccatgagggacagaggaaatgtggccagcctcatcatgacagtgctgcagagcaagctggagtatgccacagatgtgctgaagcagctgctggccgacctgattgacaagaacctggagagcaagaaccaccccaagctgctgctgcggaggacagagagcgtggccgagaagatgctgaccaactggttcaccttcctgctgtacaagttcctgaaggaatgtgccggggagcccctcttcagcctcttctgtgccatcaagcagcagatggagaagggccccattgatgccatcaccggggaggcccgctacagcctgtctgaggacaagctgatccggcagcagattgactacaagaccctggtgctgagctgtgtgtccccagacaatgccaacagccctgaggtgcctgtgaagatcctgaactgtgacaccatcacccaggtgaaggagaagatcctggatgccatcttcaagaatgtgccctgcagccaccggcccaaggctgctgacatggacctggagtggaggcagggcagcggggccaggatgatcctgcaggatgaggacatcaccaccaagattgaaaatgactggaagaggctgaacaccctggcccactaccaggtgcctgatggctctgtggtggccctggtgtccaagcaggtgacagcctacaatgctgtgaacaacagcacagtgtccaggaccagcgccagcaaatatgagaacatgatccgctacacaggcagcccagacagcctgcggagcaggacccccatgatcaccccagacctggagagcggcgtgaagatgtggcacctggtgaagaaccacgagcacggggaccagaaggagggggaccggggcagcaagatggtgtctgagatctacctgacccggctgctggccaccaagggcaccctgcagaagtttgtggatgacctgtttgagaccatcttcagcacagcccaccggggcagcgccctgcccctggccatcaagtacatgtttgacttcctggatgagcaggccgacaagcacggcatccatgacccccacgtgcgccacacctggaagagcaactgcctgcccctgcgcttctgggtgaacatgatcaagaacccccagtttgtgtttgacatccacaagaacagcatcacagatgcctgcctgtctgtggtggcccagaccttcatggacagctgcagcaccagcgagcaccggctgggcaaggacagccccagcaacaagctgctgtatgccaaggacatccccagctacaagaactgggtggagcgctactacagcgacatcggcaagatgcctgccatcagtgaccaggacatgaatgcctacctggccgagcagagcaggatgcacatgaatgagttcaacaccatgtctgccctgtctgagatcttctcctatgtgggcaagtacagcgaggagatcctgggccccctggaccatgatgaccagtgtgggaagcagaagctggcctacaagctggagcaggtgatcaccctgatgagcctggacagctag

SEQ ID NO: 164443 - DNA, 5685 bp, Artificial Sequence; identical to SEQ ID NO: 164442
  Description of Artificial Sequence: Synthetic coding sequence

SEQ ID NO: 164444 - DNA, 1569 bp, Artificial Sequence
  Description of Artificial Sequence: Synthetic coding sequence
atgaaggccatgccctggaactggacctgcctgctgagccacctgctgatggtgggcatgggcagcagcaccctgctgacccggcagcctgcccccctgagccagaagcagaggagctttgtgaccttccggggggagcctgctgagggcttcaaccacctggtggtggatgagaggacaggccacatctacctgggcgctgtgaaccgcatctacaagctgagcagtgacctgaaggtgctggtgacccatgagaccggcccagatgaggacaaccccaagtgctacccaccccgcatcgtgcagacctgcaatgagcccctgaccaccaccaacaacgtgaacaagatgctgctgattgactacaaggagaacagactcatcgcctgtggcagcctgtaccagggcatctgcaagctgctgcggctggaggacctcttcaagctgggggagccctaccacaagaaggagcactacctgtctggagtgaatgaaagtggctctgtgtttggagtgattgtgtcctacagcaacctggatgacaagctgttcatcgccacagctgtggatggcaagccagagtacttccccaccatcagcagcaggaagctgaccaagaacagcgaggctgatggcatgtttgcctacgtgttccatgatgaatttgtggcctccatgatcaagatccccagcgacaccttcaccatcatcccagactttgacatctactacgtgtatggcttcagcagcggcaactttgtgtacttcctgaccctgcagcctgagatggtgagccccccaggcagcaccaccaaggagcaggtgtacaccagcaagctggtgcggctgtgcaaggaggacacagccttcaacagctatgtggaggtgcccatcggctgtgagaggtctggagtggagtaccgcctgctgcaggccgcctacctgagcaaggccggggctgtgctgggccgcaccctgggcgtgcacccagatgatgacctgctcttcaccgtcttcagcaagggccagaagaggaagatgaagagcctggatgaaagtgccctgtgcatcttcatcctgaagcagatcaatgaccgcatcaaggagcggctgcagagctgctacagaggagagggcaccctggacctggcctggctgaaggtgaaggacatcccctgcagcagcgccctgctgaccattgatgacaacttctgtggcctggacatgaatgcccccctgggcgtgtctgacatggtgcggggcatccctgtgttcacagaagatcgggacaggatgaccagcgtcatcgcctacgtgtacaagaaccacagcctggcctttgtgggcaccaagagcggcaagctgaagaagagctttggaacaggcccccagggcggcatcacccaggagtggattggagtggagggggaccccccaggggccaacatcgccagccaggagcagatgctgtgtgtgtacctgcagtgcagcagccacaaggccatcagtgaccagagggtgcagcccctgctgtgctgcttcctgaatgtgcccggcaacagcagctag

SEQ ID NO: 164445 - DNA, 1479 bp, Artificial Sequence
  Description of Artificial Sequence: Synthetic coding sequence
atgaaggccatgccctggaactggacctgcctgctgagccacctgctgatggtgggcatgggcagcagcaccctgctgacccggcagcctgcccccctgagccagaagcagaggagctttgtgaccttccggggggagcctgctgagggcttcaaccacctggtggtggatgagaggacaggccacatctacctgggcgctgtgaaccgcatctacaagctgagcagtgacctgaaggtgctggtgacccatgagaccggcccagatgaggacaaccccaagtgctacccaccccgcatcgtgcagacctgcaatgagcccctgaccaccaccaacaacgtgaacaagatgctgctgattgactacaaggagaacagactcatcgcctgtggcagcctgtaccagggcatctgcaagctgctgcggctggaggacctcttcaagctgggggagccctaccacaagaaggagcactacctgtctggagtgaatgaaagtggctctgtgtttggagtgattgtgtcctacagcaacctggatgacaagctgttcatcgccacagctgtggatggcaagccagagtacttccccaccatcagcagcaggaagctgaccaagaacagcgaggctgatggcatgtttgcctacgtgttccatgatgaatttgtggcctccatgatcaagatccccagcgacaccttcaccatcatcccagactttgacatctactacgtgtatggcttcagcagcggcaactttgtgtacttcctgaccctgcagcctgagatggtgagccccccaggcagcaccaccaaggagcaggtgtacaccagcaagctggtgcggctgtgcaaggaggacacagccttcaacagctatgtggaggtgcccatcggctgtgagaggtctggagtggagtaccgcctgctgcaggccgcctacctgagcaaggccggggctgtgctgggccgcaccctgggcgtgcacccagatgatgacctgctcttcaccgtcttcagcaagggccagaagaggaagatgaagagcctggatgaaagtgccctgtgcatcttcatcctgaagcagatcaatgaccgcatcaaggagcggctgcagagctgctacagaggagagggcaccctggacctggcctggctgaaggtgaaggacatcccctgcagcagcgccctgctgaccattgatgacaacttctgtggcctggacatgaatgcccccctgggcgtgtctgacatggtgcggggcatccctgtgttcacagaagatcgggacaggatgaccagcgtcatcgcctacgtgtacaagaaccacagcctggcctttgtgggcaccaagagcggcaagctgaagaagatgcctggcaccagcctgtgccccaccctggagctgcagacaggccccaggagccaccgggccaccgtgaccctggagctgctcttcagcagctgcagcagcaactag

SEQ ID NO: 164446 - DNA, 5517 bp, Artificial Sequence
  Description of Artificial Sequence: Synthetic coding sequence
atggccctgcagctgtgggccctgaccctgctgggcctgctgggcgctggggccagcctgcggcccaggaagctggacttcttccgctctgagaaggagctgaaccacctggccgtggatgaggccagcggcgtggtgtacctgggcgctgtgaatgccctgtaccagctggatgccaagctgcagctggagcagcaggtggccactggacctgccctggacaacaagaagtgcaccccacccatcgaggccagccagtgccacgaggccgagatgacagacaacgtgaaccagctgctgctgctggacccccccaggaagaggctggtggagtgtggcagcctcttcaagggcatctgtgccctgcgggccctgagcaacatcagcctgcggctcttctatgaagatggcagcggggagaagagctttgtggccagcaatgatgagggcgtggccaccgtgggcctggtgagcagcacaggccctggaggagacagagtgctgtttgtgggcaaaggaaatggcccccatgacaatggcatcatcgtgtccacccggctgctggacagaacagacagccgggaggcctttgaggcctacacagaccacgccacctacaaggccggctacctgagcaccaacacccagcagtttgtggccgcctttgaagatggcccctacgtgttctttgtgttcaaccagcaggacaagcacccagccaggaacagaaccctgctggccaggatgtgccgggaggaccccaactactacagctacctggagatggacctgcagtgccgggaccctgacatccatgctgctgccttcggcacctgcctggccgcctctgtggccgcccctggcagcggccgggtgctgtatgctgtgttcagccgggacagccgcagcagcggcggccctggagctggcctgtgcctcttccccctggacaaggtgcacgccaagatggaggccaacagaaatgcctgctacacaggcacccgggaggcccgggacatcttctacaagcccttccacggggacatccagtgtggcggccacgcccctggcagcagcaagagcttcccctgtggcagcgagcacctgccctaccccctgggcagcagagatggcctgcggggcacagctgtgctgcagaggggcggcctgaacctgacagctgtgacagtggccgctgagaacaaccacacagtggccttcctgggcaccagtgatggccgcatcctgaaggtgtacctgaccccagatggcaccagcagtgaatatgacagcatcctggtggagatcaacaagagggtgaagagggacctggtgctgagcggggacctgggcagcctgtatgccatgacccaggacaaggtgttccggctgcctgtgcaggagtgcctgagctaccccacctgcacccagtgccgggacagccaggacccctactgcggctggtgtgtggtggagggccgctgcaccaggaaggccgagtgccccagggctgaggaggccagccactggctgtggagccgcagcaagagctgtgtggccgtgaccagcgcccagccccagaacatgagcagaagagcccagggcgaggtgcagctgactgtgagccccctgcctgccctgtctgaggaggatgagctgctgtgcctgtttggagagagccccccccacccagcccgggtggagggggaggccgtcatctgcaacagccccagcagcatccctgtgaccccacctggccaggaccacgtggccgtgaccatccagctgctgctgcggcggggcaacatcttcctgaccagctaccagtaccccttctatgactgccggcaggccatgagcctggaggagaacctgccctgcatcagctgtgtgagcaaccgctggacctgccagtgggacctgcgctaccatgaatgtcgggaggccagccccaacccagaagatggcatcgtgcgggcccacatggaggacagctgcccccagttcctgggccccagccccctggtgatccccatgaaccatgaaacagatgtgaacttccagggcaagaacctggacacagtgaagggcagcagcctgcacgtgggcagtgacctgctgaagttcatggagcctgtgaccatgcaggagagcggcacctttgccttccgcacccccaagctgagccatgatgccaatgagaccctgcccctgcacctgtatgtgaagagctatggcaagaacatcgacagcaagctgcacgtgaccctgtacaactgcagctttggccgcagtgactgcagcctgtgccgggccgccaacccagactaccgctgtgcctggtgtggcggccagagccgctgtgtgtatgaggccctgtgcaacaccaccagtgaatgtcctcctcctgtgatcacccgcatccagcctgagaccggccccctgggcggcggcatccgcatcaccatcctgggcagcaacctgggcgtgcaggccggggacatccagaggatctctgtggccggcaggaactgcagcttccagcctgagcgctacagcgtgtccacccgcatcgtgtgtgtgattgaggccgctgagacccccttcaccggcggcgtggaggtggatgtgtttgggaagctgggccgcagccccccaaatgtgcagttcaccttccagcagcccaagcccctgtctgtggagccccagcagggcccccaggccggcggcaccaccctgaccatccacggcacccacctggacaccggcagccaggaggatgtgcgggtgaccctgaatggagtgccctgcaaggtgaccaagtttggagcccagctgcagtgtgtgacaggcccccaggccacccggggccagatgctgctggaggtgtcctatggaggcagccctgtgcccaaccctggcatcttcttcacctacagagaaaatcctgtgctgcgggcctttgagcccctgcggagctttgccagcggcggccgcagcatcaacgtgacaggccagggcttcagcctcatccagagatttgccatggtggtgattgctgagcccctgcagagctggcagcccccccgggaggccgagagcctgcagcccatgacagtggtgggcacagattatgtgttccacaatgacaccaaggtggtgttcctgagccctgctgtgcctgaggagcctgaggcctacaacctgactgtgctgattgagatggatggccaccgggccctgctgaggacagaggccggggcctttgaatatgtgcctgaccccacctttgagaacttcaccggaggagtgaagaagcaggtgaacaagctgattcatgcccggggcaccaacctgaacaaggccatgaccctgcaggaggccgaggcctttgtgggcgctgagcgctgcaccatgaagaccctgacagaaacagacctgtactgtgagcccccagaggtgcagcccccacccaagaggcggcagaagagggacaccacccacaacctgcctgagttcatcgtgaagtttggcagccgggagtgggtgctgggccgggtggagtatgacaccagggtgtctgatgtgcccctgagcctcatcctgcccctggtgattgtgcccatggtggtggtgattgctgtgtctgtgtactgctactggaggaagagccagcaggccgagcgggagtatgagaagatcaagagccagctggagggcctggaggagagcgtgcgggaccgctgcaagaaggagttcacagacctgatgattgagatggaggaccagaccaatgatgtgcatgaggccggcatccctgtgctggactacaagacctacacagacagagtcttcttcctgcccagcaaggatggagacaaggatgtgatgatcaccgggaagctggacatccctgagccccggcggcctgtggtggagcaggccctgtaccagttcagcaacctgctgaacagcaagagcttcctgatcaacttcatccacaccctggagaaccagcgggagttcagcgcccgggccaaggtgtactttgccagcctgctgactgtggccctgcacggcaagctggagtactacacagacatcatgcacaccctcttcctggagctgctggagcagtatgtggtggccaagaaccccaagctgatgctgcggcggagtgaaacagtggtggagaggatgctgagcaactggatgagcatctgcctgtaccagtacctgaaggacagcgctggggagcccctgtacaagctgttcaaggccatcaagcaccaggtggagaagggccctgtggatgctgtgcagaagaaggccaagtacaccctgaatgacaccggcctgctgggagatgatgtggagtatgcccccctgactgtgtctgtcatcgtgcaggatgaaggagtggatgccatccctgtgaaggtgctgaactgtgacaccatcagccaggtgaaggagaagatcatcgaccaggtgtaccggggccagccctgcagctgctggcccaggccagacagcgtggtgctggagtggaggcctggcagcacagcccagatcctgagtgacctggacctgaccagccagcgggagggccgctggaagagggtgaacaccctgatgcactacaacgtgagagatggagccaccctcatcctgagcaaggtgggcgtgtcccagcagcctgaggacagccagcaggacctgcctggagagagacatgccctgctggaggaggagaacagagtgtggcacctggtgcggcccacagatgaggtggatgagggcaagagcaagaggggctctgtgaaggagaaggagaggaccaaggccatcacagagatctacctgacccggctgctgtctgtgaagggcaccctgcagcagtttgtggacaacttcttccagagcgtgctggcccctggccatgctgtgcccccagctgtgaagtacttctttgacttcctggatgagcaggccgagaagcacaacatccaggatgaggacaccatccacatctggaagaccaacagcctgcccctgcgcttctgggtgaacatcctgaagaacccccacttcatctttgatgtgcacgtgcatgaggtggtggatgccagcctgtctgtgattgcccagaccttcatggatgcctgcaccaggacagagcacaagctgagccgggacagccccagcaacaagctgctgtatgccaaggagatcagcacctacaagaagatggtggaggactactacaagggcatccggcagatggtgcaggtgtctgaccaggacatgaacacccacctggccgagatcagccgggcccacacagacagcctgaacaccctggtggccctgcaccagctgtaccagtacacccagaagtactatgatgagatcatcaatgccctggaggaggaccctgctgcccagaagatgcagctggccttccggctgcagcagattgctgctgccctggagaacaaggtgacagacctgtag

SEQ ID NO: 164447 - DNA, 1044 bp, Artificial Sequence
  Description of Artificial Sequence: Synthetic coding sequence
atgcacaccctcttcctggagctgctggagcagtatgtggtggccaagaaccccaagctgatgctgcggcggagtgaaacagtggtggagaggatgctgagcaactggatgagcatctgcctgtaccagtacctgaaggacagcgctggggagcccctgtacaagctgttcaaggccatcaagcaccaggtggagaagggccctgtggatgctgtgcagaagaaggccaagtacaccctgaatgacaccggcctgctgggagatgatgtggagtatgcccccctgactgtgtctgtcatcgtgcaggatgaaggagtggatgccatccctgtgaaggtgctgaactgtgacaccatcagccaggtgaaggagaagatcatcgaccaggtgtaccggggccagccctgcagctgtggccctggccagacagcctggagctggagcggcgtgcgggccccccagaggagatctgtgggccctggcccagatgtgacagctgggggccctgtggaggcccggcagcacccctatgccctgcagtgccccggctggagccacccccaccctgtgcagggcggcggcctgcctgctgctgggggccagcctgctggccctgcctggagcgccatgcctcctgggggcggggagcccggggtggcccctggagctgctgaccggcggggcggccggggccaggtgcaggagcggcagcgggagcgggagggcgcagatgagggccaccaccgggacctgcctgatgctgctgccctgagccagggccacacagctgctgtgtgtggccagctgctgcctgagcgggccggggcctggcatgctgtgcccccagctgtgaagtacttctttgacttcctggatgagcaggccgagaagcacaacatccaggatgaggacaccatccacatctggaagaccaacagcctgcccctgcgcttctgggtgaacatcctgaagaacccccacttcatctttgatgtgcacgtgacccgctggtggaccccccgctgccagagcagcagaagatag

SEQ ID NO: 164448 - DNA, 483 bp, Artificial Sequence
  Description of Artificial Sequence: Synthetic coding sequence
ggcccagatgtgacagctgggggccctgtggaggcccggcagcacccctatgccctgcagtgccccggctggagccacccccaccctgtgcagggcggcggcctgcctgctgctgggggccagcctgctggccctgcctggggcgccccctgccccccaggcggcggggagcccggggtggcccctggagctgctgacagaagaggaggccggggccaggtgcaggagcggcagcgggagcgggagggcgcagatgagggccaccaccgggacctgcctgatgctgctgccctgagccagggccacacagctgctgtgtgtggccagctgctgcctgagagagctggcctgggcacccgctgccacctgcagagcagcaccagcagcacctcctggaccagccggcagaggagcaccaccagcaggatgaagacccccagcaccagcggcagaagaacagcctacagaagtggcagcggctag

SEQ ID NO: 164449 - DNA, 1569 bp, Artificial Sequence
  Description of Artificial Sequence: Synthetic coding sequence
atggccctgcagctgtgggccctgaccctgctgggcctgctgggcgctggggccagcctgcggcccaggaagctggacttcttccgctctgagaaggagctgaaccacctggccgtggatgaggccagcggcgtggtgtacctgggcgctgtgaatgccctgtaccagctggatgccaagctgcagctggagcagcaggtggccactggacctgccctggacaacaagaagtgcaccccacccatcgaggccagccagtgccacgaggccgagatgacagacaacgtgaaccagctgctgctgctggacccccccaggaagaggctggtggagtgtggcagcctcttcaagggcatctgtgccctgcgggccctgagcaacatcagcctgcggctcttctatgaagatggcagcggggagaagagctttgtggccagcaatgatgagggcgtggccaccgtgggcctggtgagcagcacaggccctggaggagacagagtgctgtttgtgggcaaaggaaatggcccccatgacaatggcatcatcgtgtccacccggctgctggacagaacagacagccgggaggcctttgaggcctacacagaccacgccacctacaaggccggctacctgagcaccaacacccagcagtttgtggccgcctttgaagatggcccctacgtgttctttgtgttcaaccagcaggacaagcacccagccaggaacagaaccctgctggccaggatgtgccgggaggaccccaactactacagctacctggagatggacctgcagtgccgggaccctgacatccatgctgctgccttcggcacctgcctggccgcctctgtggccgcccctggcagcggccgggtgctgtatgctgtgttcagccgggacagccgcagcagcggcggccctggagctggcctgtgcctcttccccctggacaaggtgcacgccaagatggaggccaacagaaatgcctgctacacaggcacccgggaggcccgggacatcttctacaagcccttccacggggacatccagtgtggcggccacgcccctggcagcagcaagagcttcccctgtggcagcgagcacctgccctaccccctgggcagcagagatggcctgcggggcacagctgtgctgcagaggggcggcctgaacctgacagctgtgacagtggccgctgagaacaaccacacagtggccttcctgggcaccagtgatggccgcatcctgaaggtgtacctgaccccagatggcaccagcagtgaatatgacagcatcctggtggagatcaacaagagggtgaagagggacctggtgctgagcggggacctgggcagcctgtatgccatgacccaggacaaggtgttccggctgcctgtgcaggagtgcctgagctaccccacctgcacccagctgcccccagctgctgagcccgccagcggcgtgcactgccgggtgtccagtgacctgaagatgtgcctgaccctgccccgctggggccagctggccagcgccagcgcccacgccccagctgctgcctccatgccctag

SEQ ID NO: 164450 - DNA, 489 bp, Artificial Sequence
  Description of Artificial Sequence: Synthetic coding sequence
atggccctgcagctgtgggccctgaccctgctgggcctgctgggcgctggggccagcctgcggcccaggaagctggacttcttccgctctgagaaggagctgaaccacctggccgtggatgaggccagcggcgtggtgtacctgggcgctgtgaatgccctgtaccagctggatgccaagctgcagctggagcagcaggtggccactggacctgccctggacaacaagaagtgcaccccacccatcgaggccagccagtgccacgaggccgagatgacagacaacgtgaaccagctgctgctgctggacccccccaggaagaggctggtggagtgtggcagcctcttcaagggcatctgtgccctgcgggccctgagcaacatcagcctgcggctcttctatgaagatggcagcggggagaagagctttgtggccagcaatgatgagggcgtggccaccgtgggcctggtgagcagcacaggcccctag

SEQ ID NO: 164451 - DNA, 1434 bp, Artificial Sequence
  Description of Artificial Sequence: Synthetic coding sequence
atggccctgcagctgtgggccctgaccctgctgggcctgctgggcgctggggccagcctgcggcccaggaagctggacttcttccgctctgagaaggagctgaaccacctggccgtggatgaggccagcggcgtggtgtacctgggcgctgtgaatgccctgtaccagctggatgccaagctgcagctggagcagcaggtggccactggacctgccctggacaacaagaagtgcaccccacccatcgaggccagccagtgccacgaggccgagatgacagacaacgtgaaccagctgctgctgctggacccccccaggaagaggctggtggagtgtggcagcctcttcaagggcatctgtgccctgcgggccctgagcaacatcagcctgcggctcttctatgaagatggcagcggggagaagagctttgtggccagcaatgatgagggcgtggccaccgtgggcctggtgagcagcacaggccctggaggagacagagtgctgtttgtgggcaaaggaaatggcccccatgacaatggcatcatcgtgtccacccggctgctggacagaacagacagccgggaggcctttgaggcctacacagaccacgccacctacaaggccggctacctgagcaccaacacccagcagtttgtggccgcctttgaagatggcccctacgtgttctttgtgttcaaccagcaggacaagcacccagccaggaacagaaccctgctggccaggatgtgccgggaggaccccaactactacagctacctggagatggacctgcagtgccgggaccctgacatccatgctgctgccttcggcacctgcctggccgcctctgtggccgcccctggcagcggccgggtgctgtatgctgtgttcagccgggacagccgcagcagcggcggccctggagctggcctgtgcctcttccccctggacaaggtgcacgccaagatggaggccaacagaaatgcctgctacacaggcacccgggaggcccgggacatcttctacaagcccttccacggggacatccagtgtggcggccacgcccctggcagcagcaagagcttcccctgtggcagcgagcacctgccctaccccctgggcagcagagatggcctgcggggcacagctgtgctgcagaggggcggcctgaacctgacagctgtgacagtggccgctgagaacaaccacacagtggccttcctgggcaccagtgatggccgcatcctgaaggtgtacctgaccccagatggcaccagcagtgaatatgacagcatcctggtggagatcaacaagagggtgaagagggacctggtgctgagcggggacctgggcagcctgtatgccatgacccaggacaaggtgttccggctgcctgtgcaggagtgcctgagctaccccacctgcacccagtag

SEQ ID NO: 164452 - DNA, 5517 bp, Artificial Sequence; identical to SEQ ID NO: 164446
  Description of Artificial Sequence: Synthetic coding sequence

SEQ ID NO: 164453 - DNA, 5730 bp, Artificial Sequence
  Description of Artificial Sequence: Synthetic coding sequence
atgtgccacgccgcccaggagacccccctgctgcaccacttcatggcccctgtgatggcccgctggcccccatttggcctgtgcctgctgctgctgctgctgagccccccacccctgcccctgaccggggcccaccgcttcagcgcccccaacaccaccctgaaccacctggccctggcccctggccggggcaccctgtatgtgggcgctgtgaacagactcttccagctgagccctgagctgcagctggaggccgtggccgtgactggacctgtgattgacagcccagactgtgtgcccttccgggaccctgctgagtgcccccaggcccagctgacagacaatgccaaccagctgctgctggtgagcagccgggcccaggagctggtggcctgtggccaggtgcggcagggcgtgtgtgagacccggcggctgggagatgtggccgaggtgctgtaccaggccgaggaccctggagatggccagtttgtggccgccaacaccccaggagtggccaccgtgggcctggtggtgcccctgcccggccgggacctgctgctggtggcccggggcctggccggcaagctgtctgctggggtgccccccctggccatccggcagctggccggcagccagcccttcagcagcgagggcctgggccgcctggtggtgggggacttcagtgactacaacaacagctatgtgggcgcctttgctgatgcccggagcgcctactttgtgttcagaagaagaggagcccgggcccaggccgagtaccgctcctatgtggcccgggtgtgcctgggggacaccaacctgtacagctatgtggaggtgcccctggcctgccagggccagggcctcatccaggccgccttcctggcccctggcaccctgctgggcgtgtttgctgctggcccccggggcacccaggccgccctgtgtgccttccccatggtggagctgggcgcctccatggagcaggcccggcggctgtgctacacagctgggggccggggccccagcggggctgaggaggccaccgtggagtatggagtgaccagccgctgtgtgaccctgcccctggacagccctgagagctacccctgtggagatgagcacacccccagccccatcgccggccggcagcccctggaggtgcagcccctgctgaagctgggccagcctgtgtctgctgtggccgccctgcaggctgatggccacatgattgccttcctgggggacacccagggccagctgtacaaggtgttcctgcacggcagccagggccaggtgtaccacagccagcaggtgggccccccaggcagcgccatcagcccagacctgctgctggacagcagcggcagccacctgtatgtgctgacagcccaccaggtggaccgcatccctgtggccgcctgcccccagttcccagactgtgccagctgcctgcaggcccaggaccccctgtgtggctggtgtgtgctgcagggccgctgcaccaggaagggccagtgtggccgggccggccagctgaaccagtggctgtggagctatgaggaggacagccactgcctgcacatccagagcctgctgcccggccaccacccccggcaggagcagggccaggtgaccctgtctgtgccccggctgcccatcctggatgctgatgagtacttccactgtgccttcggggactatgacagcctggcccacgtggagggcccccacgtggcctgtgtgaccccaccccaggaccaggtgcccctgaaccccccaggcacagaccacgtgacagtgcccctggccctgatgtttgaagatgtgacagtggccgccaccaacttctccttctatgactgcagcgctgtgcaggccctggaggccgccgccccctgccgggcctgtgtgggcagcatctggcgctgccactggtgcccccagagcagccactgtgtgtatggagagcactgcccagagggggagaggaccatctacagcgcccaggaggtggacatccaggtgcggggccctggggcctgcccccaggtggagggcctggccggcccccacctggtgcctgtgggctgggagagccacctggccctgcgggtgaggaacctgcagcacttccggggcctgcctgccagcttccactgctggctggagctgcctggagagctgcggggcctgcctgccaccctggaggagacagctggggacagcggcctcatccactgccaggcccaccagttctaccccagcatgagccagcgggagctgcctgtgcccatctacgtgacccagggcgaggcccagaggctggacaacacccacgccctgtatgtgatcctgtatgactgtgccatgggccacccagactgcagccactgccaggccgccaacagaagcctgggctgcctgtggtgtgctgatggccagcctgcctgccgctatggccccctgtgccccccaggagctgtggagctgctgtgcccagcccccagcattgatgctgtggagcccctgaccggccccccagagggcggcctggccctgaccatcctgggcagcaacctgggccgggcctttgctgatgtgcagtatgctgtgtctgtggccagccggccctgcaaccctgagcccagcctgtaccgcaccagcgccagaattgtgtgtgtgaccagccctgcccccaacggcaccactggacctgtgcgggtggccatcaagagccagcccccaggcatcagcagccagcacttcacctaccaggaccctgtgctgctgagcctgagcccccgctggggcccccaggccggcggcacccagctgaccatccggggccagcacctgcagacaggaggcaacaccagcgcctttgtgggcggccagccctgccccatcctggagcctgtgtgcccagaggccatcgtgtgcaggacccggccccaggccgcccctggagaggccgctgtgctggtggtgtttggacatgcccagaggaccctgctggccagccccttccgctacacagccaacccccagctggtggccgctgagcccagcgccagcttccggggcggcggccgcctcatccgggtgcggggcaccggcctggatgtggtgcagaggcccctgctgtctgtgtggctggaggctgatgctgaggtgcaggccagccgggcccagccccaggacccccagcccaggaggagctgtggggccccagctgctgacccccaggcctgcatccagctgggcggcggcctgctgcagtgcagcacagtgtgcagcgtgaacagcagcagcctgctgctgtgccgcagccctgctgtgcctgaccgggcccacccccagagggtcttcttcaccctggacaacgtgcaggtggactttgccagcgccagcggcggccagggcttcctgtaccagcccaacccccggctggcccccctgagccgggagggccctgcccggccctaccgcctgaagccaggccacgtgctggatgtggagggggagggcctgaacctgggcatcagcaaggaggaggtgcgggtgcacatcggccgcggggagtgcctggtgaagaccctgaccaggacccacctgtactgtgagcccccagcccacgccccccagcctgccaacggcagcggcctgccccagtttgtggtgcagatgggaaatgtgcagctggccctgggccctgtgcagtatgaagctgagccccccctgagcgccttccctgtggaggcccaggccggcgtgggcatgggcgctgctgtgctgattgctgctgtgctgctgctgaccctgatgtaccgccacaagagcaagcaggccctgcgggactaccagaaggtgctggtgcagctggagagcctggagactggagtgggggaccagtgcaggaaggagttcacagacctgatgacagagatgacagacctgagcagtgacctggagggcagcggcatccccttcctggactaccgcacctatgcagagcgggccttcttccctggccatggaggctgccccctgcagcccaagccagagggccctggagaagatggccactgtgccaccgtgcggcagggcctgacccagctgagcaacctgctgaacagcaagctgttcctgctgaccctcatccacaccctggaggagcagcccagcttcagccagagggaccgctgccacgtggccagcctgctgagcctggccctgcacggcaagctggagtacctgacagacatcatgaggaccctgctgggggacctggccgcccactacgtgcacaggaaccccaagctgatgctgcggaggacagagaccatggtggagaagctgctgaccaactggctgagcatctgcctgtatgccttcctgcgggaggtggccggggagcccctgtacatgctgttccgggccatccagtaccaggtggacaagggccctgtggatgctgtgacaggcaaggccaagaggaccctgaatgacagccggctgctgagagaagatgtggagttccagcccctgaccctgatggtgctggtgggccctggggccggcggggccgccggcagcagcgagatgcagagggtgcctgcccgggtgctggacacagacaccatcacccaggtgaaggagaaggtgctggaccaggtgtacaagggcacccccttcagccagaggcccagcgtgcacgccctggacctggagtggaggagcggcctggccggccacctgaccctgagtgatgaggacctgacctctgtgacccagaaccactggaagaggctgaacaccctgcagcactacaaggtgcctgatggagccaccgtgggcctggtgccccagctgcaccggggcagcaccatcagccagagcctggcccagcgctgccccctgggggagaacatccccaccctggaggatggagaggagggcggcgtgtgcctgtggcacctggtgaaggccacagaggagcctgagggcgccaaggtgcgctgcagcagcctgcgggagcgggagcccgcccgggccaaggccatccctgagatctacctgacccggctgctgtccatgaagggcaccctgcagaagtttgtggatgacaccttccaggccatcctgtctgtgaaccggcccatccccatcgctgtgaagtacctgtttgacctgctggatgagctggccgagaagcatggaattgaggaccccggcaccctgcacatctggaagaccaacagcctgctgctgcgcttctgggtgaatgccctgaagaacccccagctgatctttgatgtgcgggtgtctgacaacgtggatgccatcctggccgtcatcgcccagaccttcatcgacagctgcaccaccagcgagcacaaggtgggccgggacagccctgtgaacaagctgctgtatgcccgggagatcccccgctacaagcagatggtggagcgctactatgctgacatccggcagagcagccctgccagctaccaggagatgaacagcgccctggccgagctgagcggcaactacaccagcgccccccactgcctggaggccctgcaggagctgtacaaccacatccaccgctactatgaccagatcatcagcgccctggaggaggaccctgtgggccagaagctgcagctggcctgccgcctgcagcaggtggccgccctggtggagaacaaggtgacagacctgtag

SEQ ID NO: 164454 - DNA, 777 bp, Artificial Sequence
  Description of Artificial Sequence: Synthetic coding sequence
tgaagcctggagactggagtgggggaccagtgcaggaaggagttcacagacctgatgacagagatgacagacctgagcagtgacctggagggcagcggcatccccttcctggactaccgcacctatgcagagcgggccttcttccctggccatggaggctgccccctgcagcccaagccagagggccctggagaagatggccactgtgccaccgtgcggcagggcctgacccagctgagcaacctgctgaacagcaagctgttcctgctgaccctcatccacaccctggaggagcagcccagcttcagccagagggaccgctgccacgtggccagcctgctgagcctggccctgcacggcaagctggagtacctgacagacatcatgaggaccctgctgggggacctggccgcccactacgtgcacaggaaccccaagctgatgctgcggaggacagagaccatggtggagaagctgctgaccaactggctgagcatctgcctgtatgccttcctgcgggaggtggccggggagcccctgtacatgctgttccgggccatccagtaccaggtggacaagggccctgtggatgctgtgacagagtggaggagcggcctggccggccacctgaccctgagtgatgaggacctgacctctgtgacccagaaccactggaagaggctgaacaccctgcagcactacaaggtgcctgatggagccaccgtgggcctggtgccccagctgcaccggggcagcaccatcagccagagcctgtag

SEQ ID NO: 164455 - DNA, 531 bp, Artificial Sequence
  Description of Artificial Sequence: Synthetic coding sequence
tgagccagccagggcaccctgcagaagtttgtggatgacaccttccaggccatcctgtctgtgaaccggcccatccccatcgctgtgaagtacctgtttgacctgctggatgagctggccgagaagcatggaattgaggaccccggcaccctgcacatctggaagaccaacagcctgctgctgcgcttctgggtgaatgccctgaagaacccccagctgatctttgatgtgcgggtgtctgacaacgtggatgccatcctggccgtcatcgcccagaccttcatcgacagctgcaccaccagcgagcacaaggtgggccgggtgcgggctgtgcctgctgctgctgctggccggggcctgcggaggaagggcctgtggggcaagccccggggcctgtgcacagagctgtgggtgggcagcggcagcatcatgggcgcccccagcccccccagcagctgcctggccccacccctgcccccagagcaggacagccctgtgaacaagctgctgtatgcccgggagatcccctag

SEQ ID NO: 164456 - DNA, 492 bp, Artificial Sequence
  Description of Artificial Sequence: Synthetic coding sequence
tgaaaaagaaccctgaatgacagccggctgctgagagaagatgtggagttccagcccctgaccctgatggtgctggtgggccctggggccggcggggccgccggcagcagcgagatgcagagggtgcctgcccgggtgctggacacagacaccatcacccaggtgaaggagaaggtgctggaccaggtgtacaagggcacccccttcagccagaggcccagcgtgcacgccctggacctggagtggaggagcggcctggccggccacctgaccctgagtgatgaggacctgacctctgtgacccagaaccactggaagaggctgaacaccctgcagcactacaaggtgcctgatggagccaccgtgggcctggtgccccagctgcaccggggcagcaccatcagccagagcctggcccagcgctgccccctgggggagagcgagagcctgggccctgacctgggccccctggagagccggctgggccgctag

SEQ ID NO: 164457 - DNA, 2967 bp, Artificial Sequence
  Description of Artificial Sequence: Synthetic coding sequence
atgtgccacgccgcccaggagacccccctgctgcaccacttcatggacagccctgagagctacccctgtggagatgagcacacccccagccccatcgccggccggcagcccctggaggtgcagcccctgctgaagctgggccagcctgtgtctgctgtggccgccctgcaggctgatggccacatgattgccttcctgggggacacccagggccagctgtacaaggtggaccgcatccctgtggccgcctgcccccagttcccagactgtgccagctgcctgcaggcccaggaccccctgtgtggctggtgtgtgctgcagggccgctgcaccaggaagggccagtgtggccgggccggccagctgaaccagtggctgtggagctatgaggaggacagccactgcctgcacatccagagcctgctgcccggccaccacccccggcaggagcagggccaggtgaccctgtctgtgccccggctgcccatcctggatgctgatgagtacttccactgtgccttcggggactatgacagcctggcccacgtggagggcccccacgtggcctgtgtgaccccaccccaggaccaggtgcccctgaaccccccaggcacagaccacgtgacagtgcccctggccctgatgtttgaagatgtgacagtggccgccaccaacttctccttctatgactgcagcgctgtgcaggccctggaggccgccgccccctgccgggcctgtgtgggcagcatctggcgctgccactggtgcccccagagcagccactgtgtgtatggagagcactgcccagagggggagaggaccatctacagcgcccaggaggtggacatccaggtgcggggccctggggcctgcccccaggtggagggcctggccggcccccacctggtgcctgtgggctgggagagccacctggccctgcgggtgaggaacctgcagcacttccggggcctgcctgccagcttccactgctggctggagctgcctggagagctgcggggcctgcctgccaccctggaggagacagctggggacagcggcctcatccactgccaggcccaccagttctaccccagcatgagccagcgggagctgcctgtgcccatctacgtgacccagggcgaggcccagaggctggacaacacccacgccctgtatgtgatcctgtatgactgtgccatgggccacccagactgcagccactgccaggccgccaacagaagcctgggctgcctgtggtgtgctgatggccagcctgcctgccgctatggccccctgtgccccccaggagctgtggagctgctgtgcccagcccccagcattgatgctgtggagcccctgaccggccccccagagggcggcctggccctgaccatcctgggcagcaacctgggccgggcctttgctgatgtgcagtatgctgtgtctgtggccagccggccctgcaaccctgagcccagcctgtaccgcaccagcgccagaattgtgtgtgtgaccagccctgcccccaacggcaccactggacctgtgcgggtggccatcaagagccagcccccaggcatcagcagccagcacttcacctaccaggaccctgtgctgctgagcctgagcccccgctggggcccccaggccggcggcacccagctgaccatccggggccagcacctgcagacaggaggcaacaccagcgcctttgtgggcggccagccctgccccatcctggagcctgtgtgcccagaggccatcgtgtgcaggacccggccccaggccgcccctggagaggccgctgtgctggtggtgtttggacatgcccagaggaccctgctggccagccccttccgctacacagccaacccccagctggtggccgctgagcccagcgccagcttccggggcggcggccgcctcatccgggtgcggggcaccggcctggatgtggtgcagaggcccctgctgtctgtgtggctggaggctgatgctgaggtgcaggccagccgggcccagccccaggacccccagcccaggaggagctgtggggccccagctgctgacccccaggcctgcatccagctgggcggcggcctgctgcagtgcagcacagtgtgcagcgtgaacagcagcagcctgctgctgtgccgcagccctgctgtgcctgaccgggcccacccccagagggtcttcttcaccctggacaacgtgcaggtggactttgccagcgccagcggcggccagggcttcctgtaccagcccaacccccggctggcccccctgagccgggagggccctgcccggccctaccgcctgaagccaggccacgtgctggatgtggagggggagggcctgaacctgggcatcagcaaggaggaggtgcgggtgcacatcggccgcggggagtgcctggtgaagaccctgaccaggacccacctgtactgtgagcccccagcccacgccccccagcctgccaacggcagcggcctgccccagtttgtggtgcagatgggaaatgtgcagctggccctgggccctgtgcagtatgaagctgagccccccctgagcgccttccctgtggaggcccaggccggcgtgggcatgggcgctgctgtgctgattgctgctgtgctgctgctgaccctgatgtaccgccacaagagcaagcaggccctgcgggactaccagaaggtgctggtgcagctggagagcctggagactggagtgggggaccagtgcaggaaggagttcaccggcggctgcggcggcggcggcaccggctacccccggggcctgaacagccacctgggcgcctcctggccccggcggccccatgatggagatgaccggccccagcagaggcctgggggccagagggaccccctgcccggcctgccccacctgcggcgggcccggctgctgccctggccctggaggctgcctgctgctgcccaggcctag

SEQ ID NO: 164458 - DNA, 675 bp, Artificial Sequence
  Description of Artificial Sequence: Synthetic coding sequence
atgtgccacgccgcccaggagacccccctgctgcaccacttcatggtggaccgcatccctgtggccgcctgcccccagttcccagactgtgccagctgcctgcaggcccaggaccccctgtgtggctggtgtgtgctgcagggccgctgcaccaggaagggccagtgtggccgggccggccagctgaaccagtggctgtggagctatgaggaggacagccactgcctgcacatccagagcctgctgcccggccaccacccccggcaggagcagggccaggtgaccctgtctgtgccccggctgcccatcctggatgctgatgagtacttccactgtgccttcggggactatgacagcctggcccacgtggagggcccccacgtggcctgtgtgaccccaccccaggaccaggtgcccctgaaccccccaggcacagaccacgtgacagtgcccctggccctgatgtttgaagatgtgacagtggccgccaccaacttctccttctatgactgcagcgctgtgcaggccctggaggccgccgccccagcctgcctgccccccagcacagctggctggagctgcctggagaactttggagactgcaggcctccctggaggcggcagcagggcatccaggccagcagcacagcccggcccaccaggagcagcccctag

SEQ ID NO: 164459 - DNA, 4689 bp, Artificial Sequence
  Description of Artificial Sequence: Synthetic coding sequence
atgtgccacgccgcccaggagacccccctgctgcaccacttcatggacagccctgagagctacccctgtggagatgagcacacccccagccccatcgccggccggcagcccctggaggtgcagcccctgctgaagctgggccagcctgtgtctgctgtggccgccctgcaggctgatggccacatgattgccttcctgggggacacccagggccagctgtacaaggtgttcctgcacggcagccagggccaggtgtaccacagccagcaggtgggccccccaggcagcgccatcagcccagacctgctgctggacagcagcggcagccacctgtatgtgctgacagcccaccaggtggaccgcatccctgtggccgcctgcccccagttcccagactgtgccagctgcctgcaggcccaggaccccctgtgtggctggtgtgtgctgcagggccgctgcaccaggaagggccagtgtggccgggccggccagctgaaccagtggctgtggagctatgaggaggacagccactgcctgcacatccagagcctgctgcccggccaccacccccggcaggagcagggccaggtgaccctgtctgtgccccggctgcccatcctggatgctgatgagtacttccactgtgcctttggagactatgacagcctggcccacgtggagggcccccacgtggcctgtgtgaccccaccccaggaccaggtgcccctgaaccccccaggcacagaccacgtgacagtgcccctggccctgatgtttgaagatgtgacagtggccgccaccaacttctccttctatgactgcagcgctgtgcaggccctggaggccgccgccccctgccgggcctgtgtgggcagcatctggcgctgccactggtgcccccagagcagccactgtgtgtatggagagcactgcccagagggggagaggaccatctacagcgcccaggaggtggacatccaggtgcggggccctggggcctgcccccaggtggagggcctggccggcccccacctggtgcctgtgggctgggagagccacctggccctgcgggtgaggaacctgcagcacttccggggcctgcctgccagcttccactgctggctggagctgcccggggagctgcggggcctgcctgccaccctggaggagacagctggggacagcggcctcatccactgccaggcccaccagttctaccccagcatgagccagcgggagctgcctgtgcccatctacgtgacccagggcgaggcccagaggctggacaacacccacgccctgtatgtgatcctgtatgactgtgccatgggccacccagactgcagccactgccaggccgccaacagaagcctgggctgcctgtggtgtgctgatggccagcctgcctgccgctatggccccctgtgccccccaggagctgtggagctgctgtgcccagcccccagcattgatgctgtggagcccctgactggacctcctgagggcggcctggccctgaccatcctgggcagcaacctgggccgggcctttgctgatgtgcagtatgctgtgtctgtggccagccggccctgcaaccctgagcccagcctgtaccgcaccagcgcccgcatcgtgtgtgtgaccagccctgccccaaatggcaccaccggccctgtgcgggtggccatcaagagccagcccccaggcatcagcagccagcacttcacctaccaggaccctgtgctgctgagcctgagcccccgctggggcccccaggccggcggcacccagctgaccatccggggccagcacctgcagacaggaggcaacaccagcgcctttgtgggcggccagccctgccccatcctggagcctgtgtgcccagaggccatcgtgtgcaggacccggccccaggccgcccctggagaggccgctgtgctggtggtgtttggccacgcccagaggaccctgctggccagccccttccgctacacagccaacccccagctggtggccgctgagcccagcgccagcttccggggcggcggccgcctcatccgggtgcggggcaccggcctggatgtggtgcagaggcccctgctgtctgtgtggctggaggctgatgctgaggtgcaggccagccgggcccagccccaggacccccagccccggcgcagctgtggggccccagctgctgacccccaggcctgcatccagctgggcggcggcctgctgcagtgcagcacagtgtgcagcgtgaacagcagcagcctgctgctgtgccgcagccctgctgtgcctgaccgggcccacccccagagggtcttcttcaccctggacaacgtgcaggtggactttgccagcgccagcggcggccagggcttcctgtaccagcccaacccccggctggcccccctgagccgggagggccctgcccggccctaccgcctgaagccaggccacgtgctggatgtggagggggagggcctgaacctgggcatcagcaaggaggaggtgcgggtgcacatcggcagaggagaatgtctggtgaagaccctgaccaggacccacctgtactgtgagcccccagcccacgccccccagcctgccaatggaagtggcctgccccagtttgtggtgcagatgggaaatgtgcagctggccctgggccctgtgcagtatgaggccgagccccccctgagcgccttccctgtggaggcccaggccggcgtgggcatgggcgctgctgtgctgattgctgctgtgctgctgctgaccctgatgtaccgccacaagagcaagcaggccctgcgggactaccagaaggtgctggtgcagctggagagcctggagaccggggtgggggaccagtgcaggaaggagttcacagacctgatgacagagatgacagacctgagcagtgacctggagggcagcggcatccccttcctggactaccgcacctacgccgagcgggccttcttccctggccacggcggctgccccctgcagcccaagccagagggccctggagaagatggccactgtgccaccgtgcggcagggcctgacccagctgagcaacctgctgaacagcaagctgttcctgctgaccctcatccacaccctggaggagcagcccagcttcagccagagggaccgctgccacgtggccagcctgctgagcctggccctgcacggcaagctggagtacctgacagacatcatgaggaccctgctgggggacctggccgcccactacgtgcacaggaaccccaagctgatgctgcggaggacagagaccatggtggagaagctgctgaccaactggctgagcatctgcctgtatgccttcctgcgggaggtggccggggagcccctgtacatgctgttccgggccatccagtaccaggtggacaagggccctgtggatgctgtgacaggcaaggccaagaggaccctgaatgacagccggctgctgcgggaggatgtggagttccagcccctgaccctgatggtgctggtgggccctggagctggaggagctgctggcagcagcgagatgcagagggtgcctgcccgggtgctggacacagacaccatcacccaggtgaaggagaaggtgctggaccaggtgtacaagggcacccccttcagccagaggccttctgtgcacgccctggacctggagtggaggagcggcctggccggccacctgaccctgagtgatgaggacctgacctctgtgacccagaaccactggaagaggctgaacaccctgcagcactacaaggtgcctgatggagccaccgtgggcctggtgccccagctgcaccggggcagcaccatcagccagagcctggcccagcgctgccccctgggggagaacatccccaccctggaggatggagaggagggcggcgtgtgcctgtggcacctggtgaaggccacagaggagcctgagggcgccaaggtgcgctgcagcagcctgcgggagcgggagcccgcccgggccaaggccatccctgagatctacctgacccggctgctgtccatgaagggcaccctgcagaagtttgtggatgacaccttccaggccatcctgtctgtgaaccggcccatccccatcgctgtgaagtacctgtttgacctgctggatgagctggccgagaagcacggcattgaagatcctggcaccctgcacatctggaagaccaacagcctgctgctgcgcttctgggtgaatgccctgaagaacccccagctgatctttgatgtgcgggtgtctgacaacgtggatgccatcctggccgtgattgcccagaccttcatcgacagctgcaccaccagcgagcacaaggtgggccgggacagccctgtgaacaagctgctgtatgcccgggagatcccccgctacaagcagatggtggagcgctactatgctgacatccggcagagcagccctgccagctaccaggagatgaacagcgccctggccgagctgagcggcaactacaccagcgccccccactgcctggaggccctgcaggagctgtacaaccacatccaccgctactatgaccagatcatcagcgccctggaggaggaccctgtgggccagaagctgcagctggcctgccgcctgcagcaggtggccgccctggtggagaacaaggtgacagacctgtag

SEQ ID NO: 164460 - DNA, 5799 bp, Artificial Sequence
  Description of Artificial Sequence: Synthetic coding sequence
atggagctgaccccagccagcagcctgacctgcagcctgctgagcccccggctgcccggcagcttcccccagctgcggcgggtgcccccctgcagccggccctggctgcccaaggcccctgtgatggcccgctggccacccttcggcctgtgcctgctgctgctgctgctgagccccccacccctgcccctgactggagcccaccgcttcagcgcccccaacaccaccctgaaccacctggccctggcccctggccggggcaccctgtatgtgggcgctgtgaacagactcttccagctgagccctgagctgcagctggaggccgtggccgtgacaggccctgtgattgacagcccagactgtgtgcccttccgggaccctgcagaatgtccccaggcccagctgacagacaatgccaaccagctgctgctggtgagcagccgggcccaggagctggtggcctgtggccaggtgcggcagggcgtgtgtgagacccggcggctgggagatgtggccgaggtgctgtaccaggctgaagatcctggagatggccagtttgtggccgccaacaccccaggagtggccaccgtgggcctggtggtgcccctgcccggccgggacctgctgctggtggcccggggcctggccggcaagctgtctgctggggtgccccccctggccatccggcagctggccggcagccagcccttcagcagcgagggcctgggccgcctggtggtgggggacttcagtgactacaacaacagctatgtgggcgcctttgctgatgcccggagcgcctactttgtgttcagaagaagaggagcccgggcccaggccgagtaccgctcctatgtggcccgggtgtgcctgggggacaccaacctgtacagctatgtggaggtgcccctggcctgccagggccagggcctcatccaggccgccttcctggcccctggcaccctgctgggcgtgtttgctgctggcccccggggcacccaggccgccctgtgtgccttccccatggtggagctgggcgcctccatggagcaggcccggcggctgtgctacacagctgggggccggggccccagcggggctgaggaggccaccgtggagtatggagtgaccagccgctgtgtgaccctgcccctggacagccctgagagctacccctgtggagatgagcacacccccagccccatcgccggccggcagcccctggaggtgcagcccctgctgaagctgggccagcctgtgtctgctgtggccgccctgcaggctgatggccacatgattgccttcctgggggacacccagggccagctgtacaaggtgttcctgcacggcagccagggccaggtgtaccacagccagcaggtgggccccccaggcagcgccatcagcccagacctgctgctggacagcagcggcagccacctgtatgtgctgacagcccaccaggtggaccgcatccctgtggccgcctgcccccagttcccagactgtgccagctgcctgcaggcccaggaccccctgtgtggctggtgtgtgctgcagggccgctgcaccaggaagggccagtgtggccgggccggccagctgaaccagtggctgtggagctatgaggaggacagccactgcctgcacatccagagcctgctgcccggccaccacccccggcaggagcagggccaggtgaccctgtctgtgccccggctgcccatcctggatgctgatgagtacttccactgtgcctttggagactatgacagcctggcccacgtggagggcccccacgtggcctgtgtgaccccaccccaggaccaggtgcccctgaaccccccaggcacagaccacgtgacagtgcccctggccctgatgtttgaagatgtgacagtggccgccaccaacttctccttctatgactgcagcgctgtgcaggccctggaggccgccgccccctgccgggcctgtgtgggcagcatctggcgctgccactggtgcccccagagcagccactgtgtgtatggagagcactgcccagagggggagaggaccatctacagcgcccaggaggtggacatccaggtgcggggccctggggcctgcccccaggtggagggcctggccggcccccacctggtgcctgtgggctgggagagccacctggccctgcgggtgaggaacctgcagcacttccggggcctgcctgccagcttccactgctggctggagctgcccggggagctgcggggcctgcctgccaccctggaggagacagctggggacagcggcctcatccactgccaggcccaccagttctaccccagcatgagccagcgggagctgcctgtgcccatctacgtgacccagggcgaggcccagaggctggacaacacccacgccctgtatgtgatcctgtatgactgtgccatgggccacccagactgcagccactgccaggccgccaacagaagcctgggctgcctgtggtgtgctgatggccagcctgcctgccgctatggccccctgtgccccccaggagctgtggagctgctgtgcccagcccccagcattgatgctgtggagcccctgactggacctcctgagggcggcctggccctgaccatcctgggcagcaacctgggccgggcctttgctgatgtgcagtatgctgtgtctgtggccagccggccctgcaaccctgagcccagcctgtaccgcaccagcgcccgcatcgtgtgtgtgaccagccctgccccaaatggcaccaccggccctgtgcgggtggccatcaagagccagcccccaggcatcagcagccagcacttcacctaccaggaccctgtgctgctgagcctgagcccccgctggggcccccaggccggcggcacccagctgaccatccggggccagcacctgcagacaggaggcaacaccagcgcctttgtgggcggccagccctgccccatcctggagcctgtgtgcccagaggccatcgtgtgcaggacccggccccaggccgcccctggagaggccgctgtgctggtggtgtttggccacgcccagaggaccctgctggccagccccttccgctacacagccaacccccagctggtggccgctgagcccagcgccagcttccggggcggcggccgcctcatccgggtgcggggcaccggcctggatgtggtgcagaggcccctgctgtctgtgtggctggaggctgatgctgaggtgcaggccagccgggcccagccccaggacccccagccccggcgcagctgtggggccccagctgctgacccccaggcctgcatccagctgggcggcggcctgctgcagtgcagcacagtgtgcagcgtgaacagcagcagcctgctgctgtgccgcagccctgctgtgcctgaccgggcccacccccagagggtcttcttcaccctggacaacgtgcaggtggactttgccagcgccagcggcggccagggcttcctgtaccagcccaacccccggctggcccccctgagccgggagggccctgcccggccctaccgcctgaagccaggccacgtgctggatgtggagggggagggcctgaacctgggcatcagcaaggaggaggtgcgggtgcacatcggcagaggagaatgtctggtgaagaccctgaccaggacccacctgtactgtgagcccccagcccacgccccccagcctgccaatggaagtggcctgccccagtttgtggtgcagatgggaaatgtgcagctggccctgggccctgtgcagtatgaggccgagccccccctgagcgccttccctgtggaggcccaggccggcgtgggcatgggcgctgctgtgctgattgctgctgtgctgctgctgaccctgatgtaccgccacaagagcaagcaggccctgcgggactaccagaaggtgctggtgcagctggagagcctggagaccggggtgggggaccagtgcaggaaggagttcacagacctgatgacagagatgacagacctgagcagtgacctggagggcagcggcatccccttcctggactaccgcacctacgccgagcgggccttcttccctggccacggcggctgccccctgcagcccaagccagagggccctggagaagatggccactgtgccaccgtgcggcagggcctgacccagctgagcaacctgctgaacagcaagctgttcctgctgaccctcatccacaccctggaggagcagcccagcttcagccagagggaccgctgccacgtggccagcctgctgagcctggccctgcacggcaagctggagtacctgacagacatcatgaggaccctgctgggggacctggccgcccactacgtgcacaggaaccccaagctgatgctgcggaggacagagaccatggtggagaagctgctgaccaactggctgagcatctgcctgtatgccttcctgcgggaggtggccggggagcccctgtacatgctgttccgggccatccagtaccaggtggacaagggccctgtggatgctgtgacaggcaaggccaagaggaccctgaatgacagccggctgctgcgggaggatgtggagttccagcccctgaccctgatggtgctggtgggccctggagctggaggagctgctggcagcagcgagatgcagagggtgcctgcccgggtgctggacacagacaccatcacccaggtgaaggagaaggtgctggaccaggtgtacaagggcacccccttcagccagaggccttctgtgcacgccctggacctggagtggaggagcggcctggccggccacctgaccctgagtgatgaggacctgacctctgtgacccagaaccactggaagaggctgaacaccctgcagcactacaaggtgcctgatggagccaccgtgggcctggtgccccagctgcaccggggcagcaccatcagccagagcctggcccagcgctgccccctgggggagaacatccccaccctggaggatggagaggagggcggcgtgtgcctgtggcacctggtgaaggccacagaggagcctgagggcgccaaggtgcgctgcagcagcctgcgggagcgggagcccgcccgggccaaggccatccctgagatctacctgacccggctgctgtccatgaagggcaccctgcagaagtttgtggatgacaccttccaggccatcctgtctgtgaaccggcccatccccatcgctgtgaagtacctgtttgacctgctggatgagctggccgagaagcacggcattgaagatcctggcaccctgcacatctggaagaccaacagcctgctgctgcgcttctgggtgaatgccctgaagaacccccagctgatctttgatgtgcgggtgtctgacaacgtggatgccatcctggccgtgattgcccagaccttcatcgacagctgcaccaccagcgagcacaaggtgggccgggacagccctgtgaacaagctgctgtatgcccgggagatcccccgctacaagcagatggtggagcgctactatgctgacatccggcagagcagccctgccagctaccaggagatgaacagcgccctggccgagctgagcggcaactacaccagcgccccccactgcctggaggccctgcaggagctgtacaaccacatccaccgctactatgaccagatcatcagcgccctggaggaggaccctgtgggccagaagctgcagctggcctgccgcctgcagcaggtggccgccctggtggagaacaaggtgacagacctgtag

SEQ ID NO: 164461 - DNA, 5778 bp, Artificial Sequence
  Description of Artificial Sequence: Synthetic coding sequence
atggcccccagggctgctgggggcgcccccctgagcgcccgggctgctgctgccagccccccacccttccagaccccaccccgctgccctgtgcccctgctgctgctgctgctgctgggcgccgcccgggccggggccctggagatccagaggcgcttccccagccccacccccaccaacaactttgccctggatggagctgctggcaccgtgtacctggccgctgtgaacagactctaccagctgagcggggccaacctgagcctggaggccgaggccgctgtgggccctgtgcctgacagccccctgtgccacgccccccagctgccccaggccagctgtgagcacccccggcggctgacagacaactacaacaagatcctgcagctggaccccggccagggcctggtggtggtgtgtggcagcatctaccagggcttctgccagctgcggcggcggggcaacatctctgctgtggccgtgcgcttccccccagctgcccccccagctgagcctgtgaccgtcttccccagcatgctgaatgtggccgccaaccaccccaatgccagcacagtgggcctggtgctgcccccagctgctggggccggcggcagccggctgctggtgggcgccacctacacaggctacggcagcagcttcttccccaggaacagaagcctggaggaccacagatttgagaacaccccagagatcgccatccgcagcctggacaccaggggggacctggccaagctgttcacctttgacctgaaccccagtgatgacaacatcctgaagatcaagcagggcgccaaggagcagcacaagctgggctttgtgtctgccttcctgcaccccagcgaccccccacctggggcccagagctatgcctacctggccctgaacagcgaggcccgggccggggacaaggagagccaggcccggagcctgctggcccgcatctgcctgccccatggagctggaggagatgccaagaagctgacagagagctacatccagctgggcctgcagtgtgccggcggggccggccgcggggacctgtacagccggctggtgtctgtgtttcctgcccgggagcggctgtttgctgtgtttgagcggccccagggcagccctgctgcccgggccgccccagctgccctgtgtgccttccgctttgctgatgtgcgggccgccatccgggccgccaggacagcctgctttgtggagcccgccccagatgtggtggccgtgctggacagcgtggtgcagggcaccggccctgcctgtgagaggaagctgaacatccagctgcagcctgagcagctggactgtggggccgcccacctgcagcaccccctgagcatcctgcagcccctgaaggccacccctgtgttccgggcccctggcctgacctctgtggccgtggcctctgtgaacaactacacagctgtgttcctgggcaccgtgaatggccgcctgctgaagatcaacctgaatgaatccatgcaggtggtgtcccggcgggtggtgacagtggcctatggagagcctgtgcaccacgtgatgcagtttgatcctgctgacagcggctacctgtacctgatgaccagccaccagatggcccgggtgaaggtggccgcctgcaatgtgcacagcacctgtggggactgtgtgggcgctgctgatgcctactgcggctggtgtgccctggagacccgctgcaccctgcagcaggactgcaccaacagcagccagcagcacttctggaccagcgccagcgagggccccagccgctgcccagccatgacagtgctgcccagcgagattgatgtgcggcaggagtacccaggcatgatcctgcagatcagcggcagcctgcccagcctgagcggcatggagatggcctgtgactatggcaacaacatcagaacagtggcccgggtgcccggccctgccttcggccaccagatcgcctactgcaacctgctgccccgggaccagttcccccccttcccccccaaccaggaccacgtgacagtggagatgtctgtgcgggtgaatggaagaaacatcgtgaaggccaacttcaccatctatgactgcagcaggacagcccaggtgtacccccacacagcctgcaccagctgcctgagcgcccagtggccctgcttctggtgcagccagcagcacagctgtgtgagcaaccagagccgctgtgaggccagccccaaccccaccagcccccaggactgccccaggaccctgctgagccccctggcccctgtgcccactggaggcagccagaacatcctggtgcccctggccaacacagccttcttccagggcgccgccctggagtgcagctttggcctggaggagatctttgaggccgtgtgggtgaatgaatctgtggtgcgctgtgaccaggtggtgctgcacaccaccaggaagagccaggtgttccccctgagcctgcagctgaagggccggcctgcccgcttcctggacagccctgagcccatgacagtgatggtgtacaactgtgccatgggcagcccagactgcagccagtgcctgggccgggaggacctgggccacctgtgcatgtggagcgatggctgccgcctgcggggccccctgcagcccatggccggcacctgcccagcccctgagatccacgccatcgagcccctgagcggccccctggatggcggcaccctgctgaccatccggggcaggaacctgggccggcggctgagtgatgtggcccatggagtgtggattggaggagtggcctgtgagcccctgcctgaccgctacacagtgtctgaggagatcgtgtgtgtgactggacctgcccctggccccctgtctggagtggtgacagtgaatgccagcaaggagggcaagagccgggaccgcttctcctatgtgctgcccctggtgcacagcctggagcccaccatgggccccaaggccggcggcacccgcatcaccatccacggcaatgacctgcacgtgggcagcgagctgcaggtgctggtgaatgacacagacccctgcacagagctgatgaggacagacaccagcatcgcctgcaccatgcctgagggcgccctgcctgcccctgtgcctgtgtgtgtgcgctttgaaagaagaggctgtgtgcacggcaacctgaccttctggtacatgcagaaccctgtgatcacagccatcagccccaggaggagccctgtgtctgggggccgcaccatcaccgtggccggggagcgcttccacatggtgcagaatgtgtccatggctgtgcaccacatcggccgggagcccaccctgtgcaaggtgctgaacagcaccctcatcacctgccccagccctggggccctgagcaatgccagcgcccctgtggacttcttcatcaatggccgggcctatgcagatgaggtggccgtggccgaggagctgctggaccctgaggaggcccagaggggcagccgcttccggctggactacctgcccaacccccagttcagcacagccaagcgggagaagtggatcaagcaccaccctggagagcccctgaccctggtgatccacaaggagcaggacagcctgggcctgcagagccatgagtacagagtgaagattggccaggtgtcctgtgacatccagatcgtgtctgaccgcatcatccactgcagcgtgaatgaaagcctgggcgctgctgtgggccagctgcccatcaccatccaggtgggcaacttcaaccagaccatcgccaccctgcagctgggcggcagcgagacagccatcatcgtgtccatcgtcatctgcagcgtgctgctgctgctgtctgtggtggccctgtttgtgttctgcaccaagagccggcgggcagagcgctactggcagaagaccctgctgcagatggaggagatggagagccagatccgggaggagatcaggaagggctttgctgagctgcagacagacatgacagacctgaccaaggagctgaacagaagccagggcatccccttcctggagtacaagcactttgtgaccaggaccttcttccccaagtgcagcagcctgtatgaggagagatatgtgctgcccagccagaccctgaacagccagggcagcagccaggcccaggagacccaccccctgctgggggagtggaagatccctgagagctgccggcccaacatggaggagggcatcagcctcttcagcagcctgctgaacaacaagcacttcctgattgtgtttgtgcacgccctggagcagcagaaggactttgctgtgcgggaccgctgcagcctggccagcctgctgaccatcgccctgcacggcaagctggagtactacaccagcatcatgaaggagctgctggtggacctgattgatgccagcgctgccaagaaccccaagctgatgctgcggaggacagagagcgtggtggagaagatgctgaccaactggatgagcatctgcatgtacagctgcctgcgggagaccgtgggggagcccttcttcctgctgctgtgtgccatcaagcagcagatcaacaagggcagcattgatgccatcaccgggaaggcccgctacaccctgtctgaggagtggctgctgagagaaaatattgaggccaagcccaggaacctgaatgtgtccttccagggctgcggcatggacagcctgtctgtgcgggccatggacacagacaccctgacccaggtgaaggagaagatcctggaggccttctgcaagaatgtgccctacagccagtggcccagggcagaagatgtggacctggagtggtttgccagcagcacccagagctacatcctgcgggacctggatgacacctctgtggtggaggatggcaggaagaagctgaacaccctggcccactacaagatccctgagggcgccagcctggccatgagcctgattgacaagaaggacaacaccctgggccgggtgaaggacctggacacagagaagtacttccacctggtgctgcccacagatgagctggccgagcccaagaagagccaccggcagagccacaggaagaaggtgctgcctgagatctacctgacccggctgctgagcaccaagggcaccctgcagaagttcctggatgacctcttcaaggccatcctgagcatccgggaggacaagccacccctggccgtgaagtacttctttgacttcctggaggagcaggccgagaagaggggcatcagtgaccctgacaccctgcacatctggaagaccaacagcctgcccctgcgcttctgggtgaacatcctgaagaacccccagtttgtgtttgatattgacaagacagaccacattgatgcctgcctgagcgtcatcgcccaggccttcattgatgcctgcagcatcagtgacctgcagctgggcaaggacagccccaccaacaagctgctgtatgccaaggagatccctgagtacaggaagatcgtgcagcgctactacaagcagatccaggacatgacccccctgtctgagcaggagatgaatgcccacctggccgaggagagcaggaagtaccagaatgagttcaacaccaacgtggccatggccgagatctacaagtatgccaagcgctaccggccccagatcatggccgccctggaggccaaccccacagcccggaggacccagctgcagcacaagtttgagcaggtggtggccctgatggaggacaacatctatgagtgctacagcgaggcctag

SEQ ID NO: 164462 - DNA, 5358 bp, Artificial Sequence
  Description of Artificial Sequence: Synthetic coding sequence
atggcccccagggctgctgggggcgcccccctgagcgcccgggctgctgctgccagccccccacccttccagaccccaccccgctgccctgtgcccctgctgctgctgctgctgctgggcgccgcccgggccggggccctggagatccagaggcgcttccccagccccacccccaccaacaactttgccctggatggagctgctggcaccgtgtacctggccgctgtgaacagactctaccagctgagcggggccaacctgagcctggaggccgaggccgctgtgggccctgtgcctgacagccccctgtgccacgccccccagctgccccaggccagctgtgagcacccccggcggctgacagacaactacaacaagatcctgcagctggaccccggccagggcctggtggtggtgtgtggcagcatctaccagggcttctgccagctgcggcggcggggcaacatctctgctgtggccgtgcgcttccccccagctgcccccccagctgagcctgtgaccgtcttccccagcatgctgaatgtggccgccaaccaccccaatgccagcacagtgggcctggtgctgcccccagctgctggggccggcggcagccggctgctggtgggcgccacctacacaggctacggcagcagcttcttccccaggaacagaagcctggaggaccacagatttgagaacaccccagagatcgccatccgcagcctggacaccaggggggacctggccaagctgttcacctttgacctgaaccccagtgatgacaacatcctgaagatcaagcagggcgccaaggagcagcacaagctgggctttgtgtctgccttcctgcaccccagcgaccccccacctggggcccagagctatgcctacctggccctgaacagcgaggcccgggccggggacaaggagagccaggcccggagcctgctggcccgcatctgcctgccccatggagctggaggagatgccaagaagctgacagagagctacatccagctgggcctgcagtgtgccggcggggccggccgcggggacctgtacagccggctggtgtctgtgtttcctgcccgggagcggctgtttgctgtgtttgagcggccccagggcagccctgctgcccgggccgccccagctgccctgtgtgccttccgctttgctgatgtgcgggccgccatccgggccgccaggacagcctgctttgtggagcccgccccagatgtggtggccgtgctggacagcgtggtgcagggcaccggccctgcctgtgagaggaagctgaacatccagctgcagcctgagcagctggactgtggggccgcccacctgcagcaccccctgagcatcctgcagcccctgaaggccacccctgtgttccgggcccctggcctgacctctgtggccgtggcctctgtgaacaactacacagctgtgttcctgggcaccgtgaatggccgcctgctgaagatcaacctgaatgaatccatgcaggtggtgtcccggcgggtggtgacagtggcctatggagagcctgtgcaccacgtgatgcagtttgatcctgctgacagcggctacctgtacctgatgaccagccaccagatggcccgggtgaaggtggccgcctgcaatgtgcacagcacctgtggggactgtgtgggcgctgctgatgcctactgcggctggtgtgccctggagacccgctgcaccctgcagcaggactgcaccaacagcagccagcagcacttctggaccagcgccagcgagggccccagccgctgcccagccatgacagtgctgcccagcgagattgatgtgcggcaggagtacccaggcatgatcctgcagatcagcggcagcctgcccagcctgagcggcatggagatggcctgtgactatggcaacaacatcagaacagtggcccgggtgcccggccctgccttcggccaccagatcgcctactgcaacctgctgccccgggaccagttcccccccttcccccccaaccaggaccacgtgacagtggagatgtctgtgcgggtgaatggaagaaacatcgtgaaggccaacttcaccatctatgactgcagcaggacagcccaggtgtacccccacacagcctgcaccagctgcctgagcgcccagtggccctgcttctggtgcagccagcagcacagctgtgtgagcaaccagagccgctgtgaggccagccccaaccccaccagcccccaggactgccccaggaccctgctgagccccctggcccctgtgcccactggaggcagccagaacatcctggtgcccctggccaacacagccttcttccagggcgccgccctggagtgcagctttggcctggaggagatctttgaggccgtgtgggtgaatgaatctgtggtgcgctgtgaccaggtggtgctgcacaccaccaggaagagccaggtgttccccctgagcctgcagctgaagggccggcctgcccgcttcctggacagccctgagcccatgacagtgatggtgtacaactgtgccatgggcagcccagactgcagccagtgcctgggccgggaggacctgggccacctgtgcatgtggagcgatggctgccgcctgcggggccccctgcagcccatggccggcacctgcccagcccctgagatccacgccatcgagcccctgagcggccccctggatggcggcaccctgctgaccatccggggcaggaacctgggccggcggctgagtgatgtggcccatggagtgtggattggaggagtggcctgtgagcccctgcctgaccgctacacagtgtctgaggagatcgtgtgtgtgactggacctgcccctggccccctgtctggagtggtgacagtgaatgccagcaaggagggcaagagccgggaccgcttctcctatgtgctgcccctggtgcacagcctggagcccaccatgggccccaaggccggcggcacccgcatcaccatccacggcaatgacctgcacgtgggcagcgagctgcaggtgctggtgaatgacacagacccctgcacagagctgatgaggacagacaccagcatcgcctgcaccatgcctgagggcgccctgcctgcccctgtgcctgtgtgtgtgcgctttgaaagaagaggctgtgtgcacggcaacctgaccttctggtacatgcagaaccctgtgatcacagccatcagccccaggaggagccctgtgtctgggggccgcaccatcaccgtggccggggagcgcttccacatggtgcagaatgtgtccatggctgtgcaccacatcggccgggagcccaccctgtgcaaggtgctgaacagcaccctcatcacctgccccagccctggggccctgagcaatgccagcgcccctgtggacttcttcatcaatggccgggcctatgcagatgaggtggccgtggccgaggagctgctggaccctgaggaggcccagaggggcagccgcttccggctggactacctgcccaacccccagttcagcacagccaagcgggagaagtggatcaagcaccaccctggagagcccctgaccctggtgatccacaaggagcaggacagcctgggcctgcagagccatgagtacagagtgaagattggccaggtgtcctgtgacatccagatcgtgtctgaccgcatcatccactgcagcgtgaatgaaagcctgggcgctgctgtgggccagctgcccatcaccatccaggtgggcaacttcaaccagaccatcgccaccctgcagctgggcggcagcgagacagccatcatcgtgtccatcgtcatctgcagcgtgctgctgctgctgtctgtggtggccctgtttgtgttctgcaccaagagccggcgggcagagcgctactggcagaagaccctgctgcagatggaggagatggagagccagatccgggaggagatcaggaagggctttgctgagctgcagacagacatgacagacctgaccaaggagctgaacagaagccagggcatccccttcctggagtacaagcactttgtgaccaggaccttcttccccaagtgcagcagcctgtatgaggagagatatgtgctgcccagccagaccctgaacagccagggcagcagccaggcccaggagacccaccccctgctgggggagtggaagatccctgagagctgccggcccaacatggaggagggcatcagcctcttcagcagcctgctgaacaacaagcacttcctgattgtgtttgtgcacgccctggagcagcagaaggactttgctgtgcgggaccgctgcagcctggccagcctgctgaccatcgccctgcacggcaagctggagtactacaccagcatcatgaaggagctgctggtggacctgattgatgccagcgctgccaagaaccccaagctgatgctgcggaggacagagagcgtggtggagaagatgctgaccaactggatgagcatctgcatgtacagctgcctgcgggagaccgtgggggagcccttcttcctgctgctgtgtgccatcaagcagcagatcaacaagggcagcattgatgccatcaccgggaaggcccgctacaccctgtctgaggagtggctgctgagagaaaatattgaggccaagcccaggaacctgaatgtgtccttccagggctgcggcatggacagcctgtctgtgcgggccatggacacagacaccctgacccaggtgaaggagaagatcctggaggccttctgcaagaatgtgccctacagccagtggcccagggcagaagatgtggacctggagtggtttgccagcagcacccagagctacatcctgcgggacctggatgacacctctgtggtggaggatggcaggaagaagctgaacaccctggcccactacaagatccctgagggcgccagcctggccatgagcctgattgacaagaaggacaacaccctgggccgggtgaaggacctggacacagagaagtacttccacctggtgctgcccacagatgagctggccgagcccaagaagagccaccggcagagccacaggaagaaggtgctgcctgagatctacctgacccggctgctgagcaccaagggcaccctgcagaagttcctggatgacctcttcaaggccatcctgagcatccgggaggacaagccacccctggccgtgaagtacttctttgacttcctggaggagcaggccgagaagaggggcatcagtgaccctgacaccctgcacatctggaagaccaaccgctggaggcccagcagccctgtgctgggggagcaccctgaggagccccctgtgtgcctgtag

SEQ ID NO: 164463 - DNA, 1503 bp, Artificial Sequence
  Description of Artificial Sequence: Synthetic coding sequence
atgagaggagagctgtggctgctggtgctggtgctgcgggaggccgcccgggccctgagcccccagcctggagctggccatgatgagggccctggcagcggctgggccgccaagggcaccgtgcggggctggaacagaagagcccgggagagccctggccacgtgtctgagccagacaggacccagctgagccaggacctgggcggcggcaccctggccatggacaccctgcctgacaacagaaccagggtggtggaggacaaccacagctactacgtgtcccggctgtatggccccagcgagccccacagccgggagctgtgggtggatgtggccgaggccaacagaagccaggtgaagatccacaccatcctgagcaacacccaccggcaggccagccgggtggtgctgagctttgacttccccttctacggccaccccctgcggcagatcaccatcgccactggaggcttcatcttcatgggagatgtgatccacaggatgctgacagccacccagtatgtggcccccctgatggccaacttcaaccctggctacagcgacaacagcacagtggtgtactttgacaatggaacagtgtttgtggtgcagtgggaccacgtgtacctgcagggctgggaggacaagggcagcttcaccttccaggccgccctgcaccatgatggaagaattgtgtttgcctacaaggagatccccatgtctgtgcctgagatcagcagcagccagcaccctgtgaagacaggcctgagtgatgccttcatgatcctgaaccccagcccagatgtgcctgagagcagaagaagaagcatctttgagtaccacagaattgagctggaccccagcaaggtgacctccatgtctgctgtggagttcacccccctgcccacctgcctgcagcacaggagctgtgatgcctgcatgagcagtgacctgaccttcaactgctcctggtgccacgtgctgcagcgctgcagcagcggctttgaccgctaccggcaggagtggatggactatggctgtgcccaggaggccgagggccgcatgtgtgaggacttccaggatgaggaccatgacagcgccagcccagacaccagcttcagcccctatgatggagacctgaccaccaccagcagcagcctcttcatcgacagcctgaccacagaagatgacaccaagctgaacccctatgctggaggagatggcctgcagaacaacctgagccccaagaccaagggcacccctgtgcacctgggcaccatcgtgggcatcgtgctggccgtgctgctggtggccgccatcatcctggccggcatctacatcaatggccaccccaccagcaatgctgccctcttcttcatcgagcggcggccccaccactggccagccatgaagttccgcagccacccagaccacagcacctacgccgaggtggagcccagcggccacgagaaggagggcttcatggaggccgagcagtgctag

SEQ ID NO: 164464 - DNA, 1014 bp, Artificial Sequence
  Description of Artificial Sequence: Synthetic coding sequence
atgagaggagagctgtggctgctggtgctggtgctgcgggaggccgcccgggccctgagcccccagcctggagctggccatgatgagggccctggcagcggctgggccgccaagggcaccgtgcggggctggaacagaagagcccgggagagccctggccacgtgtctgagccagacaggacccagctgagccaggacctgggcggcggcaccctggccatggacaccctgcctgacaacagaaccagggtggtggaggacaaccacagctactacgtgtcccggctgtatggccccagcgagccccacagccgggagctgtgggtggatgtggccgaggccaacagaagccaggtgaagatccacaccatcctgagcaacacccaccggcaggccagccgggtggtgctgagctttgacttccccttctacggccaccccctgcggcagatcaccatcgccactggaggcttcatcttcatgggagatgtgatccacaggatgctgacagccacccagtatgtggcccccctgatggccaacttcaaccctggctacagcgacaacagcacagtggtgtactttgacaatggaacagtgtttgtggtgcagtgggaccacgtgtacctgcagggctgggaggacaagggcagcttcaccttccaggccgccctgcaccatgatggaagaattgtgtttgcctacaaggagatccccatgtctgtgcctgagatcagcagcagccagcaccctgtgaagacaggcctgagtgatgccttcatgatcctgaaccccagcccagatgtgcctgagagcagaagaagaagcatctttgagtaccacagaattgagctggaccccagcaaggtgacctccatgtctgctgtggagttcacccccctgcccacctgcctgcagcacaggagctgtgatgcctgcatgagcagtgacctgaccttcaactgctcctggtgccacgtgctgcagagcagagatgaggtgagcccctgctag

SEQ ID NO: 164465 - DNA, 1284 bp, Artificial Sequence
  Description of Artificial Sequence: Synthetic coding sequence
atggacaccctgcctgacaacagaaccagggtggtggaggacaaccacagctactacgtgtcccggctgtatggccccagcgagccccacagccgggagctgtgggtggatgtggccgaggccaacagaagccaggtgaagatccacaccatcctgagcaacacccaccggcaggccagccgggtggtgctgagctttgacttccccttctacggccaccccctgcggcagatcaccatcgccaccggcggcttcatcttcatgggagatgtgatccacaggatgctgacagccacccagtatgtggcccccctgatggccaacttcaaccctggctacagcgacaacagcacagtggtgtactttgacaatggcaccgtgtttgtggtgcagtgggaccacgtgtacctgcagggctgggaggacaagggcagcttcaccttccaggccgccctgcaccatgatggccgcatcgtgtttgcctacaaggagatccccatgtctgtgcctgagatcagcagcagccagcaccctgtgaagacaggcctgagtgatgccttcatgatcctgaaccccagcccagatgtgcctgagagcagaagaagaagcatctttgagtaccaccgcatcgagctggaccccagcaaggtgacctccatgtctgctgtggagttcacccccctgcccacctgcctgcagcacaggagctgtgatgcctgcatgagcagtgacctgaccttcaactgctcctggtgccacgtgctgcagaggagcctgaacaaccaggatgagaacacctacgtgaactgcctggacagccagcagtgccacggcagcagcgagagcagaagacccttccaggatgaagatcatgattctgccagcccagacaccagcttcagcccctatgatggagacctgaccaccaccagcagcagcctcttcatcgacagcctgaccacagaagatgacaccaagctgaacccctatgctggaggagatggcctgcagaacaacctgagccccaagaccaagggcacccctgtgcacctgggcaccatcgtgggcatcgtgctggccgtgctgctggtggccgccatcatcctggccggcatctacatcaatggccaccccaccagcaatgctgccctcttcttcattgaaagaagaccccaccactggccagccatgaagttccgcagccacccagaccacagcacctatgcagaggtggagcccagcggccacgagaaggagggcttcatggaggccgagcagtgctag

SEQ ID NO: 164466 - DNA, 375 bp, Artificial Sequence
  Description of Artificial Sequence: Synthetic coding sequence
atggacaccctgcctgacaacagaaccagggtggtggaggacaaccacagctactacgtgtcccggctgtatggccccagcgagccccacagccgggagctgtgggtggatgtggccgaggccaacagaagccaggtgaagatccacaccatcctgagcaacacccaccggcaggccagccgggtggtgctgagctttgacttccccttctacggccaccccctgcggcagatcaccatcgccaccggcggcttcatcttcatgggagatgtgatccacaggatgctgacagccacccagtatgtggcccccctgatggccaacttcaaccctggctacagcgacaacagcacagtggtgtactttgacaactag

SEQ ID NO: 164467 - DNA, 669 bp, Artificial Sequence
  Description of Artificial Sequence: Synthetic coding sequence
atggacaccctgcctgacaacagaaccagggtggtggaggacaaccacagctactacgtgtcccggctgtatggccccagcgagccccacagccgggagctgtgggtggatgtggccgaggccaacagaagccaggtgaagatccacaccatcctgagcaacacccaccggcaggccagccgggtggtgctgagctttgacttccccttctacggccaccccctgcggcagatcaccatcgccaccggcggcttcatcttcatgggagatgtgatccacaggatgctgacagccacccagtatgtggcccccctgatggccaacttcaaccctggctacagcgacaacagcacagtggtgtactttgacaatggcaccgtgtttgtggtgcagtgggaccacgtgtacctgcagggctgggaggacaagggcagcttcaccttccaggccgccctgcaccatgatggccgcatcgtgtttgcctacaaggagatccccatgtctgtgcctgagatcagcagcagccagcaccctgtgaagacaggcctgagtgatgccttcatgatcctgaaccccagcccagatgtgcctgagagcagaagaagaagcatctttgagtaccaccgcatcgagctggaccccagcaaggtgacctccatgtctgcctag

SEQ ID NO: 164468 - DNA, 198 bp, Artificial Sequence
  Description of Artificial Sequence: Synthetic coding sequence
tgaagcttcaccttccaggccgccctgcaccatgatggaagaattgtgtttgcctacaaggagatccccatgtctgtgcctgagatcagcagcagccagcaccctgtgaagacaggcctgagtgatgccttcatgatcctgaaccccagcccagatgtgcccggcttctctgctgagagcgccaagcacctgtggtag

SEQ ID NO: 164469 - DNA, 1383 bp, Artificial Sequence
  Description of Artificial Sequence: Synthetic coding sequence
atggccctgtctgtgaggaccctgcccctgcggggcttcctggtgccccggccccagcccaccaggagccaggatgcccccagcccccggctgcccctgagcagcgccccagccccctgccgccacaagaatgaggaggacaaccacagctactacgtgtcccggctgtatggccccagcgagccccacagccgggagctgtgggtggatgtggccgaggccaacagaagccaggtgaagatccacaccatcctgagcaacacccaccggcaggccagccgggtggtgctgagctttgacttccccttctacggccaccccctgcggcagatcaccatcgccactggaggcttcatcttcatgggagatgtgatccacaggatgctgacagccacccagtatgtggcccccctgatggccaacttcaaccctggctacagcgacaacagcacagtggtgtactttgacaatggaacagtgtttgtggtgcagtgggaccacgtgtacctgcagggctgggaggacaagggcagcttcaccttccaggccgccctgcaccatgatggaagaattgtgtttgcctacaaggagatccccatgtctgtgcctgagatcagcagcagccagcaccctgtgaagacaggcctgagtgatgccttcatgatcctgaaccccagcccagatgtgcctgagagcagaagaagaagcatctttgagtaccacagaattgagctggaccccagcaaggtgacctccatgtctgctgtggagttcacccccctgcccacctgcctgcagcacaggagctgtgatgcctgcatgagcagtgacctgaccttcaactgctcctggtgccacgtgctgcagcgctgcagcagcggctttgaccgctaccggcaggagtggatggactatggctgtgcccaggaggccgagggccgcatgtgtgaggacttccaggatgaggaccatgacagcgccagcccagacaccagcttcagcccctatgatggagacctgaccaccaccagcagcagcctcttcatcgacagcctgaccacagaagatgacaccaagctgaacccctatgctggaggagatggcctgcagaacaacctgagccccaagaccaagggcacccctgtgcacctgggcaccatcgtgggcatcgtgctggccgtgctgctggtggccgccatcatcctggccggcatctacatcaatggccaccccaccagcaatgctgccctcttcttcatcgagcggcggccccaccactggccagccatgaagttccgcagccacccagaccacagcacctacgccgaggtggagcccagcggccacgagaaggagggcttcatggaggccgagcagtgctag

SEQ ID NO: 164470 - DNA, 723 bp, Artificial Sequence
  Description of Artificial Sequence: Synthetic coding sequence
atggacaccctgcctgacaacagaaccagggtggtggaggacaaccacagctactacgtgtcccggctgtatggccccagcgagccccacagccgggagctgtgggtggatgtggccgaggccaacagaagccaggtgaagatccacaccatcctgagcaacacccaccggcaggccagccgggtggtgctgagctttgacttccccttctacggccaccccctgcggcagatcaccatcgccaccggcggcttcatcttcatgggagatgtgatccacaggatgctgacagccacccagtatgtggcccccctgatggccaacttcaaccctggctacagcgacaacagcacagtggtgtactttgacaatggcaccgtgtttgtggtgcagtgggaccacgtgtacctgcagggctgggaggacaagggcagcttcaccttccaggccgccctgcaccatgatggccgcatcgtgtttgcctacaaggagatccccatgtctgtgcctgagatcagcagcagccagcaccctgtgaagacaggcctgagtgatgccttcatgatcctgaaccccagcccagatgtgcctgagagcagaagaagaagcatctttgagtaccaccgcatcgagctggaccccagcaaggtgacctccatgtctgctgtggagttcacccccctgcccagccccagcaccaccaggatgaagaccaggatgtag

SEQ ID NO: 164471 - DNA, 1179 bp, Artificial Sequence
  Description of Artificial Sequence: Synthetic coding sequence
atggagaaggacaaggtgaagatccacggcatcctgagcaacacccaccggcaggccgcccgggtgaacctgagctttgacttccccttctacggccacttcctgcgggagatcaccgtggccaccggcggcttcatctacaccggggaggtggtgcacaggatgctgacagccacccagtacatcgcccccctgatggccaactttgaccccagcgtgtccaggaacagcacagtgcgctactttgacaatggaacagccctggtggtgcagtgggaccacgtgcacctgcaggacaactacaacctgggcagcttcaccttccaggccaccctgctgatggatggccgcatcatcttcggctacaaggagatccctgtgctggtgacccagatcagcagcaccaaccaccctgtgaaggtgggcctgagtgatgcctttgtggtggtgcaccgcatccagcagatccccaacgtgagaagaaggaccatctatgagtaccaccgggtggagctgcagatgagcaagatcaccaacatctctgctgtggagatgacccccctgcccacctgcctgcagttcaacagatgtggcccctgtgtgagcagccagatcggcttcaactgctcctggtgcagcaagctgcagcgctgcagcagcggctttgacagacaccggcaggactgggtggacagcggctgcccagaggagagcaaggagaagatgtgtgagaacacagagcctgtggagaccagcagcaggaccaccaccaccgtgggcgccaccaccacccagttccgggtgctgaccaccaccaggagagctgtgaccagccagttccccaccagcctgcccacagaagatgacaccaagatcgccctgcacctgaaggacaatggagccagcacagatgacagcgctgctgagaagaagggcggcaccctgcatgctggcctcatcatcggcatcctgatcctggtgctgattgtggccacagccatcctggtgacagtgtacatgtaccaccaccccaccagcgctgccagcatcttcttcattgaaagaagacccagccgctggccagccatgaagttccggcggggcagcggccacccagcctatgcagaggtggagcctgtgggggagaaggagggcttcatcgtgtctgagcagtgctag

SEQ ID NO: 164472 - DNA, 1443 bp, Artificial Sequence
  Description of Artificial Sequence: Synthetic coding sequence
atggcccgcttccccaaggctgacctggccgccgccggcgtgatgctgctgtgccacttcttcacagaccagttccagtttgctgatggcaagccaggggaccagatcctggactggcagtatggagtgacccaggccttcccccacacagaggaggaggtggaggtggacagccacgcctacagccaccgctggaagaggaacctggacttcctgaaggctgtggacaccaacagagcctctgtgggccaggacagccctgagcccaggagcttcacagacctgctgctggatgatggccaggacaacaacacccagatcgagcgggtgaacctgagctttgacttccccttctacggccacttcctgcgggagatcaccgtggccaccggcggcttcatctacaccggggaggtggtgcacaggatgctgacagccacccagtacatcgcccccctgatggccaactttgaccccagcgtgtccaggaacagcacagtgcgctactttgacaatggaacagccctggtggtgcagtgggaccacgtgcacctgcaggacaactacaacctgggcagcttcaccttccaggccaccctgctgatggatggccgcatcatcttcggctacaaggagatccctgtgctggtgacccagatcagcagcaccaaccaccctgtgaaggtgggcctgagtgatgcctttgtggtggtgcaccgcatccagcagatccccaacgtgagaagaaggaccatctatgagtaccaccgggtggagctgcagatgagcaagatcaccaacatctctgctgtggagatgacccccctgcccacctgcctgcagttcaacagatgtggcccctgtgtgagcagccagatcggcttcaactgctcctggtgcagcaagctgcagcgctgcagcagcggctttgacagacaccggcaggactgggtggacagcggctgcccagaggagagcaaggagaagatgtgtgagaacacagagcctgtggagaccagcagcaggaccaccaccaccgtgggcgccaccaccacccagttccgggtgctgaccaccaccaggagagctgtgaccagccagttccccaccagcctgcccacagaagatgacaccaagatcgccctgcacctgaaggacaatggagccagcacagatgacagcgctgctgagaagaagggcggcaccctgcatgctggcctcatcatcggcatcctgatcctggtgctgattgtggccacagccatcctggtgacagtgtacatgtaccaccaccccaccagcgctgccagcatcttcttcattgaaagaagacccagccgctggccagccatgaagttccggcggggcagcggccacccagcctatgcagaggtggagcctgtgggggagaaggagggcttcatcgtgtctgagcagtgctag

SEQ ID NO: 164473 - DNA, 1590 bp, Artificial Sequence
  Description of Artificial Sequence: Synthetic coding sequence
atggcccgcttccccaaggctgacctggccgccgccggcgtgatgctgctgtgccacttcttcacagaccagttccagtttgctgatggcaagccaggggaccagatcctggactggcagtatggagtgacccaggccttcccccacacagaggaggaggtggaggtggacagccacgcctacagccaccgctggaagaggaacctggacttcctgaaggctgtggacaccaacagagcctctgtgggccaggacagccctgagcccaggagcttcacagacctgctgctggatgatggccaggacaacaacacccagatcgaggaggacacagaccacaactactacatcagccgcatctacggccccagcgacagcgccagccgggacctgtgggtgaacatcgaccagatggagaaggacaaggtgaagatccacggcatcctgagcaacacccaccggcaggccgcccgggtgaacctgagctttgacttccccttctacggccacttcctgcgggagatcaccgtggccactggaggcttcatctacacaggagaggtggtgcacaggatgctgacagccacccagtacatcgcccccctgatggccaactttgaccccagcgtgtccaggaacagcacagtgcgctactttgacaatggaacagccctggtggtgcagtgggaccacgtgcacctgcaggacaactacaacctgggcagcttcaccttccaggccaccctgctgatggatggccgcatcatcttcggctacaaggagatccctgtgctggtgacccagatcagcagcaccaaccaccctgtgaaggtgggcctgagtgatgcctttgtggtggtgcaccgcatccagcagatccccaacgtgagaagaaggaccatctatgagtaccaccgggtggagctgcagatgagcaagatcaccaacatctctgctgtggagatgacccccctgcccacctgcctgcagttcaacagatgtggcccctgtgtgagcagccagatcggcttcaactgctcctggtgcagcaagctgcagcgctgcagcagcggctttgacagacaccggcaggactgggtggacagcggctgcccagaggagagcaaggagaagatgtgtgaaaatacagagcctgtggagaccagcagcaggaccaccaccaccgtgggcgccaccaccacccagttccgggtgctgaccaccacccggcgggctgtgaccagccagttccccaccagcctgcccacagaagatgacaccaagatcgccctgcacctgaaggacaacggggccagcacagatgattctgctgctgagaagaagggcggcaccctgcacgccggcctcatcatcggcatcctgatcctggtgctgattgtggccacagccatcctggtgacagtgtacatgtaccaccaccccaccagcgctgccagcatcttcttcatcgagcggcggcccagccgctggccagccatgaagttcagaagaggcagcggccacccagcctatgcagaggtggagcctgtgggggagaaggagggcttcatcgtgtctgagcagtgctag

SEQ ID NO: 164474 - DNA, 1548 bp, Artificial Sequence
  Description of Artificial Sequence: Synthetic coding sequence
atgctgctgtgccacttcttcacagaccagttccagtttgctgatggcaagccaggggaccagatcctggactggcagtatggagtgacccaggccttcccccacacagaggaggaggtggaggtggacagccacgcctacagccaccgctggaagaggaacctggacttcctgaaggctgtggacaccaacagagcctctgtgggccaggacagccctgagcccaggagcttcacagacctgctgctggatgatggccaggacaacaacacccagatcgaggaggacacagaccacaactactacatcagccgcatctacggccccagcgacagcgccagccgggacctgtgggtgaacatcgaccagatggagaaggacaaggtgaagatccacggcatcctgagcaacacccaccggcaggccgcccgggtgaacctgagctttgacttccccttctacggccacttcctgcgggagatcaccgtggccactggaggcttcatctacacaggagaggtggtgcacaggatgctgacagccacccagtacatcgcccccctgatggccaactttgaccccagcgtgtccaggaacagcacagtgcgctactttgacaatggaacagccctggtggtgcagtgggaccacgtgcacctgcaggacaactacaacctgggcagcttcaccttccaggccaccctgctgatggatggccgcatcatcttcggctacaaggagatccctgtgctggtgacccagatcagcagcaccaaccaccctgtgaaggtgggcctgagtgatgcctttgtggtggtgcaccgcatccagcagatccccaacgtgagaagaaggaccatctatgagtaccaccgggtggagctgcagatgagcaagatcaccaacatctctgctgtggagatgacccccctgcccacctgcctgcagttcaacagatgtggcccctgtgtgagcagccagatcggcttcaactgctcctggtgcagcaagctgcagcgctgcagcagcggctttgacagacaccggcaggactgggtggacagcggctgcccagaggagagcaaggagaagatgtgtgaaaatacagagcctgtggagaccagcagcaggaccaccaccaccgtgggcgccaccaccacccagttccgggtgctgaccaccacccggcgggctgtgaccagccagttccccaccagcctgcccacagaagatgacaccaagatcgccctgcacctgaaggacaacggggccagcacagatgattctgctgctgagaagaagggcggcaccctgcacgccggcctcatcatcggcatcctgatcctggtgctgattgtggccacagccatcctggtgacagtgtacatgtaccaccaccccaccagcgctgccagcatcttcttcatcgagcggcggcccagccgctggccagccatgaagttcagaagaggcagcggccacccagcctatgcagaggtggagcctgtgggggagaaggagggcttcatcgtgtctgagcagtgctag

SEQ ID NO: 164475 - DNA, 1581 bp, Artificial Sequence
  Description of Artificial Sequence: Synthetic coding sequence
atgagatgtgccctggccctgagcgccctgctgctgctgctgagcaccccacccctgctgcccagcagccccagccccagccccagccccagccagaatgccacccagaccaccacagacagcagcaacaagacagcccccaccccagccagctctgtgaccatcatggccacagacacagcccagcagagcacagtgcccaccagcaaggccaatgagatcctggcctctgtgaaggccaccaccctgggcgtgtccagtgacagccctggcaccaccaccctggcccagcaggtgtctggccctgtgaacaccaccgtggcccggggcggcggcagcggcaaccccaccaccaccatcgagagccccaagagcaccaagtctgctgacaccaccaccgtggccaccagcacagccacagccaagcccaacaccaccagcagccagaatggagctgaggacaccaccaacagcggcggcaagagcagccacagcgtgaccacagacctgaccagcaccaaggccgagcacctgaccaccccccaccccaccagccccctgagcccccggcagcccaccagcacccaccctgtggccacccccaccagcagcggccatgaccacctgatgaagatcagcagcagcagcagcacagtggccatccctggctacaccttcaccagccctggcatgaccaccaccctgcccagcagcgtcatcagccagaggacccagcagaccagcagccagatgcctgccagcagcacagcccccagcagccaggagaccgtgcagcccaccagccctgccacagccctgcggacccccaccctgcctgagaccatgagcagcagccccacagctgccagcaccacccaccgctaccccaagacccccagccccaccgtggcccacgagagcaactgggccaagtgtgaggacctggagacccagacccagagcgagaagcagctggtgctgaacctgaccggcaacaccctgtgtgccggcggggccagtgatgagaagctgatcagcctcatctgcagagctgtgaaggccaccttcaacccagcccaggacaagtgtggcatccggctggcctctgtgcccggcagccagacagtggtggtgaaggagatcaccatccacaccaagctgcctgccaaggatgtgtatgagcggctgaaggacaagtgggatgagctgaaggaggccggcgtgtctgacatgaagctgggggaccagggccccccagaggaggctgaagatcgcttctccatgcccctcatcatcaccatcgtgtgcatggccagcttcctgctgctggtggccgccctgtatggctgctgccaccagaggctgagccagaggaaggaccagcagaggctgacagaggagctgcagacagtggagaatggctaccatgacaaccccaccctggaggtgatggagaccagcagcgagatgcaggagaagaaggtggtgtccctgaatggagagctgggggacagctggatcgtgcccctggacaacctgaccaaggatgacctggatgaggaggaggacacccacctgtag

SEQ ID NO: 164476 - DNA, 1677 bp, Artificial Sequence
  Description of Artificial Sequence: Synthetic coding sequence
atgagatgtgccctggccctgagcgccctgctgctgctgctgagcaccccacccctgctgcccagcagccccagccccagccccagccccagccagaatgccacccagaccaccacagacagcagcaacaagacagcccccaccccagccagctctgtgaccatcatggccacagacacagcccagcagagcacagtgcccaccagcaaggccaatgagatcctggcctctgtgaaggccaccaccctgggcgtgtccagtgacagccctggcaccaccaccctggcccagcaggtgtctggccctgtgaacaccaccgtggcccggggcggcggcagcggcaaccccaccaccaccatcgagagccccaagagcaccaagtctgctgacaccaccaccgtggccaccagcacagccacagccaagcccaacaccaccagcagccagaatggagctgaggacaccaccaacagcggcggcaagagcagccacagcgtgaccacagacctgaccagcaccaaggccgagcacctgaccaccccccaccccaccagccccctgagcccccggcagcccaccagcacccaccctgtggccacccccaccagcagcggccatgaccacctgatgaagatcagcagcagcagcagcacagtggccatccctggctacaccttcaccagccctggcatgaccaccaccctgctggagaccgtcttccaccacgtgtcccaggccggcctggagctgctgaccagcggggacctgcccaccctggccagccagagcgctggcatcacagccagcagcgtcatcagccagaggacccagcagaccagcagccagatgcctgccagcagcacagcccccagcagccaggagaccgtgcagcccaccagccctgccacagccctgcggacccccaccctgcctgagaccatgagcagcagccccacagctgccagcaccacccaccgctaccccaagacccccagccccaccgtggcccacgagagcaactgggccaagtgtgaggacctggagacccagacccagagcgagaagcagctggtgctgaacctgaccggcaacaccctgtgtgccggcggggccagtgatgagaagctgatcagcctcatctgcagagctgtgaaggccaccttcaacccagcccaggacaagtgtggcatccggctggcctctgtgcccggcagccagacagtggtggtgaaggagatcaccatccacaccaagctgcctgccaaggatgtgtatgagcggctgaaggacaagtgggatgagctgaaggaggccggcgtgtctgacatgaagctgggggaccagggccccccagaggaggctgaagatcgcttctccatgcccctcatcatcaccatcgtgtgcatggccagcttcctgctgctggtggccgccctgtatggctgctgccaccagaggctgagccagaggaaggaccagcagaggctgacagaggagctgcagacagtggagaatggctaccatgacaaccccaccctggaggtgatggagaccagcagcgagatgcaggagaagaaggtggtgtccctgaatggagagctgggggacagctggatcgtgcccctggacaacctgaccaaggatgacctggatgaggaggaggacacccacctgtag

SEQ ID NO: 164477 - DNA, 1581 bp, Artificial Sequence
  Description of Artificial Sequence: Synthetic coding sequence
atgagatgtgccctggccctgagcgccctgctgctgctgctgagcaccccacccctgctgcccagcagccccagccccagccccagccccagccagaatgccacccagaccaccacagacagcagcaacaagacagcccccaccccagccagctctgtgaccatcatggccacagacacagcccagcagagcacagtgcccaccagcaaggccaatgagatcctggcctctgtgaaggccaccaccctgggcgtgtccagtgacagccctggcaccaccaccctggcccagcaggtgtctggccctgtgaacaccaccgtggcccggggcggcggcagcggcaaccccaccaccaccatcgagagccccaagagcaccaagtctgctgacaccaccaccgtggccaccagcacagccacagccaagcccaacaccaccagcagccagaatggagctgaggacaccaccaacagcggcggcaagagcagccacagcgtgaccacagacctgaccagcaccaaggccgagcacctgaccaccccccaccccaccagccccctgagcccccggcagcccaccagcacccaccctgtggccacccccaccagcagcggccatgaccacctgatgaagatcagcagcagcagcagcacagtggccatccctggctacaccttcaccagccctggcatgaccaccaccctgcccagcagcgtcatcagccagaggacccagcagaccagcagccagatgcctgccagcagcacagcccccagcagccaggagaccgtgcagcccaccagccctgccacagccctgcggacccccaccctgcctgagaccatgagcagcagccccacagctgccagcaccacccaccgctaccccaagacccccagccccaccgtggcccacgagagcaactgggtgaccccagctggggtgggcacccagaccagggtggaggaggccctgcggcaggccctgacccacagcctgctgcctgctgggggcgccagtgatgagaagctgatcagcctcatctgcagagctgtgaaggccaccttcaacccagcccaggacaagtgtggcatccggctggcctctgtgcccggcagccagacagtggtggtgaaggagatcaccatccacaccaagctgcctgccaaggatgtgtatgagcggctgaaggacaagtgggatgagctgaaggaggccggcgtgtctgacatgaagctgggggaccagggccccccagaggaggctgaagatcgcttctccatgcccctcatcatcaccatcgtgtgcatggccagcttcctgctgctggtggccgccctgtatggctgctgccaccagaggctgagccagaggaaggaccagcagaggctgacagaggagctgcagacagtggagaatggctaccatgacaaccccaccctggaggtgatggagaccagcagcgagatgcaggagaagaaggtggtgtccctgaatggagagctgggggacagctggatcgtgcccctggacaacctgaccaaggatgacctggatgaggaggaggacacccacctgtag

SEQ ID NO: 164478 - DNA, 1683 bp, Artificial Sequence
  Description of Artificial Sequence: Synthetic coding sequence
atgagatgtgccctggccctgagcgccctgctgctgctgctgagcaccccacccctgctgcccagcagccccagccccagccccagccccagccagaatgaaacagccacccagaccaccacagacagcagcaacaagacagcccccaccccagccagctctgtgaccatcatggccacagacacagcccagcagagcacagtgcccaccagcaaggccaatgagatcctggcctctgtgaaggccaccaccctgggcgtgtccagtgacagccctggcaccaccaccctggcccagcaggtgtctggccctgtgaacaccaccgtggcccggggcggcggcagcggcaaccccaccaccaccatcgagagccccaagagcaccaagtctgctgacaccaccaccgtggccaccagcacagccacagccaagcccaacaccaccagcagccagaatggagctgaggacaccaccaacagcggcggcaagagcagccacagcgtgaccacagacctgaccagcaccaaggccgagcacctgaccaccccccaccccaccagccccctgagcccccggcagcccaccagcacccaccctgtggccacccccaccagcagcggccatgaccacctgatgaagatcagcagcagcagcagcacagtggccatccctggctacaccttcaccagccctggcatgaccaccaccctgctggagaccgtcttccaccacgtgtcccaggccggcctggagctgctgaccagcggggacctgcccaccctggccagccagagcgctggcatcacagccagcagcgtcatcagccagaggacccagcagaccagcagccagatgcctgccagcagcacagcccccagcagccaggagaccgtgcagcccaccagccctgccacagccctgcggacccccaccctgcctgagaccatgagcagcagccccacagctgccagcaccacccaccgctaccccaagacccccagccccaccgtggcccacgagagcaactgggccaagtgtgaggacctggagacccagacccagagcgagaagcagctggtgctgaacctgaccggcaacaccctgtgtgccggcggggccagtgatgagaagctgatcagcctcatctgcagagctgtgaaggccaccttcaacccagcccaggacaagtgtggcatccggctggcctctgtgcccggcagccagacagtggtggtgaaggagatcaccatccacaccaagctgcctgccaaggatgtgtatgagcggctgaaggacaagtgggatgagctgaaggaggccggcgtgtctgacatgaagctgggggaccagggccccccagaggaggctgaagatcgcttctccatgcccctcatcatcaccatcgtgtgcatggccagcttcctgctgctggtggccgccctgtatggctgctgccaccagaggctgagccagaggaaggaccagcagaggctgacagaggagctgcagacagtggagaatggctaccatgacaaccccaccctggaggtgatggagaccagcagcgagatgcaggagaagaaggtggtgtccctgaatggagagctgggggacagctggatcgtgcccctggacaacctgaccaaggatgacctggatgaggaggaggacacccacctgtag

SEQ ID NO: 164479 - DNA, 1551 bp, Artificial Sequence
  Description of Artificial Sequence: Synthetic coding sequence
atgagatgtgccctggccctgagcgccctgctgctgctgctgagcaccagccccagccccagccagaatgccacccagaccaccacagacagcagcaacaagacagcccccaccccagccagctctgtgaccatcatggccacagacacagcccagcagagcacagtgcccaccagcaaggccaatgagatcctggcctctgtgaaggccaccaccctgggcgtgtccagtgacagccctggcaccaccaccctggcccagcaggtgtctggccctgtgaacaccaccgtggcccggggcggcggcagcggcaaccccaccaccaccatcgagagccccaagagcaccaagtctgctgacaccaccaccgtggccaccagcacagccacagccaagcccaacaccaccagcagccagaatggagctgaggacaccaccaacagcggcggcaagagcagccacagcgtgaccacagacctgaccagcaccaaggccgagcacctgaccaccccccaccccaccagccccctgagcccccggcagcccaccagcacccaccctgtggccacccccaccagcagcggccatgaccacctgatgaagatcagcagcagcagcagcacagtggccatccctggctacaccttcaccagccctggcatgaccaccaccctgcccagcagcgtcatcagccagaggacccagcagaccagcagccagatgcctgccagcagcacagcccccagcagccaggagaccgtgcagcccaccagccctgccacagccctgcggacccccaccctgcctgagaccatgagcagcagccccacagctgccagcaccacccaccgctaccccaagacccccagccccaccgtggcccacgagagcaactgggccaagtgtgaggacctggagacccagacccagagcgagaagcagctggtgctgaacctgaccggcaacaccctgtgtgccggcggggccagtgatgagaagctgatcagcctcatctgcagagctgtgaaggccaccttcaacccagcccaggacaagtgtggcatccggctggcctctgtgcccggcagccagacagtggtggtgaaggagatcaccatccacaccaagctgcctgccaaggatgtgtatgagcggctgaaggacaagtgggatgagctgaaggaggccggcgtgtctgacatgaagctgggggaccagggccccccagaggaggctgaagatcgcttctccatgcccctcatcatcaccatcgtgtgcatggccagcttcctgctgctggtggccgccctgtatggctgctgccaccagaggctgagccagaggaaggaccagcagaggctgacagaggagctgcagacagtggagaatggctaccatgacaaccccaccctggaggtgatggagaccagcagcgagatgcaggagaagaaggtggtgtccctgaatggagagctgggggacagctggatcgtgcccctggacaacctgaccaaggatgacctggatgaggaggaggacacccacctgtag

SEQ ID NO: 164480 - DNA, 1986 bp, Artificial Sequence
  Description of Artificial Sequence: Synthetic coding sequence
atggagggcgcccgggcccggggggcccagctgcggctgggggagcgggtgcggcctgtgggccgccgcagcgcccctggccgcagccgcttccggcagccctggaggcctggggccagtgacagcgcccccccagctggcaccatggcccagagccgggtgctgctgctgctgctgctgctgcccccccagctgcacctgggccctgtgctggccgtgcgggcccctggcttcggccgcagcggcggccacagcctgagccctgaggagaatgaatttgctgaggaggagcctgtgctggtgctgagccctgaggagcccggccctggccctgctgctgtgtcctgcccccgggactgtgcctgcagccaggagggcgtggtggactgtggcggcatcgacctgcgggagttccctggggacctgcctgagcacaccaaccacctgagcctgcagaacaaccagctggagaagatctacccagaggagctgagccggctgcaccggctggagaccctgaacctgcagaacaaccggctgaccagccggggcctgcctgagaaggcctttgagcacctgaccaacctgaactacctgtacctggccaacaacaagctgaccctggccccccgcttcctgcccaatgccctgatctctgtggactttgctgccaactacctgaccaagatctacggcctgaccttcggccagaagcccaacctgcggtctgtgtacctgcacaacaacaagctggctgatgctggcctgcctgacaacatgttcaacggcagcagcaatgtggaggtgctgatcctgagcagcaacttcctgcggcacgtgcccaagcacctgcccccagccctgtacaagctgcacctgaagaacaacaagctggagaagatccccccaggggccttcagcgagctgagcagcctgcgggagctgtacctgcagaacaactacctgacagatgagggcctggacaatgagaccttctggaagctgagcagcctggagtacctggacctgagcagcaacaacctgagccgggtgcctgctggcctgcccaggagcctggtgctgctgcacctggagaagaatgccatccgctctgtggatgccaacgtgctgacccccatccgcagcctggagtacctgctgctgcacagcaaccagctgcgggagcagggcatccaccccctggccttccagggcctgaagaggctgcacacagtgcacctgtacaacaatgccctggagcgggtgcccagcggcctgccccggcgggtgaggaccctgatgatcctgcacaaccagatcactggaattggccgggaggactttgccaccacctacttcctggaggagctgaacctgagctacaaccgcatcaccagcccccaggtgcacagagatgccttcaggaagctgcggctgctgcggagcctggacctgagcggcaaccggctgcacaccctgcccccaggcctgcccagaaatgtgcacgtgctgaaggtgaagagaaatgagctggccgccctggcccggggggccctggtgggcatggcccagctgcgggagctgtacctgaccagcaaccggctgcggagccgggccctgggcccccgggcctgggtggacctggcccacctgcagctgctggacattgctggcaaccagctgacagagatccctgagggcctgcctgagagcctggagtacctgtacctgcagaacaacaagatctctgctgtgcctgccaatgcctttgacagcacccccaacctgaagggcatcttcctgcgcttcaacaagctggccgtgggctctgtggtggacagcgccttccggcggctgaagcacctgcaggtgctggacatcgagggcaacctggagtttggagacatcagcaaggaccggggccgcctgggcaaggagaaggaggaggaggaggaggaggaggaggaggaggaggagaccaggtag

SEQ ID NO: 164481 - DNA, 1929 bp, Artificial Sequence
  Description of Artificial Sequence: Synthetic coding sequence
atggagggggaggaggccgagcagcctgcctggttccggcagccctggaggcctggggccagtgacagcgcccctcctgctggcaccatggcccagagccgggtgctgctgctgctgctgctgctgcccccccagctgcacctgggccctgtgctggccgtgcgggcccctggcttcggccgcagcggcggccacagcctgagcccagaagaaaatgaatttgctgaggaggagcctgtgctggtgctgagccctgaggagcccggccctggccctgctgctgtgtcctgcccccgggactgtgcctgcagccaggagggcgtggtggactgtggcggcatcgacctgcgggagttccctggggacctgcctgagcacaccaaccacctgagcctgcagaacaaccagctggagaagatctacccagaggagctgagccggctgcaccggctggagaccctgaacctgcagaacaaccggctgaccagccggggcctgcctgagaaggcctttgagcacctgaccaacctgaactacctgtacctggccaacaacaagctgaccctggccccccgcttcctgcccaatgccctgatctctgtggactttgctgccaactacctgaccaagatctacggcctgaccttcggccagaagcccaacctgcggtctgtgtacctgcacaacaacaagctggctgatgctggcctgcctgacaacatgtttaatggcagcagcaatgtggaggtgctgatcctgagcagcaacttcctgcggcacgtgcccaagcacctgcccccagccctgtacaagctgcacctgaagaacaacaagctggagaagatccccccaggggccttcagcgagctgagcagcctgcgggagctgtacctgcagaacaactacctgacagatgagggcctggacaatgagaccttctggaagctgagcagcctggagtacctggacctgagcagcaacaacctgagccgggtgcctgctggcctgcccaggagcctggtgctgctgcacctggagaagaatgccatccgctctgtggatgccaacgtgctgacccccatccgcagcctggagtacctgctgctgcacagcaaccagctgcgggagcagggcatccaccccctggccttccagggcctgaagaggctgcacacagtgcacctgtacaacaatgccctggagcgggtgcccagcggcctgcccaggagagtgaggaccctgatgatcctgcacaaccagatcaccggcatcggcagagaagattttgccaccacctacttcctggaggagctgaacctgagctacaaccgcatcaccagcccccaggtgcacagagatgccttcaggaagctgcggctgctgcggagcctggacctgagcggcaaccggctgcacaccctgcccccaggcctgcccagaaatgtgcacgtgctgaaggtgaagagaaatgagctggccgccctggcccggggggccctggtgggcatggcccagctgcgggagctgtacctgaccagcaaccggctgcggagccgggccctgggcccccgggcctgggtggacctggcccacctgcagctgctggacattgctggcaaccagctgacagagatccctgagggcctgcctgagagcctggagtacctgtacctgcagaacaacaagatctctgctgtgcctgccaatgcctttgacagcacccccaacctgaagggcatcttcctgcgcttcaacaagctggccgtgggctctgtggtggacagcgccttccggcggctgaagcacctgcaggtgctggacatcgagggcaacctggagtttggagacatcagcaaggaccggggccgcctgggcaaggagaaggaggaggaggaggaggaggaggaggaggaggaggagaccaggtag

SEQ ID NO: 164482 - DNA, 1560 bp, Artificial Sequence
  Description of Artificial Sequence: Synthetic coding sequence
atggagggcgcccgggcccggggggcccagctgcggctgggggagcgggtgcggcctgtgggccgccgcagcgcccctggccgcagccgcttccggcagccctggaggcctggggccagtgacagcgcccccccagctggcaccatggcccagagccgggtgctgctgctgctgctgctgctgcccccccagctgcacctgggccctgtgctggccgtgcgggcccctggcttcggccgcagcggcggccacagcctgagccctgaggagaatgaatttgctgaggaggagcctgtgctggtgctgagccctgaggagcccggccctggccctgctgctgtgtcctgcccccgggactgtgcctgcagccaggagggcgtggtggactgtggcggcatcgacctgcgggagttccctggggacctgcctgagcacaccaaccacctgagcctgcagaacaacaagctggagaagatccccccaggggccttcagcgagctgagcagcctgcgggagctgtacctgcagaacaactacctgacagatgagggcctggacaatgagaccttctggaagctgagcagcctggagtacctggacctgagcagcaacaacctgagccgggtgcctgctggcctgcccaggagcctggtgctgctgcacctggagaagaatgccatccgctctgtggatgccaacgtgctgacccccatccgcagcctggagtacctgctgctgcacagcaaccagctgcgggagcagggcatccaccccctggccttccagggcctgaagaggctgcacacagtgcacctgtacaacaatgccctggagcgggtgcccagcggcctgccccggcgggtgaggaccctgatgatcctgcacaaccagatcactggaattggccgggaggactttgccaccacctacttcctggaggagctgaacctgagctacaaccgcatcaccagcccccaggtgcacagagatgccttcaggaagctgcggctgctgcggagcctggacctgagcggcaaccggctgcacaccctgcccccaggcctgcccagaaatgtgcacgtgctgaaggtgaagagaaatgagctggccgccctggcccggggggccctggtgggcatggcccagctgcgggagctgtacctgaccagcaaccggctgcggagccgggccctgggcccccgggcctgggtggacctggcccacctgcagctgctggacattgctggcaaccagctgacagagatccctgagggcctgcctgagagcctggagtacctgtacctgcagaacaacaagatctctgctgtgcctgccaatgcctttgacagcacccccaacctgaagggcatcttcctgcgcttcaacaagctggccgtgggctctgtggtggacagcgccttccggcggctgaagcacctgcaggtgctggacatcgagggcaacctggagtttggagacatcagcaaggaccggggccgcctgggcaaggagaaggaggaggaggaggaggaggaggaggaggaggaggagaccaggtag

SEQ ID NO: 164483 - DNA, 1095 bp, Artificial Sequence
  Description of Artificial Sequence: Synthetic coding sequence
atggcccgggccatggctgctgcctggcccctgctgctggtggccctgctggtgctgtcctggcccccacctggcactggagatgtggtggtgcaggcccccacccaggtgcccggcttcctgggggacagcgtgaccctgccctgctacctgcaggtgcccaacatggaggtgacccacgtgtcccagctgacctgggcccggcatggagagagcggctccatggctgtgttccaccagacccagggccccagctacagcgagagcaagaggctggagtttgtggccgcccggctgggcgctgagctgagaaatgccagcctgaggatgtttggcctgcgggtggaggatgagggcaactacacctgcctgtttgtgaccttcccccagggcagccgctctgtggacatctggctgcgggtgctggccaagccccagaacacagctgaggtgcagaaggtgcagctgactggagagcctgtgcccatggcccgctgtgtgtccactggaggccggcccccagcccagatcacctggcacagcgacctgggcggcatgcccaacaccagccaggtgcccggcttcctgtctggaacagtgacagtgaccagcctgtggatcctggtgcccagcagccaggtggatggcaagaatgtgacctgcaaggtggagcacgagagctttgagaagccccagctgctgactgtgaacctgactgtgtactacccacctgaggtgtccatcagcggctatgacaacaactggtacctgggccagaatgaggccaccctgacctgtgatgcccggagcaaccctgagcccaccggctacaactggagcaccaccatgggccccctgcccccatttgctgtggcccagggcgcccagctgctgatccggcctgtggacaagcccatcaacaccaccctcatctgcaatgtgaccaatgccctgggcgcccggcaggccgagctgactgtgcaggtgaagggcacagagcacgccagcgccagcgccaacggccacgtgtcctacagcgctgtgtcccgggagaacagcagcagccaggacccccagacagagggcaccaggtag

SEQ ID NO: 164484 - DNA, 1119 bp, Artificial Sequence
  Description of Artificial Sequence: Synthetic coding sequence
atggcccgggccatggctgctgcctggcccctgctgctggtggccctgctggtgctgtcctggcccccacctggcactggagatgtggtggtgcaggcccccacccaggtgcccggcttcctgggggacagcgtgaccctgccctgctacctgcaggtgcccaacatggaggtgacccacgtgtcccagctgacctgggcccggcatggagagagcggctccatggctgtgttccaccagacccagggccccagctacagcgagagcaagaggctggagtttgtggccgcccggctgggcgctgagctgagaaatgccagcctgaggatgtttggcctgcgggtggaggatgagggcaactacacctgcctgtttgtgaccttcccccagggcagccgctctgtggacatctggctgcgggtgctggccaagccccagaacacagctgaggtgcagaaggtgcagctgactggagagcctgtgcccatggcccgctgtgtgtccactggaggccggcccccagcccagatcacctggcacagcgacctgggcggcatgcccaacaccagccaggtgcccggcttcctgtctggaacagtgacagtgaccagcctgtggatcctggtgcccagcagccaggtggatggcaagaatgtgacctgcaaggtggagcacgagagctttgagaagccccagctgctgactgtgaacctgactgtgtactacccacctgaggtgtccatcagcggctatgacaacaactggtacctgggccagaatgaggccaccctgacctgtgatgcccggagcaaccctgagcccaccggctacaactggagcaccaccatgggccccctgcccccatttgctgtggcccagggcgcccagctgctgatccggcctgtggacaagcccatcaacaccaccctcatctgcaatgtgaccaatgccctgggcgcccggcaggccgagctgactgtgcaggtgaaggagggccccccatctgagcacagcggcacagagcacgccagcgccagcgccaacggccacgtgtcctacagcgctgtgtcccgggagaacagcagcagccaggacccccagacagagggcaccaggtag

SEQ ID NO: 164485 - DNA, 1179 bp, Artificial Sequence
  Description of Artificial Sequence: Synthetic coding sequence
atggcccgggccatggctgctgcctggcccctgctgctggtggccctgctggtgctgtcctggcccccacctggcactggagatgtggtggtgcaggcccccacccaggtgcccggcttcctgggggacagcgtgaccctgccctgctacctgcaggtgcccaacatggaggtgacccacgtgtcccagctgacctgggcccggcatggagagagcggctccatggctgtgttccaccagacccagggccccagctacagcgagagcaagaggctggagtttgtggccgcccggctgggcgctgagctgagaaatgccagcctgaggatgtttggcctgcgggtggaggatgagggcaactacacctgcctgtttgtgaccttcccccagggcagccgctctgtggacatctggctgcgggtgctggccaagccccagaacacagctgaggtgcagaaggtgcagctgactggagagcctgtgcccatggcccgctgtgtgtccactggaggccggcccccagcccagatcacctggcacagcgacctgggcggcatgcccaacaccagccaggtgcccggcttcctgtctggaacagtgacagtgaccagcctgtggatcctggtgcccagcagccaggtggatggcaagaatgtgacctgcaaggtggagcacgagagctttgagaagccccagctgctgactgtgaacctgactgtgtactacccacctgaggtgtccatcagcggctatgacaacaactggtacctgggccagaatgaggccaccctgacctgtgatgcccggagcaaccctgagcccaccggctacaactggagcaccaccatgggccccctgcccccatttgctgtggcccagggcgcccagctgctgatccggcctgtggacaagcccatcaacaccaccctcatctgcaatgtgaccaatgccctgggcgcccggcaggccgagctgactgtgcaggtgaaggagggccccccatctgagcacagcggcatcagcagaaatgccatcatcttcctggtgctgggcatcctggtgttcctgatcctgctgggcatcggcatctacttctactggagcaagtgcagccgggaggtgctgtggcactgccacctgtgccccagcagcgagcaccaccagagctgcagaaattag

SEQ ID NO: 164486 - DNA, 1254 bp, Artificial Sequence
  Description of Artificial Sequence: Synthetic coding sequence
atggcccgggccatggctgctgcctggcccctgctgctggtggccctgctggtgctgtcctggcccccacctggcactggagatgtggtggtgcaggcccccacccaggtgcccggcttcctgggggacagcgtgaccctgccctgctacctgcaggtgcccaacatggaggtgacccacgtgtcccagctgacctgggcccggcatggagagagcggctccatggctgtgttccaccagacccagggccccagctacagcgagagcaagaggctggagtttgtggccgcccggctgggcgctgagctgagaaatgccagcctgaggatgtttggcctgcgggtggaggatgagggcaactacacctgcctgtttgtgaccttcccccagggcagccgctctgtggacatctggctgcgggtgctggccaagccccagaacacagctgaggtgcagaaggtgcagctgactggagagcctgtgcccatggcccgctgtgtgtccactggaggccggcccccagcccagatcacctggcacagcgacctgggcggcatgcccaacaccagccaggtgcccggcttcctgtctggaacagtgacagtgaccagcctgtggatcctggtgcccagcagccaggtggatggcaagaatgtgacctgcaaggtggagcacgagagctttgagaagccccagctgctgactgtgaacctgactgtgtactacccacctgaggtgtccatcagcggctatgacaacaactggtacctgggccagaatgaggccaccctgacctgtgatgcccggagcaaccctgagcccaccggctacaactggagcaccaccatgggccccctgcccccatttgctgtggcccagggcgcccagctgctgatccggcctgtggacaagcccatcaacaccaccctcatctgcaatgtgaccaatgccctgggcgcccggcaggccgagctgactgtgcaggtgaaggagggccccccatctgagcacagcggcatcagcagaaatgccatcatcttcctggtgctgggcatcctggtgttcctgatcctgctgggcatcggcatctacttctactggagcaagtgcagccgggaggtgctgtggcactgccacctgtgccccagcagcacagaacatgccagcgccagcgccaatggacatgtgtcctacagcgctgtgtcccgggagaacagcagcagccaggacccccagacagagggcaccaggtag

SEQ ID NO: 164487 - DNA, 1554 bp, Artificial Sequence
  Description of Artificial Sequence: Synthetic coding sequence
atggccaggatgggcctggccggggccgccggccgctggtggggcctggccctgggcctgacagccttcttcctgcccggggtgcacagccaggtggtgcaggtgaatgacagcatgtatggcttcatcggcacagatgtggtgctgcactgcagctttgccaaccccctgcccagcgtgaagatcacccaggtgacctggcagaagagcaccaacggcagcaagcagaatgtggccatctacaaccccagcatgggcgtgtctgtgctggccccctaccgggagcgggtggagttcctgcggcccagcttcacagatggcaccatccggctgagccggctggagctggaggatgagggcgtgtacatctgtgaatttgccaccttccccactggaaaccgggagagccagctgaacctgactgtgatggccaagcccaccaactggattgagggcacccaggccgtgctgcgggccaagaagggccaggatgacaaggtgctggtggccacctgcaccagcgccaacgggaagcccccatctgtggtgtcctgggagacccggctgaagggggaggccgagtaccaggagatccggaaccccaacggcaccgtgaccgtcatcagccgctaccgcctggtgcccagccgggaggcccaccagcagagcctggcctgcatcgtgaactaccacatggaccgcttcaaggagagcctgaccctgaatgtgcagtatgagcctgaggtgaccatcgagggctttgatggcaactggtacctgcagaggatggatgtgaagctgacctgcaaggcagatgccaaccccccagccacagagtaccactggaccaccctgaatggcagcctgcccaagggcgtggaggcccagaacagaaccctcttcttcaagggccccatcaactacagcctggccggcacctacatctgtgaggccaccaaccccatcggcaccaggagcggccaggtggaggtgaacatcacagagttcccctacacccccagccccccagagcacggcagaagagctggccctgtgcccacagccatcattggaggagtggccggcagcatcctgctggtgctgattgtggtgggcggcatcgtggtggccctgcggaggagaagacacaccttcaagggggactacagcaccaagaagcacgtgtatggaaatggctacagcaaggccggcatcccccagcaccacccccccatggcccagaacctgcagtacccagatgacagtgatgatgagaagaaggccggccccctgggcggcagcagctatgaggaggaggaggaggaggaggagggcggcggcggcggggagaggaaggtgggcggcccccaccccaagtatgatgaagatgccaagaggccctacttcaccgtggatgaggccgaggcccggcaggacggctatggagacaggaccctgggctaccagtatgaccctgagcagctggacctggccgagaacatggtgtcccagaatgatggcagcttcatcagcaagaaggagtggtacgtgtag

SEQ ID NO: 164488 - DNA, 1059 bp, Artificial Sequence
  Description of Artificial Sequence: Synthetic coding sequence
atggccaggatgggcctggccggggccgccggccgctggtggggcctggccctgggcctgacagccttcttcctgcccggggtgcacagccaggtggtgcaggtgaatgacagcatgtatggcttcatcggcacagatgtggtgctgcactgcagctttgccaaccccctgcccagcgtgaagatcacccaggtgacctggcagaagagcaccaacggcagcaagcagaatgtggccatctacaaccccagcatgggcgtgtctgtgctggccccctaccgggagcgggtggagttcctgcggcccagcttcacagatggcaccatccggctgagccggctggagctggaggatgagggcgtgtacatctgtgaatttgccaccttccccactggaaaccgggagagccagctgaacctgactgtgatggccaagcccaccaactggattgagggcacccaggccgtgctgcgggccaagaagggccaggatgacaaggtgctggtggccacctgcaccagcgccaacgggaagcccccatctgtggtgtcctgggagacccggctgaagggggaggccgagtaccaggagatccggaaccccaacggcaccgtgaccgtcatcagccgctaccgcctggtgcccagccgggaggcccaccagcagagcctggcctgcatcgtgaactaccacatggaccgcttcaaggagagcctgaccctgaatgtgcagtatgagcctgaggtgaccatcgagggctttgatggcaactggtacctgcagaggatggatgtgaagctgacctgcaaggcagatgccaaccccccagccacagagtaccactggaccaccctgaatggcagcctgcccaagggcgtggaggcccagaacagaaccctcttcttcaagggccccatcaactacagcctggccggcacctacatctgtgaggccaccaaccccatcggcaccaggagcggccaggtggaggtgaacatcacagccttctgccagctgatctacccaggcaagggccgcacccgggccaggatgttttag

SEQ ID NO: 164489 - DNA, 1377 bp, Artificial Sequence
  Description of Artificial Sequence: Synthetic coding sequence
atggccaggatgggcctggccggggccgccggccgctggtggggcctggccctgggcctgacagccttcttcctgcccggggtgcacagccaggtggtgcaggtgaatgacagcatgtatggcttcatcggcacagatgtggtgctgcactgcagctttgccaaccccctgcccagcgtgaagatcacccaggtgacctggcagaagagcaccaacggcagcaagcagaatgtggccatctacaaccccagcatgggcgtgtctgtgctggccccctaccgggagcgggtggagttcctgcggcccagcttcacagatggcaccatccggctgagccggctggagctggaggatgagggcgtgtacatctgtgaatttgccaccttccccactggaaaccgggagagccagctgaacctgactgtgatggccaagcccaccaactggattgagggcacccaggccgtgctgcgggccaagaagggccaggatgacaaggtgctggtggccacctgcaccagcgccaacgggaagcccccatctgtggtgtcctgggagacccggctgaagggggaggccgagtaccaggagatccggaaccccaacggcaccgtgaccgtcatcagccgctaccgcctggtgcccagccgggaggcccaccagcagagcctggcctgcatcgtgaactaccacatggaccgcttcaaggagagcctgaccctgaatgtgcagtatgagcctgaggtgaccatcgagggctttgatggcaactggtacctgcagaggatggatgtgaagctgacctgcaaggcagatgccaaccccccagccacagagtaccactggaccaccctgaatggcagcctgcccaagggcgtggaggcccagaacagaaccctcttcttcaagggccccatcaactacagcctggccggcacctacatctgtgaggccaccaaccccatcggcaccaggagcggccaggtggaggtgaacatcacagagaagccccggccccagaggggcctgggcagcgctgcccggctgctggccggcaccgtggccgtgttcctgatcctggtggccgtgctgactgtgttcttcctgtacaaccggcagcagaagagccccccagagacagatggagctggaacagaccagcccctgagccagaagccagagcccagccccagccggcagagcagcctggtgcctgaggacatccaggtggtgcacctggaccccggccggcagcagcagcaggaggaggaggacctgcagaagctgagcctgcagcccccctactatgacctgggcgtgagccccagctaccaccccagcgtgaggaccacagagcccagaggagagtgcccctag

SEQ ID NO: 164490 - DNA, 1617 bp, Artificial Sequence
  Description of Artificial Sequence: Synthetic coding sequence
atggcccgggctgctgccctgctgcccagccgcagcccccccacccccctgctgtggcccctgctgctgctgctgctgctggagactggagcccaggatgtgcgggtgcaggtgctgcctgaggtgcggggccagctgggcggcaccgtggagctgccctgccacctgctgccccctgtgcccggcctgtacatcagcctggtgacctggcagaggccagatgccccagccaaccaccagaatgtggccgccttccaccccaagatgggccccagcttccccagccccaagccaggcagcgagcggctgagctttgtgtctgccaagcagagcacaggccaggacacagaggccgagctgcaggatgccaccctggccctgcacggcctgactgtggaggatgagggcaactacacctgtgaatttgccaccttccccaagggctctgtgcggggcatgacctggctgcgggtgattgccaagcccaagaaccaggccgaggcccagaaggtgaccttcagccaggaccccaccaccgtggccctgtgcatcagcaaggagggccggcccccagcccgcatctcctggctgagcagcctggactgggaggccaaggagacccaggtgtctggcaccctggccggcaccgtgacagtgaccagccgcttcaccctggtgcccagcggccgggcagatggagtgacagtgacctgcaaggtggagcacgagagctttgaggagcccgccctgatccctgtgaccctgtctgtgcgctacccacctgaggtgtccatcagcggctatgatgacaactggtacctgggccgcacagatgccaccctgagctgtgatgtgcgcagcaaccctgagcccaccggctatgactggagcaccaccagcggcaccttccccaccagcgctgtggcccagggcagccagctggtgattcatgctgtggacagcctcttcaacaccacctttgtgtgcaccgtgaccaatgctgtgggcatgggccgggcagagcaggtgatctttgtgcgggagacccccaacacagctggagctggggccaccggcggcatcatcggcggcatcatcgccgccatcatcgccacagctgtggccgccaccggcatcctgatctgccggcagcagaggaaggagcagaccctgcagggcgctgaggaggatgaggacctggagggccccccatcctacaagccacccacccccaaggccaagctggaggcccaggagatgcccagccagctgttcaccctgggcgccagcgagcacagccccctgaagaccccctactttgatgctggggccagctgcacagagcaggagatgccccgctaccacgagctgcccaccctggaggagaggagcggccccctgcaccctggggccaccagcctgggcagccccatccctgtgcccccaggccccccagctgtggaggatgtgtccctggacctggaggatgaggagggggaggaggaggaggagtacctggacaagatcaaccccatctatgatgccctgagctacagcagccccagcgacagctaccagggcaagggctttgtgatgagccgggccatgtatgtgtag

SEQ ID NO: 164491 - DNA, 1440 bp, Artificial Sequence
  Description of Artificial Sequence: Synthetic coding sequence
atggcccgggctgctgccctgctgcccagccgcagcccccccacccccctgctgtggcccctgctgctgctgctgctgctggagactggagcccaggatgtgcgggtgcaggtgctgcctgaggtgcggggccagctgggcggcaccgtggagctgccctgccacctgctgccccctgtgcccggcctgtacatcagcctggtgacctggcagaggccagatgccccagccaaccaccagaatgtggccgccttccaccccaagatgggccccagcttccccagccccaagccaggcagcgagcggctgagctttgtgtctgccaagcagagcacaggccaggacacagaggccgagctgcaggatgccaccctggccctgcacggcctgactgtggaggatgagggcaactacacctgtgaatttgccaccttccccaagggctctgtgcggggcatgacctggctgcgggtgattgccaagcccaagaaccaggccgaggcccagaaggtgaccttcagccaggaccccaccaccgtggccctgtgcatcagcaaggagggccggcccccagcccgcatctcctggctgagcagcctggactgggaggccaaggagacccaggtgtctggcaccctggccggcaccgtgacagtgaccagccgcttcaccctggtgcccagcggccgggcagatggagtgacagtgacctgcaaggtggagcacgagagctttgaggagcccgccctgatccctgtgaccctgtctgtgcgctacccacctgaggtgtccatcagcggctatgatgacaactggtacctgggccgcacagatgccaccctgagctgtgatgtgcgcagcaaccctgagcccaccggctatgactggagcaccaccagcggcaccttccccaccagcgctgtggcccagggcagccagctggtgattcatgctgtggacagcctcttcaacaccacctttgtgtgcaccgtgaccaatgctgtgggcatgggccgggcagagcaggtgatctttgtgcgggagaccccccgggccagccccagagatgtgggccccctggtgtggggcgctgtgggcggcaccctgctggtgctgctgctgctggccggcggcagcctggccttcatcctgctgcgggtgagaagaagaaggaagagccctgggggcgccggcggcggggccagcggagatggcggcttctatgaccccaaggcccaggtgctgggcaatggagaccccgtcttctggacccctgtggtgcccggccccatggagccagatggcaaggatgaggaggaggaggaggaggaggagaaggccgagaagggcctgatgctgcccccacctccagccctggaggatgacatggagagccagctggatggcagcctcatcagccggcgggctgtgtatgtgtag

SEQ ID NO: 164492 - DNA, 1101 bp, Artificial Sequence
  Description of Artificial Sequence: Synthetic coding sequence
atggcccggaccctgcggcccagccccctgtgccctgggggcggcaaggcccagctgagcagcgccagcctgctgggcgccggcctgctgctgcagccccccaccccaccacccctgctgctgctgctcttccccctgctgctcttcagccggctgtgtggggccctggccggccccatcatcgtggagccccacgtgacagctgtgtggggcaagaatgtgtccctgaagtgcctgattgaggtgaatgagaccatcacccagatctcctgggagaagatccacggcaagagcagccagacagtggccgtgcaccacccccagtatggcttctctgtgcagggcgagtaccagggccgggtgctcttcaagaactacagcctgaatgatgccaccatcaccctgcacaacatcggcttcagtgacagcggcaagtacatctgcaaggctgtgaccttccccctgggcaatgcccagagcagcaccaccgtgacagtgctggtggagcccaccgtgtccctcatcaagggccctgacagcctgattgatggcggcaatgagaccgtggccgccatctgcatcgccgccaccgggaagcctgtggcccacatcgactgggagggggacctgggggagatggagagcaccaccaccagcttccccaatgaaacagccaccatcatcagccagtacaagctgttccccaccaggtttgcccggggccgccgcatcacctgtgtggtgaagcacccagccctggagaaggacatccgctacagcttcatcctggacatccagtatgcccctgaggtgtctgtgacaggctatgatggcaactggtttgtgggcaggaaaggagtgaacctgaagtgcaatgctgatgccaaccccccacccttcaagtctgtgtggagccggctggatggccagtggccagatggcctgctggccagtgacaacaccctgcactttgtgcaccccctgaccttcaactacagcggcgtgtacatctgcaaggtgaccaacagcctgggccagaggagtgaccagaaggtgatctacatcagcgcctacaacagcgtggccagcctgaactgctag

SEQ ID NO: 164493 - DNA, 1650 bp, Artificial Sequence
  Description of Artificial Sequence: Synthetic coding sequence
atggcccggaccctgcggcccagccccctgtgccctgggggcggcaaggcccagctgagcagcgccagcctgctgggcgccggcctgctgctgcagccccccaccccaccacccctgctgctgctgctcttccccctgctgctcttcagccggctgtgtggggccctggccggccccatcatcgtggagccccacgtgacagctgtgtggggcaagaatgtgtccctgaagtgcctgattgaggtgaatgagaccatcacccagatctcctgggagaagatccacggcaagagcagccagacagtggccgtgcaccacccccagtatggcttctctgtgcagggcgagtaccagggccgggtgctcttcaagaactacagcctgaatgatgccaccatcaccctgcacaacatcggcttcagtgacagcggcaagtacatctgcaaggctgtgaccttccccctgggcaatgcccagagcagcaccaccgtgacagtgctggtggagcccaccgtgtccctcatcaagggccctgacagcctgattgatggcggcaatgagaccgtggccgccatctgcatcgccgccaccgggaagcctgtggcccacatcgactgggagggggacctgggggagatggagagcaccaccaccagcttccccaatgaaacagccaccatcatcagccagtacaagctgttccccaccaggtttgcccggggccgccgcatcacctgtgtggtgaagcacccagccctggagaaggacatccgctacagcttcatcctggacatccagtatgcccctgaggtgtctgtgacaggctatgatggcaactggtttgtgggcaggaaaggagtgaacctgaagtgcaatgctgatgccaaccccccacccttcaagtctgtgtggagccggctggatggccagtggccagatggcctgctggccagtgacaacaccctgcactttgtgcaccccctgaccttcaactacagcggcgtgtacatctgcaaggtgaccaacagcctgggccagaggagtgaccagaaggtgatctacatcagtgacccccccaccaccaccaccctgcagcccaccatccagtggcaccccagcacagctgacatcgaggacctggccacagagcccaagaagctgcccttccccctgagcaccctggccaccatcaaggatgacaccatcgccaccatcatcgcctctgtggtgggcggggccctcttcatcgtgctggtgtctgtgctggccggcatcttctgctacagaagaagaaggaccttccggggggactactttgccaagaactacatccccccaagtgacatgcagaaggagagccagattgatgtgctgcagcaggatgagctggacagctacccagattctgtgaagaaggagaacaagaaccctgtgaacaacctgatcaggaaggactacctggaggagcctgagaagacccagtggaacaacgtggagaacctgaacagatttgagcggcccatggactactatgaggacctgaagatgggcatgaagtttgtgtctgatgagcactatgatgaaaatgaagatgacctggtgagccacgtggatggcagcgtcatcagccggcgggagtggtacgtgtag

SEQ ID NO: 164494 - DNA, 1464 bp, Artificial Sequence
  Description of Artificial Sequence: Synthetic coding sequence
atggccgagggctggcgctggtgctttgtgcggaggaccccaggcctgctgcggggccccctgctgcccaggagcttcagcggcaacccccgggccctggccggccccatcatcgtggagccccacgtgacagctgtgtggggcaagaatgtgtccctgaagtgcctgattgaggtgaatgagaccatcacccagatctcctgggagaagatccacggcaagagcagccagacagtggccgtgcaccacccccagtatggcttctctgtgcagggcgagtaccagggccgggtgctcttcaagaactacagcctgaatgatgccaccatcaccctgcacaacatcggcttcagtgacagcggcaagtacatctgcaaggctgtgaccttccccctgggcaatgcccagagcagcaccaccgtgacagtgctggtggagcccaccgtgtccctcatcaagggccctgacagcctgattgatggcggcaatgaaacagtggccgccatctgcatcgccgccaccgggaagcctgtggcccacatcgactgggagggggacctgggggagatggagagcaccaccaccagcttccccaatgaaacagccaccatcatcagccagtacaagctgttccccaccaggtttgcccggggccgccgcatcacctgtgtggtgaagcacccagccctggagaaggacatccgctacagcttcatcctggacatccagtatgcccctgaggtgtctgtgacaggctatgatggcaactggtttgtgggcaggaagggcgtgaacctgaagtgcaatgctgatgccaaccccccacccttcaagtctgtgtggagccggctggatggccagtggccagatggcctgctggccagtgacaacaccctgcactttgtgcaccccctgaccttcaactacagcggcgtgtacatctgcaaggtgaccaacagcctgggccagaggagtgaccagaaggtgatctacatcagtgatgtgcccttcaagcagaccagcagcattgctgtggccggggccgtcatcggggctgtgctggccctcttcatcatcgccatctttgtgacagtgctgctgacccccaggaagaagaggcccagctacctggacaaggtgattgacctgccccccacccacaagcccccacccctgtatgaggagaggagcccccccctgccccagaaggacctcttccagcctgagcacctgcccctgcagacccagttcaaggagcgggaggtgggcaacctgcagcacagcaatggcctgaacagccgcagctttgattatgaagatgaaaatcctgtgggggaggatggcatccagcagatgtaccccctgtacaaccagatgtgctaccaggacaggagccctgggaagcaccaccagaacaatgaccccaagagggtgtacatcgacccccgggagcactacgtgtag

SEQ ID NO: 164495 - DNA, 1533 bp, Artificial Sequence
  Description of Artificial Sequence: Synthetic coding sequence
atgcccctgagcctgggcgctgagatgtggggccctgaggcctggctgctgctgctgctgctgctggccagcttcaccggccgctgcccagctggggagctggagaccagtgatgtggtgacagtggtgctgggccaggatgccaagctgccctgcttctacagaggagacagcggggagcaggtgggccaggtggcctgggcccgggtggatgctggggagggcgcccaggagctggccctgctgcacagcaaatatggcctgcacgtgtccccagcctatgagggccgggtggagcagcccccacctccaagaaaccccctggatggctctgtgctgctgagaaatgctgtgcaggctgatgaaggagaatatgagtgccgggtgtccaccttccctgctggcagcttccaggcccggctgcggctgcgggtgctggtgccccccctgcccagcctgaaccctggccctgccctggaggagggccagggcctgaccctggccgccagctgcacagctgagggcagccctgcccccagcgtgacctgggacacagaggtgaagggcaccaccagcagccgctccttcaagcacagccgctctgctgctgtgaccagcgagttccacctggtgcccagccgctccatgaatggccagcccctgacctgtgtggtgagccaccctggcctgctgcaggaccagaggatcacccacatcctgcacgtgtccttcctggccgaggcctctgtgcggggcctggaggaccagaacctgtggcacatcggccgggagggcgccatgctgaagtgcctgtctgagggccagcccccacccagctacaactggacccggctggatggccccctgcccagcggcgtgcgggtggatggagacaccctgggcttcccccccctgaccacagagcacagcggcatctacgtgtgccacgtgtccaatgagttcagcagccgggacagccaggtgacagtggatgtgctggacccccaggaggacagcggcaagcaggtggacctggtgtctgcctctgtggtggtggtgggcgtgattgctgccctgctcttctgcctgctggtggtggtggtggtgctgatgagccgctaccacaggaggaaggcccagcagatgacccagaagtatgaggaggagctgaccctgaccagagaaaattccatccggcggctgcacagccaccacacagaccccaggagccagcctgaggagagcgtgggcctgcgggcagagggccacccagacagcctgaaggacaacagcagctgcagcgtgatgtctgaggagcctgagggccgcagctacagcaccctgaccaccgtgcgggagattgagacccagacagagctgctgagccctggcagcggccgggcagaggaggaggaggaccaggatgagggcatcaagcaggccatgaaccactttgtgcaggagaatggcaccctgcgggccaagcccactggaaatggcatctacatcaatggccggggccacctggtgtag

SEQ ID NO: 164496 - DNA, 660 bp, Artificial Sequence
  Description of Artificial Sequence: Synthetic coding sequence
atgctgaagtgcctgtctgagggccagcccccacccagctacaactggacccggctggatggccccctgcccagcggcgtgcgggtggatggagacaccctgggcttcccccccctgaccacagagcacagcggcatctacgtgtgccacgtgtccaatgagttcagcagccgggacagccaggtgacagtggatgtgctggacccccaggaggacagcggcaagcaggtggacctggtgtctgcctctgtggtggtggtgggcgtgattgctgccctgctcttctgcctgctggtggtggtggtggtgctgatgagccgctaccacaggaggaaggcccagcagatgacccagaagtatgaggaggagctgaccctgaccagagaaaattccatccggcggctgcacagccaccacacagaccccaggagccagagcgaggagcctgagggccgcagctacagcaccctgaccaccgtgcgggagattgagacccagacagagctgctgagccctggcagcggccgggcagaggaggaggaggaccaggatgagggcatcaagcaggccatgaaccactttgtgcaggagaatggcaccctgcgggccaagcccactggaaatggcatctacatcaatggccggggccacctggtgtag

SEQ ID NO: 164497 - DNA, 2058 bp, Artificial Sequence
  Description of Artificial Sequence: Synthetic coding sequence
atggagctgctgcggaccatcacctaccagcctgctgccagcaccaagatgtgtgagcaggccctgggcaagggctgtggggctgacagcaagaagaagaggcctccccagcccccagaggagagccagcccccccagagccaggcccaggtgcccccagctgccccccaccaccaccaccaccacagccacagcggccctgagatcagccgcatcatcgtggaccccaccaccgggaagcgctactgccggggcaaggtgctgggcaagggcggctttgccaagtgctatgagatgacagacctgaccaacaacaaggtgtatgctgccaagatcatcccccacagccgggtggccaagccccaccagcgggagaagattgacaaggagattgagctgcaccgcatcctgcaccacaagcacgtggtgcagttctaccactactttgaggacaaggagaacatctacatcctgctggagtactgcagccgccgctccatggcccacatcctgaaggccaggaaggtgctgacagagcctgaggtgcgctactacctgcggcagatcgtgtctggcctgaagtacctgcacgagcaggagatcctgcaccgggacctgaagctgggcaacttcttcatcaatgaggccatggagctgaaggtgggggactttggcctggccgcccggctggagcccctggagcacagaagaaggaccatctgtggcacccccaactacctgagccctgaggtgctgaacaagcagggccacggctgtgagagtgacatctgggccctgggctgtgtgatgtacaccatgctgctgggccggcccccatttgagaccaccaacctgaaggagacctaccgctgcatccgggaggcccgctacaccatgcccagcagcctgctggccccagccaagcacctgattgcctccatgctgagcaagaaccctgaggaccggcccagcctggatgacatcatcagacatgacttcttcctgcagggcttcaccccagaccggctgagcagcagctgctgccacacagtgcctgacttccacctgagcagccctgccaagaacttcttcaagaaggctgctgctgccctgtttggaggcaagaaggacaaggcccgctacatcgacacccacaacagagtgtccaaagaagatgaggacatctacaagctgcggcatgacctgaagaagaccagcatcacccagcagcccagcaagcacaggacagatgaggagctgcagccccccaccaccaccgtggcccggagcggcaccccagctgtggagaacaagcagcagattggagatgccatccgcatgattgtgcggggcaccctgggcagctgcagcagcagcagtgaatgtctggaggacagcaccatgggctctgtggccgacacagtggcccgggtgctgcggggctgcctggagaacatgcctgaggccgactgcatccccaaggagcagctgagcaccagcttccagtgggtgaccaagtgggtggactacagcaacaagtatggcttcggctaccagctgagtgaccacacagtgggcgtgctcttcaacaatggagcccacatgagcctgctgcctgacaagaagacagtgcactactatgcagagctgggccagtgcagcgtcttccctgccacagatgcccctgagcagttcatcagccaggtgacagtgctgaagtacttcagccactacatggaggagaacctgatggatggaggagacctgcccagcgtgacagacatccggcggccccggctgtacctgctgcagtggctgaagagtgacaaggccctgatgatgctgttcaatgatggcaccttccaggtgaacttctaccatgaccacaccaagatcatcatctgcagccagaatgaggagtacctgctgacctacatcaatgaagatcgcatcagcaccaccttccggctgaccaccctgctgatgagcggctgcagcagcgagctgaagaacaggatggagtatgccctgaacatgctgctgcagcgctgcaactag

SEQ ID NO: 164498 - DNA, 1164 bp, Artificial Sequence
  Description of Artificial Sequence: Synthetic coding sequence
atggagctgctgcggaccatcacctaccagcctgctgccagcaccaagatgtgtgagcaggccctgggcaagggctgtggggctgacagcaagaagaagaggcctccccagcccccagaggagagccagcccccccagagccaggcccaggtgcccccagagatcagccgcatcatcgtggaccccaccaccgggaagcgctactgccggggcaaggtgctgggcaagggcggctttgccaagtgctatgagatgacagacctgaccaacaacaaggtgtatgctgccaagatcatcccccacagccgggtggccaagccccaccagcgggagaagattgacaaggagattgagctgcaccgcatcctgcaccacaagcacgtggtgcagttctaccactactttgaggacaaggagaacatctacatcctgctggagtactgcagccgccgctccatggcccacatcctgaaggccaggaaggtgctgacagagcctgaggtgcgctactacctgcggcagatcgtgtctggcctgaagtacctgcacgagcaggagatcctgcaccgggacctgaagctgggcaacttcttcatcaatgaggccatggagctgaaggtgggggactttggcctggccgcccggctggagcccctggagcacagaagaaggaccatctgtggcacccccaactacctgagccctgaggtgctgaacaagcagggccacggctgtgagagtgacatctgggccctgggctgtgtgatgtacaccatgctgctgggccggcccccatttgagaccaccaacctgaaggagacctaccgctgcatccgggaggcccgctacaccatgcccagcagcctgctggccccagccaagcacctgattgcctccatgctgagcaagaaccctgaggaccggcccagcctggatgacatcatcagacatgacttcttctgccgggccagcctgaggacagactgcctgctggccgtggtgatccagttccagatcagcacctaccaggcccagctgcgcatcagcctgaggaagcagctgctgctcttcctggtggccaagaagaccaagcaggacatcctgacccacatcattgaatgtctgaagaagatgaagaccagcaccagcctgggcatgatctag

SEQ ID NO: 164499 - DNA, 1140 bp, Artificial Sequence
  Description of Artificial Sequence: Synthetic coding sequence
atggagctgctgcggaccatcacctaccagcctgctgccagcaccaagatgtgtgagcaggccctgggcaagggctgtggggctgacagcaagaagaagaggcctccccagcccccagaggagagccagcccccccagagccaggcccaggtgcccccagctgccccccaccaccaccaccaccacagccacagcggccctgagatcagccgcatcatcgtggaccccaccaccgggaagcgctactgccggggcaaggtgctgggcaagggcggctttgccaagtgctatgagatgacagacctgaccaacaacaaggtgtatgctgccaagatcatcccccacagccgggtggccaagccccaccagcgggagaagattgacaaggagattgagctgcaccgcatcctgcaccacaagcacgtggtgcagttctaccactactttgaggacaaggagaacatctacatcctgctggagtactgcagccgccgctccatggcccacatcctgaaggccaggaaggtgctgacagagcctgaggtgcgctactacctgcggcagatcgtgtctggcctgaagtacctgcacgagcaggagatcctgcaccgggacctgaagctgggcaacttcttcatcaatgaggccatggagctgaaggtgggggactttggcctggccgcccggctggagcccctggagcacagaagaaggaccatctgtggcacccccaactacctgagccctgaggtgctgaacaagcagggccacggctgtgagagtgacatctgggccctgggctgtgtgatgtacaccatgctgctgggccggcccccatttgagaccaccaacctgaaggagacctaccgctgcatccgggaggcccgctacaccatgcccagcagcctgctggccccagccaagcacctgattgcctccatgctgagcaagaaccctgaggaccggcccagcctggatgacatcatcagacatgacttcttcctgcagggcttcaccccagaccggctgagcagcagctgctgccacacagtgcctgacttccacctgagcagccctgccaagaacttcttcaagagagctgctgagcacatcatctctgtgggccaccagatgggctag

SEQ ID NO: 164500 - DNA, 1476 bp, Artificial Sequence
  Description of Artificial Sequence: Synthetic coding sequence
gtggacctgctgcgggccggggaggtgcccaagcccttccccacccactacaaggacctgtgggacaacaagcacgtgaagatgccctgcagcgagcagaacctgtaccctgtggaggatgaaaatggagagaggacagctggcagccgctgggagctgatccagacagccctgctgaacaagttcacccggccccagaacctgaaggatgccatcctgaagtacaacgtggcctacagcaagaagtgggacttcaccgccctgattgacttctgggacaaggtgctggaggaggccgaggcccagcacctgtaccagagcatcctgcctgacatggtgaagatcgccctgtgcctgcccaacatctgcacccagcccatccccctgctgaagcagaagatgaaccacagcatcaccatgagccaggagcagatcgccagcctgctggccaatgccttcttctgcaccttccccaggagaaatgccaagatgaagtctgagtacagcagctacccagacatcaacttcaacagactctttgagggccgcagcagcaggaagccagagaagctgaagaccctcttctgctacttcagaagagtgacagagaagaagcccaccggcctggtgaccttcacccggcagagcctggaggacttccctgagtgggagcgctgtgagaagcccctgacccggctgcacgtgacctatgagggcaccattgaagaaaatggccagggcatgctgcaggtggactttgccaacagatttgtgggcggcggcgtgaccagcgctggcctggtgcaggaggagatccgcttcctgatcaaccctgagctgatcatcagccgcctcttcacagaggtgctggaccacaatgaatgtctcatcatcactggaacagagcagtacagcgagtacacaggctatgcagagacctaccgctggagccgcagccatgaagatggcagcgagagagatgactggcagaggcgctgcacagagatcgtggccattgatgccctgcacttccgccgctacctggaccagtttgtgcctgagaagatgagaagagagctgaacaaggcctactgcggcttcctgcggcctggggtgtcctctgagaacctgtctgctgtggccaccggcaactggggctgtggggcctttggaggagatgcccggctgaaggccctgatccagatcctggccgctgctgctgctgagagagatgtggtgtacttcacctttggagacagcgagctgatgagggacatctacagcatgcacatcttcctgacagagaggaagctgactgtgggagatgtgtacaagctgctgctgcgctactacaatgaggagtgcaggaactgcagcaccccaggccctgacatcaagctgtaccccttcatctaccacgctgtggagagctgtgccgagacagctgaccacagcggccagaggacaggcacctag

SEQ ID NO: 164501 - DNA, 579 bp, Artificial Sequence
  Description of Artificial Sequence: Synthetic coding sequence
tgaacagagcagtacagcgagtacacaggctacgccgagacctaccgctggagccgcagccatgaagatggcagcgagagagatgactggcagaggcgctgcacagaaattgtggccattgatgccctgcacttccgccgctacctggaccagtttgtgcctgagaagatgaggcgggagctgaacaaggcctactgcggcttcctgcggcctggggtgtcctctgagaacctgtctgctgtggccactggaaactggggctgtggggcctttggaggagatgcccggctgaaggccctgatccagatcctggccgctgctgctgctgagagagatgtggtgtacttcaccttcggggacagcgagctgatgagggacatctacagcatgcacatcttcctgacagagaggaagctgactgtgggagatgtgtacaagctgctgctgcgctactacaatgaagaatgtagaaactgcagcaccccaggccctgacatcaagctgtaccccttcatctaccacgctgtggagagctgtgccgagacagctgaccacagcggccagaggacaggcacctag

SEQ ID NO: 164502 - DNA, 468 bp, Artificial Sequence
  Description of Artificial Sequence: Synthetic coding sequence
atggccgagagcagtgacaagctgtacagagtggagtatgccaagagcggccgggccagctgcaagaagtgcagcgagagcatccccaaggacagcctgaggatggccatcatggtgcagagccccatgtttgatggcaaggtgccccactggtaccacttcagctgcttctggaaggtgggccacagcatccgccacccagatgtggaggtggatggcttcagcgagctgcgctgggatgaccagcagaaggtgaagaagacagctgaggccggcggcgtgactggagtgtacatcctgggccagcacggccacagcgcccccaccctgaagctgcccggcggcccccggctgcgggagcagagcaagcccccaccagcctgccccctgccccacgtgcagatcaagaggatggtgcccatgctgttccagcagcacctgctggacagcgccagctctgtggcctag

SEQ ID NO: 164503 - DNA, 327 bp, Artificial Sequence
  Description of Artificial Sequence: Synthetic coding sequence
atggccgagagcagtgacaagctgtacagagtggagtatgccaagagcggccgggccagctgcaagaagtgcagcgagagcatccccaaggacagcctgaggatggccatcatggtgcagagccccatgtttgatggcaaggtgccccactggtaccacttcagctgcttctggaaggtgggccacagcatccgccacccagatgtggaggtggatggcttcagcgagctgcgctgggatgaccagcagaaggtgaagaagacagctgaggccggcggcgtgacagagccccccatcccctgtggcatcgaggtgatgggccgctag

SEQ ID NO: 164504 - DNA, 327 bp, Artificial Sequence; identical to SEQ ID NO: 164503
  Description of Artificial Sequence: Synthetic coding sequence

SEQ ID NO: 164505 - DNA, 3045 bp, Artificial Sequence
  Description of Artificial Sequence: Synthetic coding sequence
atggccgagagcagtgacaagctgtacagagtggagtatgccaagagcggccgggccagctgcaagaagtgcagcgagagcatccccaaggacagcctgaggatggccatcatggtgcagagccccatgtttgatggcaaggtgccccactggtaccacttcagctgcttctggaaggtgggccacagcatccgccacccagatgtggaggtggatggcttcagcgagctgcgctgggatgaccagcagaaggtgaagaagacagctgaggccggcggcgtgacaggcaagggccaggacggcatcggcagcaaggccgagaagaccctgggggactttgctgctgaatatgccaagagcaacagaagcacctgcaagggctgcatggagaagattgagaagggccaggtgcggctgagcaagaagatggtggaccctgagaagccccagctgggcatgattgaccgctggtaccaccctggctgctttgtgaagaaccgggaggagctgggcttccggcctgagtacagcgccagccagctgaagggcttcagcctgctggccacagaggacaaggaggccctgaagaagcagctgcccggggtgaagtctgagggcaagaggaaaggagatgaggtggatggagtggatgaggtggccaagaagaagagcaagaaggagaaggacaaggacagcaagctggagaaggccctgaaggcccagaatgacctgatctggaacatcaaggatgagctgaagaaggtgtgcagcaccaatgacctgaaggagctgctgatcttcaacaagcagcaggtgcccagcggggagagcgccatcctggacagagtggctgatggcatggtgtttggagccctgctgccctgtgaagaatgttctggccagctggtgttcaagagtgatgcctactactgcacaggagatgtgacagcctggaccaagtgcatggtgaagacccagacccccaacaggaaggagtgggtgacccccaaggagttccgggagatctcctacctgaagaagctgaaggtgaagaagcaggaccgcatcttccccccagagaccagcgcctctgtggccgccaccccaccacccagcacagccagcgccccagctgctgtgaacagcagcgccagcgctgacaagcccctgagcaacatgaagatcctgaccctgggcaagctgagcaggaacaaggatgaggtgaaggccatgattgagaagctgggcggcaagctgaccggcacagccaacaaggccagcctgtgcatcagcaccaagaaggaggtggagaagatgaacaagaagatggaggaggtgaaggaggccaacatccgggtggtgtctgaggacttcctgcaggatgtgtctgccagcaccaagagcctgcaggagctgttcctggcccacatcctgagcccctggggcgctgaggtgaaggccgagcctgtggaggtggtggccccccggggcaagtctggagctgccctgagcaagaagagcaagggccaggtgaaggaggagggcatcaacaagtctgagaagaggatgaagctgaccctgaagggcggcgctgctgtggaccctgattctggcctggagcacagcgcccacgtgctggagaagggcggcaaggtgttcagcgccaccctgggcctggtggacatcgtgaagggcaccaacagctactacaagctgcagctgctggaggatgacaaggagaaccgctactggatcttccgctcctggggccgggtgggcaccgtcatcggcagcaacaagctggagcagatgcccagcaaggaggatgccatcgagcacttcatgaagctgtatgaggagaagacaggaaatgcctggcacagcaagaacttcaccaagtaccccaagaagttctaccccctggagattgattatggccaggatgaggaggccgtgaagaagctgactgtgaaccctggcaccaagagcaagctgcccaagcctgtgcaggacctgatcaagatgatctttgatgtggagagcatgaagaaggccatggtggagtatgaaattgacctgcagaagatgcccctgggcaagctgagcaagaggcagatccaggccgcctacagcatcctgtctgaggtgcagcaggccgtgtcccagggcagcagtgacagccagatcctggacctgagcaaccgcttctacaccctcatcccccatgactttggcatgaagaagccacccctgctgaacaatgctgacagcgtgcaggccaaggtggagatgctggacaacctgctggacatcgaggtggcctacagcctgctgcggggcggcagtgatgacagcagcaaggaccccattgatgtgaactatgagaagctgaagacagacatcaaggtggtggaccgggacagcgaggaggccgagatcatcagaaaatatgtgaagaacacccacgccaccacccacaatgcctatgacctggaggtgattgacatcttcaagattgagcgggagggggagtgccagcgctacaagcccttcaagcagctgcacaacagaaggctgctgtggcacggcagcaggaccaccaactttgctggcatcctgagccagggcctgagaattgcccctcctgaggcccctgtgacaggctacatgtttgggaagggcatctactttgctgacatggtgtccaagagcgccaactactgccacaccagccagggcgaccccatcggcctcatcctgctgggggaggtggccctgggcaacatgtatgagctgaagcacgccagccacatcagcaagctgcccaagggcaagcacagcgtgaagggcctgggcaagaccaccccagaccccagcgccaacatcagcctggatggagtggatgtgcccctgggcaccggcatcagcagtggagtgaatgacaccagcctgctgtacaatgagtacatcgtgtatgacatcgcccaggtgaacctgaagtacctgctgaagctgaagttcaacttcaagaccagcctgtggtag

SEQ ID NO: 164506 - DNA, 753 bp, Artificial Sequence
  Description of Artificial Sequence: Synthetic coding sequence
atggccgagagcagtgacaagctgtacagagtggagtatgccaagagcggccgggccagctgcaagaagtgcagcgagagcatccccaaggacagcctgaggatggccatcatggtgcagagccccatgtttgatggcaaggtgccccactggtaccacttcagctgcttctggaaggtgggccacagcatccgccacccagatgtggaggtggatggcttcagcgagctgcgctgggatgaccagcagaaggtgaagaagacagctgaggccggcggcgtgacaggcaagggccaggacggcatcggcagcaaggccgagaagaccctgggggactttgctgctgaatatgccaagagcaacagaagcacctgcaagggctgcatggagaagattgagaagggccaggtgcggctgagcaagaagatggtggaccctgagaagccccagctgggcatgattgaccgctggtaccaccctggctgctttgtgaagaaccgggaggagctgggcttccggcctgagtacagcgccagccagctgaagggcttcagcctgctggccacagaggacaaggaggccctgaagaagcagctgcccggggtgaagtctgagggcaagaggaaaggagatgaggtggatggagtggatgaggtggccaagaagaagagcaagaaggagaaggacaagaagaagaagaagaagaagaagaaggagaggaagaagaagaagaagaagaggaagaagaagtag

SEQ ID NO: 164507 - DNA, 2133 bp, Artificial Sequence
  Description of Artificial Sequence: Synthetic coding sequence
atggacttctccatggtggccggggccgccgcctacaatgagaagtctgagaccggggccctgggggagaactacagctggcagatccccatcaaccacaatgacttcaagatcctgaagaacaatgaaaggcagctgtgtgaggtgctgcagaacaagtttggctgcatcagcaccctggtgtcccctgtgcaggagggcaacagcaagagcctgcaggtgttcaggaagatgctgaccccaagaattgagctgtctgtgtggaaggatgacctgaccacccatgctgtggatgctgtggtgaatgctgccaatgaagacctgctgcacggcggcggcctggccctggccctggtgaaggccggcggctttgagatccaggaggagagcaagcagtttgtggcccgctatggcaaggtgtctgctggggagattgctgtgactggagctggccgcctgccctgcaagcagatcatccatgctgtgggcccccgctggatggagtgggacaagcagggctgcaccgggaagctgcagagggccatcgtgtccatcctgaactacgtgatctacaagaacacccacatcaagacagtggccatcccagccctgagcagcggcatcttccagttccccctgaacctgtgcaccaagaccatcgtggagaccatccgggtgtccctgcagggcaagcccatgatgagcaacctgaaggagatccacctggtgtccaatgaagaccccaccgtggccgccttcaaggccgccagcgagttcatcctgggcaagtctgagctgggccaggagaccacccccagcttcaatgccatggtggtgaacaacctgaccctgcagatcgtgcagggccacatcgagtggcagacagcagatgtgattgtgaacagcgtgaacccccatgacatcaccgtgggccctgtggccaagagcatcctgcagcaggccggcgtggagatgaagtctgagttcctggccaccaaggccaagcagttccagaggagccagctggtgctggtgaccaagggcttcaacctcttctgcaagtacatctaccacgtgctgtggcacagcgagttccccaagccccagatcctgaagcacgccatgaaggaatgtctggagaagtgcatcgagcagaacatcaccagcatctccttccctgccctgggcactggaaacatggagatcaagaaggagacagctgctgagatcctgtttgatgaggtgctgacctttgccaaggaccacgtgaagcaccagctgactgtgaagtttgtgatcttccccacagacctggagatctacaaggccttcagcagcgagatggccaagaggagcaagatgctgagcctgaacaactacagcgtgccccagagcacccgggaggagaagcgggagaatggcctggaggcccggagccctgccatcaacctgatgggcttcaacgtggaggagatgtatgaggcccacgcctggatccagaggatcctgagcctgcagaaccaccacatcatcgagaacaaccacatcctgtacctgggcaggaaggagcatgacatcctgagccagctgcagaagaccagctctgtgtccatcacagagatcatcagccctggccgcacagagctggagattgaaggagcccgggctgacctgattgaggtggtgatgaacatcgaggacatgctgtgcaaggtgcaggaggagatggccaggaagaaggagcggggcctgtggaggagcctgggccagtggaccatccagcagcagaagacccaggatgagatgaaggagaacatcatcttcctgaagtgccctgtgccccccacccaggagctgctggaccagaagaagcagtttgagaagtgtggcctgcaggtgctgaaggtggagaagattgacaatgaggtgctgatggccgccttccagaggaagaagaagatgatggaggagaagctgcaccggcagcctgtgagccacaggctcttccagcaggtgccctaccagttctgcaatgtggtgtgccgggtgggcttccagaggatgtacagcaccccctgtggccgctgccagtgcctgatcattggagccaccctgtggaacctggtgtcctag

SEQ ID NO: 164508 - DNA, 2460 bp, Artificial Sequence
  Description of Artificial Sequence: Synthetic coding sequence
atggacttctccatggtggccggggccgccgcctacaatgagaagtctgagaccggggccctgggggagaactacagctggcagatccccatcaaccacaatgacttcaagatcctgaagaacaatgaaaggcagctgtgtgaggtgctgcagaacaagtttggctgcatcagcaccctggtgtcccctgtgcaggagggcaacagcaagagcctgcaggtgttcaggaagatgctgaccccaagaattgagctgtctgtgtggaaggatgacctgaccacccatgctgtggatgctgtggtgaatgctgccaatgaagacctgctgcacggcggcggcctggccctggccctggtgaaggccggcggctttgagatccaggaggagagcaagcagtttgtggcccgctatggcaaggtgtctgctggggagattgctgtgactggagctggccgcctgccctgcaagcagatcatccatgctgtgggcccccgctggatggagtgggacaagcagggctgcaccgggaagctgcagagggccatcgtgtccatcctgaactacgtgatctacaagaacacccacatcaagacagtggccatcccagccctgagcagcggcatcttccagttccccctgaacctgtgcaccaagaccatcgtggagaccatccgggtgtccctgcagggcaagcccatgatgagcaacctgaaggagatccacctggtgtccaatgaagaccccaccgtggccgccttcaaggccgccagcgagttcatcctgggcaagtctgagctgggccaggagaccacccccagcttcaatgccatggtggtgaacaacctgaccctgcagatcgtgcagggccacatcgagtggcagacagcagatgtgattgtgaacagcgtgaacccccatgacatcaccgtgggccctgtggccaagagcatcctgcagcaggccggcgtggagatgaagtctgagttcctggccaccaaggccaagcagttccagaggagccagctggtgctggtgaccaagggcttcaacctcttctgcaagtacatctaccacgtgctgtggcacagcgagttccccaagccccagatcctgaagcacgccatgaaggaatgtctggagaagtgcatcgagcagaacatcaccagcatctccttccctgccctgggcactggaaacatggagatcaagaaggagacagctgctgagatcctgtttgatgaggtgctgacctttgccaaggaccacgtgaagcaccagctgactgtgaagtttgtgatcttccccacagacctggagatctacaaggccttcagcagcgagatggccaagaggagcaagatgctgagcctgaacaactacagcgtgccccagagcacccgggaggagaagcgggagaatggcctggaggcccggagccctgccatcaacctgatgggcttcaacgtggaggagatgtatgaggcccacgcctggatccagaggatcctgagcctgcagaaccaccacatcatcgagaacaaccacatcctgtacctgggcaggaaggagcatgacatcctgagccagctgcagaagaccagctctgtgtccatcacagagatcatcagccctggccgcacagagctggagattgaaggagcccgggctgacctgattgaggtggtgatgaacatcgaggacatgctgtgcaaggtgcaggaggagatggccaggaagaaggagcggggcctgtggaggagcctgggccagtggaccatccagcagcagaagacccaggatgagatgaaggagaacatcatcttcctgaagtgccctgtgccccccacccaggagctgctggaccagaagaagcagtttgagaagtgtggcctgcaggtgctgaaggtggagaagattgacaatgaggtgctgatggccgccttccagaggaagaagaagatgatggaggagaagctgcaccggcagcctgtgagccacaggctcttccagcaggtgccctaccagttctgcaatgtggtgtgccgggtgggcttccagaggatgtacagcaccccctgtgaccccaagtatggagctggcatctacttcaccaagaacctgaagaacctggccgagaaggccaagaagatctctgctgctgacaagctgatctacgtgtttgaagctgaggtgctgaccggcttcttctgccagggccaccccctgaacatcgtgcccccacccctgagccctggggccattgatggccatgattctgtggtggacaacgtgagcagccctgagaccttcgtcatcttcagcggcatgcaggccatcccccagtacctgtggacctgcacccaggagtatgtgcagagccaggactacagcagcggccccatgaggccctttgcccagcacccctggaggggctttgccagcggcagccctgtggactag

SEQ ID NO: 164509 - DNA, 2106 bp, Artificial Sequence
  Description of Artificial Sequence: Synthetic coding sequence
atggcccaggccggcgtggtgggggaggtgacccaggtgctgtgtgccgccggcggggccctggagctgcctgagctgcggcggcggctgaggatgggcctgtctgcagatgccctggagcggctgctgcggcagaggggccgctttgtggtggccgtgcgggccggcggcgctgctgctgcccctgagcgggtggtgctggccgccagccccctgcggctgtgccgggcccaccagggcagcaagccaggctgtgtgggcctgtgtgcccagctgcacctgtgccgcttcatggtgtatggagcctgcaagttcctgcgggccggcaagaactgcaggaacagccacagcctgaccacagagcacaacctgtctgtgctgcggacccacggcgtggaccacctgagctacaatgagctgtgccagctgctcttccagaatgacccctggctgctgcctgagatctgccagcactacaacaagggagatggcccccacggcagctgtgccttccagaagcagtgcatcaagctgcacatctgccagtacttcctgcagggcgagtgcaagtttggcaccagctgcaagaggagccatgacttcagcaacagcgagaacctggagaagctggagaagctgggcatgagcagtgacctggtgtcccggctgcccaccatctacagaaatgcccatgacatcaagaacaagagcagcgcccccagccgggtgccccccctgtttgtgccccagggcaccagcgagaggaaggacagcagcggctctgtgagccccaacaccctgagccaggaggagggggaccagatctgcctgtaccacatcaggaagagctgcagcttccaggacaagtgccaccgggtgcacttccacctgccctaccgctggcagttcctggaccggggcaagtgggaggacctggacaacatggagctgattgaggaggcctactgcaaccccaagattgagcgcatcctgtgcagcgagagcgccagcaccttccacagccactgcctgaacttcaatgccatgacctatggagccacccaggcccggcggctgagcacagccagctctgtgaccaagccaccccacttcatcctgaccacagactggatctggtactggagcgatgaatttggctcctggcaggagtatggccggcagggcaccgtgcaccctgtgaccaccgtgagcagcagtgatgtggagaaggcctacctggcctactgcaccccaggcagtgatggccaggccgccaccctgaagttccaggccggcaagcacaactatgagctggacttcaaggcctttgtgcagaagaacctggtgtatggcaccaccaagaaggtgtgccggcggcccaagtatgtgagcccccaggatgtgaccaccatgcagacctgcaacaccaagtttcctggccccaagagcatcccagactactgggacagcagcgccctgcctgaccccggcttccagaagatcaccctgagcagcagcagcgaggagtaccagaaggtgtggaacctcttcaacagaaccctgcccttctactttgtgcagaagattgagcgggtgcagaacctggccctgtgggaggtgtaccagtggcagaagggccagatgcagaagcagaatggaggcaaggctgtggatgagcggcagctgttccacggcaccagcgccatctttgtggatgccatctgccagcagaactttgactggagggtgtgtggggtgcacggcaccagctatggcaagggcagctactttgccagagatgctgcctacagccaccactacagcaagagtgacacccagacccacaccatgttcctggcccgggtgctggtgggggagtttgtgagaggaaatgccagctttgtgcggcccccagccaaggagggctggagcaatgccttctatgacagctgtgtgaacagcgtgtctgaccccagcatctttgtgatctttgagaagcaccaggtgtacccagaatatgtgatccagtacaccaccagcagcaagcccagcgtgacccccagcatcctgctggccctgggcagcctcttcagcagccggcagtag

SEQ ID NO: 164510 - DNA, 393 bp, Artificial Sequence
  Description of Artificial Sequence: Synthetic coding sequence
atgttcctggcccgggtgctggtgggggagtttgtgagaggaaatgccagctttgtgcggcccccagccaaggagggctggagcaatgccttctatgacagctgtgtgaacagcgtgtctgaccccagcatctttgtgatctttgagaagaccaggagcacccagagcatgagcagcagcaccccacctccacccagccccaggagccacccccccagctgctggccctgggccccctgcagcgctgctgacagcgagaggactggagtcttccaggccttccacctgctgtgcctggagatggccatctgggccttccccttcctgttcaagcagaagctgctgatgaactgcagcctgaacatcgacctgtccatgaagctgtgcagctag

SEQ ID NO: 164511 - DNA, 849 bp, Artificial Sequence
  Description of Artificial Sequence: Synthetic coding sequence
atgagcaagctggccagcttcctgggcttcagcaagcagagcccccagaagaagaaccacctggtgctggagaagaagacagaaagtgccaccttccgggtgtgtggagaaaatgtgacctgtgtggagtatgccatctcctggctgcaggacctgattgagaaggagcagtgcccctacaccagtgaagatgagtgcatcaaggactttgatgagaaggagtaccaggagctgaatgagctgcagaagaagctgaacatcaacatcagcctggaccacaagaggcccctcatcaaggtgctgggcatcagcagagatgtgatgcaggccagagatgaaattgaggccatgatcaagagggtgcggctggccaaggagcaggagagcagagctgactgcatcagcgagttcatcgagtggcagtacaatgacaacaacaccagccactgcttcaacaagatgaccaacctgaagctggaggatgcccggcgggagaagaagaagacagtggatgtgaagatcaaccaccgccactacacagtgaacctgaacacctacacagccacagacaccaagggccacagcctgtctgtgcagaggctgaccaagagcaaggtggacatcccagcccactggagcgacatgaagcagcagaacttctgtgtggtggagctgctgcccagcgaccctgagtacaacacagtggccagcaagttcaaccagacctgcagccacttccgcatcgagaaggtgaatgtgatgatccgggcctgcagccccagctactgggaggccgaggtggagggcctgcacgagcccaggagcctgacccctgtgtgggtgacctag

SEQ ID NO: 164512 - DNA, 2394 bp, Artificial Sequence
  Description of Artificial Sequence: Synthetic coding sequence
atgtacctgcggcggctgctgcggcccctgcagatgctgctggtgaaggagggcgtgcagaatgccaagacagatgtggtggtgaacagcgtgcccctggacctggtgctgagccggggccccctgagcaagagcctgctggagaaggccggccctgagctgcaggaggagctggacacagtgggccagggcgtggccgtgtccatgggcaccgtgctgaagaccagctcctggaacctggactgccgctacgtgctgcacgtggtggcccctgagtggagaaatggcagcaccagcagcctgaagatcatggaggacatcatccgggagtgcatggagatcacagagagcctgagcctgaagagcatcgccttccctgccatcggcaccggcaacctgggcttccccaagaacatctttgctgagctgatcatcagcgaggtgttcaagttcagcagcaagaaccagctgaagaccctgcaggaggtgcacttcctgctgcaccccagcgaccacgagaacatccaggccttcagtgatgaatttgcccggcgggccaatggaaacctggtgtctgacaagatccccaaggccaaggacacccagggcttctatggaacagtgagcagcccagattctggagtgtatgagatgaagattggcagcatcatcttccaggtggccagcggggacatcaccaaggaggaggctgatgtgattgtgaacagcaccagcaacagcttcaacctgaaggccggcgtgtccaaggccatcctggagtgtgccggccagaatgtggagagagaatgttcccagcaggcccagcagaggaagaatgactacatcatcaccggcggcggcttcctgcgctgcaagaacatcatccacgtgattggaggaaatgatgtgaagagctctgtgtcctctgtgctgcaggagtgtgagaagaagaactacagcagcatctgcctgcctgccatcggcactggaaatgccaagcagcacccagacaaggtggccgaggccatcattgatgccatcgaggactttgtgcagaagggcagcgcccagagcgtgaagaaggtgaaggtggtgatcttcctgccccaggtgctggatgtgttctacgccaacatgaagaagcgggagggcacccagctgagcagccagcagagcgtgatgagcaagctggccagcttcctgggcttcagcaagcagagcccccagaagaagaaccacctggtgctggagaagaagacagagagcgccaccttccgggtgtgtggggagaatgtgacctgtgtggagtatgccatctcctggctgcaggacctgattgagaaggagcagtgcccctacaccagtgaagatgagtgcatcaaggactttgatgagaaggagtaccaggagctgaatgagctgcagaagaagctgaacatcaacatcagcctggaccacaagaggcccctcatcaaggtgctgggcatcagcagagatgtgatgcaggccagagatgaaattgaggccatgatcaagagggtgcggctggccaaggagcaggagagcagagctgactgcatcagcgagttcatcgagtggcagtacaatgacaacaacaccagccactgcttcaacaagatgaccaacctgaagctggaggatgcccggcgggagaagaagaagacagtggatgtgaagatcaaccaccgccactacacagtgaacctgaacacctacacagccacagacaccaagggccacagcctgtctgtgcagaggctgaccaagagcaaggtggacatcccagcccactggagcgacatgaagcagcagaacttctgtgtggtggagctgctgcccagcgaccctgagtacaacacagtggccagcaagttcaaccagacctgcagccacttcagaattgagaagattgaaagaatccagaacccagacctgtggaacagctaccaggccaagaagaagaccatggatgccaagaatggccagaccatgaatgagaagcagctgttccacggcacagatgctggctctgtgccccacgtgaacagaaatggcttcaacagaagctatgctgggaagaatgctgtggcctacggcaagggcacctactttgctgtgaatgccaactacagcgccaatgacacctacagcaggccagatgccaatggaaggaagcacgtgtactacgtgcgggtgctgaccggcatctacacccacggcaaccacagcctcatcgtgccccccagcaagaacccccagaaccccacagacctgtatgacacagtgacagacaacgtgcaccaccccagcctgtttgtggccttctatgactaccaggcctacccagagtacctgatcaccttcaggaagtag

SEQ ID NO: 164513 - DNA, 5163 bp, Artificial Sequence
  Description of Artificial Sequence: Synthetic coding sequence
atggctgtgcccggcagcttccccctgctggtggagggctcctggggccctgacccccccaagaacctgaacaccaagctgcagatgtacttccagagccccaagaggtctggaggaggagaatgtgaggtgcggcaggaccccaggagccccagccgcttcctggtgttcttctacccagaagatgtgcggcagaaggtgctggagaggaagaaccacgagctggtgtggcagggcaagggcaccttcaagctgactgtgcagctgcctgccaccccagatgaaattgaccacgtgtttgaggaggagctgctgaccaaggagagcaagaccaaggaggatgtgaaggagccagacaccatccgctttgtggatgactgcaccaagcaccacagcatcaagcagctgcagctgagcccccggctgctggaggtgaccaacaccatccgggtggagaacctgcccccaggagcagatgactacagcctgaagctgttctttgagaacccctacaacggcggcggccgggtggccaacgtggagtacttccctgaggagagcagcgccctgattgagttctttgacaggaaggtgctggacaccatcatggccaccaagctggacttcaacaagatgcccctgtctgtgttcccctactatgccagcctgggcacagccctgtatggcaaggagaagcccctcatcaagctgcctgccccctttgaggagagcctggacctgcccctgtggaagttcctgcagaagaagaaccacctgattgaggagatcaatgatgagatgaggcgctgccactgtgagctgacctggagccagctgagcggcaaggtgaccatccggcctgctgccaccctggtgaatgaaggccggccccgcatcaagacctggcaggccgacaccagcaccaccctgagcagcatccgcagcaagtacaaggtgaaccccatcaaggtggaccccaccatgtgggacaccatcaagaatgatgtgaaggatgaccgcatcctgattgaatttgacaccctgaaggagatggtgatcctggccggcaagtcagaagatgtgcagagcattgaggtgcaggtgcgggagctgattgagagcaccacccagaagatcaagcgggaggagcagagcctgaaggagaagatgatcatcagccctggccgctacttcctgctgtgccacagcagcctgctggaccacctgctgacagagtgcccagaaattgagatctgctatgacagagtgacccagcacctgtgcctgaagggccccagcgcagatgtgtacaaggccaagtgtgagatccaggagaaggtgtacaccatggcccagaagaacatccaggtgtccccagagatcttccagttcctgcagcaggtgaactggaaggagttcagcaaatgtctcttcatcgcccagaagatcctggccctgtatgagctggagggcaccaccgtgctgctgaccagctgcagcagcgaggccctgctggaggccgagaagcagatgctgagcgccctgaactacaagagaattgaggtggagaacaaggaggtgctgcacggcaagaagtggaagggcctgacccacaacctgctgaagaagcagaacagcagccccaacacagtcatcatcaatgagctgaccagcgagaccacagctgaggtgatcatcaccggctgtgtgaaggaggtgaatgagacctacaagctgctcttcaactttgtggagcagaacatgaagattgaaaggctggtggaggtgaagcccagcctggtgattgactacctgaagacagagaagaagctgttctggcccaagatcaagaaggtgaatgtgcaggtgtccttcaaccctgagaacaagcagaagggcatcctgctgaccggcagcaagacagaggtgctgaaggctgtggacatcgtgaagcaggtgtgggacagcgtgtgtgtgaagtctgtgcacacagacaagccaggggccaagcagttcttccaggacaaggcccgcttctaccagagcgagatcaagaggctgtttggctgctacatcgagctgcaggagaatgaggtgatgaaggagggcggcagccctgctggccagaagtgcttcagcaggacagtgctggcccctggggtggtgctgattgtgcagcagggcgacctggcccggctgcctgtggatgtggtggtgaatgccagcaatgaagacctgaagcactatggaggcctggccgccgccctgagcaaggccgccggccctgagctgcaggccgactgtgaccagatcgtgaagcgggagggccgcctgctgcctggaaatgccaccatcagcaaggccggcaagctgccctaccaccacgtgattcatgctgtgggcccccgctggagcggctatgaggccccccgctgtgtgtacctgctgcggcgggctgtgcagctgagcctgtgcctggccgagaagtacaagtaccgcagcatcgccatcccagccatcagcagcggcgtgtttggcttccccctgggccgctgtgtggagaccatcgtgtctgccatcaaggagaacttccagttcaagaaggatggccactgcctgaaggagatctacctggtggatgtgtctgagaagacagtggaggcctttgctgaggccgtgaagacagtgttcaaggccaccctgcctgacacagctgcccctcctggcctgcccccagctgctgctggccctgggaagacctcctgggagaagggcagcctggtgtcccctgggggcctgcagatgctgctggtgaaggagggcgtgcagaatgccaagacagatgtggtggtgaacagcgtgcccctggacctggtgctgagccggggccccctgagcaagagcctgctggagaaggccggccctgagctgcaggaggagctggacacagtgggccagggcgtggccgtgtccatgggcaccgtgctgaagaccagctcctggaacctggactgccgctacgtgctgcacgtggtggcccctgagtggagaaatggcagcaccagcagcctgaagatcatggaggacatcatccgggagtgcatggagatcacagagagcctgagcctgaagagcatcgccttccctgccatcggcactggaaacctgggcttccccaagaacatctttgctgagctgatcatcagcgaggtgttcaagttcagcagcaagaaccagctgaagaccctgcaggaggtgcacttcctgctgcaccccagcgaccacgagaacatccaggccttcagtgatgaatttgcccggcgggccaacggcaacctggtgtctgacaagatccccaaggccaaggacacccagggcttctacggcaccgtgagcagcccagacagcggcgtgtatgagatgaagattggcagcatcatcttccaggtggccagcggggacatcaccaaggaggaggctgatgtgattgtgaacagcaccagcaacagcttcaacctgaaggtgggcgtgtccaaggccatcctggagtgtgccggccagaatgtggagcgggagtgcagccagcaggcccagcagaggaagaatgactacatcatcactggaggcggcttcctgcgctgcaagaacatcatccacgtgattggaggaaatgatgtgaagagctctgtgtcctctgtgctgcaggagtgtgagaagaagaactacagcagcatctgcctgcctgccatcggcactggaaatgccaagcagcacccagacaaggtggccgaggccatcattgatgccattgaagattttgtgcagaagggcagcgcccagagcgtgaagaaggtgaaggtggtgatcttcctgccccaggtgctggatgtgttctacgccaacatgaagaagcgggagggcacccagctgagcagccagcagagcgtgatgagcaagctggccagcttcctgggcttcagcaagcagagcccccagaagaagaaccacctggtgctggagaagaagacagaaagtgccaccttccgggtgtgtggagaaaatgtgacctgtgtggagtatgccatctcctggctgcaggacctgattgagaaggagcagtgcccctacaccagtgaagatgagtgcatcaaggactttgatgagaaggagtaccaggagctgaatgagctgcagaagaagctgaacatcaacatcagcctggaccacaagaggcccctcatcaaggtgctgggcatcagcagagatgtgatgcaggccagagatgaaattgaggccatgatcaagagggtgcggctggccaaggagcaggagagcagagctgactgcatcagcgagttcatcgagtggcagtacaatgacaacaacaccagccactgcttcaacaagatgaccaacctgaagctggaggatgcccggcgggagaagaagaagacagtggatgtgaagatcaaccaccgccactacacagtgaacctgaacacctacacagccacagacaccaagggccacagcctgtctgtgcagaggctgaccaagagcaaggtggacatcccagcccactggagcgacatgaagcagcagaacttctgtgtggtggagctgctgcccagcgaccctgagtacaacacagtggccagcaagttcaaccagacctgcagccacttccgcatcgagaagattgagcgcatccagaacccagacctgtggaacagctaccaggccaagaagaagaccatggatgccaagaatggccagaccatgaatgagaagcagctgttccatggaacagatgctggctctgtgccccacgtgaacagaaatggcttcaacagaagctatgccggcaagaatgctgtggcctacggcaagggcacctactttgctgtgaatgccaactacagcgccaatgacacctacagcaggccagatgccaacggcaggaagcacgtgtactacgtgcgggtgctgaccggcatctacacccacggcaaccacagcctgattgtgccccccagcaagaacccccagaaccccacagacctgtatgacacagtgacagacaacgtgcaccaccccagcctgtttgtggccttctatgactaccaggcctacccagagtacctgatcaccttcaggaagtag

SEQ ID NO: 164514 - DNA, 5406 bp, Artificial Sequence
  Description of Artificial Sequence: Synthetic coding sequence
atggctgtgcccggcagcttccccctgctggtggagggctcctggggccctgacccccccaagaacctgaacaccaagctgcagatgtacttccagagccccaagaggtctggaggaggagaatgtgaggtgcggcaggaccccaggagccccagccgcttcctggtgttcttctacccagaagatgtgcggcagaaggtgctggagaggaagaaccacgagctggtgtggcagggcaagggcaccttcaagctgactgtgcagctgcctgccaccccagatgaaattgaccacgtgtttgaggaggagctgctgaccaaggagagcaagaccaaggaggatgtgaaggagccagatgtgtctgaggagctggacaccaagctgcccctggatggcggcctggacaagatggaggacatcccagaagaatgtgagaacatcagcagcctggtggcctttgagaacctgaaggccaacgtgacagacatcatgctgatcctgctggtggagaacatcagcggcctgagcaatgatgacttccaggtggagatcatccgggactttgatgtggccgtggtgaccttccagaagcacatcgacaccatccgctttgtggatgactgcaccaagcaccacagcatcaagcagctgcagctgagcccccggctgctggaggtgaccaacaccatccgggtggagaacctgcccccaggagcagatgactacagcctgaagctgttctttgagaacccctacaatggaggcggccgggtggccaacgtggagtacttccctgaggagagcagcgccctgattgagttctttgacaggaaggtgctggacaccatcatggccaccaagctggacttcaacaagatgcccctgagcgtcttcccctactatgccagcctgggcacagccctgtatggcaaggagaagcccctcatcaagctgcctgccccctttgaggagagcctggacctgcccctgtggaagttcctgcagaagaagaaccacctgattgaggagatcaatgatgagatgaggcgctgccactgtgagctgacctggagccagctgagcggcaaggtgaccatccggcctgctgccaccctggtgaatgaaggccggccccgcatcaagacctggcaggccgacaccagcaccaccctgagcagcatccgcagcaagtacaaggtgaaccccatcaaggtggaccccaccatgtgggacaccatcaagaatgatgtgaaggatgaccgcatcctgattgaatttgacaccctgaaggagatggtgatcctggccggcaagtcagaagatgtgcagagcattgaggtgcaggtgcgggagctgattgagagcaccacccagaagatcaagcgggaggagcagagcctgaaggagaagatgatcatcagccctggccgctacttcctgctgtgccacagcagcctgctggaccacctgctgacagaatgtcctgagattgagatctgctatgacagagtgacccagcacctgtgcctgaagggccccagcgcagatgtgtacaaggccaagtgtgagatccaggagaaggtgtacaccatggcccagaagaacatccaggtgtccccagagatcttccagttcctgcagcaggtgaactggaaggagttcagcaagtgcctcttcatcgcccagaagatcctggccctgtatgagctggagggcaccaccgtgctgctgaccagctgcagcagcgaggccctgctggaggccgagaagcagatgctgagcgccctgaactacaagagaattgaggtggagaacaaggaggtgctgcacggcaagaagtggaagggcctgacccacaacctgctgaagaagcagaacagcagccccaacacagtcatcatcaatgagctgaccagcgagaccacagctgaggtgatcatcaccggctgtgtgaaggaggtgaatgagacctacaagctgctcttcaactttgtggagcagaacatgaagattgagcggctggtggaggtgaagcccagcctggtgattgactacctgaagacagagaagaagctgttctggcccaagatcaagaaggtgaatgtgcaggtgtccttcaaccctgagaacaagcagaagggcatcctgctgaccggcagcaagacagaggtgctgaaggctgtggacatcgtgaagcaggtgtgggacagcgtgtgtgtgaagtctgtgcacacagacaagccaggggccaagcagttcttccaggacaaggcccgcttctaccagagcgagatcaagaggctgtttggctgctacatcgagctgcaggagaatgaggtgatgaaggagggcggcagccctgctggccagaagtgcttcagcaggacagtgctggcccctggggtggtgctgattgtgcagcagggcgacctggcccggctgcctgtggatgtggtggtgaatgccagcaatgaagacctgaagcactacggcggcctggccgccgccctgagcaaggctgctggccctgagctgcaggccgactgtgaccagatcgtgaagcgggagggccgcctgctgcctggaaatgccaccatcagcaaggccggcaagctgccctaccaccacgtgattcatgctgtgggcccccgctggagcggctatgaggccccccgctgtgtgtacctgctgcggcgggctgtgcagctgagcctgtgcctggccgagaagtacaagtaccgcagcatcgccatcccagccatcagcagtggagtgtttggcttccccctgggccgctgtgtggagaccatcgtgtctgccatcaaggagaacttccagttcaagaaggatggccactgcctgaaggagatctacctggtggatgtgtctgagaagacagtggaggcctttgctgaggccgtgaagacagtgttcaaggccaccctgcctgacacagctgcccctcctggcctgcccccagctgctgctggccctgggaagacctcctgggagaagggcagcctggtgtccccaggcggcctgcagatgctgctggtgaaggagggcgtgcagaatgccaagacagatgtggtggtgaacagcgtgcccctggacctggtgctgagccggggccccctgagcaagagcctgctggagaaggccggccctgagctgcaggaggagctggacacagtgggccagggcgtggccgtgtccatgggcaccgtgctgaagaccagctcctggaacctggactgccgctacgtgctgcacgtggtggcccctgagtggagaaatggcagcaccagcagcctgaagatcatggaggacatcatccgggagtgcatggagatcacagagagcctgagcctgaagagcatcgccttccctgccatcggcaccggcaacctgggcttccccaagaacatctttgctgagctgatcatcagcgaggtgttcaagttcagcagcaagaaccagctgaagaccctgcaggaggtgcacttcctgctgcaccccagcgaccacgagaacatccaggccttcagtgatgaatttgcccggcgggccaatggaaacctggtgtctgacaagatccccaaggccaaggacacccagggcttctatggaacagtgagcagcccagattctggagtgtatgagatgaagattggcagcatcatcttccaggtggccagcggggacatcaccaaggaggaggctgatgtgattgtgaacagcaccagcaacagcttcaacctgaaggccggcgtgtccaaggccatcctggagtgtgccggccagaatgtggagagagaatgttcccagcaggcccagcagaggaagaatgactacatcatcaccggcggcggcttcctgcgctgcaagaacatcatccacgtgattggaggaaatgatgtgaagagctctgtgtcctctgtgctgcaggagtgtgagaagaagaactacagcagcatctgcctgcctgccatcggcactggaaatgccaagcagcacccagacaaggtggccgaggccatcattgatgccatcgaggactttgtgcagaagggcagcgcccagagcgtgaagaaggtgaaggtggtgatcttcctgccccaggtgctggatgtgttctacgccaacatgaagaagcgggagggcacccagctgagcagccagcagagcgtgatgagcaagctggccagcttcctgggcttcagcaagcagagcccccagaagaagaaccacctggtgctggagaagaagacagagagcgccaccttccgggtgtgtggggagaatgtgacctgtgtggagtatgccatctcctggctgcaggacctgattgagaaggagcagtgcccctacaccagtgaagatgagtgcatcaaggactttgatgagaaggagtaccaggagctgaatgagctgcagaagaagctgaacatcaacatcagcctggaccacaagaggcccctcatcaaggtgctgggcatcagcagagatgtgatgcaggccagagatgaaattgaggccatgatcaagagggtgcggctggccaaggagcaggagagcagagctgactgcatcagcgagttcatcgagtggcagtacaatgacaacaacaccagccactgcttcaacaagatgaccaacctgaagctggaggatgcccggcgggagaagaagaagacagtggatgtgaagatcaaccaccgccactacacagtgaacctgaacacctacacagccacagacaccaagggccacagcctgtctgtgcagaggctgaccaagagcaaggtggacatcccagcccactggagcgacatgaagcagcagaacttctgtgtggtggagctgctgcccagcgaccctgagtacaacacagtggccagcaagttcaaccagacctgcagccacttcagaattgagaagattgaaagaatccagaacccagacctgtggaacagctaccaggccaagaagaagaccatggatgccaagaatggccagaccatgaatgagaagcagctgttccacggcacagatgctggctctgtgccccacgtgaacagaaatggcttcaacagaagctatgctgggaagaatgctgtggcctacggcaagggcacctactttgctgtgaatgccaactacagcgccaatgacacctacagcaggccagatgccaatggaaggaagcacgtgtactacgtgcgggtgctgaccggcatctacacccacggcaaccacagcctcatcgtgccccccagcaagaacccccagaaccccacagacctgtatgacacagtgacagacaacgtgcaccaccccagcctgtttgtggccttctatgactaccaggcctacccagagtacctgatcaccttcaggaagtag

SEQ ID NO: 164515 - DNA, 585 bp, Artificial Sequence
  Description of Artificial Sequence: Synthetic coding sequence
tgagtgagaagaagagctgagctgaggatggctgtgcccggcagcttccccctgctggtggagggctcctggggccctgacccccccaagaacctgaacaccaagctgcagatgtacttccagagccccaagaggtctgggggcggggagtgtgaggtgcggcaggaccccaggagccccagccgcttcctggtgttcttctacccagaagatgtgcggcagaaggtgctggagaggaagaaccacgagctggtgtggcagggcaagggcaccttcaagctgactgtgcagctgcctgccaccccagatgaaattgaccacgtgtttgaggaggagctgctgaccaaggagagcaagaccaaggaggatgtgaaggagccagacaccatccgctttgtggatgactgcaccaagcaccacagcatcaagcagctgcagctgagcccccggctgctggaggtgaccaacaccatccgggtggagaacctgcccccaggagcagatgactacagcctgaagctgttctttgagaacccctacaatggaggcggccgggtggccaacgtggagtacttccctgagtag

SEQ ID NO: 164516 - DNA, 1335 bp, Artificial Sequence
  Description of Artificial Sequence: Synthetic coding sequence
atgctgcagagaattggcctcatcttcctgcacaacatcgtggtggtgagcaactgcttctacttccaggccttcctggatgagttcaccaactggagccgcatcaaccccaacaaggcccgcatccccatggccggggacacccagggcgtggtgggcaccgtgtccaagccctgcttcaccgcctatgagatgaagattggagccatcaccttccaggtggccaccggggacatcgccacagagcaggtggatgtgattgtgaacagcacagcccggaccttcaacaggaagtctggagtgtcccgggccatcctggagggcgccggccaggccgtggagagtgaatgtgctgtgctggccgcccagccccaccgggacttcatcatcacccctgggggctgcctgaagtgcaagatcatcatccacgtgcctgggggcaaggatgtgaggaagacagtgacctctgtgctggaggagtgtgagcagaggaagtacacctctgtgtccctgcctgccatcggcactggaaatgccggcaagaaccccatcaccgtggccgacaacatcattgatgccatcgtggacttcagcagccagcacagcacccccagcctgaagacagtgaaggtggtgatcttccagcctgagctgctgaacatcttctatgacagcatgaagaagagggacctgagcgccagcctgaacttccagagcaccttctccatgaccacctgcaacctgcctgagcactggacagacatgaaccaccagctgttctgcatggtgcagctggagcccggccagagcgagtacaacaccatcaaggacaagttcaccaggacctgcagcagctatgccatcgagaagattgagcgcatccagaatgccttcctgtggcagagctaccaggtgaagaagaggcagatggacatcaagaatgaccacaagaacaatgaaaggctgctcttccatggaacagatgctgacagcgtgccctacgtgaaccagcacggcttcaacagaagctgtgccggcaagaatgctgtgtcctatggcaagggcacctactttgctgtggatgccagctacagcgccaaggacacctacagcaagccagacagcaatggaaggaagcacatgtatgtggtgcgggtgctgactggagtcttcaccaagggccgggccggcctggtgaccccaccacccaagaacccccacaaccccacagacctgtttgattctgtgaccaacaacaccaggagccccaagctgtttgtggtgttctttgacaaccaggcctacccagagtacctgatcaccttcaccgcctag

SEQ ID NO: 164517 - DNA, 2037 bp, Artificial Sequence
  Description of Artificial Sequence: Synthetic coding sequence
atggccgcccctggccccctgcctgctgctgccctgagccctggggcccccaccccccgggagctgatgcacggcgtggccggcgtgaccagcagagctggccgggaccgggaggccggctctgtgctgcctgctggcaacagaggagccaggaaggccagcagaagaagcagcagccgctccatgagccgggacaacaagttcagcaagaaggactgcctgagcatcagaaatgtggtggccagcatccagaccaaggagggcctgaacctgaagctgatctctggagatgtgctgtacatctgggcagatgtgattgtgaacagcgtgcccatgaacctgcagctgggcggcggccccctgagccgggccttcctgcagaaggccggccccatgctgcagaaggagctggatgacagaagaagagaaacagaggagaaggtgggcaacatcttcatgaccagcggctgcaacctggactgcaaggctgtgctgcatgctgtggccccctactggaacaacggggctgagacctcctggcagatcatggccaacatcatcaagaagtgcctgaccaccgtggaggtgctgtccttcagcagcatcaccttccccatgattggaacaggcagcctgcagttccccaaggctgtgtttgccaagctgatcctgtctgaggtgtttgagtacagcagcagcacccggcccatcaccagccccctgcaggaggtgcacttcctggtgtacaccaatgatgatgagggctgccaggccttcctggatgagttcaccaactggagccgcatcaaccccaacaaggcccgcatccccatggccggggacacccagggcgtggtgggcaccgtgtccaagccctgcttcaccgcctatgagatgaagattggagccatcaccttccaggtggccaccggggacatcgccacagagcaggtggatgtgattgtgaacagcacagcccggaccttcaacaggaagtctggagtgtcccgggccatcctggagggcgccggccaggccgtggagagtgaatgtgctgtgctggccgcccagccccaccgggacttcatcatcacccctgggggctgcctgaagtgcaagatcatcatccacgtgcctgggggcaaggatgtgaggaagacagtgacctctgtgctggaggagtgtgagcagaggaagtacacctctgtgtccctgcctgccatcggcactggaaatgccggcaagaaccccatcaccgtggccgacaacatcattgatgccatcgtggacttcagcagccagcacagcacccccagcctgaagacagtgaaggtggtgatcttccagcctgagctgctgaacatcttctatgacagcatgaagaagagggacctgagcgccagcctgaacttccagagcaccttctccatgaccacctgcaacctgcctgagcactggacagacatgaaccaccagctgttctgcatggtgcagctggagcccggccagagcgagtacaacaccatcaaggacaagttcaccaggacctgcagcagctatgccatcgagaagattgagcgcatccagaatgccttcctgtggcagagctaccaggtgaagaagaggcagatggacatcaagaatgaccacaagaacaatgaaaggctgctcttccatggaacagatgctgacagcgtgccctacgtgaaccagcacggcttcaacagaagctgtgccggcaagaatgctgtgtcctatggcaagggcacctactttgctgtggatgccagctacagcgccaaggacacctacagcaagccagacagcaatggaaggaagcacatgtatgtggtgcgggtgctgactggagtcttcaccaagggccgggccggcctggtgaccccaccacccaagaacccccacaaccccacagacctgtttgattctgtgaccaacaacaccaggagccccaagctgtttgtggtgttctttgacaaccaggcctacccagagtacctgatcaccttcaccgcctag

SEQ ID NO: 164518 - DNA, 1278 bp, Artificial Sequence
  Description of Artificial Sequence: Synthetic coding sequence
atgaagcacacagccttcctggatgagttcaccaactggagccgcatcaaccccaacaaggcccgcatccccatggccggggacacccagggcgtggtgggcaccgtgtccaagccctgcttcaccgcctatgagatgaagatcggggccatcaccttccaggtggccactggagacatcgccacagagcaggtggatgtgattgtgaacagcacagcccggaccttcaacaggaagagcggcgtgtcccgggccatcctggagggcgccggccaggccgtggagagtgaatgtgctgtgctggccgcccagccccaccgggacttcatcatcaccccaggcggctgcctgaagtgcaagatcatcatccacgtgcctgggggcaaggatgtgaggaagacagtgacctctgtgctggaggagtgtgagcagaggaagtacacctctgtgtccctgcctgccatcggcactggaaatgctgggaagaaccccatcaccgtggccgacaacatcattgatgccatcgtggacttcagcagccagcacagcacccccagcctgaagacagtgaaggtggtgatcttccagcctgagctgctgaacatcttctatgacagcatgaagaagagggacctgagcgccagcctgaacttccagagcaccttctccatgaccacctgcaacctgcctgagcactggacagacatgaaccaccagctgttctgcatggtgcagctggagcccggccagagcgagtacaacaccatcaaggacaagttcaccaggacctgcagcagctatgccatcgagaagattgaaagaatccagaatgccttcctgtggcagagctaccaggtgaagaagaggcagatggacatcaagaatgaccacaagaacaatgaaaggctgctcttccacggcacagatgctgacagcgtgccctacgtgaaccagcacggcttcaacagaagctgtgccggcaagaatgctgtgtcctatggcaagggcacctactttgctgtggatgccagctacagcgccaaggacacctacagcaagccagacagcaatggaaggaagcacatgtatgtggtgcgggtgctgactggagtcttcaccaagggccgggccggcctggtgaccccaccacccaagaacccccacaaccccacagacctgtttgacagcgtgaccaacaacaccaggagccccaagctgtttgtggtgttctttgacaaccaggcctacccagagtacctgatcaccttcaccgcctag

SEQ ID NO: 164519 - DNA, 2565 bp, Artificial Sequence
  Description of Artificial Sequence: Synthetic coding sequence
atggacttctccatggtggccggggccgccgcctacaatgagaagagcggccgcatcaccagcctgagcctgctcttccagaaggtgtttgcccagatcttcccccagtggaggaaaggaaacacagaggagtgcctgccctacaagtgcagcgagactggagccctgggggagaactacagctggcagatccccatcaaccacaatgacttcaagatcctgaagaacaatgaaaggcagctgtgtgaggtgctgcagaacaagtttggctgcatcagcaccctggtgtcccctgtgcaggagggcaacagcaagagcctgcaggtgttcaggaagatgctgaccccccgcatcgagctgtctgtgtggaaggatgacctgaccacccatgctgtggatgctgtggtgaatgctgccaatgaagacctgctgcatggaggcggcctggccctggccctggtgaaggccggcggctttgagatccaggaggagagcaagcagtttgtggcccgctatggcaaggtgtctgctggggagattgctgtgactggagctggccgcctgccctgcaagcagatcatccatgctgtgggcccccgctggatggagtgggacaagcagggctgcaccgggaagctgcagagggccatcgtgtccatcctgaactacgtgatctacaagaacacccacatcaagacagtggccatcccagccctgagcagcggcatcttccagttccccctgaacctgtgcaccaagaccatcgtggagaccatccgggtgtccctgcagggcaagcccatgatgagcaacctgaaggagatccacctggtgtccaatgaagaccccaccgtggccgccttcaaggccgccagcgagttcatcctgggcaagtctgagctgggccaggagaccacccccagcttcaatgccatggtggtgaacaacctgaccctgcagatcgtgcagggccacatcgagtggcagacagcagatgtgattgtgaacagcgtgaacccccatgacatcaccgtgggccctgtggccaagagcatcctgcagcaggccggcgtggagatgaagtctgagttcctggccaccaaggccaagcagttccagaggagccagctggtgctggtgaccaagggcttcaacctcttctgcaagtacatctaccacgtgctgtggcacagcgagttccccaagccccagatcctgaagcacgccatgaaggagtgcctggagaagtgcatcgagcagaacatcaccagcatctccttccctgccctgggcaccggcaacatggagatcaagaaggagacagctgctgagatcctgtttgatgaggtgctgacctttgccaaggaccacgtgaagcaccagctgactgtgaagtttgtgatcttccccacagacctggagatctacaaggccttcagcagcgagatggccaagaggagcaagatgctgagcctgaacaactacagcgtgccccagagcacccgggaggagaagagagaaaatggcctggaggcccggagccctgccatcaacctgatgggcttcaacgtggaggagatgtatgaggcccacgcctggatccagaggatcctgagcctgcagaaccaccacatcatcgagaacaaccacatcctgtacctgggcaggaaggagcatgacatcctgagccagctgcagaagaccagctctgtgtccatcacagagatcatcagccctggccgcacagagctggagattgagggcgcccgggctgacctgattgaggtggtgatgaacatcgaggacatgctgtgcaaggtgcaggaggagatggccaggaagaaggagcggggcctgtggaggagcctgggccagtggaccatccagcagcagaagacccaggatgagatgaaggagaacatcatcttcctgaagtgccctgtgccccccacccaggagctgctggaccagaagaagcagtttgagaagtgtggcctgcaggtgctgaaggtggagaagattgacaatgaggtgctgatggccgccttccagaggaagaagaagatgatggaggagaagctgcaccggcagcctgtgagccacaggctcttccagcaggtgccctaccagttctgcaatgtggtgtgccgggtgggcttccagaggatgtacagcaccccctgtgaccccaagtacggggccggcatctacttcaccaagaacctgaagaacctggccgagaaggccaagaagatctctgctgctgacaagctgatctacgtgtttgaggccgaggtgctgaccggcttcttctgccagggccaccccctgaacatcgtgcccccacccctgagccctggggccattgatggccatgacagcgtggtggacaacgtgagcagccctgagacctttgtgatcttcagcggcatgcaggccatcccccagtacctgtggacctgcacccaggagtatgtgcagagccaggactacagcagcggccccatgaggccctttgcccagcacccctggaggggctttgccagcggcagccctgtggactag

SEQ ID NO: 164520 - DNA, 2334 bp, Artificial Sequence
  Description of Artificial Sequence: Synthetic coding sequence
atgtctgtgtcctgtgtgaagagcagccgcatcagcctggccgtgtccctgccctggagcctgcagttcaggaaggccacagccaacctgtgtgtgttcaggaagatgctgaccccaagaattgagctgtctgtgtggaaggatgacctgaccacccatgctgtggatgctgtggtgaatgctgccaatgaagacctgctgcacggcggcggcctggccctggccctggtgaaggccggcggctttgagatccaggaggagagcaagcagtttgtggcccgctatggcaaggtgtctgctggggagattgctgtgactggagctggccgcctgccctgcaagcagatcatccatgctgtgggcccccgctggatggagtgggacaagcagggctgcaccgggaagctgcagagggccatcgtgtccatcctgaactacgtgatctacaagaacacccacatcaagacagtggccatcccagccctgagcagcggcatcttccagttccccctgaacctgtgcaccaagaccatcgtggagaccatccgggtgtccctgcagggcaagcccatgatgagcaacctgaaggagatccacctggtgtccaatgaagaccccaccgtggccgccttcaaggccgccagcgagttcatcctgggcaagtctgagctgggccaggagaccacccccagcttcaatgccatggtggtgaacaacctgaccctgcagatcgtgcagggccacatcgagtggcagacagcagatgtgattgtgaacagcgtgaacccccatgacatcaccgtgggccctgtggccaagagcatcctgcagcaggccggcgtggagatgaagtctgagttcctggccaccaaggccaagcagttccagaggagccagctggtgctggtgaccaagggcttcaacctcttctgcaagtacatctaccacgtgctgtggcacagcgagttccccaagccccagatcctgaagcacgccatgaaggaatgtctggagaagtgcatcgagcagaacatcaccagcatctccttccctgccctgggcactggaaacatggagatcaagaaggagacagctgctgagatcctgtttgatgaggtgctgacctttgccaaggaccacgtgaagcaccagctgactgtgaagtttgtgatcttccccacagacctggagatctacaaggccttcagcagcgagatggccaagaggagcaagatgctgagcctgaacaactacagcgtgccccagagcacccgggaggagaagcgggagaatggcctggaggcccggagccctgccatcaacctgatgggcttcaacgtggaggagatgtatgaggcccacgcctggatccagaggatcctgagcctgcagaaccaccacatcatcgagaacaaccacatcctgtacctgggcaggaaggagcatgacatcctgagccagctgcagaagaccagctctgtgtccatcacagagatcatcagccctggccgcacagagctggagattgaaggagcccgggctgacctgattgaggtggtgatgaacatcgaggacatgctgtgcaaggtgcaggaggagatggccaggaagaaggagcggggcctgtggaggagcctgggccagtggaccatccagcagcagaagacccaggatgagatgaaggagaacatcatcttcctgaagtgccctgtgccccccacccaggagctgctggaccagaagaagcagtttgagaagtgtggcctgcaggtgctgaaggtggagaagattgacaatgaggtgctgatggccgccttccagaggaagaagaagatgatggaggagaagctgcaccggcagcctgtgagccacaggctcttccagcaggtgccctaccagttctgcaatgtggtgtgccgggtgggcttccagaggatgtacagcaccccctgtgaccccaagtatggagctggcatctacttcaccaagaacctgaagaacctggccgagaaggccaagaagatctctgctgctgacaagctgatctacgtgtttgaagctgaggtgctgaccggcttcttctgccagggccaccccctgaacatcgtgcccccacccctgagccctggggccattgatggccatgattctgtggtggacaacgtgagcagccctgagaccttcgtcatcttcagcggcatgcaggccatcccccagtacctgtggacctgcacccaggagtatgtgcagagccaggactacagcagcggccccatgaggccctttgcccagcacccctggaggggctttgccagcggcagccctgtggactag

SEQ ID NO: 164521 - DNA, 2460 bp, Artificial Sequence; identical to SEQ ID NO: 164508
  Description of Artificial Sequence: Synthetic coding sequence

SEQ ID NO: 164522 - DNA, 1440 bp, Artificial Sequence
  Description of Artificial Sequence: Synthetic coding sequence
atgtctgatggctttgaccgggcccctggagctggccggggccgcagccggggcctgggccggggcggcggcggccctgagggcggcggcttccccaatggagctggccctgctgagcgggcccggcaccagcccccccagcccaaggcccctggcttcctgcagcccccacccctgcggcagcccaggaccaccccacctcctggggcccagtgtgaggtgcctgccagcccccagaggcccagcaggcctggggccctgcctgagcagacccggcccctgcgggccccacccagcagccaggacaagatcccccagcagaacagcgagagcgccatggccaagccccaggtggtggtggcccctgtgctgatgagcaagctgtctgtgaatgcccctgagttctaccccagcggctacagcagcagctacacagagagctatgaagatggctgtgaggactaccccaccctgtctgaatatgtgcaggacttcctgaaccacctgacagagcagcccggcagctttgaaacagaaattgagcagtttgctgagaccctgaatggctgtgtgaccacagatgatgccctgcaggagctggtggagctgatctaccagcaggccaccagcatccccaacttctcctacatgggcgcccggctgtgcaactacctgagccaccacctgaccatcagcccccagagcggcaacttccggcagctgctgctgcagcgctgcaggacagaatatgaggtgaaggaccaggccgccaagggagatgaggtgaccaggaagcgcttccacgcctttgtgctcttcctgggggagctgtacctgaacctggagatcaagggcaccaacggccaggtgaccagggctgacatcctgcaggtgggcctgcgggagctgctgaatgccctcttcagcaaccccatggatgacaacctgatctgtgctgtgaagctgctgaagctgaccggctctgtgctggaggatgcctggaaggagaagggcaagatggacatggaggagatcatccagagaattgaaaatgtggtgctggatgccaactgcagcagagatgtgaagcagatgctgctgaagctggtggagctgcggagcagcaactggggccgggtgcacgccaccagcacctaccgggaggccaccccagaaaatgaccccaactacttcatgaatgagcccaccttctacaccagtgatggagtgcccttcaccgctgctgaccctgactaccaggagaagtaccaggagctgctggagcgggaggacttcttcccagactatgaggagaatggaacagacctgagcggggccggggacccctacctggatgacattgatgatgagatggaccctgagattgaggaggcctatgagaagttctgcctggagagcgagaggaagaggaagcagtag

SEQ ID NO: 164523 - DNA, 1104 bp, Artificial Sequence
  Description of Artificial Sequence: Synthetic coding sequence
atggccaagccccaggtggtggtggcccctgtgctgatgagcaagctgtctgtgaatgcccctgagttctaccccagcggctacagcagcagctacacagagagctatgaagatggctgtgaggactaccccaccctgtctgaatatgtgcaggacttcctgaaccacctgacagagcagcccggcagctttgaaacagaaattgagcagtttgctgagaccctgaatggctgtgtgaccacagatgatgccctgcaggagctggtggagctgatctaccagcaggccaccagcatccccaacttctcctacatgggcgcccggctgtgcaactacctgagccaccacctgaccatcagcccccagagcggcaacttccggcagctgctgctgcagcgctgcaggacagaatatgaggtgaaggaccaggccgccaagggagatgaggtgaccaggaagcgcttccacgcctttgtgctcttcctgggggagctgtacctgaacctggagatcaagggcaccaacggccaggtgaccagggctgacatcctgcaggtgggcctgcgggagctgctgaatgccctcttcagcaaccccatggatgacaacctgatctgtgctgtgaagctgctgaagctgaccggctctgtgctggaggatgcctggaaggagaagggcaagatggacatggaggagatcatccagagaattgaaaatgtggtgctggatgccaactgcagcagagatgtgaagcagatgctgctgaagctggtggagctgcggagcagcaactggggccgggtgcacgccaccagcacctaccgggaggccaccccagaaaatgaccccaactacttcatgaatgagcccaccttctacaccagtgatggagtgcccttcaccgctgctgaccctgactaccaggagaagtaccaggagctgctggagcgggaggacttcttcccagactatgaggagaatggaacagacctgagcggggccggggacccctacctggatgacattgatgatgagatggaccctgagattgaggaggcctatgagaagttctgcctggagagcgagaggaagaggaagcagtag

SEQ ID NO: 164524 - DNA, 1203 bp, Artificial Sequence
  Description of Artificial Sequence: Synthetic coding sequence
atgtctgatggctttgaccgggcccctgagcagacccggcccctgcgggccccacccagcagccaggacaagatcccccagcagaacagcgagagcgccatggccaagccccaggtggtggtggcccctgtgctgatgagcaagctgtctgtgaatgcccctgagttctaccccagcggctacagcagcagctacacagagagctatgaagatggctgtgaggactaccccaccctgtctgaatatgtgcaggacttcctgaaccacctgacagagcagcccggcagctttgaaacagaaattgagcagtttgctgagaccctgaatggctgtgtgaccacagatgatgccctgcaggagctggtggagctgatctaccagcaggccaccagcatccccaacttctcctacatgggcgcccggctgtgcaactacctgagccaccacctgaccatcagcccccagagcggcaacttccggcagctgctgctgcagcgctgcaggacagaatatgaggtgaaggaccaggccgccaagggagatgaggtgaccaggaagcgcttccacgcctttgtgctcttcctgggggagctgtacctgaacctggagatcaagggcaccaacggccaggtgaccagggctgacatcctgcaggtgggcctgcgggagctgctgaatgccctcttcagcaaccccatggatgacaacctgatctgtgctgtgaagctgctgaagctgactggatctgtgctggaggatgcctggaaggagaagggcaagatggacatggaggagatcatccagagaattgaaaatgtggtgctggatgccaactgcagcagagatgtgaagcagatgctgctgaagctggtggagctgcggagcagcaactggggccgggtgcacgccaccagcacctaccgggaggccaccccagaaaatgaccccaactacttcatgaatgagcccaccttctacaccagtgatggagtgcccttcaccgctgctgaccctgactaccaggagaagtaccaggagctgctggagcgggaggacttcttcccagactatgaagaaaatggaacagacctgtctggagctggggacccctacctggatgacattgatgatgagatggaccctgagattgaggaggcctatgagaagttctgcctggagagcgagaggaagaggaagcagtag

SEQ ID NO: 164525 - DNA, 507 bp, Artificial Sequence
  Description of Artificial Sequence: Synthetic coding sequence
atggccaagccccaggtggtggtggcccctgtgctgatgagcaagctgtctgtgaatgcccctgagttctaccccagcggctacagcagcagctacacagagagctatgaagatggctgtgaggactaccccaccctgtctgaatatgtgcaggacttcctgaaccacctgacagagcagcccggcagctttgaaacagaaattgagcagtttgctgagaccctgaatggctgtgtgaccacagatgatgccctgcaggagctggtggagctgatctaccagcaggccaccagcatccccaacttctcctacatgggcgcccggctgtgcaactacctgagccaccacctgaccatcagcccccagagcggcaacttccggcagctgctgctgcagcgctgcaggacagaatatgaggtgaaggaccaggccgccaagggagatgaggtgaccaggaagcgcttccacgcctttgtgctcttcctgggggagctgtacctgaactag

SEQ ID NO: 164526 - DNA, 603 bp, Artificial Sequence
  Description of Artificial Sequence: Synthetic coding sequence
atggccaagccccaggtggtggtggcccctgtgctgatgagcaagctgtctgtgaatgcccctgagttctaccccagcggctacagcagcagctacacagagagctatgaagatggctgtgaggactaccccaccctgtctgaatatgtgcaggacttcctgaaccacctgacagagcagcccggcagctttgaaacagaaattgagcagtttgctgagaccctgaatggctgtgtgaccacagatgatgccctgcaggagctggtggagctgatctaccagcaggccaccagcatccccaacttctcctacatgggcgcccggctgtgcaactacctgagccaccacctgaccatcagcccccagagcggcaacttccggcagctgctgctgcagcgctgcaggacagaatatgaggtgaaggaccaggccgccaagggagatgaggtgaccaggaagcgcttccacgcctttgtgctcttcctgggggagctgtacctgaacctggagatcaagggcaccaacggccaggtgaccagggctgacatcctgcaggtgggcctgcgggagctgctgaatgccctcttcagcaaccccatgtag

SEQ ID NO: 164527 - DNA, 1056 bp, Artificial Sequence
  Description of Artificial Sequence: Synthetic coding sequence
atgtctgatggctttgaccgggcccctgagcagacccggcccctgcgggccccacccagcagccaggacaagatcccccagcagaacagcgagagcgccatggccaagccccaggtggtggtggcccctgtgctgatgagcaagctgtctgtgaatgcccctgagttctaccccagcggctacagcagcagctacacagagagctatgaagatggctgtgaggactaccccaccctgtctgaatatgtgcaggacttcctgaaccacctgacagagcagcccggcagctttgaaacagaaattgagcagtttgctgagaccctgaatggctgtgtgaccacagatgatgccctgcaggagctggtggagctgatctaccagcaggccaccagcatccccaacttctcctacatgggcgcccggctgtgcaactacctgagccaccacctgaccatcagcccccagagcggcaacttccggcagctgctgctgcagcgctgcaggacagaatatgaggtgaaggaccaggccgccaagggagatgaggtgaccaggaagcgcttccacgcctttgtgctcttcctgggggagctgtacctgaacctggagatcaagggcaccaacggccaggtgaccagggctgacatcctgcaggtgggcctgcgggagctgctgaatgccctcttcagcaaccccatggatgacaacctgatctgtgctgtgaagctgctgaagctgactggatctgtgctggaggatgcctggaaggagaagggcaagatggacatggaggagatcatccagagaattgaaaatgtggtgctggatgccaactgcagcagagatgtgaagcagatgctgctgaagctggtggagctgcggagcagcaactggggccgggtgcacgccaccagcacctaccgggaggccaccccagaaaatgaccccaactacttcatgaatgagcccaccttctacaccagtgatggagtgcccttcaccgctgctgaccctgacacctggatgatcctgatgatgcgctggacccagaggtag

SEQ ID NO: 164528 - DNA, 288 bp, Artificial Sequence
  Description of Artificial Sequence: Synthetic coding sequence
atggccaagccccaggtggtggtggcccctgtgctgatgagcaagctgtctgtgaatgcccctgagttctaccccagcggctacagcagcagctacacagagagctatgaagatggctgtgaggactaccccaccctgtctgaatatgtgcaggacttcctgaaccacctgacagagcagcccggcagctttgaaacagaaattgagcagtttgctgagaccctgaatggctgtgtgaccacagatgatgccctgcaggagctggtggagctgatctaccagcagtag

SEQ ID NO: 164529 - DNA, 384 bp, Artificial Sequence
  Description of Artificial Sequence: Synthetic coding sequence
atgaaggaccccagccgcagcagcaccagccccagcatcatcaatgaagatgtgatcatcaatggccacagccatgaagatgacaacccctttgctgagtacatgtggatggagaatgaggaggagttcaaccggcagatcgaggaggagctgtgggaggaggagttcatcgagcgctgcttccaggagatgctggaggaggaggaggagcacgagtggttcatcccagcccgggacctgccccagaccatggaccagatccaggaccagttcaatgacctggtgatcagtgatggcagcagcctggaggacctggtggtgaagagcaacctgaaccccaatgccaaggagtttgtgcctggggtgaagtatggcaacatctag

SEQ ID NO: 164530 - DNA, 384 bp, Artificial Sequence; identical to SEQ ID NO: 164529
  Description of Artificial Sequence: Synthetic coding sequence

SEQ ID NO: 164531 - DNA, 282 bp, Artificial Sequence
  Description of Artificial Sequence: Synthetic coding sequence
atgaaggaccccagccgcagcagcaccagccccagcatcatcaatgaagatgtgatcatcaatggccacagccatgaagatgacaacccctttgctgagtacatgtggatggagaatgaggaggagttcaaccggcagatcgaggaggagctgtgggaggaggagttcatcgagcgctgcttccaggagatgctggaggaggaggaggagcacgagtggttcatcccagcccgggacctgccccagaccatggaccagatccaggaccagttcaatgactag

SEQ ID NO: 164532 - DNA, 384 bp, Artificial Sequence; identical to SEQ ID NO: 164529
  Description of Artificial Sequence: Synthetic coding sequence

SEQ ID NO: 164533 - DNA, 372 bp, Artificial Sequence
  Description of Artificial Sequence: Synthetic coding sequence
atgaatggcagcaacatggccaacaccagccccagcgtgaagagcaaagaagaccagggcctgagcggccatgatgagaaggagaacccctttgctgagtacatgtggatggagaatgaggaggacttcaaccggcaggtggaggaggagctgcaggagcaggacttcctggaccgctgcttccaggagatgctggatgaggaggaccaggactggttcatccccagccgggacctgccccaggccatgggccagctgcagcagcagctgaatggcctgtctgtgtctgagggccatgattctgaggacatcctgagcaagagcaacctgaacccagatgccaaggagttcatccctggagagaagtactag

SEQ ID NO: 164534 - DNA, 1896 bp, Artificial Sequence
  Description of Artificial Sequence: Synthetic coding sequence
atgaaccccagcacccccagctaccccacagccagcctgtatgtgggggacctgcacccagatgtgacagaggccatgctgtatgagaagttctccccagctggccccatcctgagcatccgcatctgccgggacctgatcaccagcggcagcagcaactatgcctacgtgaacttccagcacaccaaggatgctgagcacgccctggacaccatgaactttgatgtgatcaagggcaagcctgtgcgcatcatgtggagccagagggaccccagcctgaggaagagcggcgtgggcaacatctttgtgaagaacctggacaagagcatcaacaacaaggccctgtatgacacagtgtctgccttcggcaacatcctgagctgcaatgtggtgtgtgatgaaaatggcagcaagggctacggctttgtgcactttgagacccatgaggccgctgagcgggccatcaagaagatgaatggcatgctgctgaatggaaggaaggtgtttgtgggccagttcaagagcaggaaggagcgggaggccgagctgggcgcccgggccaaggagttccccaacgtgtacatcaagaactttggagaggacatggatgatgagcggctgaaggacctgtttgggaagtttggacctgccctgtctgtgaaggtgatgacagatgaaagtggcaagagcaaaggatttggatttgtgtcctttgaaagacatgaagatgcccagaaggctgtggatgagatgaatggcaaggagctgaatggcaagcagatctacgtgggccgggcccagaagaaggtggagcggcagacagagctgaagaggacctttgagcagatgaagcaggaccgcatcacccgctaccaggtggtgaacctgtatgtgaagaacctggatgatggcattgatgatgagcggctgaggaaggccttcagccccttcggcaccatcaccagcgccaaggtgatgatggagggcggccgcagcaaaggatttggatttgtgtgcttcagcagccctgaggaggccaccaaggctgtgacagagatgaatggaagaattgtggccaccaagcccctgtatgtggccctggcccagaggaaggaggagcggcaggcctacctgaccaatgagtacatgcagaggatggcctctgtgcgggctgtgcccaaccagagggccccacccagcggctacttcatgacagctgtgccccagacccagaaccacgccgcctactacccacccagccagatcgcccggctgcggcccagcccccgctggacagcccagggcgcccggccccaccccttccagaacaagcccagcgccatccggcctggggccccccgggtgcccttcagcaccatgaggcctgccagcagccaggtgccccgggtgatgagcacccagagggtggccaacaccagcacccagacagtgggccccaggcctgctgctgctgctgctgctgctgccaccccagctgtgaggacagtgccccgctacaagtatgctgctggggtgaggaacccccagcagcacagaaatgcccagccccaggtgaccatgcagcagctggccgtgcacgtgcagggccaggagaccctgacagccagccggctggccagcgccccaccccagaagcagaagcagatgctgggggagcggctcttccccctcatccaggccatgcaccccaccctggccggcaagatcaccggcatgctgctggagattgacaacagcgagctgctgtacatgctggagagccctgagagcctgcggagcaaggtggatgaagctgtggccgtgctgcaggcccaccaggccaaggaggccacccagaaggctgtgaacagcgccaccggggtgcccaccgtgtag

SEQ ID NO: 164535 - DNA, 1896 bp, Artificial Sequence
  Description of Artificial Sequence: Synthetic coding sequence
atgaatgctgctgccagcagctaccccatggccagcctgtatgtgggggacctgcacagtgatgtgacagaggccatgctgtatgagaagttctccccagctggccctgtgctgagcatccgggtgtgccgggacatgatcaccaggaggagcctgggctacgcctacgtgaacttccagcagcctgcagatgctgagcgggccctggacaccatgaactttgatgtgatcaagggcaagcccatccgcatcatgtggagccagagggaccccagcctgaggaagagcggcgtgggcaatgtgttcatcaagaacctggacaagagcattgacaacaaggccctgtatgacaccttcagcgccttcggcaacatcctgagctgcaaggtggtgtgtgatgaaaatggcagcaagggctacgcctttgtgcactttgagacccaggaggccgctgacaaggccatcgagaagatgaatggcatgctgctgaatgacaggaaggtgtttgtgggccgcttcaagagcaggaaggagcgggaggccgagctgggcgccaaggccaaggagttcaccaacgtgtacatcaagaactttggagaggaggtggatgatgagagcctgaaggagctgttcagccagtttgggaagaccctgtctgtgaaggtgatgagggaccccaacgggaagagcaaaggatttggatttgtgtcctatgagaagcatgaagatgccaacaaggctgtggaggagatgaatggcaaggagatcagcggcaagatcatctttgtgggccgggcccagaagaaggtggagcggcaggccgagctgaagaggaagtttgagcagctgaagcaggagcgcatcagccgctaccagggcgtgaacctgtacatcaagaacctggatgacaccattgatgatgagaagctgaggaaggagttcagccccttcggcagcatcaccagcgccaaggtgatgctggaggatggccgcagcaaaggatttggatttgtgtgcttcagcagccctgaggaggccaccaaggctgtgacagagatgaatggaagaattgtgggcagcaagcccctgtatgtggccctggcccagaggaaggaggagaggaaggcccacctgaccaaccagtacatgcagagggtggccggcatgagggccctgcctgccaatgccatcctgaaccagttccagcctgctgctgggggctactttgtgcctgctgtgccccaggcccagggccggcccccctactacacccccaaccagctggcccagatgaggcccaacccccgctggcagcagggcggccggccccagggcttccagggcatgcccagcgccatccggcagagcggcccccggcccaccctgcggcacctggcccccactggaaatgccccagccagccggggcctgcccaccaccacccagagggtgggcgtgcccacagctgtgcagaacctggcccccagggctgctgtggccgccgccgcccccagggctgtggccccctacaagtatgccagctctgtgcgcagcccccacccagccatccagcccctgcaggccccccagcctgctgtgcacgtgcagggccaggagcccctgacagcctccatgctggccgccgccccaccccaggagcagaagcagatgctgggggagcggctcttccccctcatccagaccatgcacagcaacctggccggcaagatcaccggcatgctgctggagattgacaacagcgagctgctgcacatgctggagagccctgagagcctgcggagcaaggtggatgaggccgtggccgtgctgcaggcccaccacgccaagaaggaggccgcccagaaggtgggcgctgtggccgccgccaccagctag

SEQ ID NO: 164536 - DNA, 1935 bp, Artificial Sequence
  Description of Artificial Sequence: Synthetic coding sequence
atgaatgctgctgccagcagctaccccatggccagcctgtatgtgggggacctgcacagtgatgtgacagaggccatgctgtatgagaagttctccccagctggccctgtgctgagcatccgggtgtgccgggacatgatcaccaggaggagcctgggctacgcctacgtgaacttccagcagcctgcagatgctgagcgggccctggacaccatgaactttgatgtgatcaagggcaagcccatccgcatcatgtggagccagagggaccccagcctgaggaagagcggcgtgggcaatgtgttcatcaagaacctggacaagagcattgacaacaaggccctgtatgacaccttcagcgccttcggcaacatcctgagctgcaaggtggtgtgtgatgaaaatggcagcaagggctacgcctttgtgcactttgagacccaggaggccgctgacaaggccatcgagaagatgaatggcatgctgctgaatgacaggaaggtgtttgtgggccgcttcaagagcaggaaggagcgggaggccgagctgggcgccaaggccaaggagttcaccaacgtgtacatcaagaactttggagaggaggtggatgatgagagcctgaaggagctgttcagccagtttgggaagaccctgtctgtgaaggtgatgagggaccccaacgggaagagcaaaggatttggatttgtgtcctatgagaagcatgaagatgccaacaaggctgtggaggagatgaatggcaaggagatcagcggcaagatcatctttgtgggccgggcccagaagaaggtggagcggcaggccgagctgaagaggaagtttgagcagctgaagcaggagcgcatcagccgctaccagggcgtgaacctgtacatcaagaacctggatgacaccattgatgatgagaagctgaggaaggagttcagccccttcggcagcatcaccagcgccaaggtgatgctggaggatggccgcagcaaaggatttggatttgtgtgcttcagcagccctgaggaggccaccaaggctgtgacagagatgaatggaagaattgtgggcagcaagcccctgtatgtggccctggcccagaggaaggaggagaggaaggcccacctgaccaaccagtacatgcagagggtggccggcatgagggccctgcctgccaatgccatcctgaaccagttccagcctgctgctgggggctactttgtgcctgctgtgccccaggcccagggccggcccccctactacacccccaaccagctggcccagatgaggcccaacccccgctggcagcagggcggccggccccagggcttccagggcatgcccagcgccatccggcagagcggcccccggcccaccctgcggcacctggcccccaccggctctgaatgtcctgaccggctggccatggactttggaggagctggagctgcccagcagggcctgacagacagctgccagagcggcggcgtgcccacagctgtgcagaacctggcccccagggctgctgtggccgctgctgcccccagggctgtggccccctacaagtatgccagctctgtgcgcagcccccacccagccatccagcccctgcaggccccccagcctgctgtgcacgtgcagggccaggagcccctgacagcctccatgctggccgccgccccaccccaggagcagaagcagatgctgggggagcggctcttccccctcatccagaccatgcacagcaacctggccggcaagatcaccggcatgctgctggagattgacaacagcgagctgctgcacatgctggagagccctgagagcctgcggagcaaggtggatgaagctgtggccgtgctgcaggcccaccacgccaagaaggaggccgcccagaaggtgggcgctgtggccgccgccaccagctag

SEQ ID NO: 164537 - DNA, 1983 bp, Artificial Sequence
  Description of Artificial Sequence: Synthetic coding sequence
atgaatgctgctgccagcagctaccccatggccagcctgtatgtgggggacctgcacagtgatgtgacagaggccatgctgtatgagaagttctccccagctggccctgtgctgagcatccgggtgtgccgggacatgatcaccaggaggagcctgggctacgcctacgtgaacttccagcagcctgcagatgctgagcgggccctggacaccatgaactttgatgtgatcaagggcaagcccatccgcatcatgtggagccagagggaccccagcctgaggaagagcggcgtgggcaatgtgttcatcaagaacctggacaagagcattgacaacaaggccctgtatgacaccttcagcgccttcggcaacatcctgagctgcaaggtggtgtgtgatgaaaatggcagcaagggctacgcctttgtgcactttgagacccaggaggccgctgacaaggccatcgagaagatgaatggcatgctgctgaatgacaggaaggtgtttgtgggccgcttcaagagcaggaaggagcgggaggccgagctgggcgccaaggccaaggagttcaccaacgtgtacatcaagaactttggagaggaggtggatgatgagagcctgaaggagctgttcagccagtttgggaagaccctgtctgtgaaggtgatgagggaccccaacgggaagagcaaaggatttggatttgtgtcctatgagaagcatgaagatgccaacaaggctgtggaggagatgaatggcaaggagatcagcggcaagatcatctttgtgggccgggcccagaagaaggtggagcggcaggccgagctgaagaggaagtttgagcagctgaagcaggagcgcatcagccgctaccagggcgtgaacctgtacatcaagaacctggatgacaccattgatgatgagaagctgaggaaggagttcagccccttcggcagcatcaccagcgccaaggtgatgctggaggatggccgcagcaaaggatttggatttgtgtgcttcagcagccctgaggaggccaccaaggctgtgacagagatgaatggaagaattgtgggcagcaagcccctgtatgtggccctggcccagaggaaggaggagaggaaggcccacctgaccaaccagtacatgcagagggtggccggcatgagggccctgcctgccaatgccatcctgaaccagttccagcctgctgctgggggctactttgtgcctgctgtgccccaggcccagggccggcccccctactacacccccaaccagctggcccagatgaggcccaacccccgctggcagcagggcggccggccccagggcttccagggcatgcccagcgccatccggcagagcggcccccggcccaccctgcggcacctggcccccactggaaatgccccagccagccggggcctgcccaccaccacccagagggtgggctctgaatgtcctgaccggctggccatggactttggaggagctggagctgcccagcagggcctgacagacagctgccagagcggcggcgtgcccacagctgtgcagaacctggcccccagggctgctgtggccgctgctgcccccagggctgtggccccctacaagtatgccagctctgtgcgcagcccccacccagccatccagcccctgcaggccccccagcctgctgtgcacgtgcagggccaggagcccctgacagcctccatgctggccgccgccccaccccaggagcagaagcagatgctgggggagcggctcttccccctcatccagaccatgcacagcaacctggccggcaagatcaccggcatgctgctggagattgacaacagcgagctgctgcacatgctggagagccctgagagcctgcggagcaaggtggatgaagctgtggccgtgctgcaggcccaccacgccaagaaggaggccgcccagaaggtgggcgctgtggccgccgccaccagctag

SEQ ID NO: 164538 - DNA, 390 bp, Artificial Sequence
  Description of Artificial Sequence: Synthetic coding sequence
atgaatgctgctgccagcagctaccccatggccagcctgtatgtgggggacctgcacagtgatgtgacagaggccatgctgtatgagaagttctccccagctggccctgtgctgagcatccgggtgtgccgggacatgatcaccaggaggagcctgggctacgcctacgtgaacttccagcagcctgcagatgctgagcgggccctggacaccatgaactttgatgtgatcaagggcaagcccatccgcatcatgtggagccagagggaccccagcctgaggaagagcggcgtgggcaatgtgttcatcaagaacctggacaagagcattgacaacaaggccctgtatgacaccttcagcgccttcggcaacatcctgagctgcaagtag

SEQ ID NO: 164539 - DNA, 207 bp, Artificial Sequence
  Description of Artificial Sequence: Synthetic coding sequence
tgactcatccagaccatgcacagcaacctggccggcaagatcaccggcatgctgctggagattgacaacagcgagctgctgcacatgctggagagccctgagagcctgcggagcaaggtggatgaagctgtggccgtgctgcaggcccaccacgccaagaaggaggccgcccagaaggtgggcgctgtggccgccgccaccagctag

SEQ ID NO: 164540 - DNA, 120 bp, Artificial Sequence
  Description of Artificial Sequence: Synthetic coding sequence
atgaatgctgctgccagcagctaccccatggccagcctgtatgtgggggacctgcacagtgatgtgacagaggccatgctgtatgagaagttctccccagctggccctgtgctgtcctag

SEQ ID NO: 164541 - DNA, 1149 bp, Artificial Sequence
  Description of Artificial Sequence: Synthetic coding sequence
atgggcagcggggagcccaacccagctgggaagaagaagaagtacctgaaggccgccctgtatgtgggggacctggaccctgatgtgacagaggacatgctgtacaagaagttccggcctgctggccccctgcgcttcacccgcatctgccgggaccctgtgaccaggagccccctgggctacggctacgtgaacttccgcttcccagcagatgctgagtgggccctgaacaccatgaactttgacctgatcaatggcaagcccttccggctgatgtggagccagccagatgaccggctgaggaagtctggagtgggcaacatcttcatcaagaacctggacaagagcattgacaacagagccctcttctacctgttcagcgcctttggaaacatcctgagctgcaaggtggtgtgtgatgacaatggcagcaagggctacgcctacgtgcactttgacagcctggccgccgccaacagagccatctggcacatgaatggagtgcggctgaacaaccggcaggtgtatgtgggccgcttcaagtttcctgaggagagagctgctgaggtgaggacccgggaccgggccaccttcaccaacgtgtttgtgaagaacattggagatgacattgatgatgagaagctgaaggagctgttctgtgaatatggccccacagaatctgtgaaggtgatcagagatgccagcggcaagagcaaaggatttggatttgtgcgctatgagacccatgaagctgcccagaaggctgtgctggacctgcacggcaagagcattgatggcaaggtgctgtatgtgggccgggcccagaagaagattgaaaggctggccgagctgcggaggagatttgagcggctgcggctgaaggagaagagcaggcctcctggggtgcccatctacatcaagaacctggatgagaccatcaatgatgagaagctgaaggaggagttcagcagctttggcagcatcagccgggccaaggtgatgatggaggtgggccagggcaaaggatttggagtggtgtgcttcagcagctttgaggaggccaccaaggctgtggatgagatgaatggaagaattgtgggcagcaagcccctgcacgtgaccctgggccaggcccggcggcgctgctag

SEQ ID NO: 164542 - DNA, 657 bp, Artificial Sequence
  Description of Artificial Sequence: Synthetic coding sequence
atgaatggagtgcggctgaacaaccggcaggtgtatgtgggccgcttcaagtttcctgaggagagagctgctgaggtgaggacccgggaccgggccaccttcaccaacgtgtttgtgaagaacattggagatgacattgatgatgagaagctgaaggagctgttctgtgaatatggccccacagaatctgtgaaggtgatcagagatgccagcggcaagagcaaaggatttggatttgtgcgctatgagacccatgaagctgcccagaaggctgtgctggacctgcacggcaagagcattgatggcaaggtgctgtatgtgggccgggcccagaagaagattgaaaggctggccgagctgcggaggagatttgagcggctgcggctgaaggagaagagcaggcctcctggggtgcccatctacatcaagaacctggatgagaccatcaatgatgagaagctgaaggaggagttcagcagctttggcagcatcagccgggccaaggtgatgatggaggtgggccagggcaaaggatttggagtggtgtgcttcagcagctttgaggaggccaccaaggctgtggatgagatgaatggaagaattgtgggcagcaagcccctgcacgtgaccctgggccaggcccggcggcgctgctag

SEQ ID NO: 164543 - DNA, 1053 bp, Artificial Sequence
  Description of Artificial Sequence: Synthetic coding sequence
atgctgtacaagaagttccggcctgctggccccctgcgcttcacccgcatctgccgggaccctgtgaccaggagccccctgggctacggctacgtgaacttccgcttcccagcagatgctgagtgggccctgaacaccatgaactttgacctgatcaatggcaagcccttccggctgatgtggagccagccagatgaccggctgaggaagtctggagtgggcaacatcttcatcaagaacctggacaagagcattgacaacagagccctcttctacctgttcagcgcctttggaaacatcctgagctgcaaggtggtgtgtgatgacaatggcagcaagggctacgcctacgtgcactttgacagcctggccgccgccaacagagccatctggcacatgaatggagtgcggctgaacaaccggcaggtgtatgtgggccgcttcaagtttcctgaggagagagctgctgaggtgaggacccgggaccgggccaccttcaccaacgtgtttgtgaagaacattggagatgacattgatgatgagaagctgaaggagctgttctgtgaatatggccccacagaatctgtgaaggtgatcagagatgccagcggcaagagcaaaggatttggatttgtgcgctatgagacccatgaagctgcccagaaggctgtgctggacctgcacggcaagagcattgatggcaaggtgctgtatgtgggccgggcccagaagaagattgaaaggctggccgagctgcggaggagatttgagcggctgcggctgaaggagaagagcaggcctcctggggtgcccatctacatcaagaacctggatgagaccatcaatgatgagaagctgaaggaggagttcagcagctttggcagcatcagccgggccaaggtgatgatggaggtgggccagggcaaaggatttggagtggtgtgcttcagcagctttgaggaggccaccaaggctgtggatgagatgaatggaagaattgtgggcagcaagcccctgcacgtgaccctgggccaggcccggcggcgctgctag

SEQ ID NO: 164544 - DNA, 957 bp, Artificial Sequence
  Description of Artificial Sequence: Synthetic coding sequence
atgcccaagaggggcaagaagggagctgtggccgaggatggagatgagctgaggacagagcctgaggccaagaagagcaagacagctgccaagaagaatgacaaggaggccgccggggagggccctgccctgtatgaggaccccccagaccagaagaccagccccagcggcaagccagccaccctgaagatctgctcctggaatgtggatggcctgcgggcctggatcaagaagaagggcctggactgggtgaaggaggaggccccagacatcctgtgcctgcaggagaccaagtgcagcgagaacaagctgcctgctgagctgcaggagctgcccggcctgagccaccagtactggagcgcccccagcgacaaggagggctacagcggcgtgggcctgctgagccggcagtgccccctgaaggtgtcctatggaattggagatgaggagcatgaccaggagggccgggtcatcgtggccgagtttgacagctttgtgctggtgacagcctacgtgcccaatgccggccggggcctggtgcggctggagtaccggcagcgctgggatgaggccttcaggaagttcctgaagggcctggccagcaggaagcccctggtgctgtgtggggacctgaatgtggcccacgaggagattgacctgaggaaccccaagggcaacaagaagaatgccggcttcaccccccaggagcggcagggctttggagagctgctgcaggccgtgcccctggccgacagcttccgccacctgtaccccaacaccccctatgcctacaccttctggacctacatgatgaatgcccggagcaagaatgtgggctggaggctggactacttcctgctgagccacagcctgctgcctgccctgtgtgacagcaagatccgcagcaaggccctgggcagtgaccactgccccatcaccctgtacctggccctgtag

SEQ ID NO: 164545 - DNA, 891 bp, Artificial Sequence
  Description of Artificial Sequence: Synthetic coding sequence
atggctgctgctgctgctgctgctgctgctgctggagctgctgggggccggggcagcggccctggaagaagaagacacctggtgcctggagctggaggagaggccggggagggcgcccctgggggcgctggggactatggaaatggcctggagagcgaggagctggagcctgaggagctgctgctggagcctgagcctgagcctgagcctgaggaggagcccccccggccccgggcccctcctggggcccctggccctggccctggcagcggggcccctggcagccaggaggaggaggaggagcccggcctggtggagggggaccctggagatggagccattgaagatcctgagctggaggccatcaaggcccgggtgcgggagatggaggaggaggccgagaagctgaaggagctgcagaatgaggtggagaagcagatgaacatgagccccccacctggaaatgccggccctgtgatcatgagcattgaggagaagatggaggctgatgcccggagcatctacgtgggcaatgtggactatggagccacagctgaggagctggaggcccacttccacggctgcggctctgtgaacagagtgaccatcctgtgtgacaagttcagcggccaccccaagggctttgcctacatcgagttcagtgacaaggagagcgtgaggaccagcctggccctggatgagagcctcttccggggccggcagatcaaggtgatccccaagaggaccaaccggcccggcatcagcaccacagaccggggcttcccccgggcccgctaccgggcccggaccaccaactacaacagcagccgcagccgcttctacagcggcttcaacagccggccccggggccgggtgtacagaagtggatag

SEQ ID NO: 164546 - DNA, 1557 bp, Artificial Sequence
  Description of Artificial Sequence: Synthetic coding sequence
atgagctgtgtgaagctgtggcccagcggggccccagcccccctggtgtccattgaggagctggagaaccaggagctggtgggcaaaggaggcttcggcaccgtcttccgggcccagcacaggaagtggggctatgatgtggccgtgaagatcgtgaacagcaaggccatcagccgggaggtgaaggccatggccagcctggacaatgaatttgtgctgcggctggagggcgtgattgagaaggtgaactgggaccaggaccccaagccagccctggtgaccaagttcatggagaatggcagcctgagcggcctgctgcagagccagtgcccccggccctggcccctgctgtgccgcctgctgaaggaggtggtgctgggcatgttctacctgcatgaccagaaccctgtgctgctgcaccgggacctgaagcccagcaatgtgctgctggaccctgagctgcacgtgaagctggccgactttggcctgagcaccttccagggcggcagccagagcggcaccggcagcggggagcccggcggcaccctgggctacctggcccctgagctgtttgtgaatgtgaacaggaaggccagcacagccagtgatgtgtacagctttggcatcctgatgtgggccgtgctggccggccgggaggtggagctgcccacagagcccagcctggtgtatgaggccgtgtgcaaccggcagaaccggcccagcctggccgagctgccccaggccggccctgagaccccaggcctggagggcctgaaggagctgatgcagctgtgctggagcagcgagcccaaggaccggcccagcttccaggagtgcctgcccaagacagatgaggtgttccagatggtggagaacaacatgaatgctgctgtgtccacagtgaaggacttcctgagccagctgcggagcagcaacagacgcttcagcatccctgagagcggccagggcggcacagagatggatggcttccggaggaccatcgagaaccagcacagcagaaatgatgtgatggtgtctgagtggctgaacaagctgaacctggaggagccccccagctctgtgcccaagaagtgccccagcctgaccaagaggagccgggcccaggaggagcaggtgccccaggcctggacagctggcaccagcagtgacagcatggcccagcccccccagaccccagagaccagcaccttcaggaaccagatgcccagccccaccagcacaggcacccccagccctggcccccggggcaaccagggcgctgagcggcagggcatgaactggagctgcaggaccccagagcccaaccctgtgacaggccggcccctggtgaacatctacaactgcagcggcgtgcaggtgggggacaacaactacctgaccatgcagcagaccacagccctgcccacctggggcctggcccccagcggcaagggccggggcctgcagcaccccccacctgtgggcagccaggagggccccaaggaccctgaggcctggagccggccccagggctggtacaaccacagcggcaagtag

SEQ ID NO: 164547 - DNA, 2223 bp, Artificial Sequence
  Description of Artificial Sequence: Synthetic coding sequence
atgctgggccggcggggcagtgactgggccgtgcctgcccctgagaccatgcccttccctgtgaccacccagggcagccagcagacccagcccccccagaagcactacggcatcaccagccccatcagcctggccgcccccaaggagacagactgtgtgctgacccagaagctgattgagaccctgaagccctttggagtgtttgaggaggaggaggagctgcagaggcgcatcctgatcctgggcaagctgaacaacctggtgaaggagtggatccgggagatcagcgagagcaagaacctgccccagagcgtgattgaaaatgtgggcggcaagatcttcaccttcggcagctaccgcctgggcgtgcacaccaagggagctgacattgatgccctgtgtgtggcccccaggcatgtggacagaagtgacttcttcaccagcttctatgacaagctgaagctgcaggaggaggtgaaggacctgcgggctgtggaggaggcctttgtgcctgtgatcaagctgtgctttgatggcatcgagattgacatcctgtttgcccggctggccctgcagaccatccctgaggacctggacctgagagatgacagcctgctgaagaacctggacatccgctgcatccgcagcctgaatggctgccgggtgacagatgagatcctgcacctggtgcccaacatcgacaacttccggctgaccctgcgggccatcaagctgtgggccaagaggcacaacatctacagcaacatcctgggcttcctgggcggcgtgtcctgggccatgctggtggcccggacctgccagctgtacccaaatgccatcgccagcaccctggtgcacaagttcttcctggtgttcagcaagtgggagtggcccaaccctgtgctgctgaagcagcctgaggagtgcaacctgaacctgcctgtgtgggacccccgggtgaaccccagcgaccgctaccacctgatgcccatcatcaccccagcctacccccagcagaacagcacctacaacgtgtctgtgtccaccaggatggtgatggtggaggagttcaagcagggcctggccatcacagatgagatcctgctgagcaaggccgagtggagcaagctgtttgaggcccccaacttcttccagaagtacaagcactacatcgtgctgctggccagcgcccccacagagaagcagaggctggagtgggtgggcctggtggagagcaagatccgcatcctggtgggcagcctggagaagaatgagttcatcaccctggcccacgtgaacccccagagcttccctgcccccaaggagaacccagacaaggaggagttccgcaccatgtgggtgattggcctggtgttcaagaagacagaaaattctgagaacctgtctgtggacctgacctatgacatccagagcttcacagacacagtgtaccggcaggccatcaacagcaagatgtttgaggtggacatgaagattgctgccatgcacgtgaagaggaagcagctgcaccagctgctgcccaaccacgtgctgcagaagaagaagaagcacagcacagagggcgtgaagctgacagccctgaatgacagcagcctggacctgtccatggacagcgacaacagcatgtctgtgcccagccccaccagcgccaccaagaccagccccctgaacagcagcggcagcagccagggcaggaacagccctgccccagctgtgacagctgcctctgtgaccaacatccaggccacagaggtgtctgtgccccaggtgaacagcagcgagagcagcggcggcaccagcagcgagagcatcccccagacagccacccagcctgccatcagccccccacccaagcccaccgtgtcccgggtggtgagcagcacccggctggtgaaccccccacccaggagcagtggaaatgctgccaccagcggaaatgctgccaccaagatccccacccccatcgtgggcgtgaagaggaccagcagcccccacaaggaggagagccccaagaagaccaagacagaggaggagcagctggacacagagaccagcaccacccagagcgagaccatccagacagctgccagcctgctggccagccagaagaccagcagcacagacctgagtgacatcccagccctgcctgccaaccccatccctgtgatcaagaacagcatcaagctgcggctgaacagatag

SEQ ID NO: 164548 - DNA, 858 bp, Artificial Sequence
  Description of Artificial Sequence: Synthetic coding sequence
atgcccttccctgtgaccacccagggcagccagcagacccagcccccccagaagcactacggcatcaccagccccatcagcctggccgcccccaaggagacagactgtgtgctgacccagaagctgattgagaccctgaagccctttggagtgtttgaggaggaggaggagctgcagaggcgcatcctgatcctgggcaagctgaacaacctggtgaaggagtggatccgggagatcagcgagagcaagaacctgccccagagcgtgattgaaaatgtgggcggcaagatcttcaccttcggcagctaccgcctgggcgtgcacaccaagggagctgacattgatgccctgtgtgtggcccccaggcatgtggacagaagtgacttcttcaccagcttctatgacaagctgaagctgcaggaggaggtgaaggacctgcgggctgtggaggaggcctttgtgcctgtgatcaagctgtgctttgatggcatcgagattgacatcctgtttgcccggctggccctgcagaccatccctgaggacctggacctgagagatgacagcctgctgaagaacctggacatccgctgcatccgcagcctgaatggctgccgggtgacagatgagatcctgcacctggtgcccaacatcgacaacttccggctgaccctgcgggccatcaagctgtgggccaagaggcacaacatctacagcaacatcctgggcttcctgggcggcgtgtcctgggccatgctggtggcccggacctgccagctgtacccaaatgccatcgccagcaccctggtgcacaagttcttcctggtgttcagcaagtggtacgtgttccggctgtactag

SEQ ID NO: 164549 - DNA, 1911 bp, Artificial Sequence
  Description of Artificial Sequence: Synthetic coding sequence
atgcccttccctgtgaccacccagggccccccccagcctgcccccccacccaacagatatggagtgagcagccccatcagcctggccgtgcccaaggagacagactgcctgctgacccagaggctgattgagaccctgcggccctttggagtgtttgaggaggaggaggagctgcagaggcgcatcctggtgctggagaagctgaacaacctggtgaaggagtggatccgggagatcagcgagagcaagagcctgccccagagcgtgattgaaaatgtgggcggcaagatcttcaccttcggcagctaccgcctgggcgtgcacaccaagggagctgacattgatgccctgtgtgtggcccccagccacgtggacagaagtgacttcttcaccagcttctacgccaagctgaagctgcaggaggaggtgaaggacctgcgggctgtggaggaggcctttgtgcctgtgatcaagctgtgctttgatggcatcgagattgacatcctgtttgcccggctggccctgcagaccatccctgaggacctggacctgagagatgacagcctgctgaagaacctggacatccgctgcatccgcagcctgaatggctgccgggtgacagatgagatcctgcacctggtgcccaacatcgacaacttccggctgaccctgcgggccatcaagctgtgggccaagtgccacaacatctacagcaacatcctgggcttcctgggcggcgtgtcctgggccatgctggtggcccggacctgccagctgtacccaaatgctgtggccagcaccctggtgaggaagttcttcctggtgttttctgagtgggagtggcccaaccctgtgctgctgaaggagcctgaggagaggaacctgaacctgcctgtgtgggacccccgggtgaaccccagcgaccgctaccacctgatgcccatcatcaccccagcctacccccagcagaacagcacctacaacgtgtccatcagcaccaggatggtgatgattgaggagttcaagcagggcctggccatcacccatgagatcctgctgagcaaggccgagtggagcaagctgtttgaggcccccagcttcttccagaagtacaagcactacatcgtgctgctggccagcgccagcacagagaagcagcacctggagtgggtgggcctggtggagagcaagatccgcatcctggtgggcagcctggagaagaatgagttcatcaccctggcccacgtgaacccccagagcttccctgcccccaaggagaacccagacatggaggagttccgcaccatgtgggtgattggcctgggcctgaagaagccagacaacagcgagatcctgagcattgacctgacctatgacatccagagcttcacagacacagtgtaccggcaggccgtgaacagcaagatgtttgagatgggcatgaagatcacagccatgcacctgcggaggaaggagctgcaccagctgctgccccaccacgtgctgcaggacaagaaggcccacagcacagagggccgccgcctgacagacctgaatgacagcagctttgacctgtctgctggctgtgagaacagcatgtctgtgcccagcagcaccagcaccatgaagacaggccccctcatcagcagcagccagggcaggaacagccctgccctggccgtgatgacagcctctgtggccaacatccaggccacagagttcagcctgcagcaggtgaacaccaatgaatcttctggagtggccctgaatgaaagcatcccccatgctgtgtcccagcctgccatcagccccagccccaaggccatggtggcccgggtggtgagcagcacctgcctgatcagccacccagacctgcaggagacccagcagcagacctacctgatcctgtag

SEQ ID NO: 164550 - DNA, 1737 bp, Artificial Sequence
  Description of Artificial Sequence: Synthetic coding sequence
atggacttcctgctcttccagtttggcctgtgcaccttcaagtatgactacacagacagcaagtacatcaccaagagcttcaacttctacgtgttccccaagcccttcaacagaagcagcccagatgtgaagtttgtgtgccagagcagcagcattgacttcctggccagccagggctttgacttcaacaaggtgttcagaaatggcatcccctacctgaaccaggaggaggagcggcagctgcgggagcagtatgatgagaagaggagccaggccaatggagctggggccctgtcctatgtgagccccaacaccagcaaatgtcctgtgaccatccctgaggaccagaagaagttcatcgaccaggtggtggagaagattgaggacctgctgcagagcgaggagaacaagaacctggacctggagccctgcaccggcttccagaggaagctgatctaccagaccctgtcctggaagtaccccaagggcatccacgtggagaccctggagacagagaagaaggagcgctacatcgtcatcagcaaggtggatgaggaggagaggaagaggcgggagcagcagaagcacgccaaggagcaggaggagctgaatgatgctgtgggcttcagcagggtcatccacgccatcgccaacagcggcaagctggtgattggccacaacatgctgctggatgtgatgcacacagtgcaccagttctactgccccctgcctgctgacctgtctgagttcaaggagatgaccacctgtgtgttcccccggctgctggacaccaagctgatggccagcacccagcccttcaaggacatcatcaacaacaccagcctggccgagctggagaagaggctgaaggagacccccttcaacccccccaaggtggagagcgctgagggcttccccagctatgacacagccagcgagcagctgcacgaggccggctatgatgcctacatcaccggcctgtgcttcatctccatggccaactacctgggcagcttcctgagcccccccaagatccacgtgtctgcccggagcaagctgattgagcccttcttcaacaagctgttcctgatgagggtgatggacatcccctacctgaacctggagggccctgacctgcagcccaagagggaccacgtgctgcacgtgaccttccccaaggagtggaagaccagtgacctgtaccagctgttcagcgcctttggaaacatccagatctcctggattgatgacaccagcgcctttgtgtccctgagccagcctgagcaggtgaagattgctgtgaacaccagcaaatatgcagagagctaccgcatccagacctatgcagagtacatgggcaggaagcaggaggagaagcagatcaagaggaagtggacagaagattcctggaaggaggccgacagcaagaggctgaacccccagtgcatcccctacaccctgcagaaccactactacagaaacaacagcttcaccgcccccagcacagtgggcaagaggaacctgagccccagccaggaggaggccggcctggaggatggagtgtctggagagatcagtgacacagagctggagcagacagacagctgtgccgagcccctgtctgagggcaggaagaaggccaagaagctgaagaggatgaagaaggagctgagccctgctggcagcatcagcaagaacagccctgccaccctgtttgaggtgcctgacacctggtag

SEQ ID NO: 164551 - DNA, 1782 bp, Artificial Sequence
  Description of Artificial Sequence: Synthetic coding sequence
atggagatcatccgcagcaacttcaagagcaacctgcacaaggtgtaccaggccatcgaggaggccgacttctttgccattgatggagagttcagcggcatcagtgatggccccagcgtgtctgccctgaccaatggatttgacaccccagaggagaggagcagcccagatgtgaagtttgtgtgccagagcagcagcattgacttcctggccagccagggctttgacttcaacaaggtgttcagaaatggcatcccctacctgaaccaggaggaggagcggcagctgcgggagcagtatgatgagaagaggagccaggccaacggggccggggccctgtcctatgtgagccccaacaccagcaagtgccctgtgaccatccctgaggaccagaagaagttcatcgaccaggtggtggagaagattgaggacctgctgcagagcgaggagaacaagaacctggacctggagccctgcaccggcttccagaggaagctgatctaccagaccctgtcctggaagtaccccaagggcatccacgtggagaccctggagacagagaagaaggagcgctacatcgtcatcagcaaggtggatgaggaggagaggaagagaagagagcagcagaagcacgccaaggagcaggaggagctgaatgatgctgtgggcttcagcagggtcatccacgccatcgccaacagcggcaagctggtgattggccacaacatgctgctggatgtgatgcacacagtgcaccagttctactgccccctgcctgctgacctgtctgagttcaaggagatgaccacctgtgtgttcccccggctgctggacaccaagctgatggccagcacccagcccttcaaggacatcatcaacaacaccagcctggccgagctggagaagaggctgaaggagacccccttcaacccccccaaggtggagagcgctgagggcttccccagctatgacacagccagcgagcagctgcatgaagctggctatgatgcctacatcaccggcctgtgcttcatctccatggccaactacctgggcagcttcctgagcccccccaagatccacgtgtctgcccggagcaagctgattgagcccttcttcaacaagctgttcctgatgagggtgatggacatcccctacctgaacctggagggccctgacctgcagcccaagagggaccacgtgctgcacgtgaccttccccaaggagtggaagaccagtgacctgtaccagctgttcagcgccttcggcaacatccagatctcctggattgatgacaccagcgcctttgtgtccctgagccagcctgagcaggtgaagattgctgtgaacaccagcaaatatgcagagagctaccgcatccagacctacgccgagtacatgggcaggaagcaggaggagaagcagatcaagaggaagtggacagaggacagctggaaggaggccgacagcaagaggctgaacccccagtgcatcccctacaccctgcagaaccactactacagaaacaacagcttcaccgcccccagcacagtgggcaagaggaacctgagccccagccaggaggaggccggcctggaggatggagtgtctggagagatcagtgacacagagctggagcagacagacagctgtgccgagcccctgtctgagggcaggaagaaggccaagaagctgaagaggatgaagaaggagctgagccctgctggcagcatcagcaagaacagccctgccaccctgtttgaggtgcctgacacctggtag

SEQ ID NO: 164552 - DNA, 1920 bp, Artificial Sequence
  Description of Artificial Sequence: Synthetic coding sequence
atggagatcatccgcagcaacttcaagagcaacctgcacaaggtgtaccaggccatcgaggaggccgacttctttgccattgatggagagttcagcggcatcagtgatggccccagcgtgtctgccctgaccaatggatttgacaccccagaggagcgctaccagaagctgaagaagcacagcatggacttcctgctcttccagtttggcctgtgcaccttcaagtatgactacacagacagcaagtacatcaccaagagcttcaacttctacgtgttccccaagcccttcaacagaagcagcccagatgtgaagtttgtgtgccagagcagcagcattgacttcctggccagccagggctttgacttcaacaaggtgttcagaaatggcatcccctacctgaaccaggaggaggagcggcagctgcgggagcagtatgatgagaagaggagccaggccaacggggccggggccctgtcctatgtgagccccaacaccagcaagtgccctgtgaccatccctgaggaccagaagaagttcatcgaccaggtggtggagaagattgaggacctgctgcagagcgaggagaacaagaacctggacctggagccctgcaccggcttccagaggaagctgatctaccagaccctgtcctggaagtaccccaagggcatccacgtggagaccctggagacagagaagaaggagcgctacatcgtcatcagcaaggtggatgaggaggagaggaagagaagagagcagcagaagcacgccaaggagcaggaggagctgaatgatgctgtgggcttcagcagggtcatccacgccatcgccaacagcggcaagctggtgattggccacaacatgctgctggatgtgatgcacacagtgcaccagttctactgccccctgcctgctgacctgtctgagttcaaggagatgaccacctgtgtgttcccccggctgctggacaccaagctgatggccagcacccagcccttcaaggacatcatcaacaacaccagcctggccgagctggagaagaggctgaaggagacccccttcaacccccccaaggtggagagcgctgagggcttccccagctatgacacagccagcgagcagctgcatgaagctggctatgatgcctacatcaccggcctgtgcttcatctccatggccaactacctgggcagcttcctgagcccccccaagatccacgtgtctgcccggagcaagctgattgagcccttcttcaacaagctgttcctgatgagggtgatggacatcccctacctgaacctggagggccctgacctgcagcccaagagggaccacgtgctgcacgtgaccttccccaaggagtggaagaccagtgacctgtaccagctgttcagcgccttcggcaacatccagatctcctggattgatgacaccagcgcctttgtgtccctgagccagcctgagcaggtgaagattgctgtgaacaccagcaaatatgcagagagctaccgcatccagacctacgccgagtacatgggcaggaagcaggaggagaagcagatcaagaggaagtggacagaggacagctggaaggaggccgacagcaagaggctgaacccccagtgcatcccctacaccctgcagaaccactactacagaaacaacagcttcaccgcccccagcacagtgggcaagaggaacctgagccccagccaggaggaggccggcctggaggatggagtgtctggagagatcagtgacacagagctggagcagacagacagctgtgccgagcccctgtctgagggcaggaagaaggccaagaagctgaagaggatgaagaaggagctgagccctgctggcagcatcagcaagaacagccctgccaccctgtttgaggtgcctgacacctggtag

SEQ ID NO: 164553 - DNA, 624 bp, Artificial Sequence
  Description of Artificial Sequence: Synthetic coding sequence
atggagatcatccgcagcaacttcaagagcaacctgcacaaggtgtaccaggccatcgaggaggccgacttctttgccattgatggagagttcagcggcatcagtgatggccccagcgtgtctgccctgaccaatggatttgacaccccagaggagcgctaccagaagctgaagaagcacagcatggacttcctgctcttccagtttggcctgtgcaccttcaagtatgactacacagacagcaagagcagcccagatgtgaagtttgtgtgccagagcagcagcattgacttcctggccagccagggctttgacttcaacaaggtgttcagaaatggcatcccctacctgaaccaggaggaggagcggcagctgcgggagcagtatgatgagaagaggagccaggccaatggagctggggccctgtcctatgtgagccccaacaccagcaaatgtcctgtgaccatccctgaggaccagaagaagttcatcgaccaggtggtggagaagattgaggacctgctgcagagcgaggagaacaagaacctggacctggagccctgcaccggcttccagaggaagctgatctaccagaccctgtcctggaagagaagtgacatctag

SEQ ID NO: 164554 - DNA, 1395 bp, Artificial Sequence
  Description of Artificial Sequence: Synthetic coding sequence
atggagatcatccgcagcaacttcaagagcaacctgcacaaggtgtaccaggccatcgaggaggccgacttctttgccattgatggagagttcagcggcatcagtgatggccccagcgtgtctgccctgaccaatggatttgacaccccagaggagcgctaccagaagctgaagaagaaggagcgctacatcgtcatcagcaaggtggatgaggaggagaggaagaggcgggagcagcagaagcacgccaaggagcaggaggagctgaatgatgctgtgggcttcagcagggtcatccacgccatcgccaacagcggcaagctggtgattggccacaacatgctgctggatgtgatgcacacagtgcaccagttctactgccccctgcctgctgacctgtctgagttcaaggagatgaccacctgtgtgttcccccggctgctggacaccaagctgatggccagcacccagcccttcaaggacatcatcaacaacaccagcctggccgagctggagaagaggctgaaggagacccccttcaacccccccaaggtggagagcgctgagggcttccccagctatgacacagccagcgagcagctgcacgaggccggctatgatgcctacatcaccggcctgtgcttcatctccatggccaactacctgggcagcttcctgagcccccccaagatccacgtgtctgcccggagcaagctgattgagcccttcttcaacaagctgttcctgatgagggtgatggacatcccctacctgaacctggagggccctgacctgcagcccaagagggaccacgtgctgcacgtgaccttccccaaggagtggaagaccagtgacctgtaccagctgttcagcgcctttggaaacatccagatctcctggattgatgacaccagcgcctttgtgtccctgagccagcctgagcaggtgaagattgctgtgaacaccagcaaatatgcagagagctaccgcatccagacctatgcagagtacatgggcaggaagcaggaggagaagcagatcaagaggaagtggacagaagattcctggaaggaggccgacagcaagaggctgaacccccagtgcatcccctacaccctgcagaaccactactacagaaacaacagcttcaccgcccccagcacagtgggcaagaggaacctgagccccagccaggaggaggccggcctggaggatggagtgtctggagagatcagtgacacagagctggagcagacagacagctgtgccgagcccctgtctgagggcaggaagaaggccaagaagctgaagaggatgaagaaggagctgagccctgctggcagcatcagcaagaacagccctgccaccctgtttgaggtgcctgacacctggtag

SEQ ID NO: 164555 - DNA, 1071 bp, Artificial Sequence
  Description of Artificial Sequence: Synthetic coding sequence
atggatgctggggtgacagagagcggcctgaatgtgaccctgaccatccggctgctgatgcacggcaaggaggtgggcagcatcatcggcaagaagggggagagcgtgaagaggatccgggaggagagcggggcccgcatcaacatcagcgagggcaactgcccagagcgcatcatcaccctgaccggccccaccaatgccatcttcaaggcctttgccatgatcatcgacaagctggaggaggacatcaacagctccatgaccaacagcacagctgccagccggccccctgtgaccctgcggctggtggtgcctgccacccagtgtggcagcctgattggaaaaggaggctgcaagatcaaggagatccgggagagcactggagcccaggtgcaggtggccggggacatgctgcccaacagcacagagcgggccatcaccatcgccggcgtgccccagagcgtgacagaatgtgtgaagcagatctgcctggtgatgctggagaccctgagccagagcccccagggccgggtgatgaccatcccctaccagcccatgcctgccagcagccctgtgatctgtgccggcggccaggaccgctgcagtgatgctgctggctacccccacgccacccatgacctggagggcccccccctggatgcctacagcatccagggccagcacaccatcagccccctggacctggccaagctgaaccaggtggcccggcagcagagccactttgccatgatgcacggcggcactggatttgctggcatcgacagcagcagccctgaggtgaagggctactgggccagcctggatgccagcacccagaccacccatgagctgaccatccccaacaacctgattggctgcatcatcggccggcagggcgccaacatcaatgagatccggcagatgtctggggcccagatcaagatcgccaaccctgtggagggcagcagcggccggcaggtgaccatcaccggcagcgctgccagcatcagcctggcccagtacctgatcaatgcccggctgagcagcgagaagggcatgggctgcagctag

SEQ ID NO: 164556 - DNA, 957 bp, Artificial Sequence
  Description of Artificial Sequence: Synthetic coding sequence
atggacacaggagtcatcgagggcggcctgaatgtgaccctgaccatccggctgctgatgcacggcaaggaggtgggcagcatcatcggcaagaagggggagagcgtgaagaagatgagggaggagagcggggcccgcatcaacatcagcgagggcaactgcccagagcgcatcatcaccctggccggccccaccaatgccatcttcaaggcctttgccatgatcatcgacaagctggaggaggacatcagcagctccatgaccaacagcacagctgccagccggccccctgtgaccctgcggctggtggtgcctgccagccagtgtggcagcctgattggaaaaggaggctgcaagatcaaggagatccgggagagcactggagcccaggtgcaggtggccggggacatgctgcccaacagcacagagcgggccatcaccatcgccggcatcccccagagcatcattgaatgtgtgaagcagatctgtgtggtgatgctggagagcccccccaagggcgtgaccatcccctaccggcccaagcccagcagcagccctgtgatctttgctgggggccaggcctacaccatccagggccagtatgccatcccccagcctgacctgaccaagctgcaccagctggccatgcagcagagccacttccccatgacccacggcaacacaggcttctctgctggcctggatgccagcgcccagaccaccagccatgagctgaccatccccaatgacctgattggctgcatcatcggccggcagggcgccaagatcaatgagatccggcagatgtctggggcccagatcaagatcgccaaccctgtggagggcagcacagaccggcaggtgaccatcactggatctgctgccagcatcagcctggcccagtacctgatcaacgtgcggctgagcagcgagaccggcggcatgggcagcagctag

SEQ ID NO: 164557 - DNA, 1098 bp, Artificial Sequence
  Description of Artificial Sequence: Synthetic coding sequence
atggacacaggagtcatcgagggcggcctgaatgtgaccctgaccatccggctgctgatgcacggcaaggaggtgggcagcatcatcggcaagaagggggagagcgtgaagaagatgagggaggagagcggggcccgcatcaacatcagcgagggcaactgcccagagcgcatcatcaccctggccggccccaccaatgccatcttcaaggcctttgccatgatcatcgacaagctggaggaggacatcagcagctccatgaccaacagcacagctgccagccggccccctgtgaccctgcggctggtggtgcctgccagccagtgtggcagcctgattggaaaaggaggctgcaagatcaaggagatccgggagagcactggagcccaggtgcaggtggccggggacatgctgcccaacagcacagagcgggccatcaccatcgccggcatcccccagagcatcattgaatgtgtgaagcagatctgtgtggtgatgctggagaccctgagccagagcccccccaagggcgtgaccatcccctaccggcccaagcccagcagcagccctgtgatctttgctgggggccaggaccgctacagcacaggcagtgacagcgccagcttcccccacaccacccccagcatgtgcctgaacccagacctggagggcccccccctggaggcctacaccatccagggccagtatgccatcccccagcctgacctgaccaagctgcaccagctggccatgcagcagagccacttccccatgacccacggcaacacaggcttcagcggcatcgagagcagcagccctgaggtgaagggctactggggcctggatgccagcgcccagaccaccagccatgagctgaccatccccaatgacctgattggctgcatcatcggccggcagggcgccaagatcaatgagatccggcagatgtctggggcccagatcaagatcgccaaccctgtggagggcagcacagaccggcaggtgaccatcaccggcagcgctgccagcatcagcctggcccagtacctgatcaacgtgcggctgagcagcgagactggaggcatgggcagcagctag

SEQ ID NO: 164558 - DNA, 1008 bp, Artificial Sequence
  Description of Artificial Sequence: Synthetic coding sequence
atggacacaggagtcatcgagggcggcctgaatgtgaccctgaccatccggctgctgatgcacggcaaggaggtgggcagcatcatcggcaagaagggggagagcgtgaagaagatgagggaggagagcggggcccgcatcaacatcagcgagggcaactgcccagagcgcatcatcaccctggccggccccaccaatgccatcttcaaggcctttgccatgatcatcgacaagctggaggaggacatcagcagctccatgaccaacagcacagctgccagccggccccctgtgaccctgcggctggtggtgcctgccagccagtgtggcagcctgattggaaaaggaggctgcaagatcaaggagatccgggagagcactggagcccaggtgcaggtggccggggacatgctgcccaacagcacagagcgggccatcaccatcgccggcatcccccagagcatcattgaatgtgtgaagcagatctgtgtggtgatgctggagaccctgagccagagcccccccaagggcgtgaccatcccctaccggcccaagcccagcagcagccctgtgatctttgctgggggccaggcctacaccatccagggccagtatgccatcccccagcctgacctgaccaagctgcaccagctggccatgcagcagagccacttccccatgacccacggcaacacaggcttctctggaattgagagcagcagccctgaggtgaagggctactgggccggcctggatgccagcgcccagaccaccagccatgagctgaccatccccaatgacctgattggctgcatcatcggccggcagggcgccaagatcaatgagatccggcagatgtctggggcccagatcaagatcgccaaccctgtggagggcagcacagaccggcaggtgaccatcaccggcagcgctgccagcatcagcctggcccagtacctgatcaacgtgcggctgagcagcgagactggaggcatgggcagcagctag

SEQ ID NO: 164559 - DNA, 906 bp, Artificial Sequence
  Description of Artificial Sequence: Synthetic coding sequence
atggacacaggagtcatcgagggcggcctgaatgtgaccctgaccatccggctgctgatgcacggcaaggaggtgggcagcatcatcggcaagaagggggagagcgtgaagaagatgagggaggagagcggggcccgcatcaacatcagcgagggcaactgcccagagcgcatcatcaccctggccggccccaccaatgccatcttcaaggcctttgccatgatcatcgacaagctggaggaggacatcagcagctccatgaccaacagcacagctgccagccggccccctgtgaccctgcggctggtggtgcctgccagccagtgtggcagcctgattggaaaaggaggctgcaagatcaaggagatccgggagagcactggagcccaggtgcaggtggccggggacatgctgcccaacagcacagagcgggccatcaccatcgccggcatcccccagagcatcattgaatgtgtgaagcagatctgtgtggtgatgctggagagcccccccaagggcgtgaccatcccctaccggcccaagcccagcagcagccctgtgatctttgctgggggccaggaccgctacagcacaggcagtgacagcgccagcttcccccacaccacccccagcatgtgcctgaacccagacctggagggcccccccctggaggcctacaccatccagggccagtatgccatcccccagcctgacctgaccaagctgcaccagctggccatgcagcagagccacttccccatgacccacggcaacacaggcttcagcggcatggacacctctgtgttcatctctgtgcgctgcagcgcccgggagaggcctgtgcccaggagccagctggacatctgcctgaagcagaccagcctgagcagcatcctgctggtgtag

SEQ ID NO: 164560 - DNA, 1089 bp, Artificial Sequence
  Description of Artificial Sequence: Synthetic coding sequence
atggacacaggagtcatcgagggcggcctgaatgtgaccctgaccatccggctgctgatgcacggcaaggaggtgggcagcatcatcggcaagaagggggagagcgtgaagaagatgagggaggagagcggggcccgcatcaacatcagcgagggcaactgcccagagcgcatcatcaccctggccggccccaccaatgccatcttcaaggcctttgccatgatcatcgacaagctggaggaggacatcagcagctccatgaccaacagcacagctgccagccggccccctgtgaccctgcggctggtggtgcctgccagccagtgtggcagcctgattggaaaaggaggctgcaagatcaaggagatccgggagagcactggagcccaggtgcaggtggccggggacatgctgcccaacagcacagagcgggccatcaccatcgccggcatcccccagagcatcattgaatgtgtgaagcagatctgtgtggtgatgctggagagcccccccaagggcgtgaccatcccctaccggcccaagcccagcagcagccctgtgatctttgctgggggccaggaccgctacagcacaggcagtgacagcgccagcttcccccacaccacccccagcatgtgcctgaacccagacctggagggcccccccctggaggcctacaccatccagggccagtatgccatcccccagcctgacctgaccaagctgcaccagctggccatgcagcagagccacttccccatgacccacggcaacacaggcttcagcggcatcgagagcagcagccctgaggtgaagggctactgggccggcctggatgccagcgcccagaccaccagccatgagctgaccatccccaatgacctgattggctgcatcatcggccggcagggcgccaagatcaatgagatccggcagatgtctggggcccagatcaagatcgccaaccctgtggagggcagcacagaccggcaggtgaccatcactggatctgctgccagcatcagcctggcccagtacctgatcaacgtgcggctgagcagcgagaccggcggcatgggcagcagctag

SEQ ID NO: 164561 - DNA, 996 bp, Artificial Sequence
  Description of Artificial Sequence: Synthetic coding sequence
atggacacaggagtcatcgagggcggcctgaatgtgaccctgaccatccggctgctgatgcacggcaaggaggtgggcagcatcatcggcaagaagggggagagcgtgaagaagatgagggaggagagcggggcccgcatcaacatcagcgagggcaactgcccagagcgcatcatcaccctggccggccccaccaatgccatcttcaaggcctttgccatgatcatcgacaagctggaggaggacatcagcagctccatgaccaacagcacagctgccagccggccccctgtgaccctgcggctggtggtgcctgccagccagtgtggcagcctgattggaaaaggaggctgcaagatcaaggagatccgggagagcactggagcccaggtgcaggtggccggggacatgctgcccaacagcacagagcgggccatcaccatcgccggcatcccccagagcatcattgaatgtgtgaagcagatctgtgtggtgatgctggagagcccccccaagggcgtgaccatcccctaccggcccaagcccagcagcagccctgtgatctttgctgggggccaggcctacaccatccagggccagtatgccatcccccagcctgacctgaccaagctgcaccagctggccatgcagcagagccacttccccatgacccacggcaacacaggcttctctggaattgagagcagcagccctgaggtgaagggctactgggccggcctggatgccagcgcccagaccaccagccatgagctgaccatccccaatgacctgattggctgcatcatcggccggcagggcgccaagatcaatgagatccggcagatgtctggggcccagatcaagatcgccaaccctgtggagggcagcacagaccggcaggtgaccatcaccggcagcgctgccagcatcagcctggcccagtacctgatcaacgtgcggctgagcagcgagactggaggcatgggcagcagctag

SEQ ID NO: 164562 - DNA, 1101 bp, Artificial Sequence
  Description of Artificial Sequence: Synthetic coding sequence
atggacacaggagtcatcgagggcggcctgaatgtgaccctgaccatccggctgctgatgcacggcaaggaggtgggcagcatcatcggcaagaagggggagagcgtgaagaagatgagggaggagagcggggcccgcatcaacatcagcgagggcaactgcccagagcgcatcatcaccctggccggccccaccaatgccatcttcaaggcctttgccatgatcatcgacaagctggaggaggacatcagcagctccatgaccaacagcacagctgccagccggccccctgtgaccctgcggctggtggtgcctgccagccagtgtggcagcctgattggaaaaggaggctgcaagatcaaggagatccgggagagcactggagcccaggtgcaggtggccggggacatgctgcccaacagcacagagcgggccatcaccatcgccggcatcccccagagcatcattgaatgtgtgaagcagatctgtgtggtgatgctggagaccctgagccagagcccccccaagggcgtgaccatcccctaccggcccaagcccagcagcagccctgtgatctttgctgggggccaggaccgctacagcacaggcagtgacagcgccagcttcccccacaccacccccagcatgtgcctgaacccagacctggagggcccccccctggaggcctacaccatccagggccagtatgccatcccccagcctgacctgaccaagctgcaccagctggccatgcagcagagccacttccccatgacccacggcaacacaggcttcagcggcatcgagagcagcagccctgaggtgaagggctactgggccggcctggatgccagcgcccagaccaccagccatgagctgaccatccccaatgacctgattggctgcatcatcggccggcagggcgccaagatcaatgagatccggcagatgtctggggcccagatcaagatcgccaaccctgtggagggcagcacagaccggcaggtgaccatcactggatctgctgccagcatcagcctggcccagtacctgatcaacgtgcggctgagcagcgagaccggcggcatgggcagcagctag

SEQ ID NO: 164563 - DNA, 1086 bp, Artificial Sequence
  Description of Artificial Sequence: Synthetic coding sequence
atggacacaggagtcatcgagggcggcctgaatgtgaccctgaccatccggctgctgatgcacggcaaggaggtgggcagcatcatcggcaagaagggggagagcgtgaagaagatgagggaggagagcggggcccgcatcaacatcagcgagggcaactgcccagagcgcatcatcaccctggccggccccaccaatgccatcttcaaggcctttgccatgatcatcgacaagctggaggaggacatcagcagctccatgaccaacagcacagctgccagccggccccctgtgaccctgcggctggtggtgcctgccagccagtgtggcagcctgattggaaaaggaggctgcaagatcaaggagatccgggagagcactggagcccaggtgcaggtggccggggacatgctgcccaacagcacagagcgggccatcaccatcgccggcatcccccagagcatcattgaatgtgtgaagcagatctgtgtggtgatgctggagagcccccccaagggcgtgaccatcccctaccggcccaagcccagcagcagccctgtgatctttgctgggggccaggaccgctacagcacaggcagtgacagcgccagcttcccccacaccacccccagcatgtgcctgaacccagacctggagggcccccccctggaggcctacaccatccagggccagtatgccatcccccagcctgacctgaccaagctgcaccagctggccatgcagcagagccacttccccatgacccacggcaacacaggcttcagcggcatcgagagcagcagccctgaggtgaagggctactggggcctggatgccagcgcccagaccaccagccatgagctgaccatccccaatgacctgattggctgcatcatcggccggcagggcgccaagatcaatgagatccggcagatgtctggggcccagatcaagatcgccaaccctgtggagggcagcacagaccggcaggtgaccatcaccggcagcgctgccagcatcagcctggcccagtacctgatcaacgtgcggctgagcagcgagactggaggcatgggcagcagctag

SEQ ID NO: 164564 - DNA, 1056 bp, Artificial Sequence
  Description of Artificial Sequence: Synthetic coding sequence
ctgagccctggagatgccttctgggcccccagcgtgctgccccacagcaccctgagcaccctgagccaccacccccagccccagtttggaagaaggatggagagcaaggtgtctgagggcggcctgaatgtgaccctgaccatccggctgctgatgcacggcaaggtgagaggagctgccatcgtgtccaagggggagaccgtgaagaagatgagggaggagagcggggcccgcatcaacatcagcgagggcaactgcccagagcgcatcgtgaccatcaccggccccacagatgccatcttcaaggcctttgccatgattgcctacaagtttgaggaggacatcatcaacagcatgagcaacagccctgccaccagcaagccccctgtgaccctgcggctggtggtgcctgccagccagtgtggcagcctgattggaaaaggaggcagcaagatcaaggagatccgggagagcactggagcccaggtgcaggtggccggggacatgctgcccaacagcacagaaagagctgtgaccatcagcggcaccccagatgccatcatccagtgtgtgaagcagatctgtgtggtgatgctggagagcccccccaagggggccaccatcccctaccggcccaagccagccagcacccctgtgatctttgctgggggccaggcctacaccatccagggccagtatgccatcccccacccagaccagctgaccaagctgcaccagctggccatgcagcagacccccttcccccccctgggccagaccaacccagccttccctggcctggatgccagccccccagccagcacccatgagctgaccatccccaatgacctgattggctgcatcatcggccggcagggcaccaagatcaatgagatccggcagatgtctggggcccagatcaagatcgccaatgccacagagggcagcagcgagcggcagatcaccatcaccggcaccccagccaacatcagcctggcccagtacctgatcaatgcccggctgaccagcgaggtgacaggcatgggcaccctgtag

SEQ ID NO: 164565 - DNA, 969 bp, Artificial Sequence
  Description of Artificial Sequence: Synthetic coding sequence
ccccagccccagtttggaagaaggatggagagcaaggtgtctgagggcggcctgaatgtgaccctgaccatccggctgctgatgcacggcaaggaggtgggcagcatcatcggcaagaagggggagaccgtgaagaagatgagggaggagagcggggcccgcatcaacatcagcgagggcaactgcccagagcgcatcgtgaccatcaccggccccacagatgccatcttcaaggcctttgccatgattgcctacaagtttgaggaggacatcatcaacagcatgagcaacagccctgccaccagcaagccccctgtgaccctgcggctggtggtgcctgccagccagtgtggcagcctgattggaaaaggaggcagcaagatcaaggagatccgggagagcactggagcccaggtgcaggtggccggggacatgctgcccaacagcacagaaagagctgtgaccatcagcggcaccccagatgccatcatccagtgtgtgaagcagatctgtgtggtgatgctggaggcctacaccatccagggccagtatgccatcccccacccagaccagctgaccaagctgcaccagctggccatgcagcagacccccttcccccccctgggccagaccaacccagccttccctggagagaagctgcccctgcacagcagcgaggaggcccagaacctgatgggccagagcagcggcctggatgccagccccccagccagcacccatgagctgaccatccccaatgacctgattggctgcatcatcggccggcagggcaccaagatcaatgagatccggcagatgtctggggcccagatcaagatcgccaatgccacagagggcagcagcgagcggcagatcaccatcaccggcaccccagccaacatcagcctggcccagtacctgatcaatgcccggctgaccagcgaggtgacaggcatgggcaccctgtag

SEQ ID NO: 164566 - DNA, 1038 bp, Artificial Sequence
  Description of Artificial Sequence: Synthetic coding sequence
atgggagaaggagatgccttctgggcccccagcgtgctgccccacagcaccctgagcaccctgagccaccacccccagccccagtttggaagaaggatggagagcaaggtgtctgagggcggcctgaatgtgaccctgaccatccggctgctgatgcacggcaaggaggtgggcagcatcatcggcaagaagggggagaccgtgaagaagatgagggaggagagcggggcccgcatcaacatcagcgagggcaactgcccagagcgcatcgtgaccatcaccggccccacagatgccatcttcaaggcctttgccatgattgcctacaagtttgaggaggacatcatcaacagcatgagcaacagccctgccaccagcaagccccctgtgaccctgcggctggtggtgcctgccagccagtgtggcagcctgattggaaaaggaggcagcaagatcaaggagatccgggagagcactggagcccaggtgcaggtggccggggacatgctgcccaacagcacagaaagagctgtgaccatcagcggcaccccagatgccatcatccagtgtgtgaagcagatctgtgtggtgatgctggaggcctacaccatccagggccagtatgccatcccccacccagacctgaccaagctgcaccagctggccatgcagcagacccccttcccccccctgggccagaccaacccagccttccctggagagaagctgcccctgcacagcagcgaggaggcccagaacctgatgggccagagcagcggcctggatgccagccccccagccagcacccatgagctgaccatccccaatgacctgattggctgcatcatcggccggcagggcaccaagatcaatgagatccggcagatgtctggggcccagatcaagatcgccaatgccacagagggcagcagcgagcggcagatcaccatcaccggcaccccagccaacatcagcctggcccagtacctgatcaatgcccggctgaccagcgaggtgacaggcatgggcaccctgtag

SEQ ID NO: 164567 - DNA, 1113 bp, Artificial Sequence
  Description of Artificial Sequence: Synthetic coding sequence
atgggagaaggagatgccttctgggcccccagcgtgctgccccacagcaccctgagcaccctgagccaccacccccagccccagtttggaagaaggatggagagcaaggtgtctgagggcggcctgaatgtgaccctgaccatccggctgctgatgcacggcaaggaggtgggcagcatcatcggcaagaagggggagaccgtgaagaagatgagggaggagagcggggcccgcatcaacatcagcgagggcaactgcccagagcgcatcgtgaccatcaccggccccacagatgccatcttcaaggcctttgccatgattgcctacaagtttgaggaggacatcatcaacagcatgagcaacagccctgccaccagcaagccccctgtgaccctgcggctggtggtgcctgccagccagtgtggcagcctgattggaaaaggaggcagcaagatcaaggagatccgggagagcactggagcccaggtgcaggtggccggggacatgctgcccaacagcacagaaagagctgtgaccatcagcggcaccccagatgccatcatccagtgtgtgaagcagatctgtgtggtgatgctggagagcccccccaagggggccaccatcccctaccggcccaagccagccagcacccctgtgatctttgctgggggccaggcctacaccatccagggccagtatgccatcccccacccagacctgaccaagctgcaccagctggccatgcagcagacccccttcccccccctgggccagaccaacccagccttccctggagagaagctgcccctgcacagcagcgaggaggcccagaacctgatgggccagagcagcggcctggatgccagccccccagccagcacccatgagctgaccatccccaatgacctgattggctgcatcatcggccggcagggcaccaagatcaatgagatccggcagatgtctggggcccagatcaagatcgccaatgccacagagggcagcagcgagcggcagatcaccatcaccggcaccccagccaacatcagcctggcccagtacctgatcaatgcccggctgaccagcgaggtgacaggcatgggcaccctgtag

SEQ ID NO: 164568 - DNA, 1056 bp, Artificial Sequence
  Description of Artificial Sequence: Synthetic coding sequence
atgggagaaggagatgccttctgggcccccagcgtgctgccccacagcaccctgagcaccctgagccaccacccccagccccagtttggaagaaggatggagagcaaggtgtctgagggcggcctgaatgtgaccctgaccatccggctgctgatgcacggcaaggaggtgggcagcatcatcggcaagaagggggagaccgtgaagaagatgagggaggagagcggggcccgcatcaacatcagcgagggcaactgcccagagcgcatcgtgaccatcaccggccccacagatgccatcttcaaggcctttgccatgattgcctacaagtttgaggaggacatcatcaacagcatgagcaacagccctgccaccagcaagccccctgtgaccctgcggctggtggtgcctgccagccagtgtggcagcctgattggaaaaggaggcagcaagatcaaggagatccgggagagcactggagcccaggtgcaggtggccggggacatgctgcccaacagcacagaaagagctgtgaccatcagcggcaccccagatgccatcatccagtgtgtgaagcagatctgtgtggtgatgctggagagcccccccaagggggccaccatcccctaccggcccaagccagccagcacccctgtgatctttgctgggggccaggcctacaccatccagggccagtatgccatcccccacccagaccagctgaccaagctgcaccagctggccatgcagcagacccccttcccccccctgggccagaccaacccagccttccctggcctggatgccagccccccagccagcacccatgagctgaccatccccaatgacctgattggctgcatcatcggccggcagggcaccaagatcaatgagatccggcagatgtctggggcccagatcaagatcgccaatgccacagagggcagcagcgagcggcagatcaccatcaccggcaccccagccaacatcagcctggcccagtacctgatcaatgcccggctgaccagcgaggtgacaggcatgggcaccctgtag

SEQ ID NO: 164569 - DNA, 1116 bp, Artificial Sequence
  Description of Artificial Sequence: Synthetic coding sequence
atgggagaaggagatgccttctgggcccccagcgtgctgccccacagcaccctgagcaccctgagccaccacccccagccccagtttggaagaaggatggagagcaaggtgtctgagggcggcctgaatgtgaccctgaccatccggctgctgatgcacggcaaggaggtgggcagcatcatcggcaagaagggggagaccgtgaagaagatgagggaggagagcggggcccgcatcaacatcagcgagggcaactgcccagagcgcatcgtgaccatcaccggccccacagatgccatcttcaaggcctttgccatgattgcctacaagtttgaggaggacatcatcaacagcatgagcaacagccctgccaccagcaagccccctgtgaccctgcggctggtggtgcctgccagccagtgtggcagcctgattggaaaaggaggcagcaagatcaaggagatccgggagagcactggagcccaggtgcaggtggccggggacatgctgcccaacagcacagaaagagctgtgaccatcagcggcaccccagatgccatcatccagtgtgtgaagcagatctgtgtggtgatgctggagagcccccccaagggggccaccatcccctaccggcccaagccagccagcacccctgtgatctttgctgggggccaggcctacaccatccagggccagtatgccatcccccacccagaccagctgaccaagctgcaccagctggccatgcagcagacccccttcccccccctgggccagaccaacccagccttccctggagagaagctgcccctgcacagcagcgaggaggcccagaacctgatgggccagagcagcggcctggatgccagccccccagccagcacccatgagctgaccatccccaatgacctgattggctgcatcatcggccggcagggcaccaagatcaatgagatccggcagatgtctggggcccagatcaagatcgccaatgccacagagggcagcagcgagcggcagatcaccatcaccggcaccccagccaacatcagcctggcccagtacctgatcaatgcccggctgaccagcgaggtgacaggcatgggcaccctgtag

SEQ ID NO: 164570 - DNA, 1116 bp, Artificial Sequence; identical to SEQ ID NO: 164569
  Description of Artificial Sequence: Synthetic coding sequence

SEQ ID NO: 164571 - DNA, 18 bp, Artificial Sequence
  Description of Artificial Sequence: Synthetic coding sequence
atggagagcaaggtgtag

SEQ ID NO: 164572 - DNA, 5070 bp, Artificial Sequence
  Description of Artificial Sequence: Synthetic coding sequence
atgggcagcaagagaagaagagccaccagccccagcagctctgtgtctggggactttgatgatggccaccacagcgtgtccaccccaggccccagcaggaagagaagaaggctgagcaacctgcccaccgtggaccccatcgctgtgtgccacgagctgtacaacaccatccgggactacaaggatgagcagggccgcctgctgtgtgagctgttcatccgggcccccaagagaagaaaccagcctgactactatgaggtggtgtcccagcccatcgacctgatgaagatccagcagaagctgaagatggaggagtatgatgatgtgaacctgctgacagctgacttccagctgctcttcaacaatgccaagagctactacaagccagacagccctgagtacaaggccgcctgcaagctgtgggacctgtacctgcggaccagaaatgaatttgtgcagaagggggaggctgatgatgaagatgatgatgaagatggccaggacaaccagggcaccgtgacagagggcagcagccctgcctacctgaaggagatcctggagcagctgctggaggccatcgtggtggccaccaaccccagcggccgcctcatcagcgagctgttccagaagctgcccagcaaggtgcagtacccagactactatgccatcatcaaggagcccatcgacctgaagaccatcgcccagaggatccagaatggcagctacaagagcatccacgccatggccaaggacatcgacctgctggccaagaatgccaagacctacaatgaacctggcagccaggtgttcaaggatgccaacagcatcaagaagatcttctacatgaagaaggccgagattgagcaccacgagatggccaagagcagcctgaggatgaggacccccagcaacctggccgccgcccggctgaccggccccagccacagcaagggcagcctgggggaggagaggaaccccaccagcaagtactacagaaacaagagagctgtgcagggcggccgcctgagcgccatcaccatggccctgcagtatggcagcgagagtgaagaagatgctgccctggccgccgcccgctatgaggagggggagagcgaggccgagagcatcaccagcttcatggatgtgagcaaccccttctaccagctgtatgacacagtgcgcagctgcaggaacaaccagggccagctgattgctgagcccttctaccacctgcccagcaagaagaagtacccagactactaccagcagatcaagatgcccatcagcctgcagcagatccgcaccaagctgaagaaccaggagtatgagaccctggaccacctggagtgtgacctgaacctgatgtttgaaaatgccaagcgctacaacgtgcccaacagcgccatctacaagagggtgctgaagctgcagcaggtgatgcaggccaagaagaaggagctggccaggagagatgacattgaagatggagacagcatgatcagcagcgccaccagtgacaccggcagcgccaagaggaagagcaagaagaacatcaggaagcagaggatgaagatcctcttcaacgtggtgctggaggcccgggagcccggcagcggccggcggctgtgtgacctcttcatggtgaagcccagcaagaaggactacccagactactacaagatcatcctggagcccatggacctgaagatcatcgagcacaacatcagaaatgacaagtatgctggggaggagggcatgattgaggacatgaagctgatgttcagaaatgcccggcactacaatgaggagggcagccaggtgtacaatgatgcccacatcctggagaagctgctgaaggagaagaggaaggagctgggccccctgcctgatgatgatgacatggccagccccaagctgaagctgagcaggaagagcggcatcagccccaagaagagcaagtacatgacccccatgcagcagaagctgaatgaggtgtatgaggccgtgaagaactacacagacaagaggggccggcggctgagcgccatcttcctgcggctgcccagccgctctgagctgcctgactactacctgaccatcaagaagcccatggacatggagaagatccgcagccacatgatggccaacaagtaccaggacatcgacagcatggtggaggactttgtgatgatgttcaacaatgcctgcacctacaatgaacctgagagcctcatctacaaggatgccctggtgctgcacaaggtgctgctggagacccggcgggacctggagggagatgaggacagccacgtgcccaacgtgaccctgctgatccaggagctgatccacaacctgtttgtgtctgtgatgagccaccaggatgatgagggccgctgctacagcgacagcctggccgagatcccagctgtggaccccaacttccccaacaagccacccctgacctttgacatcatcaggaagaatgtggagaacaaccgctacagaaggctggacctcttccaggagcacatgtttgaggtgctggagcgggcccggaggatgaacagaacagattctgagatctatgaagatgctgtggagctgcagcagttcttcatcaagatcagagatgagctgtgcaagaatggagagatcctgctgagccctgccctgagctacaccaccaagcacctgcacaatgatgtggagaaggagaggaaggagaagctgcccaaggagattgaggaggacaagctgaagcgggaggaggagaagcgggaggccgagaagtctgaggacagcagtggagctgctggcctgagcggcctgcacaggacctacagccaggactgcagcttcaagaacagcatgtaccacgtgggggactatgtgtatgtggagcctgctgaggccaacctgcagccccacatcgtgtgcatcgagcggctgtgggaggacagcgctggggagaagtggctgtatggctgctggttctaccggcccaatgagaccttccacctggccaccaggaagttcctggagaaggaggtgttcaagagtgactactacaacaaggtgcctgtgtccaagatcctgggcaaatgtgtggtgatgtttgtgaaggagtacttcaagctgtgcccagagaacttcagagatgaagatgtgtttgtgtgtgagagccgctacagcgccaagaccaagagcttcaagaagatcaagctgtggaccatgcccatcagctctgtgcgctttgtgcccagagatgtgcccctgcctgtggtgcgggtggcctctgtgtttgccaatgctgacaagggagatgatgagaagaacacagacaacagcgaggacagcagagctgaggacaacttcaacctggagaaggagaaggaggatgtgcctgtggagatgagcaatggagagcccggctgccactactttgagcagctgcactacaatgacatgtggctgaaggtgggggactgtgtgttcatcaagagccacggcctggtgcggccccgggtgggcagaattgagaaggtgtgggtgagagatggagctgcctacttctacggccccatcttcatccaccctgaggagacagagcacgagcccaccaagatgttctacaagaaggaggtgttcctgagcaacctggaggagacctgccccatgacctgcatcctgggcaaatgtgctgtgctgtccttcaaggacttcctgagctgccggcccacagagatcccagaaaatgacatcctgctgtgtgagagccgctacaatgaaagtgacaagcagatgaagaagttcaagggcctgaagcgcttcagcctgagcgccaaggtggtggatgatgagatctactacttcaggaagcccatcgtgccccagaaggagcccagccccctgctggagaagaagatccagctgctggaggccaagtttgctgagctggagggcggagatgatgacatcgaggagatgggagaggaggacagcgaggtgattgagccccccagcctgccccagctgcagacccccctggccagcgagctggacctgatgccctacaccccaccccagagcacccccaagagcgccaagggcagcgccaagaaggagggcagcaagaggaagatcaacatgagcggctacatcctcttcagcagcgagatgagagctgtgatcaaggcccagcacccagactacagctttggagagctgagccggctggtgggcacagagtggaggaacctggagacagccaagaaggccgagtatgaggagcgggccgccaaggtggccgagcagcaggagcgggagcgggccgcccagcagcagcagcccagcgccagcccccgggccggcacccctgtgggcgccctgatgggcgtggtgcccccacccacccccatgggcatgctgaaccagcagctgacccctgtggccggcatgatgggcggctacccacctggcctgccccccctgcagggccctgtggatggcctggtgtccatgggctccatgcagcccctgcaccctgggggccccccaccccaccacctgcccccaggagtgcccggcctgcccggcatccccccacctggggtgatgaaccagggcgtggcccccatggtgggcaccccagcccctgggggcagcccctacggccagcaggtgggcgtgctgggccccccaggccagcaggcccccccaccctacccaggcccccaccctgctggcccccctgtgatccagcagcccaccacccccatgtttgtggcccccccacccaagacccagaggctgctgcacagcgaggcctacctgaagtacatcgagggcctgtctgctgagagcaacagcatcagcaagtgggaccagaccctggccgccaggagaagagatgtgcacctgagcaaggagcaggagagccggctgcccagccactggctgaagagcaagggggcccacaccaccatggctgatgccctgtggaggctgcgggacctgatgctgcgggacaccctgaacatccggcaggcctacaacctggagaatgtgtag

SEQ ID NO: 164573 - DNA, 4749 bp, Artificial Sequence
  Description of Artificial Sequence: Synthetic coding sequence
atgggcagcaagagaagaagagccaccagccccagcagctctgtgtctggggactttgatgatggccaccacagcgtgtccaccccaggccccagcaggaagagaagaaggctgagcaacctgcccaccgtggaccccatcgctgtgtgccacgagctgtacaacaccatccgggactacaaggatgagcagggccgcctgctgtgtgagctgttcatccgggcccccaagagaagaaaccagcctgactactatgaggtggtgtcccagcccatcgacctgatgaagatccagcagaagctgaagatggaggagtatgatgatgtgaacctgctgacagctgacttccagctgctcttcaacaatgccaagagctactacaagccagacagccctgagtacaaggccgcctgcaagctgtgggacctgtacctgcggaccagaaatgaatttgtgcagaagggggaggctgatgatgaagatgatgatgaagatggccaggacaaccagggcaccgtgacagagggcagcagccctgcctacctgaaggagatcctggagcagctgctggaggccatcgtggtggccaccaaccccagcggccgcctcatcagcgagctgttccagaagctgcccagcaaggtgcagtacccagactactatgccatcatcaaggagcccatcgacctgaagaccatcgcccagaggatccagaatggcagctacaagagcatccacgccatggccaaggacatcgacctgctggccaagaatgccaagacctacaatgaacctggcagccaggtgttcaaggatgccaacagcatcaagaagatcttctacatgaagaaggccgagattgagcaccacgagatggccaagagcagcctgaggatgaggacccccagcaacctggccgccgcccggctgaccggccccagccacagcaagggcagcctgggggaggagaggaaccccaccagcaagtactacagaaacaagagagctgtgcagggcggccgcctgagcgccatcaccatggccctgcagtatggcagcgagagtgaagaagatgctgccctggccgccgcccgctatgaggagggggagagcgaggccgagagcatcaccagcttcatggatgtgagcaaccccttctaccagctgtatgacacagtgcgcagctgcaggaacaaccagggccagctgattgctgagcccttctaccacctgcccagcaagaagaagtacccagactactaccagcagatcaagatgcccatcagcctgcagcagatccgcaccaagctgaagaaccaggagtatgagaccctggaccacctggagtgtgacctgaacctgatgtttgaaaatgccaagcgctacaacgtgcccaacagcgccatctacaagagggtgctgaagctgcagcaggtgatgcaggccaagaagaaggagctggccaggagagatgacattgaagatggagacagcatgatcagcagcgccaccagtgacaccggcagcgccaagaggaagagcaagaagaacatcaggaagcagaggatgaagatcctcttcaacgtggtgctggaggcccgggagcccggcagcggccggcggctgtgtgacctcttcatggtgaagcccagcaagaaggactacccagactactacaagatcatcctggagcccatggacctgaagatcatcgagcacaacatcagaaatgacaagtatgctggggaggagggcatgattgaggacatgaagctgatgttcagaaatgcccggcactacaatgaggagggcagccaggtgtacaatgatgcccacatcctggagaagctgctgaaggagaagaggaaggagctgggccccctgcctgatgatgatgacatggccagccccaagctgaagctgagcaggaagagcggcatcagccccaagaagagcaagtacatgacccccatgcagcagaagctgaatgaggtgtatgaggccgtgaagaactacacagacaagaggggccggcggctgagcgccatcttcctgcggctgcccagccgctctgagctgcctgactactacctgaccatcaagaagcccatggacatggagaagatccgcagccacatgatggccaacaagtaccaggacatcgacagcatggtggaggactttgtgatgatgttcaacaatgcctgcacctacaatgaacctgagagcctcatctacaaggatgccctggtgctgcacaaggtgctgctggagacccggcgggacctggagggagatgaggacagccacgtgcccaacgtgaccctgctgatccaggagctgatccacaacctgtttgtgtctgtgatgagccaccaggatgatgagggccgctgctacagcgacagcctggccgagatcccagctgtggaccccaacttccccaacaagccacccctgacctttgacatcatcaggaagaatgtggagaacaaccgctacagaaggctggacctcttccaggagcacatgtttgaggtgctggagcgggcccggaggatgaacagaacagattctgagatctatgaagatgctgtggagctgcagcagttcttcatcaagatcagagatgagctgtgcaagaatggagagatcctgctgagccctgccctgagctacaccaccaagcacctgcacaatgatgtggagaaggagaggaaggagaagctgcccaaggagattgaggaggacaagctgaagcgggaggaggagaagcgggaggccgagaagtctgaggacagcagtggagctgctggcctgagcggcctgcacaggacctacagccaggactgcagcttcaagaacagcatgtaccacgtgggggactatgtgtatgtggagcctgctgaggccaacctgcagccccacatcgtgtgcatcgagcggctgtgggaggacagcgctggggagaagtggctgtatggctgctggttctaccggcccaatgagaccttccacctggccaccaggaagttcctggagaaggaggtgttcaagagtgactactacaacaaggtgcctgtgtccaagatcctgggcaaatgtgtggtgatgtttgtgaaggagtacttcaagctgtgcccagagaacttcagagatgaagatgtgtttgtgtgtgagagccgctacagcgccaagaccaagagcttcaagaagatcaagctgtggaccatgcccatcagctctgtgcgctttgtgcccagagatgtgcccctgcctgtggtgcgggtggcctctgtgtttgccaatgctgacaagggagatgatgagaagaacacagacaacagcgaggacagcagagctgaggacaacttcaacctggagaaggagaaggaggatgtgcctgtggagatgagcaatggagagcccggctgccactactttgagcagctgcactacaatgacatgtggctgaaggtgggggactgtgtgttcatcaagagccacggcctggtgcggccccgggtgggcagaattgagaaggtgtgggtgagagatggagctgcctacttctacggccccatcttcatccaccctgaggagacagagcacgagcccaccaagatgttctacaagaaggaggtgttcctgagcaacctggaggagacctgccccatgacctgcatcctgggcaaatgtgctgtgctgtccttcaaggacttcctgagctgccggcccacagagatcccagaaaatgacatcctgctgtgtgagagccgctacaatgaaagtgacaagcagatgaagaagttcaagggcctgaagcgcttcagcctgagcgccaaggtggtggatgatgagatctactacttcaggaagcccatcgtgccccagaaggagcccagccccctgctggagaagaagatccagctgctggaggccaagtttgctgagctggagggcggagatgatgacatcgaggagatgggagaggaggacagcgaggtgattgagccccccagcctgccccagctgcagacccccctggccagcgagctggacctgatgccctacaccccaccccagagcacccccaagagcgccaagggcagcgccaagaaggagggcagcaagaggaagatcaacatgagcggctacatcctcttcagcagcgagatgagagctgtgatcaaggcccagcacccagactacagctttggagagctgagccggctggtgggcacagagtggaggaacctggagacagccaagaaggccgagtatgagggcgtgatgaaccagggcgtggcccccatggtgggcaccccagcccctgggggcagcccctacggccagcaggtgggcgtgctgggccccccaggccagcaggcccccccaccctacccaggcccccaccctgctggcccccctgtgatccagcagcccaccacccccatgtttgtggcccccccacccaagacccagaggctgctgcacagcgaggcctacctgaagtacatcgagggcctgtctgctgagagcaacagcatcagcaagtgggaccagaccctggccgcccggaggagagatgtgcacctgagcaaggagcaggagagccggctgcccagccactggctgaagagcaaaggagcccacaccaccatggctgatgccctgtggaggctgcgggacctgatgctgcgggacaccctgaacatccggcaggcctacaacctggagaatgtgtag

SEQ ID NO: 164574 - DNA, 4809 bp, Artificial Sequence
  Description of Artificial Sequence: Synthetic coding sequence
atgggcagcaagagaagaagagccaccagccccagcagctctgtgtctggggactttgatgatggccaccacagcgtgtccaccccaggccccagcaggaagagaagaaggctgagcaacctgcccaccgtggaccccatcgctgtgtgccacgagctgtacaacaccatccgggactacaaggatgagcagggccgcctgctgtgtgagctgttcatccgggcccccaagagaagaaaccagcctgactactatgaggtggtgtcccagcccatcgacctgatgaagatccagcagaagctgaagatggaggagtatgatgatgtgaacctgctgacagctgacttccagctgctcttcaacaatgccaagagctactacaagccagacagccctgagtacaaggccgcctgcaagctgtgggacctgtacctgcggaccagaaatgaatttgtgcagaagggggaggctgatgatgaagatgatgatgaagatggccaggacaaccagggcaccgtgacagagggcagcagccctgcctacctgaaggagatcctggagcagctgctggaggccatcgtggtggccaccaaccccagcggccgcctcatcagcgagctgttccagaagctgcccagcaaggtgcagtacccagactactatgccatcatcaaggagcccatcgacctgaagaccatcgcccagaggatccagaatggcagctacaagagcatccacgccatggccaaggacatcgacctgctggccaagaatgccaagacctacaatgaacctggcagccaggtgttcaaggatgccaacagcatcaagaagatcttctacatgaagaaggccgagattgagcaccacgagatggccaagagcagcctgaggatgagcaacaagagagctgtgcagggcggccgcctgagcgccatcaccatggccctgcagtatggcagcgagagtgaagaagatgctgccctggccgccgcccgctatgaggagggggagagcgaggccgagagcatcaccagcttcatggatgtgagcaaccccttctaccagctgtatgacacagtgcgcagctgcaggaacaaccagggccagctgattgctgagcccttctaccacctgcccagcaagaagaagtacccagactactaccagcagatcaagatgcccatcagcctgcagcagatccgcaccaagctgaagaaccaggagtatgagaccctggaccacctggagtgtgacctgaacctgatgtttgaaaatgccaagcgctacaacgtgcccaacagcgccatctacaagagggtgctgaagctgcagcaggtgatgcaggccaagaagaaggagctggccaggagagatgacattgaagatggagacagcatgatcagcagcgccaccagtgacaccggcagcgccaagaggaagagcaagaagaacatcaggaagcagaggatgaagatcctcttcaacgtggtgctggaggcccgggagcccggcagcggccggcggctgtgtgacctcttcatggtgaagcccagcaagaaggactacccagactactacaagatcatcctggagcccatggacctgaagatcatcgagcacaacatcagaaatgacaagtatgctggggaggagggcatgattgaggacatgaagctgatgttcagaaatgcccggcactacaatgaggagggcagccaggtgtacaatgatgcccacatcctggagaagctgctgaaggagaagaggaaggagctgggccccctgcctgatgatgatgacatggccagccccaagctgaagctgagcaggaagagcggcatcagccccaagaagagcaagtacatgacccccatgcagcagaagctgaatgaggtgtatgaggccgtgaagaactacacagacaagaggggccggcggctgagcgccatcttcctgcggctgcccagccgctctgagctgcctgactactacctgaccatcaagaagcccatggacatggagaagatccgcagccacatgatggccaacaagtaccaggacatcgacagcatggtggaggactttgtgatgatgttcaacaatgcctgcacctacaatgaacctgagagcctcatctacaaggatgccctggtgctgcacaaggtgctgctggagacccggcgggacctggagggagatgaggacagccacgtgcccaacgtgaccctgctgatccaggagctgatccacaacctgtttgtgtctgtgatgagccaccaggatgatgagggccgctgctacagcgacagcctggccgagatcccagctgtggaccccaacttccccaacaagccacccctgacctttgacatcatcaggaagaatgtggagaacaaccgctacagaaggctggacctcttccaggagcacatgtttgaggtgctggagcgggcccggaggatgaacagaacagattctgagatctatgaagatgctgtggagctgcagcagttcttcatcaagatcagagatgagctgtgcaagaatggagagatcctgctgagccctgccctgagctacaccaccaagcacctgcacaatgatgtggagaaggagaggaaggagaagctgcccaaggagattgaggaggacaagctgaagcgggaggaggagaagcgggaggccgagaagtctgaggacagcagtggagctgctggcctgagcggcctgcacaggacctacagccaggactgcagcttcaagaacagcatgtaccacgtgggggactatgtgtatgtggagcctgctgaggccaacctgcagccccacatcgtgtgcatcgagcggctgtgggaggacagcgctggggagaagtggctgtatggctgctggttctaccggcccaatgagaccttccacctggccaccaggaagttcctggagaaggaggtgttcaagagtgactactacaacaaggtgcctgtgtccaagatcctgggcaaatgtgtggtgatgtttgtgaaggagtacttcaagctgtgcccagagaacttcagagatgaagatgtgtttgtgtgtgagagccgctacagcgccaagaccaagagcttcaagaagatcaagctgtggaccatgcccatcagctctgtgcgctttgtgcccagagatgtgcccctgcctgtggtgcgggtggcctctgtgtttgccaatgctgacaagggagatgatgagaagaacacagacaacagcgaggacagcagagctgaggacaacttcaacctggagaaggagaaggaggatgtgcctgtggagatgagcaatggagagcccggctgccactactttgagcagctgcactacaatgacatgtggctgaaggtgggggactgtgtgttcatcaagagccacggcctggtgcggccccgggtgggcagaattgagaaggtgtgggtgagagatggagctgcctacttctacggccccatcttcatccaccctgaggagacagagcacgagcccaccaagatgttctacaagaaggaggtgttcctgagcaacctggaggagacctgccccatgacctgcatcctgggcaaatgtgctgtgctgtccttcaaggacttcctgagctgccggcccacagagatcccagaaaatgacatcctgctgtgtgagagccgctacaatgaaagtgacaagcagatgaagaagttcaagggcctgaagcgcttcagcctgagcgccaaggtggtggatgatgagatctactacttcaggaagcccatcgtgccccagaaggagcccagccccctgctggagaagaagatccagctgctggaggccaagtttgctgagctggagggcggagatgatgacatcgaggagatgggagaggaggacagcgaggtgattgagccccccagcctgccccagctgcagacccccctggccagcgagctggacctgatgccctacaccccaccccagagcacccccaagagcgccaagggcagcgccaagaaggagggcagcaagaggaagatcaacatgagcggctacatcctcttcagcagcgagatgagagctgtgatcaaggcccagcacccagactacagctttggagagctgagccggctggtgggcacagagtggaggaacctggagacagccaagaaggccgagtatgagggcatgatgggcggctacccacctggcctgccccccctgcagggccctgtggatggcctggtgtccatgggctccatgcagcccctgcaccctgggggccccccaccccaccacctgcccccaggagtgcccggcctgcccggcatccccccacctggggtgatgaaccagggcgtggcccccatggtgggcaccccagcccctgggggcagcccctacggccagcaggtgggcgtgctgggccccccaggccagcaggcccccccaccctacccaggcccccaccctgctggcccccctgtgatccagcagcccaccacccccatgtttgtggcccccccacccaagacccagaggctgctgcacagcgaggcctacctgaagtacatcgagggcctgtctgctgagagcaacagcatcagcaagtgggaccagaccctggccgcccggaggagagatgtgcacctgagcaaggagcaggagagccggctgcccagccactggctgaagagcaaaggagcccacaccaccatggctgatgccctgtggaggctgcgggacctgatgctgcgggacaccctgaacatccggcaggcctacaacctggagaatgtgtag

SEQ ID NO: 164575 - DNA, 4749 bp, Artificial Sequence
  Description of Artificial Sequence: Synthetic coding sequence
atgggcagcaagagaagaagagccaccagccccagcagctctgtgtctggggactttgatgatggccaccacagcgtgtccaccccaggccccagcaggaagagaagaaggctgagcaacctgcccaccgtggaccccatcgctgtgtgccacgagctgtacaacaccatccgggactacaaggatgagcagggccgcctgctgtgtgagctgttcatccgggcccccaagagaagaaaccagcctgactactatgaggtggtgtcccagcccatcgacctgatgaagatccagcagaagctgaagatggaggagtatgatgatgtgaacctgctgacagctgacttccagctgctcttcaacaatgccaagagctactacaagccagacagccctgagtacaaggccgcctgcaagctgtgggacctgtacctgcggaccagaaatgaatttgtgcagaagggggaggctgatgatgaagatgatgatgaagatggccaggacaaccagggcaccgtgacagagggcagcagccctgcctacctgaaggagatcctggagcagctgctggaggccatcgtggtggccaccaaccccagcggccgcctcatcagcgagctgttccagaagctgcccagcaaggtgcagtacccagactactatgccatcatcaaggagcccatcgacctgaagaccatcgcccagaggatccagaatggcagctacaagagcatccacgccatggccaaggacatcgacctgctggccaagaatgccaagacctacaatgaacctggcagccaggtgttcaaggatgccaacagcatcaagaagatcttctacatgaagaaggccgagattgagcaccacgagatggccaagagcagcctgaggatgaggacccccagcaacctggccgccgcccggctgaccggccccagccacagcaagggcagcctgggggaggagaggaaccccaccagcaagtactacagaaacaagagagctgtgcagggcggccgcctgagcgccatcaccatggccctgcagtatggcagcgagagtgaagaagatgctgccctggccgccgcccgctatgaggagggggagagcgaggccgagagcatcaccagcttcatggatgtgagcaaccccttctaccagctgtatgacacagtgcgcagctgcaggaacaaccagggccagctgattgctgagcccttctaccacctgcccagcaagaagaagtacccagactactaccagcagatcaagatgcccatcagcctgcagcagatccgcaccaagctgaagaaccaggagtatgagaccctggaccacctggagtgtgacctgaacctgatgtttgaaaatgccaagcgctacaacgtgcccaacagcgccatctacaagagggtgctgaagctgcagcaggtgatgcaggccaagaagaaggagctggccaggagagatgacattgaagatggagacagcatgatcagcagcgccaccagtgacaccggcagcgccaagaggaagagcaagaagaacatcaggaagcagaggatgaagatcctcttcaacgtggtgctggaggcccgggagcccggcagcggccggcggctgtgtgacctcttcatggtgaagcccagcaagaaggactacccagactactacaagatcatcctggagcccatggacctgaagatcatcgagcacaacatcagaaatgacaagtatgctggggaggagggcatgattgaggacatgaagctgatgttcagaaatgcccggcactacaatgaggagggcagccaggtgtacaatgatgcccacatcctggagaagctgctgaaggagaagaggaaggagctgggccccctgcctgatgatgatgacatggccagccccaagctgaagctgagcaggaagagcggcatcagccccaagaagagcaagtacatgacccccatgcagcagaagctgaatgaggtgtatgaggccgtgaagaactacacagacaagaggggccggcggctgagcgccatcttcctgcggctgcccagccgctctgagctgcctgactactacctgaccatcaagaagcccatggacatggagaagatccgcagccacatgatggccaacaagtaccaggacatcgacagcatggtggaggactttgtgatgatgttcaacaatgcctgcacctacaatgaacctgagagcctcatctacaaggatgccctggtgctgcacaaggtgctgctggagacccggcgggacctggagggagatgaggacagccacgtgcccaacgtgaccctgctgatccaggagctgatccacaacctgtttgtgtctgtgatgagccaccaggatgatgagggccgctgctacagcgacagcctggccgagatcccagctgtggaccccaacttccccaacaagccacccctgacctttgacatcatcaggaagaatgtggagaacaaccgctacagaaggctggacctcttccaggagcacatgtttgaggtgctggagcgggcccggaggatgaacagaacagattctgagatctatgaagatgctgtggagctgcagcagttcttcatcaagatcagagatgagctgtgcaagaatggagagatcctgctgagccctgccctgagctacaccaccaagcacctgcacaatgatgtggagaaggagaggaaggagaagctgcccaaggagattgaggaggacaagctgaagcgggaggaggagaagcgggaggccgagaagtctgaggacagcagtggagctgctggcctgagcggcctgcacaggacctacagccaggactgcagcttcaagaacagcatgtaccacgtgggggactatgtgtatgtggagcctgctgaggccaacctgcagccccacatcgtgtgcatcgagcggctgtgggaggacagcgctgagaaggaggtgttcaagagtgactactacaacaaggtgcctgtgtccaagatcctgggcaaatgtgtggtgatgtttgtgaaggagtacttcaagctgtgcccagagaacttcagagatgaagatgtgtttgtgtgtgagagccgctacagcgccaagaccaagagcttcaagaagatcaagctgtggaccatgcccatcagctctgtgcgctttgtgcccagagatgtgcccctgcctgtggtgcgggtggcctctgtgtttgccaatgctgacaagggagatgatgagaagaacacagacaacagcgaggacagcagagctgaggacaacttcaacctggagaaggagaaggaggatgtgcctgtggagatgagcaatggagagcccggctgccactactttgagcagctgcactacaatgacatgtggctgaaggtgggggactgtgtgttcatcaagagccacggcctggtgcggccccgggtgggccgcatcgagaaggtgtgggtgagagatggagctgcctacttctacggccccatcttcatccaccctgaggagacagaacatgagcccaccaagatgttctacaagaaggaggtgttcctgagcaacctggaggagacctgccccatgacctgcatcctgggcaaatgtgctgtgctgtccttcaaggacttcctgagctgccggcccacagagatcccagaaaatgacatcctgctgtgtgagagccgctacaatgaaagtgacaagcagatgaagaagttcaagggcctgaagcgcttcagcctgagcgccaaggtggtggatgatgagatctactacttcaggaagcccatcgtgccccagaaggagcccagccccctgctggagaagaagatccagctgctggaggccaagtttgctgagctggagggcggagatgatgacatcgaggagatgggagaagaagattctgagagcacccccaagagcgccaagggcagcgccaagaaggagggcagcaagaggaagatcaacatgagcggctacatcctcttcagcagcgagatgagagctgtgatcaaggcccagcacccagactacagctttggagagctgagccggctggtgggcacagagtggaggaacctggagacagccaagaaggccgagtatgagggcatgatgggcggctacccacctggcctgccccccctgcagggccctgtggatggcctggtgtccatgggctccatgcagcccctgcaccctgggggccccccaccccaccacctgcccccaggagtgcccggcctgcccggcatccccccacctggggtgatgaaccagggcgtggcccccatggtgggcaccccagcccctgggggcagcccctacggccagcaggtgggcgtgctgggccccccaggccagcaggcccccccaccctacccaggcccccaccctgctggcccccctgtgatccagcagcccaccacccccatgtttgtggcccccccacccaagacccagaggctgctgcacagcgaggcctacctgaagtacatcgagggcctgtctgctgagagcaacagcatcagcaagtgggaccagaccctggccgcccggaggagagatgtgcacctgagcaaggagcaggagagccggctgcccagccactggctgaagagcaaaggagcccacaccaccatggctgatgccctgtggaggctgcgggacctgatgctgcgggacaccctgaacatccggcaggcctacaacctggagaatgtgtag

SEQ ID NO: 164576 - DNA, 4905 bp, Artificial Sequence
  Description of Artificial Sequence: Synthetic coding sequence
atgggcagcaagagaagaagagccaccagccccagcagctctgtgtctggggactttgatgatggccaccacagcgtgtccaccccaggccccagcaggaagagaagaaggctgagcaacctgcccaccgtggaccccatcgctgtgtgccacgagctgtacaacaccatccgggactacaaggatgagcagggccgcctgctgtgtgagctgttcatccgggcccccaagagaagaaaccagcctgactactatgaggtggtgtcccagcccatcgacctgatgaagatccagcagaagctgaagatggaggagtatgatgatgtgaacctgctgacagctgacttccagctgctcttcaacaatgccaagagctactacaagccagacagccctgagtacaaggccgcctgcaagctgtgggacctgtacctgcggaccagaaatgaatttgtgcagaagggggaggctgatgatgaagatgatgatgaagatggccaggacaaccagggcaccgtgacagagggcagcagccctgcctacctgaaggagatcctggagcagctgctggaggccatcgtggtggccaccaaccccagcggccgcctcatcagcgagctgttccagaagctgcccagcaaggtgcagtacccagactactatgccatcatcaaggagcccatcgacctgaagaccatcgcccagaggatccagaatggcagctacaagagcatccacgccatggccaaggacatcgacctgctggccaagaatgccaagacctacaatgaacctggcagccaggtgttcaaggatgccaacagcatcaagaagatcttctacatgaagaaggccgagattgagcaccacgagatggccaagagcagcctgaggatgaggacccccagcaacctggccgccgcccggctgaccggccccagccacagcaagggcagcctgggggaggagaggaaccccaccagcaagtactacagaaacaagagagctgtgcagggcggccgcctgagcgccatcaccatggccctgcagtatggcagcgagagtgaagaagatgctgccctggccgccgcccgctatgaggagggggagagcgaggccgagagcatcaccagcttcatggatgtgagcaaccccttctaccagctgtatgacacagtgcgcagctgcaggaacaaccagggccagctgattgctgagcccttctaccacctgcccagcaagaagaagtacccagactactaccagcagatcaagatgcccatcagcctgcagcagatccgcaccaagctgaagaaccaggagtatgagaccctggaccacctggagtgtgacctgaacctgatgtttgaaaatgccaagcgctacaacgtgcccaacagcgccatctacaagagggtgctgaagctgcagcaggtgatgcaggccaagaagaaggagctggccaggagagatgacattgaagatggagacagcatgatcagcagcgccaccagtgacaccggcagcgccaagaggaagagcaagaagaacatcaggaagcagaggatgaagatcctcttcaacgtggtgctggaggcccgggagcccggcagcggccggcggctgtgtgacctcttcatggtgaagcccagcaagaaggactacccagactactacaagatcatcctggagcccatggacctgaagatcatcgagcacaacatcagaaatgacaagtatgctggggaggagggcatgattgaggacatgaagctgatgttcagaaatgcccggcactacaatgaggagggcagccaggtgtacaatgatgcccacatcctggagaagctgctgaaggagaagaggaaggagctgggccccctgcctgatgatgatgacatggccagccccaagctgaagctgagcaggaagagcggcatcagccccaagaagagcaagtacatgacccccatgcagcagaagctgaatgaggtgtatgaggccgtgaagaactacacagacaagaggggccggcggctgagcgccatcttcctgcggctgcccagccgctctgagctgcctgactactacctgaccatcaagaagcccatggacatggagaagatccgcagccacatgatggccaacaagtaccaggacatcgacagcatggtggaggactttgtgatgatgttcaacaatgcctgcacctacaatgaacctgagagcctcatctacaaggatgccctggtgctgcacaaggtgctgctggagacccggcgggacctggagggagatgaggacagccacgtgcccaacgtgaccctgctgatccaggagctgatccacaacctgtttgtgtctgtgatgagccaccaggatgatgagggccgctgctacagcgacagcctggccgagatcccagctgtggaccccaacttccccaacaagccacccctgacctttgacatcatcaggaagaatgtggagaacaaccgctacagaaggctggacctcttccaggagcacatgtttgaggtgctggagcgggcccggaggatgaacagaacagattctgagatctatgaagatgctgtggagctgcagcagttcttcatcaagatcagagatgagctgtgcaagaatggagagatcctgctgagccctgccctgagctacaccaccaagcacctgcacaatgatgtggagaaggagaggaaggagaagctgcccaaggagattgaggaggacaagctgaagcgggaggaggagaagcgggaggccgagaagtctgaggacagcagtggagctgctggcctgagcggcctgcacaggacctacagccaggactgcagcttcaagaacagcatgtaccacgtgggggactatgtgtatgtggagcctgctgaggccaacctgcagccccacatcgtgtgcatcgagcggctgtgggaggacagcgctggggagaagtggctgtatggctgctggttctaccggcccaatgagaccttccacctggccaccaggaagttcctggagaaggaggtgttcaagagtgactactacaacaaggtgcctgtgtccaagatcctgggcaaatgtgtggtgatgtttgtgaaggagtacttcaagctgtgcccagagaacttcagagatgaagatgtgtttgtgtgtgagagccgctacagcgccaagaccaagagcttcaagaagatcaagctgtggaccatgcccatcagctctgtgcgctttgtgcccagagatgtgcccctgcctgtggtgcgggtggcctctgtgtttgccaatgctgacaagggagatgatgagaagaacacagacaacagcgaggacagcagagctgaggacaacttcaacctggagaaggagaaggaggatgtgcctgtggagatgagcaatggagagcccggctgccactactttgagcagctgcactacaatgacatgtggctgaaggtgggggactgtgtgttcatcaagagccacggcctggtgcggccccgggtgggcagaattgagaaggtgtgggtgagagatggagctgcctacttctacggccccatcttcatccaccctgaggagacagagcacgagcccaccaagatgttctacaagaaggaggtgttcctgagcaacctggaggagacctgccccatgacctgcatcctgggcaaatgtgctgtgctgtccttcaaggacttcctgagctgccggcccacagagatcccagaaaatgacatcctgctgtgtgagagccgctacaatgaaagtgacaagcagatgaagaagttcaagggcctgaagcgcttcagcctgagcgccaaggtggtggatgatgagatctactacttcaggaagcccatcgtgccccagaaggagcccagccccctgctggagaagaagatccagctgctggaggccaagtttgctgagctggagggcggagatgatgacatcgaggagatgggagaggaggacagcgaggtgattgagccccccagcctgccccagctgcagacccccctggccagcgagctggacctgatgccctacaccccaccccagagcacccccaagagcgccaagggcagcgccaagaaggagggcagcaagaggaagatcaacatgagcggctacatcctcttcagcagcgagatgagagctgtgatcaaggcccagcacccagactacagctttggagagctgagccggctggtgggcacagagtggaggaacctggagacagccaagaaggccgagtatgagggcatgatgggcggctacccacctggcctgccccccctgcagggccctgtggatggcctggtgtccatgggctccatgcagcccctgcaccctgggggccccccaccccaccacctgcccccaggagtgcccggcctgcccggcatccccccacctggggtgatgaaccagggcgtggcccccatggtgggcaccccagcccctgggggcagcccctacggccagcaggtgggcgtgctgggccccccaggccagcaggcccccccaccctacccaggcccccaccctgctggcccccctgtgatccagcagcccaccacccccatgtttgtggcccccccacccaagacccagaggctgctgcacagcgaggcctacctgaagtacatcgagggcctgtctgctgagagcaacagcatcagcaagtgggaccagaccctggccgcccggaggagagatgtgcacctgagcaaggagcaggagagccggctgcccagccactggctgaagagcaaaggagcccacaccaccatggctgatgccctgtggaggctgcgggacctgatgctgcgggacaccctgaacatccggcaggcctacaacctggagaatgtgtag

SEQ ID NO: 164577 - DNA, 459 bp, Artificial Sequence
  Description of Artificial Sequence: Synthetic coding sequence
atgggcagcaagagaagaagagccaccagccccagcagctctgtgtctggggactttgatgatggccaccacagcgtgtccaccccaggccccagcaggaagagaagaaggctgagcaacctgcccaccgtggaccccatcgctgtgtgccacgagctgtacaacaccatccgggactacaaggatgagcagggccgcctgctgtgtgagctgttcatccgggcccccaagagaagaaaccagcctgactactatgaggtggtgtcccagcccatcgacctgatgaagatccagcagaagctgaagatggaggagtatgatgatgtgaacctgctgacagctgacttccagctgctcttcaacaatgccaagagctactacaagccagacagccctgagtacaaggccgcctgcaagctgtgggacctgtacctgcggaccagaaatgaatttgtgtag

SEQ ID NO: 164578 - DNA, 81 bp, Artificial Sequence
  Description of Artificial Sequence: Synthetic coding sequence
atgggcagcaagagaagaagagccaccagccccagcagctctgtgtctggggactttgatgatggccaccacagcgtgtag

SEQ ID NO: 164579 - DNA, 693 bp, Artificial Sequence
  Description of Artificial Sequence: Synthetic coding sequence
atgggcagcaagagaagaagagccaccagccccagcagctctgtgtctggggactttgatgatggccaccacagcgtgtccaccccaggccccagcaggaagagaagaaggctgagcaacctgcccaccgtggaccccatcgctgtgtgccacgagctgtacaacaccatccgggactacaaggatgagcagggccgcctgctgtgtgagctgttcatccgggcccccaagagaagaaaccagcctgactactatgaggtggtgtcccagcccatcgacctgatgaagatccagcagaagctgaagatggaggagtatgatgatgtgaacctgctgacagctgacttccagctgctcttcaacaatgccaagagctactacaagccagacagccctgagtacaaggccgcctgcaagctgtgggacctgtacctgcggaccagaaatgaatttgtgcagaagggggaggctgatgatgaagatgatgatgaagatggccaggacaaccagggcaccgtgacagagggcagcagccctgcctacctgaaggagatcctggagcagctgctggaggccatcgtggtggccaccaaccccagcggccgcctcatcagcgagctgttccagaagctgcccagcaaggtgcagtacccagactactatgccatcatcaaggagcccatcgacctgtag

SEQ ID NO: 164580 - DNA, 132 bp, Artificial Sequence
  Description of Artificial Sequence: Synthetic coding sequence
atgggcagcaagagaagaagagccaccagccccagcagctctgtgtctggggactttgatgatggccaccacagcgtgtccaccccaggccccagcaggaagagaagaaggctgagcaacctgcccacctag

SEQ ID NO: 164581 - DNA, 357 bp, Artificial Sequence
  Description of Artificial Sequence: Synthetic coding sequence
atgggcagcaagagaagaagagccaccagccccagcagctctgtgtctggggactttgatgatggccaccacagcgtgtccaccccaggccccagcaggaagagaagaaggctgagcaacctgcccaccgtggaccccatcgctgtgtgccacgagctgtacaacaccatccgggactacaaggatgagcagggccgcctgctgtgtgagctgttcatccgggcccccaagagaagaaaccagcctgactactatgaggtggtgtcccagcccatcgacctgatgaagatccagcagaagctgaagatggaggagtatgatgatgtgaacctgctgacagctgacttccagctgtag

SEQ ID NO: 164582 - DNA, 264 bp, Artificial Sequence
  Description of Artificial Sequence: Synthetic coding sequence
atgggcagcaagagaagaagagccaccagccccagcagctctgtgtctggggactttgatgatggccaccacagcgtgtccaccccaggccccagcaggaagagaagaaggctgagcaacctgcccaccgtggaccccatcgctgtgtgccacgagctgtacaacaccatccgggactacaaggatgagcagggccgcctgctgtgtgagctgttcatccgggcccccaagagaagaaaccagcctgactactatgaggtgtag

SEQ ID NO: 164583 - DNA, 132 bp, Artificial Sequence; identical to SEQ ID NO: 164580
  Description of Artificial Sequence: Synthetic coding sequence

SEQ ID NO: 164584 - DNA, 828 bp, Artificial Sequence
  Description of Artificial Sequence: Synthetic coding sequence
atggagggcgtggccgtggtgacagctggctctgtgggcgccgccaagacagaaggagctgctgccctgcccccacctcctcctgtgtccccaccagccctgaccccagccccagctgctggggaggagggccctgcccccctgtctgaaacaggagcccctggctgcagcggcagcaggcctcctgagctggagcctgagaggagcctgggccgcttccggggccgctttgaagatgaagatgaggagctggaggaggaggaggagctggaggaggaggaggaggaggaggaggaggacatgagccacttcagcctgcggctggagggcggccggcaggacagtgaagatgaggaggagcggctcatcaacctgtctgagctgaccccctacatcctgtgcagcatctgcaagggctacctgattgatgccaccaccatcacagaatgtctgcacaccttctgcaagagctgcatcgtgcgccacttctactacagcaaccgctgccccaagtgcaacatcgtggtgcaccagacccagcccctgtacaacatcagcgccaatgaaggaacaggccacttcaagcccctggagaagaagtttgtgcgggtgtctggagaggccaccatcggccacgtggagaagttcctgcggaggaagatgggcctggaccctgcctgccaggtggacatcatctgtggggaccacctgctggagcagtaccagaccctgcgggagatccggcgggccatcggagatgctgccatgcaggacggcctgctggtgctgcactacggcctggtggtgagccccctgaagatcacctag

SEQ ID NO: 164585 - DNA, 1053 bp, Artificial Sequence
  Description of Artificial Sequence: Synthetic coding sequence
atggagggcgtggccgtggtgacagctggctctgtgggcgccgccaagacagaaggagctgctgccctgcccccacctcctcctgtgtccccaccagccctgaccccagccccagctgctggggaggagggccctgcccccctgtctgaaacaggagcccctggctgcagcggcagcaggcctcctgagctggagcctgagaggagcctgggccgcttccggggccgctttgaagatgaagatgaggagctggaggaggaggaggagctggaggaggaggaggaggaggaggaggaggacatgagccacttcagcctgcggctggagggcggccggcaggacagtgaagatgaggaggagcggctcatcaacctgtctgagctgaccccctacatcctgtgcagcatctgcaagggctacctgattgatgccaccaccatcacagaatgtctgcacaccttctgcaagagctgcatcgtgcgccacttctactacagcaaccgctgccccaagtgcaacatcgtggtgcaccagacccagcccctgtacaacatccggctggaccggcagctgcaggacatcgtgtacaagctggtgatcaacctggaggagcgggagaagaagcagatgcatgacttctacaaggagcggggcctggaggtgcccaagccagctgtgccccagcctgtgcccagcagcaagggccgcagcaagaaggtgctggagagcgtcttccgcatccccccagagctggacatgagcctgctgctggagttcatcggggccaatgaaggcaccggccacttcaagcccctggagaagaagtttgtgcgggtgtctggagaggccaccatcggccacgtggagaagttcctgcggaggaagatgggcctggaccctgcctgccaggtggacatcatctgtggggaccacctgctggagcagtaccagaccctgcgggagatcagaagagccatcggagatgctgccatgcaggacggcctgctggtgctgcactacggcctggtggtgagccccctgaagatcacctag

SEQ ID NO: 164586 - DNA, 10191 bp, Artificial Sequence
  Description of Artificial Sequence: Synthetic coding sequence
atgacagcctggctgatcagcctgatgagcattgaggtgctgctgctggccgtgcgccacctgagcctgcacatcgagcctgaggagggcagcctggccggcggcacctggatcaccgtcatctttgatggcctggagctgggcgtgctgtaccccaacaacggcagccagctggagatccacctggtgaatgtgaacatggtggtgcctgccctgcggtctgtgccctgtgatgtgtttcctgtgttcctggacctgcctgtggtgacctgcaggaccaggtctgtgctgtctgaggcccacgagggcctgtacttcctggaggcctactttggaggccagctggtgagcagccccaaccctggcccccgggacagctgcaccttcaagttcagcaaggcccagacccccatcgtgcaccaggtgtacccacccagcggcgtgcctgggaagctgatccacgtgtatggctggatcatcaccggccgcctggagacctttgattttgatgctgagtacatcgacagccctgtgatcctggaggcccagggcgacaagtgggtgaccccctgcagcctcatcaaccggcagatgggcagctgctaccccatccaggaggaccacggcctgggcaccctgcagtgccacgtggagggggactacatcggcagccagaatgtgtccttcagcgtcttcaacaagggcaagtccatggtgcacaagaaggcctggctgatcagcgccaagcaggacctcttcctgtaccagacccacagcgagatcctgtctgtgtttcctgagaccggcagcctgggcggccgcaccaacatcaccatcaccggggacttctttgacaacagcgcccaggtgaccatcgccggcatcccctgtgacatcagacatgtgagccccaggaagattgagtgcaccacccgggcccctgggaaggatgtgcggctgaccaccccccagcccggcaacagaggcctgctgtttgaggtgggagatgctgtggagggcctggagctgacagaggccaccccaggctaccgctggcagatcgtgcccaatgccagcagccccttcggcttctggagccaggagggccagcccttccgggcccggctgagcggcttctttgtggcccctgagaccaacaactacaccttctggatccaggccgacagccaggccagcctgcacttctcctggagcgaggagcccaggaccaaggtgaaggtggccagcatctctgtgggcacagctgactggtttgacagctgggagcagaacagagatgagggcacctggcagcagaagacccccaagctggagctgctgggcggggccatgtactacctggaggccgagcaccacggcatcgcccccagccggggcatgagaattggagtgcagatccacaacacctggctgaacccagatgtggtgaccacctacctgcgggagaagcaccagatccgggtgcgggcccagaggctgcctgaggtgcaggtgctgaatgtgtctggccggggcaacttcttcctgacctgggacaacgtgagcagccagcccatcccagccaatgccacagcccacctgatccagaccaccatcgaggagctgctggccgtgaagtgcaagctggagcccctgtggagcaacatcctgctgcggctgggctttgagcggggccctgaggtgagcaacagtgatggagacctgaccagcggcacagagcccttctgtggccgcttcagcctgcggcagcccaggcacctggtgctgaccccacctgctgcccagaagggctaccgcctggaccagtacacccacctgtgcctggcctacaagggccacatgaacaagatcctgaagatgattgtgtccttcaccatcggcttccagaacatggtgaagaacaccacctgtgactggagcctgaccaggaccagccctgagagctggcagtttgactgcacagacctgtgggagacctgtgtgcgctgctttggagacctgcagcccccaccagccaacagccctgtgctggtgcaccagatcaacctgctgcccctggcccaggagaccggcctcttctacgtggatgagatcatcatcgctgacaccaacgtgacagtgtcccaggccgacagcggcacagcccggcctgggggcaacctggtggagagcgtgtctgtggtgggcagcccccctgtgtacagcgtgacctcctggctggccggctgcggcacagagctgcccctcatcacagcccggtctgtgcccacagagggcacagaggagggcagcggcctggtgctggtgaccacccagaggcggcagaggaccagcccccccctgggcggccacttccgcatccagctgcccaacacagtcatcagtgatgtgcctgtgcagatcagcgcccaccacctgcaccagctgctgcagaacaatgctgatgacttcaccagccgctacctgaatgccagtgacttcaccgtgaaggaggacctgtacacctgctatgagcacgtgtggaccctgtcctggagcacccagatcggggacctgcccaacttcatccgggtgtctgatgagaacctgactggagtgaacccagctgctgccaccagggtggtgtatgatggcggcgtcttcctgggccccatctttggagacatgctggccacagccaaccagcacacccaggtggtggtgcgggtgaatgatgtgcctgcccactgccccggcagctgcagcttccagtacctgcagggcagcaccccctgtgtgcacagcgtgtggtacagcattgatggagacatcaacctgatgatctacatcactggaacaggcttcagcggggacagccagttcctgcaggtgacagtgaacaagaccagctgcaaggtgatcttcagcaaccagaccaacgtggtgtgccagacagacctgctgcctgtgggcatgcaccgcatcctgatgctggtgcggcccagcggcctggccatcagcgccactggagaagatctcttcctgaatgtgaagccccggctggacatggtggagcccagcagagctgctgacatcggcggcctgtgggccaccatccggggcagcagcctggagggcgtgtccctcatcctgtttggcagctacagctgtgccatcaacgtggccaccagcaacagcagccgcatccagtgcaaggtgcccccccggggcaaggatggccgcatcgtgaatgtgaccgtcatccggggggactacagcgctgtgctgccccgggccttcacctacgtgagcagcctgaaccctgtgattgtgaccctgagcaggaacatcagcaacattgctggaggagagaccctggtgattggagtggcccggctgatgaactacacagacctggatgtggaggtgcacgtgcaggatgccctggcccctgtgcacacccagagcgcctggggcctggaggtggccctgccccccctgcctgctggcctgcaccgcatctctgtgtccatcaatggagtgtccatccacagccagggcgtggacctgcacatccagtacctgacagaggtgttcagcattgagccctgctgcggcagcctgctgggcggcaccatcctgagcatctctggaattggcttcagccgggaccctgccctggtgtgggtgctggtgggcaacagaagctgtgacatcgtgaacctgacagaggccagcatctggtgtgagaccctgcctgccccccagatcccagatgctggggcccccaccgtgcctgctgctgtggaggtgtgggccggcaaccgcttctttgcccggggccccagccccagcctggtgggcaagggcttcaccttcatgtatgaagctgctgccacccctgtggtgacagccatgcagggcgagatcaccaacagcagcctgagcctgcacgtgggcggcagcaacctgagcaacagcgtcatcctgctgggcaacctgaactgtgatgtggagacccagagcttccagggcaatgtgtccctgagcggctgcagcatccccctgcacagcctggaggccggcatctaccccctgcaggtgcggcagaagcagatgggctttgccaacatgtctgtggtgctgcagcagtttgctgtgatgccccgcatcatggccatcttccccagccagggcagcgcctgtggcggcaccatcctgactgtgcggggcctgctgctgaacagcagaagaagatctgtgcgggtggacctgagcggccccttcacctgtgtgatcctgagcctgggggaccacaccatcctgtgccaggtgtccctggagggggaccccctgcccggggccagcttcagcctgaatgtgacagtgctggtgaatggcctgaccagcgagtgccagggcaactgcaccctcttcatccgggaggaggccagccctgtgatggatgccctgagcaccaacaccagcggcagcctgaccaccgtgctgatccggggccagaggctggccaccacagcagatgagcccatggtgtttgtggatgaccagctgccctgcaatgtgaccttcttcaatgccagccacgtggtgtgccagacccgggacctggcccctggcccccactacctgtctgtgttctacaccagaaatggctacgcctgcagcggaaatgtgagccgccacttctacatcatgccccaggtgttccactacttccccaagaacttcagcctgcacggcggcagcctgctgaccatcgagggcaccggcctgcggggccagaacaccacctctgtgtacatcgaccagcagacctgcctgactgtgaacatcggggctgagctgatccgctgcatcgtgcccactggaaatggatctgtggccctggagattgaggtggatggcctgtggtaccacatcggggtcatcggctacaacaaggccttcaccccagagctgatcagcatcagccagagtgatgacatcctgacctttgctgtggcccagatcagcggggccgccaacatcgacatcttcatcggcatgagcccctgtgtgggcgtgtctggcaaccacacagtgctgcagtgtgtggtgcccagcctgcctgctggggagtaccacgtgcggggctatgactgcatccggggctgggccagcagcgccctggtgttcaccagcagggtcatcatcacagctgtgacagaaaattttggctgcctgggcggccgcctggtgcacgtgtttggagctggcttcagccctggaaatgtgtctgctgctgtgtgtggggccccctgccgggtgctggccaatgccaccgtgtctgccttcagctgcctggtgctgcccctggatgtgtccctggccttcctgtgtggcctgaagcgggaggaggacagctgtgaggccgcccggcacacctacgtgcagtgtgacctgactgtggccatggccacagagcagctgctggagagctggccctacctgtacatctgtgaggagagcagccagtgcctgtttgtgcctgaccactgggccgagagcatgttccccagcttcagcggcctcttcatcagccccaagctggagagagatgaggtgctgatctacaacagcagctgcaacatcaccatggagacagaggccgagatggagtgtgagacccccaaccagcccatcaccgtgaagatcacagagatcaggaagcgctggggccagaacacccagggcaacttcagcctgcagttctgccgccgctggagcaggacccacagctggttccctgagcggctgccccaggatggagacaacgtgacagtggagaatggccagctgctgctgctggacaccaacaccagcatcctgaacctgctgcacatcaagggcggcaagctgatcttcatggcccctggccccatcgagctgcgggcccacgccatcctggtgtctgatggaggagagctgcgcatcggcagcgaggacaagcccttccagggccgggcccagatcaccctgtatggcagcagctacagcacccccttcttcccctatggagtgaagttcctggccgtgagaaatggcaccctgagcctgcacggcagcctgcctgaggtgattgtgacctgcctgcgggccacagcccacgccctggacacagtgctggccctggaggatgctgtggactggaaccctggagatgaggtggtgatcatcagcggcaccggggtgaagggggccaagcccatggaggagatcgtgacagtggagaccgtgcaggacacagacctgtacctgaagagccccctgcgctacagccacaacttcacagagaactgggtggccggggagcaccacatcctgaaggccaccgtggccctgctgagccgcagcatcaccatccagggcaacctgaccaatgaaagagagaagctgctggtgtcctgccaggaggccaatgcccctgagggcaacctgcagcactgcctgtacagcatgtctgagaagatgctgggcagccgggacatgggcgcccgggtcatcgtgcagagcttccctgaggagcccagccaggtgcagctgaagggcgtgcagttccaggtgctgggccaggccttccacaagcacctgagcagcctgaccctggtgggcgccatgagggagagcttcatccagggctgcaccgtgagaaattccttcagccggggcctgtccatgtgtggcaccctgggcctgaaggtggacagcaatgtgttctacaacatcctgggccacgccctgctggtgggcacctgcacagagatgagatacatctcctgggaggccatccacggcaggaaggatgactggagcggccacggcaacatcatccggaacaacgtcatcatccaggtgtctggagctgagggcctgagcaaccctgagatgctgacccccagcggcatctacatctgcagccccaccaacgtgattgagggcaacagagtgtgtggggccggctacggctacttcttccacctgatgaccaaccagaccagccaggcccccctgctgtccttcacccagaacatcgcccacagctgcaccaggtatggcctgtttgtgtaccccaagttccagcccccctgggacaacgtgacaggcaccaccctcttccagagcttcaccgtgtgggagagcgctggaggagcccagatcttccgcagcagcaacctgcggctgaagaacttcaaggtgtacagctgccgggactttggaattgatgtgctggagagtgatgccaacacctctgtgacagacagcctgctgctgggccactttgcccacaagggcagcctgtgcatgagcagcggcatcaagacccccaagcgctgggagctgatggtgagcaacaccacctttgtgaactttgacctgatcaactgtgtggccatccgcacctgcagcgactgcagccagggccagggcggcttcaccgtgaagaccagccagctgaagttcaccaacagcagcaacctggtggccttccccttcccccatgctgccatcctggaggacctggatggcagcctgagcggcaagaacagaagccacatcctggcctccatggagaccctgagcgccagctgcctggtgaacagcagctttggccgggtggtgcacggcagcgcctgtggcggcggcgtgctcttccacaggatgagcatcggcctggccaacaccccagaggtgtcctatgacctgaccatgacagacagcaggaacaagaccaccaccgtgaactacgtgcgggacaccctgagcaacccccggggctggatggccctgctgctggaccaggagacctacagcctgcagagcgagaacctgtggatcaacagaagcctgcagtacagcgccacctttgacaactttgcccctggcaactacctgctgctggtgcacacagacctgcccccctacccagacatcctgctgcgctgtggcagccgggtgggcctgtccttccccttcctgcccagccctggccagaaccagggctgtgactggttcttcaacagccagctgcggcagctgacctacctggtgtctggagagggccaggtgcaggtgatcctgcgggtgaaggagggcatgccacccaccatcagcgccagcaccagcgcccctgagagcgccctgaagtggagcctgcctgagacctggcagggcgtggaggagggctggggcggctacaacaacaccatccctggccctggagatgatgtgctgatcctgcccaacagaacagtgctggtggacacagacctgcccttcttcaagggcctgtatgtgatgggcaccctggacttccctgtggacaggagcaatgtgctgtctgtggcctgcatggtgattgctggaggagagctgaaggtgggcaccctggagaaccccctggagaaggagcagaagctgctgatcctgctgcgggccagcgagggcgtcttctgtgacaggatgaatggcatccacatcgaccccggcaccatcggcgtgtatggcaaggtgcacctgtacagcgcctaccccaagaacagctggacccacctgggcgctgacatcgccagcggaaatgaaagaatcatcgtggaggatgctgtggactggaggcctcatgacaagatcgtgctgagcagcagcagctatgagccccatgaggccgaggtgctgactgtgaaggaggtgaagggccaccacgtgcgcatctatgaaaggctgaagcaccgccacatcggctctgtgcacgtgacagaagatggccgccacatccggctggccgctgaggtgggcctgctgaccaggaacatccagatccagccagatgtgtcctgccggggccgcctgtttgtgggcagcttcaggaagagcagccgggaggagttctctggagtgctgcagctgctgaatgtggagatccagaactttggcagccccctgtacagctctgtggagttcagcaatgtgtctgctggctcctggatcatcagcagcaccctgcaccagagctgtggcggcggcatccacgccgccgccagccacggcgtgctgctgaatgacaacatcgtgtttggaacagctggccatggaattgacctggagggccaggcctacacagtgaccaacaacctggtggtgctgatgacccagcctgcctggagcaccatctgggtggccggcatcaaggtgaaccaggtgaaggacatcaacctgcacggcaatgtggtggccggcagcgagcggctgggcttccacatccggggccacaagtgcagcagctgtgagctgctgtggagcgacaacgtggcccacagcagcctgcacggcctgcacctgtacaaggagagcggcctggacaactgcacccgcatcagcggcttcctggccttcaagaactttgattatggagccatgctgcacgtggagaacagcgtggagattgagaacatcaccctggtggacaacaccatcggcctgctggccgtggtgtatgtgttttctgccccccagaacagcgtgaagaaggtgcagatcgtgctgagaaattctgtgattgtggccaccagcagcagctttgactgcatccaggacaaggtgaagccccacagcgccaacctgaccagcacagaccgggcccccagcaacccccggggcggcagaattggcatcctgtggcctgtgttcaccagcgagcccaaccagtggccccaggagccctggcacaaggtgagaaatgaccacagcatcagcggcatcatgaagctgcaggatgtgaccttcagcagctttgtgaagagctgctacagtgatgacctggatgtgtgcatcctgcccaatgcagaaaattctggcatcatgcaccccatcacagctgagaggaccaggatgctgaagatcaaggacaagaacaagttctacttccccagcctgcagcccaggaaggacctgggcaaggtggtgtgcccagagctggactgtgccagccccaggaagtacctgttcaaggacctggatggccgggccctgggcctgcccccacctgtgtctgtgttccccaagacagaggccgagtggacagccagcttcttcaatgctgtgaccacagagcaggccctgaagatcagcgagtag

SEQ ID NO: 164587 - DNA, 12225 bp, Artificial Sequence
  Description of Artificial Sequence: Synthetic coding sequence
atgacagcctggctgatcagcctgatgagcattgaggtgctgctgctggccgtgcgccacctgagcctgcacatcgagcctgaggagggcagcctggccggcggcacctggatcaccgtcatctttgatggcctggagctgggcgtgctgtaccccaacaacggcagccagctggagatccacctggtgaatgtgaacatggtggtgcctgccctgcggtctgtgccctgtgatgtgtttcctgtgttcctggacctgcctgtggtgacctgcaggaccaggtctgtgctgtctgaggcccacgagggcctgtacttcctggaggcctactttggaggccagctggtgagcagccccaaccctggcccccgggacagctgcaccttcaagttcagcaaggcccagacccccatcgtgcaccaggtgtacccacccagcggcgtgcctgggaagctgatccacgtgtatggctggatcatcaccggccgcctggagacctttgattttgatgctgagtacatcgacagccctgtgatcctggaggcccagggcgacaagtgggtgaccccctgcagcctcatcaaccggcagatgggcagctgctaccccatccaggaggaccacggcctgggcaccctgcagtgccacgtggagggggactacatcggcagccagaatgtgtccttcagcgtcttcaacaagggcaagtccatggtgcacaagaaggcctggctgatcagcgccaagcaggacctcttcctgtaccagacccacagcgagatcctgtctgtgtttcctgagaccggcagcctgggcggccgcaccaacatcaccatcaccggggacttctttgacaacagcgcccaggtgaccatcgccggcatcccctgtgacatcagacatgtgagccccaggaagattgagtgcaccacccgggcccctgggaaggatgtgcggctgaccaccccccagcccggcaacagaggcctgctgtttgaggtgggagatgctgtggagggcctggagctgacagaggccaccccaggctaccgctggcagatcgtgcccaatgccagcagccccttcggcttctggagccaggagggccagcccttccgggcccggctgagcggcttctttgtggcccctgagaccaacaactacaccttctggatccaggccgacagccaggccagcctgcacttctcctggagcgaggagcccaggaccaaggtgaaggtggccagcatctctgtgggcacagctgactggtttgacagctgggagcagaacagagatgagggcacctggcagcagaagacccccaagctggagctgctgggcggggccatgtactacctggaggccgagcaccacggcatcgcccccagccggggcatgagaattggagtgcagatccacaacacctggctgaacccagatgtggtgaccacctacctgcgggagaagcaccagatccgggtgcgggcccagaggctgcctgaggtgcaggtgctgaatgtgtctggccggggcaacttcttcctgacctgggacaacgtgagcagccagcccatcccagccaatgccacagcccacctgatccagaccaccatcgaggagctgctggccgtgaagtgcaagctggagcccctgtggagcaacatcctgctgcggctgggctttgagcggggccctgaggtgagcaacagtgatggagacctgaccagcggcacagagcccttctgtggccgcttcagcctgcggcagcccaggcacctggtgctgaccccacctgctgcccagaagggctaccgcctggaccagtacacccacctgtgcctggcctacaagggccacatgaacaagatcctgaagatgattgtgtccttcaccatcggcttccagaacatggtgaagaacaccacctgtgactggagcctgaccaggaccagccctgagagctggcagtttgactgcacagacctgtgggagacctgtgtgcgctgctttggagacctgcagcccccaccagccaacagccctgtgctggtgcaccagatcaacctgctgcccctggcccaggagaccggcctcttctacgtggatgagatcatcatcgctgacaccaacgtgacagtgtcccaggccgacagcggcacagcccggcctgggggcaacctggtggagagcgtgtctgtggtgggcagcccccctgtgtacagcgtgacctcctggctggccggctgcggcacagagctgcccctcatcacagcccggtctgtgcccacagagggcacagaggagggcagcggcctggtgctggtgaccacccagaggcggcagaggaccagcccccccctgggcggccacttccgcatccagctgcccaacacagtcatcagtgatgtgcctgtgcagatcagcgcccaccacctgcaccagctgctgcagaacaatgctgatgacttcaccagccgctacctgaatgccagtgacttcaccgtgaaggaggacctgtacacctgctatgagcacgtgtggaccctgtcctggagcacccagatcggggacctgcccaacttcatccgggtgtctgatgagaacctgactggagtgaacccagctgctgccaccagggtggtgtatgatggcggcgtcttcctgggccccatctttggagacatgctggccacagccaaccagcacacccaggtggtggtgcgggtgaatgatgtgcctgcccactgccccggcagctgcagcttccagtacctgcagggcagcaccccctgtgtgcacagcgtgtggtacagcattgatggagacatcaacctgatgatctacatcactggaacaggcttcagcggggacagccagttcctgcaggtgacagtgaacaagaccagctgcaaggtgatcttcagcaaccagaccaacgtggtgtgccagacagacctgctgcctgtgggcatgcaccgcatcctgatgctggtgcggcccagcggcctggccatcagcgccactggagaagatctcttcctgaatgtgaagccccggctggacatggtggagcccagcagagctgctgacatcggcggcctgtgggccaccatccggggcagcagcctggagggcgtgtccctcatcctgtttggcagctacagctgtgccatcaacgtggccaccagcaacagcagccgcatccagtgcaaggtgcccccccggggcaaggatggccgcatcgtgaatgtgaccgtcatccggggggactacagcgctgtgctgccccgggccttcacctacgtgagcagcctgaaccctgtgattgtgaccctgagcaggaacatcagcaacattgctggaggagagaccctggtgattggagtggcccggctgatgaactacacagacctggatgtggaggtgcacgtgcaggatgccctggcccctgtgcacacccagagcgcctggggcctggaggtggccctgccccccctgcctgctggcctgcaccgcatctctgtgtccatcaatggagtgtccatccacagccagggcgtggacctgcacatccagtacctgacagaggtgttcagcattgagccctgctgcggcagcctgctgggcggcaccatcctgagcatctctggaattggcttcagccgggaccctgccctggtgtgggtgctggtgggcaacagaagctgtgacatcgtgaacctgacagaggccagcatctggtgtgagaccctgcctgccccccagatcccagatgctggggcccccaccgtgcctgctgctgtggaggtgtgggccggcaaccgcttctttgcccggggccccagccccagcctggtgggcaagggcttcaccttcatgtatgaagctgctgccacccctgtggtgacagccatgcagggcgagatcaccaacagcagcctgagcctgcacgtgggcggcagcaacctgagcaacagcgtcatcctgctgggcaacctgaactgtgatgtggagacccagagcttccagggcaatgtgtccctgagcggctgcagcatccccctgcacagcctggaggccggcatctaccccctgcaggtgcggcagaagcagatgggctttgccaacatgtctgtggtgctgcagcagtttgctgtgatgccccgcatcatggccatcttccccagccagggcagcgcctgtggcggcaccatcctgactgtgcggggcctgctgctgaacagcagaagaagatctgtgcgggtggacctgagcggccccttcacctgtgtgatcctgagcctgggggaccacaccatcctgtgccaggtgtccctggagggggaccccctgcccggggccagcttcagcctgaatgtgacagtgctggtgaatggcctgaccagcgagtgccagggcaactgcaccctcttcatccgggaggaggccagccctgtgatggatgccctgagcaccaacaccagcggcagcctgaccaccgtgctgatccggggccagaggctggccaccacagcagatgagcccatggtgtttgtggatgaccagctgccctgcaatgtgaccttcttcaatgccagccacgtggtgtgccagacccgggacctggcccctggcccccactacctgtctgtgttctacaccagaaatggctacgcctgcagcggaaatgtgagccgccacttctacatcatgccccaggtgttccactacttccccaagaacttcagcctgcacggcggcagcctgctgaccatcgagggcaccggcctgcggggccagaacaccacctctgtgtacatcgaccagcagacctgcctgactgtgaacatcggggctgagctgatccgctgcatcgtgcccactggaaatggatctgtggccctggagattgaggtggatggcctgtggtaccacatcggggtcatcggctacaacaaggccttcaccccagagctgatcagcatcagccagagtgatgacatcctgacctttgctgtggcccagatcagcggggccgccaacatcgacatcttcatcggcatgagcccctgtgtgggcgtgtctggcaaccacacagtgctgcagtgtgtggtgcccagcctgcctgctggggagtaccacgtgcggggctatgactgcatccggggctgggccagcagcgccctggtgttcaccagcagggtcatcatcacagctgtgacagaaaattttggctgcctgggcggccgcctggtgcacgtgtttggagctggcttcagccctggaaatgtgtctgctgctgtgtgtggggccccctgccgggtgctggccaatgccaccgtgtctgccttcagctgcctggtgctgcccctggatgtgtccctggccttcctgtgtggcctgaagcgggaggaggacagctgtgaggccgcccggcacacctacgtgcagtgtgacctgactgtggccatggccacagagcagctgctggagagctggccctacctgtacatctgtgaggagagcagccagtgcctgtttgtgcctgaccactgggccgagagcatgttccccagcttcagcggcctcttcatcagccccaagctggagagagatgaggtgctgatctacaacagcagctgcaacatcaccatggagacagaggccgagatggagtgtgagacccccaaccagcccatcaccgtgaagatcacagagatcaggaagcgctggggccagaacacccagggcaacttcagcctgcagttctgccgccgctggagcaggacccacagctggttccctgagcggctgccccaggatggagacaacgtgacagtggagaatggccagctgctgctgctggacaccaacaccagcatcctgaacctgctgcacatcaagggcggcaagctgatcttcatggcccctggccccatcgagctgcgggcccacgccatcctggtgtctgatggaggagagctgcgcatcggcagcgaggacaagcccttccagggccgggcccagatcaccctgtatggcagcagctacagcacccccttcttcccctatggagtgaagttcctggccgtgagaaatggcaccctgagcctgcacggcagcctgcctgaggtgattgtgacctgcctgcgggccacagcccacgccctggacacagtgctggccctggaggatgctgtggactggaaccctggagatgaggtggtgatcatcagcggcaccggggtgaagggggccaagcccatggaggagatcgtgacagtggagaccgtgcaggacacagacctgtacctgaagagccccctgcgctacagccacaacttcacagagaactgggtggccggggagcaccacatcctgaaggccaccgtggccctgctgagccgcagcatcaccatccagggcaacctgaccaatgaaagagagaagctgctggtgtcctgccaggaggccaatgcccctgagggcaacctgcagcactgcctgtacagcatgtctgagaagatgctgggcagccgggacatgggcgcccgggtcatcgtgcagagcttccctgaggagcccagccaggtgcagctgaagggcgtgcagttccaggtgctgggccaggccttccacaagcacctgagcagcctgaccctggtgggcgccatgagggagagcttcatccagggctgcaccgtgagaaattccttcagccggggcctgtccatgtgtggcaccctgggcctgaaggtggacagcaatgtgttctacaacatcctgggccacgccctgctggtgggcacctgcacagagatgagatacatctcctgggaggccatccacggcaggaaggatgactggagcggccacggcaacatcatccggaacaacgtcatcatccaggtgtctggagctgagggcctgagcaaccctgagatgctgacccccagcggcatctacatctgcagccccaccaacgtgattgagggcaacagagtgtgtggggccggctacggctacttcttccacctgatgaccaaccagaccagccaggcccccctgctgtccttcacccagaacatcgcccacagctgcaccaggtatggcctgtttgtgtaccccaagttccagcccccctgggacaacgtgacaggcaccaccctcttccagagcttcaccgtgtgggagagcgctggaggagcccagatcttccgcagcagcaacctgcggctgaagaacttcaaggtgtacagctgccgggactttggaattgatgtgctggagagtgatgccaacacctctgtgacagacagcctgctgctgggccactttgcccacaagggcagcctgtgcatgagcagcggcatcaagacccccaagcgctgggagctgatggtgagcaacaccacctttgtgaactttgacctgatcaactgtgtggccatccgcacctgcagcgactgcagccagggccagggcggcttcaccgtgaagaccagccagctgaagttcaccaacagcagcaacctggtggccttccccttcccccatgctgccatcctggaggacctggatggcagcctgagcggcaagaacagaagccacatcctggcctccatggagaccctgagcgccagctgcctggtgaacagcagctttggccgggtggtgcacggcagcgcctgtggcggcggcgtgctcttccacaggatgagcatcggcctggccaacaccccagaggtgtcctatgacctgaccatgacagacagcaggaacaagaccaccaccgtgaactacgtgcgggacaccctgagcaacccccggggctggatggccctgctgctggaccaggagacctacagcctgcagagcgagaacctgtggatcaacagaagcctgcagtacagcgccacctttgacaactttgcccctggcaactacctgctgctggtgcacacagacctgcccccctacccagacatcctgctgcgctgtggcagccgggtgggcctgtccttccccttcctgcccagccctggccagaaccagggctgtgactggttcttcaacagccagctgcggcagctgacctacctggtgtctggagagggccaggtgcaggtgatcctgcgggtgaaggagggcatgccacccaccatcagcgccagcaccagcgcccctgagagcgccctgaagtggagcctgcctgagacctggcagggcgtggaggagggctggggcggctacaacaacaccatccctggccctggagatgatgtgctgatcctgcccaacagaacagtgctggtggacacagacctgcccttcttcaagggcctgtatgtgatgggcaccctggacttccctgtggacaggagcaatgtgctgtctgtggcctgcatggtgattgctggaggagagctgaaggtgggcaccctggagaaccccctggagaaggagcagaagctgctgatcctgctgcgggccagcgagggcgtcttctgtgacaggatgaatggcatccacatcgaccccggcaccatcggcgtgtatggcaaggtgcacctgtacagcgcctaccccaagaacagctggacccacctgggcgctgacatcgccagcggaaatgaaagaatcatcgtggaggatgctgtggactggaggcctcatgacaagatcgtgctgagcagcagcagctatgagccccatgaggccgaggtgctgactgtgaaggaggtgaagggccaccacgtgcgcatctatgaaaggctgaagcaccgccacatcggctctgtgcacgtgacagaagatggccgccacatccggctggccgctgaggtgggcctgctgaccaggaacatccagatccagccagatgtgtcctgccggggccgcctgtttgtgggcagcttcaggaagagcagccgggaggagttctctggagtgctgcagctgctgaatgtggagatccagaactttggcagccccctgtacagctctgtggagttcagcaatgtgtctgctggctcctggatcatcagcagcaccctgcaccagagctgtggcggcggcatccacgccgccgccagccacggcgtgctgctgaatgacaacatcgtgtttggaacagctggccatggaattgacctggagggccaggcctacacagtgaccaacaacctggtggtgctgatgacccagcctgcctggagcaccatctgggtggccggcatcaaggtgaaccaggtgaaggacatcaacctgcacggcaatgtggtggccggcagcgagcggctgggcttccacatccggggccacaagtgcagcagctgtgagctgctgtggagcgacaacgtggcccacagcagcctgcacggcctgcacctgtacaaggagagcggcctggacaactgcacccgcatcagcggcttcctggccttcaagaactttgattatggagccatgctgcacgtggagaacagcgtggagattgagaacatcaccctggtggacaacaccatcggcctgctggccgtggtgtatgtgttttctgccccccagaacagcgtgaagaaggtgcagatcgtgctgagaaattctgtgattgtggccaccagcagcagctttgactgcatccaggacaaggtgaagccccacagcgccaacctgaccagcacagaccgggcccccagcaacccccggggcggcagaattggcatcctgtggcctgtgttcaccagcgagcccaaccagtggccccaggagccctggcacaaggtgagaaatgaccacagcatcagcggcatcatgaagctgcaggatgtgaccttcagcagctttgtgaagagctgctacagtgatgacctggatgtgtgcatcctgcccaatgcagaaaattctggcatcatgcaccccatcacagctgagaggaccaggatgctgaagatcaaggacaagaacaagttctacttccccagcctgcagcccaggaaggacctgggcaaggtggtgtgcccagagctggactgtgccagccccaggaagtacctgttcaaggacctggatggccgggccctgggcctgcccccacctgtgtctgtgttccccaagacagaggccgagtggacagccagcttcttcaatgccggcaccttccgggaggagcagaagtgcacctaccagttcctgatgcagggcttcatctgcaagcagacagaccaggtggtgctgatcctggacagcgcagatgccatctgggccatccagaagctgtaccctgtggtgtctgtgaccagcggctttgtggatgtgttcagctctgtgaatgccaacatcccctgcagcaccagcggctctgtgtccaccttctacagcatcctgcccatccggcagatcaccaaggtgtgcttcatggaccagaccccccaggtgctgcgcttcttcctgctgggcaacaagagcaccagcaagctgctgctggccgtgttctaccacgagctgcagagcccccacgtgttcctgggggagagcttcatcccccccaccctggtgcagagcgccagcctgctgctgaatgaaagcattggagccaactacttcaacatcatggacaacctgctgtatgtggtgctgcagggcgaggagcccatcgagatccgctctggagtgtccatccacctggccctgactgtgatggtgtctgtgctggagaagggctgggagatcgtcatcctggagcggctgaccaacttcctgcagatcggccagaaccagatccgcttcatccacgagatgcctggccacgaggagaccctgaaggccatcgctgacagccgggccaagaggaagaggaactgccccaccgtgacctgcaccagccactaccgccgggtgggccagaggcggcccctgatgatggagatgaacagccaccgggccagcccccccatgacagtggagaccatcagcaaggtgattgtcatcgagatcggggacagccccaccgtgcgcagcacaggcatgatcagcagcctgagcagcaacaagctgcagaacctggcccacagggtcatcacagcccagcagacaggagtgctggagaatgtgctgaacatgaccatcggggccctgctggtgacccagagcaaaggagtcatcggctacggcaacaccagcagcttcaagacaggcaacctgatctacatccggccctatgccctgagcatcctggtgcagcccagtgatggagaggtgggcaatgagctgcctgtgcagccccagctggtgttcctggatgagcagaacagaagagtggagagcctgggccccccatctgagccctggaccatcagcgccagcctggagggcgccagtgacagcgtgctgaagggctgcacccaggccgagacccaggacggctacgtgtccttctacaacctggccgtgctgatcagcggcagcaactggcacttcatcttcaccgtgaccagccccccaggagtgaacttcaccgcccggagcaagccctttgctgtgctgcctgtgaccaggaaggagaagagcaccatcatcctggccgccagcctgagctctgtggcctcctggctggccctgagctgcctggtgtgctgctggctgaagaggagcaagagcaggaagaccaagccagaggagatccctgagagccagaccaacaaccagaacatccacatccacatcagcagcaagagaagagagagccagggccccaagaaggaggacacagtggtgggggaggacatgaggatgaaggtgatgctgggcaaggtgaaccagtgcccccaccagctgatgaatggagtgtccaggaggaaggtgagccgccacatcgtgcgggaggaggaggccgctgtgcctgcccctggcaccaccggcatcaccagccacggccacatctgtgcccctggggccccagcccagcaggtgtacctgcaggagaccggcaactggaaggagggccaggagcagctgctgcgctaccagctggccggccagaaccagctgctgctgctgtgcccagacttccggcaggagcggcagcagctgcccggccagagccggctgagcaagcagagcggcagcctgggcctgagccaggagaagaaggccagctgtggggccacagaggccttctgcctgcacagcgtgcaccctgagaccatccaggagcagctgtag

SEQ ID NO: 164588 - DNA, 10191 bp, Artificial Sequence
  Description of Artificial Sequence: Synthetic coding sequence
atgacagcctggctgatcagcctgatgagcattgaggtgctgctgctggccgtgcgccacctgagcctgcacatcgagcctgaggagggcagcctggccggcggcacctggatcaccgtcatctttgatggcctggagctgggcgtgctgtaccccaacaacggcagccagctggagatccacctggtgaatgtgaacatggtggtgcctgccctgcggtctgtgccctgtgatgtgtttcctgtgttcctggacctgcctgtggtgacctgcaggaccaggtctgtgctgtctgaggcccacgagggcctgtacttcctggaggcctactttggaggccagctggtgagcagccccaaccctggcccccgggacagctgcaccttcaagttcagcaaggcccagacccccatcgtgcaccaggtgtacccacccagcggcgtgcctgggaagctgatccacgtgtatggctggatcatcaccggccgcctggagacctttgattttgatgctgagtacatcgacagccctgtgatcctggaggcccagggcgacaagtgggtgaccccctgcagcctcatcaaccggcagatgggcagctgctaccccatccaggaggaccacggcctgggcaccctgcagtgccacgtggagggggactacatcggcagccagaatgtgtccttcagcgtcttcaacaagggcaagtccatggtgcacaagaaggcctggctgatcagcgccaagcaggacctcttcctgtaccagacccacagcgagatcctgtctgtgtttcctgagaccggcagcctgggcggccgcaccaacatcaccatcaccggggacttctttgacaacagcgcccaggtgaccatcgccggcatcccctgtgacatcagacatgtgagccccaggaagattgagtgcaccacccgggcccctgggaaggatgtgcggctgaccaccccccagcccggcaacagaggcctgctgtttgaggtgggagatgctgtggagggcctggagctgacagaggccaccccaggctaccgctggcagatcgtgcccaatgccagcagccccttcggcttctggagccaggagggccagcccttccgggcccggctgagcggcttctttgtggcccctgagaccaacaactacaccttctggatccaggccgacagccaggccagcctgcacttctcctggagcgaggagcccaggaccaaggtgaaggtggccagcatctctgtgggcacagctgactggtttgacagctgggagcagaacagagatgagggcacctggcagcagaagacccccaagctggagctgctgggcggggccatgtactacctggaggccgagcaccacggcatcgcccccagccggggcatgagaattggagtgcagatccacaacacctggctgaacccagatgtggtgaccacctacctgcgggagaagcaccagatccgggtgcgggcccagaggctgcctgaggtgcaggtgctgaatgtgtctggccggggcaacttcttcctgacctgggacaacgtgagcagccagcccatcccagccaatgccacagcccacctgatccagaccaccatcgaggagctgctggccgtgaagtgcaagctggagcccctgtggagcaacatcctgctgcggctgggctttgagcggggccctgaggtgagcaacagtgatggagacctgaccagcggcacagagcccttctgtggccgcttcagcctgcggcagcccaggcacctggtgctgaccccacctgctgcccagaagggctaccgcctggaccagtacacccacctgtgcctggcctacaagggccacatgaacaagatcctgaagatgattgtgtccttcaccatcggcttccagaacatggtgaagaacaccacctgtgactggagcctgaccaggaccagccctgagagctggcagtttgactgcacagacctgtgggagacctgtgtgcgctgctttggagacctgcagcccccaccagccaacagccctgtgctggtgcaccagatcaacctgctgcccctggcccaggagaccggcctcttctacgtggatgagatcatcatcgctgacaccaacgtgacagtgtcccaggccgacagcggcacagcccggcctgggggcaacctggtggagagcgtgtctgtggtgggcagcccccctgtgtacagcgtgacctcctggctggccggctgcggcacagagctgcccctcatcacagcccggtctgtgcccacagagggcacagaggagggcagcggcctggtgctggtgaccacccagaggcggcagaggaccagcccccccctgggcggccacttccgcatccagctgcccaacacagtcatcagtgatgtgcctgtgcagatcagcgcccaccacctgcaccagctgctgcagaacaatgctgatgacttcaccagccgctacctgaatgccagtgacttcaccgtgaaggaggacctgtacacctgctatgagcacgtgtggaccctgtcctggagcacccagatcggggacctgcccaacttcatccgggtgtctgatgagaacctgactggagtgaacccagctgctgccaccagggtggtgtatgatggcggcgtcttcctgggccccatctttggagacatgctggccacagccaaccagcacacccaggtggtggtgcgggtgaatgatgtgcctgcccactgccccggcagctgcagcttccagtacctgcagggcagcaccccctgtgtgcacagcgtgtggtacagcattgatggagacatcaacctgatgatctacatcactggaacaggcttcagcggggacagccagttcctgcaggtgacagtgaacaagaccagctgcaaggtgatcttcagcaaccagaccaacgtggtgtgccagacagacctgctgcctgtgggcatgcaccgcatcctgatgctggtgcggcccagcggcctggccatcagcgccactggagaagatctcttcctgaatgtgaagccccggctggacatggtggagcccagcagagctgctgacatcggcggcctgtgggccaccatccggggcagcagcctggagggcgtgtccctcatcctgtttggcagctacagctgtgccatcaacgtggccaccagcaacagcagccgcatccagtgcaaggtgcccccccggggcaaggatggccgcatcgtgaatgtgaccgtcatccggggggactacagcgctgtgctgccccgggccttcacctacgtgagcagcctgaaccctgtgattgtgaccctgagcaggaacatcagcaacattgctggaggagagaccctggtgattggagtggcccggctgatgaactacacagacctggatgtggaggtgcacgtgcaggatgccctggcccctgtgcacacccagagcgcctggggcctggaggtggccctgccccccctgcctgctggcctgcaccgcatctctgtgtccatcaatggagtgtccatccacagccagggcgtggacctgcacatccagtacctgacagaggtgttcagcattgagccctgctgcggcagcctgctgggcggcaccatcctgagcatctctggaattggcttcagccgggaccctgccctggtgtgggtgctggtgggcaacagaagctgtgacatcgtgaacctgacagaggccagcatctggtgtgagaccctgcctgccccccagatcccagatgctggggcccccaccgtgcctgctgctgtggaggtgtgggccggcaaccgcttctttgcccggggccccagccccagcctggtgggcaagggcttcaccttcatgtatgaagctgctgccacccctgtggtgacagccatgcagggcgagatcaccaacagcagcctgagcctgcacgtgggcggcagcaacctgagcaacagcgtcatcctgctgggcaacctgaactgtgatgtggagacccagagcttccagggcaatgtgtccctgagcggctgcagcatccccctgcacagcctggaggccggcatctaccccctgcaggtgcggcagaagcagatgggctttgccaacatgtctgtggtgctgcagcagtttgctgtgatgccccgcatcatggccatcttccccagccagggcagcgcctgtggcggcaccatcctgactgtgcggggcctgctgctgaacagcagaagaagatctgtgcgggtggacctgagcggccccttcacctgtgtgatcctgagcctgggggaccacaccatcctgtgccaggtgtccctggagggggaccccctgcccggggccagcttcagcctgaatgtgacagtgctggtgaatggcctgaccagcgagtgccagggcaactgcaccctcttcatccgggaggaggccagccctgtgatggatgccctgagcaccaacaccagcggcagcctgaccaccgtgctgatccggggccagaggctggccaccacagcagatgagcccatggtgtttgtggatgaccagctgccctgcaatgtgaccttcttcaatgccagccacgtggtgtgccagacccgggacctggcccctggcccccactacctgtctgtgttctacaccagaaatggctacgcctgcagcggaaatgtgagccgccacttctacatcatgccccaggtgttccactacttccccaagaacttcagcctgcacggcggcagcctgctgaccatcgagggcaccggcctgcggggccagaacaccacctctgtgtacatcgaccagcagacctgcctgactgtgaacatcggggctgagctgatccgctgcatcgtgcccactggaaatggatctgtggccctggagattgaggtggatggcctgtggtaccacatcggggtcatcggctacaacaaggccttcaccccagagctgatcagcatcagccagagtgatgacatcctgacctttgctgtggcccagatcagcggggccgccaacatcgacatcttcatcggcatgagcccctgtgtgggcgtgtctggcaaccacacagtgctgcagtgtgtggtgcccagcctgcctgctggggagtaccacgtgcggggctatgactgcatccggggctgggccagcagcgccctggtgttcaccagcagggtcatcatcacagctgtgacagaaaattttggctgcctgggcggccgcctggtgcacgtgtttggagctggcttcagccctggaaatgtgtctgctgctgtgtgtggggccccctgccgggtgctggccaatgccaccgtgtctgccttcagctgcctggtgctgcccctggatgtgtccctggccttcctgtgtggcctgaagcgggaggaggacagctgtgaggccgcccggcacacctacgtgcagtgtgacctgactgtggccatggccacagagcagctgctggagagctggccctacctgtacatctgtgaggagagcagccagtgcctgtttgtgcctgaccactgggccgagagcatgttccccagcttcagcggcctcttcatcagccccaagctggagagagatgaggtgctgatctacaacagcagctgcaacatcaccatggagacagaggccgagatggagtgtgagacccccaaccagcccatcaccgtgaagatcacagagatcaggaagcgctggggccagaacacccagggcaacttcagcctgcagttctgccgccgctggagcaggacccacagctggttccctgagcggctgccccaggatggagacaacgtgacagtggagaatggccagctgctgctgctggacaccaacaccagcatcctgaacctgctgcacatcaagggcggcaagctgatcttcatggcccctggccccatcgagctgcgggcccacgccatcctggtgtctgatggaggagagctgcgcatcggcagcgaggacaagcccttccagggccgggcccagatcaccctgtatggcagcagctacagcacccccttcttcccctatggagtgaagttcctggccgtgagaaatggcaccctgagcctgcacggcagcctgcctgaggtgattgtgacctgcctgcgggccacagcccacgccctggacacagtgctggccctggaggatgctgtggactggaaccctggagatgaggtggtgatcatcagcggcaccggggtgaagggggccaagcccatggaggagatcgtgacagtggagaccgtgcaggacacagacctgtacctgaagagccccctgcgctacagccacaacttcacagagaactgggtggccggggagcaccacatcctgaaggccaccgtggccctgctgagccgcagcatcaccatccagggcaacctgaccaatgaaagagagaagctgctggtgtcctgccaggaggccaatgcccctgagggcaacctgcagcactgcctgtacagcatgtctgagaagatgctgggcagccgggacatgggcgcccgggtcatcgtgcagagcttccctgaggagcccagccaggtgcagctgaagggcgtgcagttccaggtgctgggccaggccttccacaagcacctgagcagcctgaccctggtgggcgccatgagggagagcttcatccagggctgcaccgtgagaaattccttcagccggggcctgtccatgtgtggcaccctgggcctgaaggtggacagcaatgtgttctacaacatcctgggccacgccctgctggtgggcacctgcacagagatgagatacatctcctgggaggccatccacggcaggaaggatgactggagcggccacggcaacatcatccggaacaacgtcatcatccaggtgtctggagctgagggcctgagcaaccctgagatgctgacccccagcggcatctacatctgcagccccaccaacgtgattgagggcaacagagtgtgtggggccggctacggctacttcttccacctgatgaccaaccagaccagccaggcccccctgctgtccttcacccagaacatcgcccacagctgcaccaggtatggcctgtttgtgtaccccaagttccagcccccctgggacaacgtgacaggcaccaccctcttccagagcttcaccgtgtgggagagcgctggaggagcccagatcttccgcagcagcaacctgcggctgaagaacttcaaggtgtacagctgccgggactttggaattgatgtgctggagagtgatgccaacacctctgtgacagacagcctgctgctgggccactttgcccacaagggcagcctgtgcatgagcagcggcatcaagacccccaagcgctgggagctgatggtgagcaacaccacctttgtgaactttgacctgatcaactgtgtggccatccgcacctgcagcgactgcagccagggccagggcggcttcaccgtgaagaccagccagctgaagttcaccaacagcagcaacctggtggccttccccttcccccatgctgccatcctggaggacctggatggcagcctgagcggcaagaacagaagccacatcctggcctccatggagaccctgagcgccagctgcctggtgaacagcagctttggccgggtggtgcacggcagcgcctgtggcggcggcgtgctcttccacaggatgagcatcggcctggccaacaccccagaggtgtcctatgacctgaccatgacagacagcaggaacaagaccaccaccgtgaactacgtgcgggacaccctgagcaacccccggggctggatggccctgctgctggaccaggagacctacagcctgcagagcgagaacctgtggatcaacagaagcctgcagtacagcgccacctttgacaactttgcccctggcaactacctgctgctggtgcacacagacctgcccccctacccagacatcctgctgcgctgtggcagccgggtgggcctgtccttccccttcctgcccagccctggccagaaccagggctgtgactggttcttcaacagccagctgcggcagctgacctacctggtgtctggagagggccaggtgcaggtgatcctgcgggtgaaggagggcatgccacccaccatcagcgccagcaccagcgcccctgagagcgccctgaagtggagcctgcctgagacctggcagggcgtggaggagggctggggcggctacaacaacaccatccctggccctggagatgatgtgctgatcctgcccaacagaacagtgctggtggacacagacctgcccttcttcaagggcctgtatgtgatgggcaccctggacttccctgtggacaggagcaatgtgctgtctgtggcctgcatggtgattgctggaggagagctgaaggtgggcaccctggagaaccccctggagaaggagcagaagctgctgatcctgctgcgggccagcgagggcgtcttctgtgacaggatgaatggcatccacatcgaccccggcaccatcggcgtgtatggcaaggtgcacctgtacagcgcctaccccaagaacagctggacccacctgggcgctgacatcgccagcggaaatgaaagaatcatcgtggaggatgctgtggactggaggcctcatgacaagatcgtgctgagcagcagcagctatgagccccatgaggccgaggtgctgactgtgaaggaggtgaagggccaccacgtgcgcatctatgaaaggctgaagcaccgccacatcggctctgtgcacgtgacagaagatggccgccacatccggctggccgctgaggtgggcctgctgaccaggaacatccagatccagccagatgtgtcctgccggggccgcctgtttgtgggcagcttcaggaagagcagccgggaggagttctctggagtgctgcagctgctgaatgtggagatccagaactttggcagccccctgtacagctctgtggagttcagcaatgtgtctgctggctcctggatcatcagcagcaccctgcaccagagctgtggcggcggcatccacgccgccgccagccacggcgtgctgctgaatgacaacatcgtgtttggaacagctggccatggaattgacctggagggccaggcctacacagtgaccaacaacctggtggtgctgatgacccagcctgcctggagcaccatctgggtggccggcatcaaggtgaaccaggtgaaggacatcaacctgcacggcaatgtggtggccggcagcgagcggctgggcttccacatccggggccacaagtgcagcagctgtgagctgctgtggagcgacaacgtggcccacagcagcctgcacggcctgcacctgtacaaggagagcggcctggacaactgcacccgcatcagcggcttcctggccttcaagaactttgattatggagccatgctgcacgtggagaacagcgtggagattgagaacatcaccctggtggacaacaccatcggcctgctggccgtggtgtatgtgttttctgccccccagaacagcgtgaagaaggtgcagatcgtgctgagaaattctgtgattgtggccaccagcagcagctttgactgcatccaggacaaggtgaagccccacagcgccaacctgaccagcacagaccgggcccccagcaacccccggggcggcagaattggcatcctgtggcctgtgttcaccagcgagcccaaccagtggccccaggagccctggcacaaggtgagaaatgaccacagcatcagcggcatcatgaagctgcaggatgtgaccttcagcagctttgtgaagagctgctacagtgatgacctggatgtgtgcatcctgcccaatgcagaaaattctggcatcatgcaccccatcacagctgagaggaccaggatgctgaagatcaaggacaagaacaagttctacttccccagcctgcagcccaggaaggacctgggcaaggtggtgtgcccagagctggactgtgccagccccaggaagtacctgttcaaggacctggatggccgggccctgggcctgcccccacctgtgtctgtgttccccaagacagaggccgagtggacagccagcttcttcaatgccggcaccaaggagcagagcattgagatcaacgtgtag

SEQ ID NO: 164589 - DNA, 12732 bp, Artificial Sequence
  Description of Artificial Sequence: Synthetic coding sequence
atgggccacctgtggctgctgggcatctggggcctgtgtggcctgctgctgtgtgccgctgaccccagcacagatggcagccagatcatccccaaggtgacagagatcatccccaagtatggcagcatcaacggggccacccggctgaccatccggggggagggcttcagccaggccaaccagttcaactacggcgtggacaatgctgagctgggcaacagcgtgcagctgatcagcagcttccagagcatcacctgtgatgtggagaaggatgccagccacagcacccagatcacctgctacacccgggccatgccagaagattcctacacagtgcgggtgtctgtggatggagtgcctgtgacagagaacaacacctgcaagggccacatcaacagctgggagtgcaccttcaatgccaagagcttccgcacccccaccatccgcagcatcacccccctgagcggcaccccaggcaccctcatcaccatccagggccgcatcttcacagatgtgtatggcagcaacatcgccctgagcagcaatggcaagaatgtgcgcatcctgcgggtgtacatcggcggcatgccctgtgagctgctgatcccccagagcgacaacctgtatggcctgaagctggaccaccccaatggagacatgggctccatggtgtgcaagaccaccggcaccttcatcggccaccacaacgtgtccttcatcctggacaatgactatggccgctccttcccccagaagatggcctactttgtgagcagcctgaacaagatcgccatgttccagacctacgccgaggtgaccatgatcttccccagccagggcagcatccggggcggcaccaccctgaccatcagcggccgcttctttgaccagacagacttccctgtgcgggtgctggtgggcggggagccctgtgacatcctgaatgtgacagagaacagcatctgctgcaagaccccacccaagccccacatcctgaagacagtgtacccaggcggccggggcctgaagctggaggtgtggaacaacagccggcccatccggctggaggagatcctggagtacaatgagaagaccccaggctacatgggcgcctcctgggtggacagcgccagctacatctggctgatggagcaggacacctttgtggcccgcttcagcggcttcctggtggccccagacagtgatgtgtaccgcttctacatcaagggagatgacagatatgccatctacttcagccagacaggcctgcctgaggacaaggtgcgcatcgcctaccacagcgccaatgccaacagctacttcagcagccccacccagaggagtgatgacatccacctgcagaagggcaaggagtactacatcgagatcctgctgcaggagtaccgcctgagcgcctttgtggatgtgggcctgtaccagtacagaaatgtgtacacagagcagcagacaggagatgctgtgaatgaggagcaggtgatcaagagccagagcaccatcctgcaggaggtgcaggtgatcaccctggagaactgggagaccaccaatgccatcaatgaggtgcagaagatcaaggtgaccagcccctgtgtggaggccaacagctgcagcctgtaccagtaccgcctcatctacaacatggagaagacagtgttcctgcctgcagatgccagcgagttcatcctgcagagcgccctgaatgacctgtggagcatcaagccagacacagtgcaggtgatccgcacccagaacccccagagctatgtgtacatggtgaccttcatcagcaccaggggggactttgacctgctgggctatgaggtggtggagggcaacaacgtgaccctggacatcacagagcagaccaagggcaagcccaacctggagaccttcaccctgaactgggatggcatcgccagcaagcccctgaccctgtggagcagcgaggccgagttccagggcgctgtggaggagatggtgtccaccaagtgccccccccagatcgccaactttgaggagggctttgtggtgaagtacttccgggactatgaaacagacttcaacctggagcacatcaacagaggccagaagacagctgagacagatgcctactgcggccgctacagcctgaagaacccagctgtgctgtttgattctgcagatgtgaagcccaacagaagaccctatggagacatcctgctcttcccctacaaccagctgtgcctggcctacaagggcttcctggccaactacatcggcctgaagttccagtaccaggacaacagcaagatcaccaggagcacagacacccagttcacctacaactttgcctacggcaacaactggacctacacctgcatcgacctgctggacctggtgaggaccaagtacacaggcaccaacgtgtccctgcagaggatcagcctgcacaaggccagcgagagccagagcttctacgtggatgtggtgtacatcggccacaccagcaccatcagcaccctggatgagatgcccaagaggcggctgcctgccctggccaacaagggcatcttcctggagcacttccaggtgaaccagaccaagaccaacggccccaccatgaccaaccagtacagcgtgaccatgaccagctacaactgcagctacaacatccccatgatggctgtgtcctttggccagatcatcacccatgaaacagaaaatgaatttgtgtaccggggcaacaactggccaggagagagcaagatccacatccagaggatccaggccgccagcccccccctgagcggcagctttgacatccaggcctacggccacatcctgaagggcctgcctgctgctgtgtctgctgctgacctgcagtttgccctgcagagcctggagggcatgggccgcatctctgtgacccgggagggcacctgtgccggctacgcctggaacatcaagtggaggagcacctgtgggaagcagaacctgctgcagatcaatgacagcaacatcattggagagaaggccaacatgacagtgacccgcatcaaggagggcggcctcttccggcagcacgtgctgggggacctgctgcggacccccagccagcagccccaggtggaggtgtatgtgaatggcatcccagccaagtgcagcggggactgtggcttcacctgggacagcaacatcacccccctggtgctggccatcagccccagccagggcagctatgaggagggcaccatcctgaccatcgtgggcagcggcttcagccccagcagcgctgtgacagtgtctgtgggccctgtgggctgcagcctgctgtctgtggatgagaaggagctgaagtgccagatcctgaatggatctgctggccacgcccctgtggccgtgtccatggctgatgtgggcctggcccagaatgtgggcggggaggagttctactttgtgtaccagagccagatcagccacatctggccagacagcggcagcattgctgggggcaccctgctgaccctgagcggcttcggcttcaatgaaaacagcaaggtgctggtgggcaatgagacctgcaacgtcatcgagggggacctgaaccgcatcacctgcaggacccccaagaagacagagggcaccgtggacatctctgtgaccaccaacggcttccaggccacagccagagatgccttctcctacaactgcctgcagacccccatcatcacagacttcagccccaaggtgaggaccatcctgggggaggtgaacctgaccatcaagggctacaactttggaaatgagctgacccagaacatggctgtgtatgtgggcggcaagacctgccagatcctgcactggaacttcacagacatccgctgcctgctgcccaagctgagccctgggaagcatgacatctacgtggaggtgaggaactggggctttgccagcacccgggacaagctgaacagcagcatccagtatgtgctggaggtgacctccatgttcccccagaggggcagcctgtttggaggaacagagatcaccatccggggcttcggcttcagcaccatcccagcagaaaatacagtgctgctgggcagcatcccctgcaatgtgaccagcagcagtgaaaatgtcatcaagtgcatcctgcacagcacaggcaacatcttccgcatcaccaacaacgggaaggacagcgtgcacggcctgggctacgcctggagcccccctgtgctgaatgtgtctgtgggggacacagtggcctggcactggcagacccaccccttcctgcggggcatcggctaccgcatcttctctgtgagcagccctggcagcgtcatctatgatggcaagggcttcaccagcggccggcagaagagcaccagcggcagcttctcctaccagttcaccagccctggcatccactactacagcagcggctacgtggatgaggcccacagcatcttcctgcagggcgtcatcaacgtgctgcctgctgagaccaggcacatccccctgcacctgtttgtgggccgctctgaggccacctacgcctatggaggccctgagaacctgcacctgggcagctctgtggccggctgcctggccacagagcccctgtgcagcctgaacaacaccagggtgaagaacagcaagaggctgctgtttgaggtgagcagctgcttcagccccagcatcagcaacatcacccccagcactggaacagtgaatgaactcatcaccatcattggacatggcttcagcaacctgccctgggccaacaaggtgaccatcggcagctacccctgtgtggtggaggagagcagcgaggacagcatcacctgccacatcgacccccagaacagcatggatgtgggcatccgggagaccgtgaccctgactgtgtacaacctgggcacagccatcaacaccctgagcaatgaatttgacagaagatttgtgctgctgcccaacatcgacctggtgctgcccaatgccggcagcaccaccggcatgacctctgtgaccatcaagggcagcggctttgctgtgagcagcgctggggtgaaggtgctgatgggccacttcccctgcaaggtgctgtctgtgaactacacagccattgaatgtgagaccagccctgctgcccagcagctggtggatgtggacctgctgattcatggagtgcctgcccagtgccagggcaactgcaccttctcctacctggagagcatcaccccctacatcaccggggtcttccccaacagcgtcatcggctctgtgaaggtgctgattgaaggagagggcctgggcaccgtgctggaggacattgctgtgttcatcggcaaccagcagttccgggccatcgaggtgaatgaaaacaacatcacagccctggtgacccccctgcctgtgggccaccacagcgtgtctgtggtggtgggcagcaagggcctggccctgggcaacctgactgtgagcagcccccctgtggccagcctgagccccaccagcggcagcattggaggcggcaccaccctggtgatcactggaaatggcttctacccaggcaacaccaccgtgaccatcggagatgagccctgccagatcatcagcatcaaccccaatgaggtgtactgcaggaccccagctggcaccaccggcatggtggatgtgaagatctttgtgaacaccatcgcctacccacccctgctcttcacctacgccctggaggacacccccttcctgcggggcatcatccccagccggggccccccaggcacagaaattgagatcaccggcagcaactttggatttgagatcctggagatctctgtgatgatcaacaacatccagtgcaatgtgaccatggccaatgattctgtggtgcagtgcatcgtgggggaccatgctgggggcaccttccctgtgatgatgcaccacaagaccaagggcagcgccatgagcacagtggtgtttgagtaccccctgaacatccagaacatcaaccccagccagggcagctttggaggcggccagaccatgacagtgacaggcaccggcttcaacccccagaacagcatcatcctggtgtgtggctctgaatgtgccatcgaccggctgcggagtgactacaccaccctgctgtgtgagatccccagcaacaacggcaccggggctgagcaggcctgtgaggtgtctgtggtgaatggcaaggacctgagccagagcatgacccccttcacctatgctgtgtccctgacccccctcatcacagctgtgagccccaagaggggcagcacagctgggggcacccggctgactgtggtgggcagcggcttcagcgagaacatggaggatgtgcacatcaccatcgccgaggccaagtgtgatgtggagtacagcaacaagacccacatcatctgcatgacagatgcccacaccctgagcggctgggcccctgtgtgtgtgcacatccggggcgtgggcatggccaagctggacaatgctgacttcctgtatgtggatgcctggagcagcaacttctcctggggcggcaagagccccccagaggagggcagcctggtggtgatcaccaagggccagaccatcctgctggaccagagcacccccatcctgaagatgctgctgatccagggcggcaccctcatctttgatgaggccgacatcgagctgcaggccgagaacatcctgatcacagatggaggagtgctgcagattggaacagagaccagccccttccagcacaaggccgtcatcaccctgcacggccacctgcggagccctgagctgcctgtgtatggagccaagaccctggccgtgcgggagggcatcctggacctgcatggagtgcctgtgcctgtgacctggacccggctggcccacacagccaaggccggggagcgcatcctgatcctgcaggaggccgtgacctggaagccaggggacaacatcgtgattgccagcacaggccaccgccacagccagggagaaaatgagaagatgaccatcgcctctgtgtctgcagatggcatcaacatcaccctgagcaaccccctgaactacacccacctgggcatcaccgtgaccctgcctgatggcaccctgtttgaggcccgggcagaggtgggcatcctgaccaggaacatcctgatccggggcagtgacaacgtggagtggaacaacaagatcccagcctgcccagatggctttgacacaggagaatttgccacccagacctgcctgcagggcaagtttggagaggagatcggcagtgaccagtttggaggctgtgtgatgttccacgcccctgtgcctggggccaacatggtgactggaagaattgaatatgtggaggtgttccacgccggccaggccttccggctgggccgctaccccatccactggcacctgctgggggacctgcagttcaagagctatgtgcggggctgtgccatccaccaggcctacaacagagctgtgaccatccacaacacccaccacctgctggtggagaggaacatcatctatgacatcaagggcggggccttcttcattgaagatggcatcgagcacggcaacatcctgcagtacaacctggccgtgtttgtgcagcagagcaccagcctgctgaatgatgatgtgaccccagctgccttctgggtgaccaaccccaacaacaccatccgccacaatgctgtggccggcggcacccacttcggcttctggtacaggatgaacaaccacccagatggccccagctatgacaggaacatctgccagaagagggtgcccctgggggagttcttcaacaacacagtgcacagccagggctggtttggcatgtggatctttgaggagtacttccccatgcagacaggcagctgcaccagcacagtgcctgccccagccatcttcaacagcctgaccacctggaactgccagaagggagctgagtgggtgaatggaggagccctgcagttccacaactttgtgatggtgaacaactatgaagctggcatcgagaccaagaggatcctggccccctacgtgggcggctggggcgagaccaacggggccgtcatcaagaatgccaagatcgtgggccacctggatgagctgggcatgggcagcgccttctgcacagccaagggcctggtgctgcccttcagcgagggcctgactgtgtcctctgtgcacttcatgaactttgaccggcccaactgtgtggccctgggcgtgaccagcatcagcggcgtgtgcaatgacagatgtggcggctggagcgccaagtttgtggatgtgcagtacagccacacccccaacaaggccggcttccgctgggagcacgagatggtgatgattgatgtggatggcagcctgaccggccacaagggccacacagtcatcccccacagcagcctgctggaccccagccactgcacccaggaggccgagtggagcatcggcttccctggctctgtgtgtgatgcctctgtgtccttccaccggctggccttcaaccagcccagccctgtgtccctgctggagaaggatgtggtgctgagtgacagctttggcaccagcatcatccccttccagaagaagaggctgacccacatgagcggctggatggccctgatccccaatgccaaccacatcaactggtacttcaagggcgtggaccacatcaccaacatctcctacaccagcaccttctacggcttcaaggaggaggactatgtgatcatcagccacaacttcacccagaacccagacatgttcaacatcatcgacatgagaaatggcagcagcaaccccctgaactggaacaccagcaagaatggagactggcacctggaggccaacaccagcaccctgtactacctggtgtctggaagaaatgacctgcaccagagccagctgatcagcggcaacctggaccctgatgtgaaggatgtggtgatcaacttccaggcctactgctgcatcctgcaggactgcttccctgtgcacccccccagcaggaagcccatccccaagaagaggcctgccacctacaacctgtggagcaatgacagcttctggcagagcagccgggagaacaactacacagtgccccaccctggggccaacgtcatcatccctgagggcacctggatcgtggccgacatcgacatgcccagcatggagcggctcatcatctggggcgtgctggagctggaggacaagtacaacgtgggcgctgctgagagcagctaccgggaggtggtgctgaatgccacctacatcagcctgcagggcggccgcctcatcggcggctgggaggacaaccccttcaagggggacctgaagatcgtgctgcggggcaaccacaccacccaggactgggccctgcctgagggccccaaccagggcgccaaggtgctgggcgtgtttggagagctggacctgcacggcatcccccacagcatctacaagaccaagctgtctgaaacagcctttgctggcagcaaggtgctgagcctgatggatgctgtggactggcaggagggggaggagatcgtcatcaccaccaccagctatgacttccaccagacagagaccaggagcatcgtgaagatcctgcatgaccacaagatcctgatcctgaatgacagcctgagctacacccactttgctgagaagtaccacgtgcccggcaccggggagagctacaccctggccgcagatgtgggcatcctgagcaggaacatcaagatcgtgggggaggactacccaggctggagcgaagattcttttggagcccgggtgctggtgggcagcttcacagagaacatgatgaccttcaagggaaatgcccgcatcagcaatgtggagttctaccacagcggccaggagggcttccgggacagcacagaccccaggtatgctgtgaccttcctgaacctgggccagatccaggagcacggcagcagctacatccggggctgtgccttccaccacggcttcagccctgccatcggcgtgtttggaacagatggcctggacattgatgacaacatcatccacttcaccgtgggggagggcatccgcatctggggcaatgccaacagagtgcggggcaacctgattgccctgtctgtgtggccaggcacctaccagaacaggaaggacctgagcagcaccctgtggcatgctgccatcgagatcaacagaggcaccaacacagtgctgcagaacaacgtggtggccggcttcggccgggccggctacagaattgatggagagccctgccccggccagttcaaccctgtggagaagtggtttgacaatgaggcccatggaggcctgtatggcatctacatgaaccaggacggcctgcccggctgcagcctcatccagggcttcaccatctggacctgctgggactatggcatctacttccagaccacagagagcgtgcacatctacaacgtgaccctggtggacaatggcatggccatcttccccatgatctacatgcctgctgccatcagccacaagatcagcagcaagaatgtgcagatcaagagcagcctgattgtgggcagcagccctggcttcaactgcagtgatgtgctgaccaatgatgaccccaacatcgagctgacagctgcccacaggagccccaggagccccagcggcggccgcagcggcatctgctggcccacctttgccagcgcccacaacatggcccccaggaagccccacgccggcatcatgagctacaatgccatcagcggcctgctggacatcagcggcagcacctttgtgggcttcaagaatgtgtgcagcggggagaccaacgtcatcttcatcaccaaccccctgaatgaagacctgcagcaccccatccacgtgaagaacatcaagctggtggacaccacagagcagagcaagatcttcatccacaggccagacatcagcaaggtgaaccccagcgactgtgtggacatggtgtgtgatgccaagaggaagagcttcctgcgggacattgatggcagcttcctgggcaatgccggcagcgtcatcccccaggccgagtatgagtgggatggcaacagccaggtgggcattggagactaccgcatccccaaggccatgctgaccttcctgaatggcagccgcatccctgtgacagagaaggccccccacaagggcatcatccgggacagcacctgcaagtacctgcctgagtggcagagctaccagtgcttcggcatggagtatgccatgatggtgattgagagcctggaccctgacacagagacccggcggctgagccctgtggccatcatgggaaatggctacgtggacctgatcaatggcccccaggaccacggctggtgtgccggctacacctgccagaggcggctgagcctcttccacagcatcgtggccctgaacaagagctatgaggtgtacttcaccggcaccagcccccagaacctgcggctgatgctgctgaatgtggaccacaacaaggctgtgctggtgggcatcttcttcagcaccctgcagaggctggatgtgtatgtgaacaacctgctggtgtgccccaagaccaccatctggaatgcccagcagaagcactgtgagctgaacaaccacctgtacaaggaccagttcctgcccaacctggacagcacagtgctgggggagaactactttgatggcacctaccagatgctgtacctgctggtgaagggcaccatccctgtggagatccacacagccaccgtcatctttgtgtccttccagctgtctgtggccacagaagatgacttctacaccagccacaacctggtgaagaacctggccctcttcctgaagatccccagcgacaagatccgcatcagcaagatccggggcaagagcctgcggaggaagaggtccatgggcttcatcattgaaattgaaattggagacccccccatccagttcatcagcaatggcaccaccggccagatgcagctgtctgagctgcaggagattgctggcagcctgggccaggccgtcatcctgggcaacatcagcagcatcctgggcttcaacatcagctccatgagcatcaccaaccccctgcccagccccagcgacagcggctggatcaaggtgacagcccagcctgtggagaggtctgccttccctgtgcaccacgtggcctttgtgagcagcctgctggtgatcacccagcctgtggccgcccagcccggccagcccttcccccagcagcccagcgtgaaggccacagacagtgatggcaactgtgtgtctgtgggcatcacagccctgaccctgcgggccatcctgaaggacagcaacaacaaccaggtgaatggcctgagcggcaacaccaccatccccttcagcagctgctgggccaactacacagacctgacccccctgaggacaggcaagaactacaagattgagttcatcctggacaacgtggtgggcgtggagagcaggaccttcagcctgctggccgagagcgtgagcagcagcggcagcagcagcagcagcaacagcaaggccagcacagtgggcacctacgcccagatcatgacagtggtgatcagctgcctggtgggccgcatgtggctgctggagatcttcatggctgctgtgtccaccctgaacatcaccctgcggagctactag

SEQ ID NO: 164590 - DNA, 6762 bp, Artificial Sequence
  Description of Artificial Sequence: Synthetic coding sequence
atgaggcctggccctgccctgctgctgctgggcgtgggcctgagcctgtctgtgggccgcctgcccctgccccctgtgcccaggggggcccaggccgctgtgtctggggcccctgggggcctgctgcggggggcccctggcctgggcgtgcggggcggccgggccctgctgagcctgcggcccagcgctgtgcgggccggcggcgctgtgctgagcggccggggcagcctgtgcttcccccatggaggcaccggccgccgctggtactgcctggacctgcgggtgctgctgagcgcccagaggctgccctggccagctgccccagccctggccctggtggacctgcagctgagcgcccggggcggccgcctgagcctgacctggagcgtgcggctgcccaggagccctggccgcctggcctgggccttccggctgcggctgctgggccctggggccgcccggcctgccagccctgctgcccgggtgagccccaggtctgctgcccctggcccccggccccagcagggctttgtggccaggacagagtgccccacagatggccctgcccgggtgatgctgcaggccgtgaacagcagcagccacagagctgtggagagctctgtgtcctgccagatcaatgcctgtgtgatccagagggtgcgcatcaacacagaccagaagggggcccctgtgcggctgtccatgcaggccgaggccaccatcaatgcctctgtgcagctggactgcccagctgcccgggccatcgcccagtactggcaggtgttttctgtgcctgctgtgggccaggccccagactggacccagcccctggacctgccccagctggagatccggaacagccccctcttcatccacatccccaacaacagcctgcagtggggcgtgtatgtgttcaacttcaccgtgtccatcaccactggaaaccccaagatgcctgaggtgaaggacagtgatgctgtgtatgtgtggatcgtgcgcagcagcctgcaggccgtgatgctgggagatgccaacatcacagccaacttcacagagcagctgatcctggatggcagcaccagcagtgaccctgatgctgacagccccctgcagggcctgcagttcttctggtactgcaccacagaccccaggaactacggcggggaccgcatcatcctgggcagcaaggaggtgtgccaccctgagcaggccaacctgaagtggccctgggccagcggccctgtgctgaccctgctgcctgagaccctgaagggggaccacgtgtacttcttcaggatggtgatcaggaaggacagcaggacagccttcagtgacaagagggtgcacgtgctgcagggccccaaggccatcgcccacatcacctgcatcgagaactgtgagaggaacttcatcgtgtctgaccgcttcagcctcttcctgaactgcaccaactgtgccagccgggacttctacaagtggagcatcctgagcagcagtggaggagagatgctgtttgactggatgggagaaacagtgactggaagaaatggagcctacctgagcatcaaggcctttgccttccgccacttcctggaggccgagttcagcatcagcctgtacctggcctgctggagcggcgtgacctctgtgttccgccacagcttcatcatcaaccacggcccccagattggagagtgcaagatcaacccagccaagggcatcgccctgatcaccaagtttgtggtgcagtgcagcaacttccgggacaagcacgtgcccctgacctacaagatcatcgtgtctgacctgcacagcgtgggggagatcagctctgtgaaggagaacaccctgggcaccatcctgtacctgggcccccagagcacagtgccccccagcttcctgcctgtgggcatgctggccagccagtatggcctgaagatctatgcccaggtgtatgacagcctgggcgccttcagccaggtgaccctgcacgccacagcccaggcccccacagacaagaacagcagcaagacagtgctgaaccagctgctgtccttcaccgtgggccccagcagcctgctgagcaccctcatccagaagaaggacttcctgcctgctggctacctgctgtacatcgtggcctctgtgctgaacaacatgaagacagagctgcccctgagagatgacagagtgaacctgaggaagcacctgattgaccagagcttcctgctgcctgtgtccaccctggtggagatcggccaggtggtgatgaccatcaccaagctgacccagaagcccagcgagttcacctgggatgcccagaagagggccaccatgagggtgtggcaggccaaccaggccctgcaggagtaccagcagaaggacaagcgcttccgctctgagcagattgaaattgtgtccacaggcatcctgatgagcctgagcaacatcctgaagatgaccagcccccaccaggtggtgaaggaccccttctacgtgattgagagcctgagtgacaccatcctggccaacaaggtgcccggcaacaagaccacctccatgaggacccccaacttcaacatgtatgtgaagaaggtggagaagtggggcatcaaccagctgttcagaaatgagaagcactgcaggaactgcttctaccccaccctgaatgtgtcctctgtgcccggcctgagcgccaacggccccatcagcaccatgttctgtgacttcaccaatgacctcttcccctggctgaatgaccaggagaacacctctgtggaggtgtctggcttcaggatgactggagtggccgacaatggatctgtgctggagatcaccccagatgtggccgaggtgtacctggtgaggaagaacctgacctttgctgccttcaacctgactgtgggccccaacagcgaggtggatggcagcctgaagaagaccaccggcggcttctccttccaggtggacagcacagtgctgcgggaggtgctggtgcacatcgtgacagaggtgatggtgctcttcaccgtgctggtgtacacaggcagccagatcacccccacagccctggtggccaccttcctggtgccccatgacatccccccatttgccagccagagcgccctgtttgatcctgcctgcaccgtgaagaaggcccgggtggtgtgcctgcctgtgtccctgctgcagctgattgcccagcacagccacagcccccactgcaccgtgtccatcgtgctgcaggcccccaggtttgtgatgaagctgaatgacaagctggtgcgcatcagcatcttctctgtgcagtgcctggacatgtatggcatccagagcgagtggagggagggctactgcatcctgggggagaagacctcctggtatgaggtgcactgcatctgcaagaatgtggtgcgggcccggcggcagctgggcaccatcggcctgaccggcatccacctgcacacccactacgtgatggccaaggtgattgtcatccccaaccctgtggacctgcggctgaacatcatcaagagcctgcaccagaaccctgtgaccctcttcaccgtgctcttcatcatcctgctgtatgtgggcctggccttctgggccctgtacagagatgagatggaccagcacctgcggggccacgtgattgtgctgcctgacaatgacccctatgacaacctgtgctacctggtgaccatcttcaccggcagccgctggggcagcggcacccgggccaacgtgtttgtgcagctgcggggcaccgtgtccaccagtgatgtgcactgcctgagccacccccacttcaccaccctgtaccggggcagcatcaacaccttcctgctgaccaccaagagtgacctgggggacatccacagcatccgggtgtggcacaacaatgaaggccgcagccccagctggtacctgagccgcatcaaggtggagaacctcttcagccgccacatctggctgttcatctgccagaagtggctgtctgtggacaccaccctggacaggaccttccacgtgacccacccagatgagcggctgaccaggaaggacttcttcttcattgatgtgagcagcaacctgaggaagaaccacatgtggttcagcatctttgcctctgtggtggccaagaccttcaaccggctgcagaggctgagctgctgcctggccatgctgctgagcagcctgctgtgcaacatcatgttcttcaacctgaaccggcaggagcagacagagagccgggagaggaagtacatgaggtccatgatgattggaattgaatctgtgctgatcaccatccctgtgcagctgctgatcaccttcctgttcacctgcagccagaggaagccccaggccgacctgaaggaggtgagcccccagaagcaccccctgatgtctgaggccagcgagcactgggaggagtacctgaggaagtggcacgcctatgaaacagccaaggtgcacccccgggaggtggccaagccagccagcaagggcaagccccggctgcccaaggccagccccaaggccaccagcaagcccaagcaccgccacaggaaggcccagatcaagaccccagagaccctgggccccaacaccaacagcaacaacaacattgaagatgaccaggatgtgcacagcgagcagcaccccagccagaaggacctgcagcagctgaagaagaagccccgcatcgtgctgccctggtggtgtgtgtatgtggcctggttcctggtgtttgccaccagcagcatcagcagcttcttcatcgtgttctacggcctgacctacggctatgacaagagcattgagtggctgtttgccagcttctgcagcttctgccagagcgtgctgctggtgcagcccagcaagatcatcctgctgagcggcttccgcaccaacaagcccaagtactgcaagaacctgtcctggagcaccaagtacaagtacacagagatccggctggatggcatgaggatgcaccctgaggagatgcagagaattcatgaccagatcgtgcgcatccggggcaccaggatgtaccagcccctgacagaagatgagatccgcatcttcaagaggaagaagaggatcaagagaagagccctgctcttcctgagctacatcctgacccacttcatcttcctggccctgctgctgatcctgattgtgctgctgcggcacacagactgcttctactacaaccagttcatccgggaccgcttctccatggacctggccaccgtgaccaagctggaggacatctaccgctggctgaacagcgtgctgctgcccctgctgcacaatgacctgaaccccaccttcctgcctgagagcagcagcaagatcctgggcctgcccctgatgaggcaggtgcgggccaagagcagcgagaagatgtgcctgcctgctgagaagtttgtgcagaacagcatccggcgggagatccactgccaccccaagtatggaattgatcctgaggacaccaagaactacagcggcttctggaatgaggtggacaagcaggccattgatgagagcaccaacggcttcacctacaagccccagggcacccagtggctgtactacagctatggcctgctgcacacctacggcagcggcggctacgccctgtacttcttccctgagcagcagcgcttcaacagcaccctgcggctgaaggagctgcaggagagcaactggctggatgagaagacctgggccgtggtgctggagctgaccaccttcaacccagacatcaacctcttctgcagcatcagcgtcatctttgaggtgtcccagctgggcgtggtgaacaccagcatcagcctgcacagcttcagcctggccgactttgacaggaaggccagcgctgagatctacctgtatgtggccatcctgatcttcttcctggcctacgtggtggatgagggctgcatcatcatgcaggagcgggccagctatgtgcgctctgtgtacaacctgctgaactttgccctgaagtgcatcttcaccgtgctgattgtgctcttcctgaggaagcacttcctggccaccggcatcatccgcttctacctgagcaaccctgaggacttcatccccttccacgctgtgtcccaggtggaccacatcatgaggatcatcctgggcttcctgctcttcctgaccatcctgaagaccctgcgctacagccgcttcttctatgatgtgcggctggcccagagggccatccaggccgccctgcccggcatctgccacatggcctttgtggtgtctgtgtacttctttgtgtacatggccttcggctacctggtgtttggccagcacgagtggaactacagcaacctgatccacagcacccagacagtgttctcctactgtgtgtctgccttccagaacacagagttcagcaacaaccgcatcctgggcgtgctcttcctgagcagcttcatgctggtgatgatctgtgtgctgatcaacctcttccaggccgtcatcctgagcgcctatgaggagatgaagcagcctgtgtatgaggagcccagtgatgaggtggaggccatgacctacctgtgcaggaagctgcggaccatgttctccttcctgaccagccagagcaaggccaaggatgagcctgagttcttcatcgacatgctgtatggccagcctgagaagaacagccaccgctacctgggcctgaagaccaggaacatcaacgggaagaagatggtgtacctggtggtgtag

SEQ ID NO: 164591 - DNA, 12912 bp, Artificial Sequence
  Description of Artificial Sequence: Synthetic coding sequence
atgcccccagctgccccagcccggctggccctggccctgggcctgggcctgtggctgggcgccctggccggcggccctggccggggctgcggcccctgtgagcccccctgcctgtgtggccctgcccctggagctgcctgccgggtgaactgcagcggccggggcctgcggaccctgggccctgccctgcgcatcccagcagatgccacagccctggatgtgagccacaacctgctgcgggccctggatgtgggcctgctggccaacctgagcgccctggccgagctggacatcagcaacaacaagatcagcaccctggaggagggcatctttgccaacctcttcaacctgtctgagatcaacctgagcggcaacccctttgaatgtgactgtggcctggcctggctgccccgctgggccgaggagcagcaggtgcgggtggtgcagcctgaggccgccacctgtgccggccctggcagcctggccggccagcccctgctgggcatccccctgctggacagcggctgtggggaggagtatgtggcctgcctgcctgacaacagcagcggcaccgtggccgctgtgtccttctctgctgcccacgagggcctgctgcagcctgaggcctgcagcgccttctgcttcagcacaggccagggcctggccgccctgtctgagcagggctggtgcctgtgtggggccgcccagcccagcagcgccagctttgcctgcctgagcctgtgcagcggccccccacctcctccagcccccacctgccggggccccaccctgctgcagcacgtgtttcctgccagccctggggccaccctggtgggcccccacggccccctggccagcggccagctggccgccttccacatcgccgcccccctgcctgtgacagccacccgctgggactttggagatggcagcgctgaggtggatgctgctggccctgctgccagccacagatatgtgctgcccggccgctaccacgtgacagctgtgctggccctgggcgccggcagcgccctgctgggcacagatgtgcaggtggaggccgccccagctgccctggagctggtgtgccccagctctgtgcagagtgatgagagcctggacctgagcatccagaacagaggaggcagcggcctggaggccgcctacagcatcgtggccctgggggaggagcccgcccgggctgtgcaccccctgtgccccagcgacacagagatcttccctggaaatggccactgctaccgcctggtggtggagaaggccgcctggctgcaggcccaggagcagtgccaggcctgggccggggccgccctggccatggtggacagccctgctgtgcagcgcttcctggtgtcccgggtgaccaggagcctggatgtgtggattggcttcagcacagtgcagggcgtggaggtgggccctgccccccagggcgaggccttcagcctggagagctgccagaactggctgcctggagagccccacccagccacagctgagcactgtgtgcggctgggccccaccggctggtgcaacacagacctgtgcagcgccccccacagctatgtgtgtgagctgcagcccggcggccctgtgcaggatgctgagaacctgctggtgggcgcccccagcggggacctgcagggccccctgacccccctggcccagcaggacggcctgagcgcccctcatgagcctgtggaggtgatggtgtttcctggcctgcggctgagccgggaggccttcctgaccacagctgagtttggcacccaggagctgcggcggcctgcccagctgcggctgcaggtgtaccgcctgctgagcacagctggcaccccagaaaatggaagtgagcctgagagccgcagcccagacaacagaacccagctggccccagcctgcatgcctgggggccgctggtgccctggggccaacatctgcctgcccctggatgccagctgccacccccaggcctgtgccaacggctgcaccagcggccctggcctgcccggggccccctatgccctgtggagggagttcctgttctctgtgcctgctggccccccagcccagtacagcgtgaccctgcacggccaggatgtgctgatgctgcccggggacctggtgggcctgcagcatgatgctggccctggggccctgctgcactgcagccctgcccctggccaccctggcccccgggccccctacctgagcgccaatgccagctcctggctgccccacctgcctgcccagctggagggcacctgggcctgcccagcctgtgccctgcggctgctggccgccacagagcagctgactgtgctgctgggcctgcggcccaaccctggcctgcggctgcccggccgctatgaggtgcgggcagaggtgggcaatggagtgagccgccacaacctgagctgcagctttgatgtggtgtcccctgtggccggcctgcgggtcatctacccagcccccagagatggccgcctgtatgtgcccaccaatggaagtgccctggtgctgcaggtggacagcggggccaatgccacagccacagcccgctggccaggcggctctgtgtctgccaggtttgaaaatgtgtgcccagccctggtggccacctttgtgcccggctgcccctgggagaccaatgacaccctcttctctgtggtggccctgccctggctgtctgagggggagcacgtggtggatgtggtggtggagaacagcgccagccgggccaacctgagcctgcgggtgacagctgaggagcccatctgtggcctgcgggccacccccagccctgaggcccgggtgctgcagggcgtgctggtgcgctacagccctgtggtggaggccggcagtgacatggtgttccgctggaccatcaatgacaagcagagcctgaccttccagaatgtggtgttcaacgtcatctaccagagcgctgctgtgttcaagctgagcctgacagccagcaaccacgtgtccaatgtgacagtgaactacaacgtgacagtggagaggatgaacaggatgcagggcctgcaggtgtccacagtgcctgctgtgctgagccccaatgccaccctggccctgacagctggggtgctggtggacagcgctgtggaggtggccttcctgtggacctttggagatggagagcaggccctgcaccagttccagcccccctacaatgaaagcttccctgtgcctgaccccagcgtggcccaggtgctggtggagcacaacgtgatgcacacctacgccgcccctggagagtacctgctgactgtgctggccagcaatgcctttgagaacctgacccagcaggtgcctgtgtctgtgcgggccagcctgcccagcgtggccgtgggcgtgtctgatggagtgctggtggccggccggcctgtgaccttctacccccaccccctgcccagccctgggggcgtgctgtacacctgggactttggagatggcagccctgtgctgacccagagccagcctgctgccaaccacacctacgccagccggggcacctaccacgtgcggctggaggtgaacaacacagtgtctggagctgctgcccaggctgatgtgcgggtgtttgaggagctgcggggcctgtctgtggacatgagcctggccgtggagcagggcgcccctgtggtggtgtctgctgctgtgcagacaggagacaacatcacctggacctttgacatgggagatggcaccgtgctgagcggccctgaggccaccgtggagcacgtgtacctgcgggcccagaactgcaccgtgacagtgggcgccgccagccctgctggccacctggcccggagcctgcacgtgctggtgtttgtgctggaggtgctgcgggtggagcctgctgcctgcatccccacccagccagatgcccggctgacagcctacgtgacaggcaacccagcccactacctgtttgactggacctttggagatggcagcagcaacaccaccgtgcggggctgccccaccgtgacccacaacttcaccaggagcggcaccttccccctggccctggtgctgagcagccgggtgaacagagcccactacttcaccagcatctgtgtggagcctgaggtgggcaatgtgaccctgcagcctgagcggcagtttgtgcagctgggagatgaggcctggctggtggcctgtgcctggccacccttcccctaccgctacacctgggactttggaacagaggaggccgcccccacccgggcccggggccctgaggtgaccttcatctacagagaccccggcagctacctggtgacagtgacagccagcaacaacatctctgctgccaatgattctgccctggtggaggtgcaggagcctgtgctggtgaccagcatcaaggtgaatggcagcctgggcctggagctgcagcagccctacctgttctctgctgtgggccggggccgcccagccagctacctgtgggacctgggagatggcggctggctggagggccctgaggtgacccacgcctacaacagcactggagacttcaccgtgcgggtggccggctggaatgaggtgagccgctctgaggcctggctgaatgtgacagtgaagagaagagtgcggggcctggtggtgaatgccagcaggacagtggtgcccctgaatggatctgtgtccttcagcaccagcctggaggccggcagtgatgtgcgctacagctgggtgctgtgtgaccgctgcacccccatccctgggggccccaccatctcctacaccttccgctctgtgggcaccttcaacatcatcgtgacagcagaaaatgaggtgggcagcgcccaggacagcatctttgtgtatgtgctgcagctgattgagggcctgcaggtggtgggcggcggccgctacttccccaccaaccacacagtgcagctgcaggccgtggtgagagatggcaccaacgtgtcctacagctggacagcctggagggaccggggccctgccctggccggcagcggcaagggcttcagcctgactgtgctggaggccggcacctaccacgtgcagctgcgggccaccaacatgctgggcagcgcctgggccgactgcaccatggactttgtggagcctgtgggctggctgatggtggccgccagccccaacccagctgctgtgaacacctctgtgaccctgtctgctgagctggccggcggcagcggcgtggtgtacacctggagcctggaggagggcctgtcctgggagaccagcgagcccttcaccacccacagcttccccaccccaggcctgcacctggtgaccatgacagctggcaaccccctgggcagcgccaatgccaccgtggaggtggatgtgcaggtgcctgtgtctggcctgagcatccgggccagcgagcccggcggcagctttgtggccgccggcagctctgtgcccttctggggccagctggccaccggcaccaacgtgtcctggtgctgggccgtgcctgggggcagcagcaagaggggcccccacgtgaccatggtgtttcctgatgctggcaccttcagcatccggctgaatgccagcaatgctgtgtcctgggtgtctgccacctacaacctgacagctgaggagcccatcgtgggcctggtgctgtgggccagcagcaaggtggtggcccctggccagctggtgcacttccagatcctgctggccgccggcagcgctgtgaccttccggctgcaggtgggcggggccaaccctgaggtgctgcccggcccccgcttcagccacagcttcccccgggtgggggaccacgtggtgtctgtgcggggcaagaaccacgtgtcctgggcccaggcccaggtgagaattgtggtgctggaggccgtgtctggcctgcaggtgcccaactgctgtgagcccggcatcgccaccggcacagagaggaacttcaccgcccgggtgcagaggggcagccgggtggcctatgcctggtacttcagcctgcagaaggtgcagggcgacagcctggtgatcctgagcggcagagatgtgacctacacccctgtggccgccggcctgctggagatccaggtgcgggccttcaatgccctgggctctgaaaatagaaccctggtgctggaggtgcaggatgctgtgcagtatgtggccctgcagagcggcccctgcttcaccaacagaagtgcccagtttgaagctgccaccagccccagcccccggcgggtggcctaccactgggactttggagatggcagccctggccaggacacagatgagcccagggctgagcacagctacctgcggcctggggactacagagtgcaggtgaatgccagcaacctggtgtccttctttgtggcccaggccaccgtgacagtgcaggtgctggcctgccgggagcctgaggtggatgtggtgctgcccctgcaggtgctgatgaggaggagccagaggaactacctggaggcccacgtggacctgcgggactgtgtgacctaccagacagagtaccgctgggaggtgtacagaacagccagctgccagaggcctggccgcccagcccgggtggccctgcccggggtggatgtgtcccggccccggctggtgctgccccggctggccctgcctgtgggccactactgctttgtgtttgtggtgtcctttggagacacccccctgacccagagcatccaggccaacgtgacagtggcccctgagcggctggtgcccatcatcgagggcggcagctacagagtgtggagcgacacccgggacctggtgctggatggcagcgagagctatgaccccaacctggaggatggagaccagacccccctgtccttccactgggcctgtgtggccagcacccagcgggaggccggcggctgtgccctgaactttggcccccggggcagcagcacagtgaccatcccccgggagcggctggccgccggcgtggagtacaccttcagcctgactgtgtggaaggccggcaggaaggaggaggccaccaaccagacagtgctgatccgcagcggccgggtgcccatcgtgtccctggagtgtgtgtcctgcaaggcccaggccgtgtatgaggtgagccgcagcagctatgtgtacctggagggccgctgcctgaactgcagcagcggcagcaagaggggccgctgggccgcccggaccttcagcaacaagaccctggtgctggatgagaccaccaccagcacaggcagcgctggcatgaggctggtgctgcggcggggcgtgctgagagatggagagggctacaccttcaccctgactgtgctgggccgcagcggggaggaggagggctgtgccagcatccggctgagccccaaccggccccccctgggcggcagctgccgcctcttccccctgggcgctgtgcacgccctgaccaccaaggtgcactttgagtgcaccggctggcatgatgctgaagatgctggggcccccctggtgtatgccctgctgctgcggcgctgccggcagggccactgtgaggagttctgtgtgtacaagggcagcctgagcagctatggagctgtgctgcccccaggcttccggccccactttgaggtgggcctggccgtggtggtgcaggaccagctgggcgctgctgtggtggccctgaacagaagcctggccatcaccctgcctgagcccaacggcagcgccaccggcctgactgtgtggctgcacggcctgacagcctctgtgctgcccggcctgctgcggcaggccgacccccagcacgtgattgagtacagcctggccctggtgacagtgctgaatgaatatgaaagagccctggatgtggccgctgagcccaagcatgagcggcagcaccgggcccagatcaggaagaacatcacagagaccctggtgtccctgcgggtgcacacagtggatgacatccagcagattgctgctgccctggcccagtgcatgggccccagccgggagctggtgtgccgcagctgcctgaagcagaccctgcacaagctggaggccatgatgctgatcctgcaggccgagaccacagctggcaccgtgacccccacagccatcggggacagcatcctgaacatcaccggggacctgatccacctggccagcagtgatgtgcgggccccccagcccagcgagctgggcgctgagagccccagcaggatggtggccagccaggcctacaacctgaccagcgccctgatgaggatcctgatgaggagccgggtgctgaatgaggagcccctgaccctggccggggaggagatcgtggcccagggcaagagaagtgaccccaggagcctgctgtgctacggcggggcccctggccctggctgccacttcagcatccctgaggccttcagcggggccctggccaacctgagtgatgtggtgcagctgatcttcctggtggacagcaaccccttccccttcggctacatcagcaactacacagtgtccaccaaggtggcctccatggccttccagacccaggccggggcccagatccccatcgagcggctggccagcgagcgggccatcaccgtgaaggtgcccaacaacagcgactgggccgcccggggccacaggagcagcgccaacagcgccaacagcgtggtggtgcagccccaggcctctgtgggcgctgtggtgaccctggacagcagcaacccagctgctggcctgcacctgcagctgaactacaccctgctggatggccactacctgtctgaggagcctgagccctacctggccgtgtacctgcacagcgagccccggcccaatgagcacaactgcagcgccagccgccgcatccggcctgagagcctgcagggcgctgaccaccggccctacaccttcttcatcagccctggcagccgggaccctgctggcagctaccacctgaacctgagcagccacttccgctggagcgccctgcaggtgtctgtgggcctgtacaccagcctgtgccagtacttcagcgaggaggacatggtgtggaggacagagggcctgctgcccctggaggagaccagcccccggcaggccgtgtgcctgaccaggcacctgacagcctttggagccagcctgtttgtgccccccagccacgtgcgctttgtgtttcctgagcccacagcagatgtgaactacatcgtgatgctgacctgtgctgtgtgcctggtgacctacatggtgatggccgccatcctgcacaagctggaccagctggatgccagccggggccgggccatccccttctgtggccagaggggccgcttcaagtatgagatcctggtgaagacaggctggggccggggcagcggcaccacagcccacgtgggcatcatgctgtatggagtggacagccgcagcggccaccgccacctggatggagaccgggccttccacaggaacagcctggacatcttccgcatcgccaccccccacagcctgggctctgtgtggaagatccgggtgtggcatgacaacaagggcctgagccctgcctggttcctgcagcacgtgattgtgcgggacctgcagacagcccggagcgccttcttcctggtgaatgactggctgtctgtggagacagaggccaacggcggcctggtggagaaggaggtgctggccgccagtgatgctgccctgctgcgcttccggcggctgctggtggccgagctgcagaggggcttctttgacaagcacatctggctgagcatctgggaccggccccccaggagccgcttcacccgcatccagagggccacctgctgcgtgctgctgatctgcctcttcctgggcgccaatgctgtgtggtatggagctgtgggggacagcgcctacagcactggacatgtgtcccggctgagccccctgtctgtggacacagtggccgtgggcctggtgtcctctgtggtggtgtaccctgtgtacctggccatcctcttcctgttcaggatgagccgcagcaaggtggccggcagccccagccccaccccagctggccagcaggtgctggacatcgacagctgcctggacagctctgtgctggacagcagcttcctgaccttcagcggcctgcacgccgagcaggcctttgtgggccagatgaagagtgacctcttcctggatgacagcaagagcctggtgtgctggcccagcggggagggcaccctgtcctggccagacctgctgagtgaccccagcatcgtgggcagcaacctgcggcagctggcccggggccaggccggccacggcctgggccctgaggaggatggcttcagcctggccagcccctacagccctgccaagagcttcagcgccagtgatgaggacctgatccagcaggtgctggccgagggcgtgagcagccctgcccccacccaggacacccacatggagacagacctgctgagcagcctgagcagcaccccaggagagaagacagagaccctggccctgcagaggctgggggagctgggcccccccagccctggcctgaactgggagcagccccaggccgcccggctgagcaggacaggcctggtggagggcctgaggaagaggctgctgcctgcctggtgtgccagcctggcccacggcctgagcctgctgctggtggccgtggccgtggccgtgtctggctgggtgggcgccagcttccccccaggagtgtctgtggcctggctgctgagcagcagcgccagcttcctggccagcttcctgggctgggagcccctgaaggtgctgctggaggccctgtacttcagcctggtggccaagaggctgcacccagatgaagatgacaccctggtggagagccctgctgtgacccctgtgtctgcccgggtgccccgggtgcggcccccccacggctttgccctcttcctggccaaggaggaggccaggaaggtgaagaggctgcacggcatgctgcggagcctgctggtgtacatgctgttcctgctggtgaccctgctggccagctatggagatgccagctgccacggccacgcctaccgcctgcagagcgccatcaagcaggagctgcacagccgggccttcctggccatcaccaggtctgaggagctgtggccctggatggcccacgtgctgctgccctacgtgcacggcaaccagagcagccctgagctgggccccccccggctgcggcaggtgcggctgcaggaggccctgtacccagaccccccaggcccccgggtgcacacctgcagcgctgctgggggcttcagcaccagtgactatgatgtgggctgggagagcccccacaacggcagcggcacctgggcctacagcgccccagacctgctgggcgcctggagctggggcagctgtgctgtgtatgacagcggcggctacgtgcaggagctgggcctgagcctggaggagagccgggaccggctgcgcttcctgcagctgcacaactggctggacaacagaagcagagctgtgttcctggagctgacccgctacagccctgctgtgggcctgcatgctgctgtgaccctgcggctggagttccctgctgctggccgggccctggccgccctgtctgtgcggccctttgccctgcggcggctgtctgctggcctgagcctgcccctgctgacctctgtgtgcctgctgctgtttgctgtgcactttgctgtggccgaggcccggacctggcaccgggagggccgctggagggtgctgcggctgggcgcctgggcccgctggctgctggtggccctgacagctgccacagccctggtgcggctggcccagctgggcgctgctgaccggcagtggaccaggtttgtgcggggccggccccggcgcttcaccagctttgaccaggtggcccagctgagcagcgctgcccggggcctggccgccagcctgctcttcctgctgctggtgaaggccgcccagcagctgcgctttgtgcggcagtggagcgtgtttgggaagaccctgtgccgggccctgcctgagctgctgggcgtgaccctgggcctggtggtgctgggcgtggcctatgcccagctggccatcctgctggtgagcagctgtgtggacagcctgtggagcgtggcccaggccctgctggtgctgtgccccggcaccggcctgagcaccctgtgcccagctgagagctggcacctgagccccctgctgtgtgtgggcctgtgggccctgcggctgtggggcgccctgcggctgggcgctgtgatcctgcgctggagataccacgccctgcggggggagctgtacagacctgcctgggagccccaggactatgagatggtggagctgttcctgcggcggctgcggctgtggatgggcctgagcaaggtgaaggagttccgccacaaggtgcgctttgagggcatggagcccctgcccagccgcagcagccggggcagcaaggtgtccccagatgtgcccccaccttctgctggcagtgatgccagccaccccagcaccagcagcagccagctggatggcctgtctgtgtccctgggccgcctgggcacccgctgtgagcctgagcccagccggctgcaggccgtgtttgaggccctgctgacccagtttgaccggctgaaccaggccacagaagatgtgtaccagctggagcagcagctgcacagcctgcagggcagaagaagcagccgggccccagctggcagcagccggggccccagccctggcctgcggcctgccctgcccagccggctggcccgggccagccggggcgtggacctggccaccggccccagcaggacccccctgcgggccaagaacaaggtgcaccccagcagcacctag

SEQ ID NO: 164592 - DNA, 10914 bp, Artificial Sequence
  Description of Artificial Sequence: Synthetic coding sequence
atgcccccagctgccccagcccggctggccctggccctgggcctgggcctgtggctgggcgccctggccggcggccctggccggggctgcggcccctgtgagcccccctgcctgtgtggccctgcccctggagctgcctgccgggtgaactgcagcggccggggcctgcggaccctgggccctgccctgcgcatcccagcagatgccacagccctgacagccatggccaaggcagatggagatgtgaagaagtatggcagcaagagaggagccctggccctgacccacggccacagcctgctgagagatgtgagccacaacctgctgcgggccctggatgtgggcctgctggccaacctgagcgccctggccgagctggacatcagcaacaacaagatcagcaccctggaggagggcatctttgccaacctcttcaacctgtctgagatcaacctgagcggcaacccctttgaatgtgactgtggcctggcctggctgccccgctgggccgaggagcagcaggtgcgggtggtgcagcctgaggccgccacctgtgccggccctggcagcctggccggccagcccctgctgggcatccccctgctggacagcggctgtggggccaccctggtgggcccccacggccccctggccagcggccagctggccgccttccacatcgccgcccccctgcctgtgacagccacccgctgggactttggagatggcagcgctgaggtggatgctgctggccctgctgccagccaccgctacgtgctgcccggccgctaccacgtgacagctgtgctggccctgggcgccggcagcgccctgctgggcacagatgtgcaggtggaggccgccccagctgccctggagctggtgtgccccagctctgtgcagagtgatgagagcctggacctgagcatccagaacagaggaggcagcggcctggaggccgcctacagcatcgtggccctgggggaggagcccgcccgggctgtgcaccccctgtgccccagcgacacagagatcttccctggaaatggccactgctaccgcctggtggtggagaaggccgcctggctgcaggcccaggagcagtgccaggcctgggccggggccgccctggccatggtggacagccctgctgtgcagcgcttcctggtgtcccgggtgaccaggagcctggatgtgtggattggcttcagcacagtgcagggcgtggaggtgggccctgccccccagggcgaggccttcagcctggagagctgccagaactggctgcccggggagccccacccagccacagctgagcactgtgtgcggctgggccccaccggctggtgcaacacagacctgtgcagcgccccccacagctatgtgtgtgagctgcagcccggcggccctgtgcaggatgctgagaacctgctggtgggcgcccccagcggggacctgcagggccccctgacccccctggcccagcaggacggcctgagcgcccctcatgagcctgtggaggccggcatgggctctgtggagctgcggcggcccccagcccaccaggtgatggtgtttcctggcctgcggctgagccgggaggccttcctgaccacagctgagtttggcacccaggagctgcggcggcctgcccagctgcggctgcaggtgtaccgcctgctgagcacagctggcaccccagaaaatggaagtgagcctgagagccgcagcccagacaacagaacccagctggccccagcctgcatgcctgggggccgctggtgccctggggccaacatctgcctgcccctggatgccagctgccacccccaggcctgtgccaacggctgcacagaaggagagcacgtggtggatgtggtggtggagaacagcgccagccgggccaacctgagcctgcgggtgacagctgaggagcccatctgtggcctgcgggccacccccagccctgaggcccgggtgctgcagggcgtgctggtgcgctacagccctgtggtggaggccggcagtgacatggtgttccgctggaccatcaatgacaagcagagcctgaccttccagaatgtggtgttcaacgtcatctaccagagcgctgctgtgttcaagctgagcctgacagccagcaaccacgtgtccaatgtgacagtgaactacaacgtgacagtggagaggatgaacaggatgcagggcctgcaggtgtccacagtgcctgctgtgctgagccccaatgccaccctggccctgacagctggggtgctggtggacagcgctgtggaggtggccttcctgtggacctttggagatggagagcaggccctgcaccagttccagcccccctacaatgaaagcttccctgtgcctgaccccagcgtggcccaggtgctggtggagcacaacgtgatgcacacctatgctgcccctggagagtacctgctgactgtgctggccagcaatgcctttgagaacctgacccagcaggtgcctgtgtctgtgcgggccagcctgcccagcgtggccgtgggcgtgtctgatggagtgctgagccagcctgctgccaaccacacctacgccagccggggcacctaccacgtgcggctggaggtgaacaacacagtgtctggagctgctgcccaggctgatgtgcgggtgtttgaggagctgcggggcctgtctgtggacatgagcctggccgtggagcagggcgcccctgtggtggtgtctgctgctgtgcagacaggagacaacatcacctggacctttgacatgggagatggcaccgtgctgagcggccctgaggccaccgtggagcacgtgtacctgcgggcccagaactgcaccgtgacagtgggcgccgccagccctgctggccacctggcccggagcctgcacgtgctggtgtttgtgctggaggtgctgcgggtggagcctgctgcctgcatccccacccagccagatgcccggctgacagcctacgtgactggaaatcctgcccactacctgtttgactggacctttggagatggcagcagcaacaccaccgtgcggggctgccccaccgtgacccacaacttcaccaggagcggcaccttccccctggccctggtgctgagcagccgggtgaacagagcccactacttcaccagcatctgtgtggagcctgaggtgggcaatgtgaccctgcagcctgagcggcagtttgtgcagctgggagatgaggcctggctggtggcctgtgcctggccacccttcccctaccgctacacctgggactttggaacagaggaggccgcccccacccgggcccggggccctgaggtgaccttcatctacagagatcctggcagctacctggtgacagtgacagccagcaacaacatctctgctgccaatgacagcgccctggtggaggtgcaggagcctgtgctggtgaccagcatcaaggtgaatggcagcctgggcctggagctgcagcagccctacctgttctctgctgtgggccggggccggcctgccagctacctgtgggacctgggagatggcggctggctggagggccctgaggtgacccacgcctacaacagcactggagacttcaccggccctggccctggccggcagaggcagaggctgctggcccaccgggaggccggcacctaccacgtgcagctgcgggccaccaacatgctgggcagcgcctgggccgactgcaccatggactttgtggagcctgtgggctggctgatggtggccgccagccccaacccagctgctgtgaacacctctgtgaccctgtctgctgagctggccggcggcagcggcgtggtgtacacctggagcctggaggagggcctgtcctgggagaccagcgagcccttcaccacccacagcttccccaccccaggcctgcacctggtgaccatgacagctggcaaccccctgggcagcgccaatgccaccgtggaggtggatgtgcaggtgcctgtgtctggcctgagcatccgggccagcgagcccggcggcagctttgtggccgccggcagctctgtgcccttctggggccagctggccaccggcaccaacgtgtcctggtgctgggccgtgcctgggggcagcagcaagaggggcccccacgtgaccatggtgtttcctgatgctggcaccttcagcatccggctgaatgccagcaatgctgtgtcctgggtgtctgccacctacaacctgacagctgaggagcccatcgtgggcctggtgctgtgggccagcagcaaggtggtggcccctggccagctggtgcacttccagatcctgctggccgccggcagcgctgtgaccttccggctgcaggacacagatgagcccagggctgagcacagctacctgcggcctggggactacagagtgcaggtgaatgccagcaacctggtgtccttctttgtggcccaggccaccgtgacagtgcaggtgctggcctgccgggagcctgaggtggatgtggtgctgcccctgcaggtgctgatgagaagaagccagaggaactacctggaggcccacgtggacctgcgggactgtgtgacctaccagacagagtaccgctgggaggtgtacagaacagccagctgccagaggcctggccggcctgcccgggtggccctgcccggggtggatgtgtcccggccccggctggtgctgccccggctggccctgcctgtgggccactactgctttgtgtttgtggtgtcctttggagacacccccctgacccagagcatccaggccaacgtgacagtggcccctgagcggctggtgcccatcattgaaggaggcagctacagagtgtggagcgacacccgggacctggtgctggatggcagcgagagctatgaccccaacctggaggatggagaccagacccccctgtccttccactgggcctgtgtggccagcacccagcgggaggccggcggctgtgccctgaactttggcccccggggcagcagcacagtgaccatcccccgggagcggctggccgccggcgtggagtacaccttcagcctgactgtgtggaaggccggcaggaaggaggaggccaccaaccagacagtgctgatccgcagcggccgggtgcccatcgtgtccctggagtgtgtgtcctgcaaggcccaggccgtgtatgaggtgagccgcagcagctatgtgtacctggagggccgctgcctgaactgcagcagcggcagcaagaggggccgctgggccgcccggaccttcagcaacaagaccctggtgctggatgagaccaccaccagcactggatctgctggcatgaggctggtgctgcggcggggcgtgctgagagatggagagggctacaccttcaccctgactgtgctgggccgctctggagaggaggagggctgtgccagcatccggctgagccccaacagaccacccctgggcggcagctgccgcctcttccccctgggcgctgtgcacgccctgaccaccaaggtgcactttgaatgtacaggctggcatgatgctgaagatgctggggcccccctggtgtatgccctgctgctgcggcgctgccggcagggccactgtgaggagttctgtgtgtacaagggcagcctgagcagctatggagctgtgctgcccccaggcttccggccccactttgaggtgggcctggccgtggtggtgcaggaccagctgggcgctgctgtggtggccctgaacagaagcctggccatcaccctgcctgagcccaatggaagtgccaccggcctgactgtgtggctgcacggcctgacagcctctgtgctgcccggcctgctgcggcaggccgacccccagcacgtgattgagtacagcctggccctggtgacagtgctgaatgagcaccgggcccagatcaggaagaacatcacagagaccctggtgtccctgcgggtgcacacagtggatgacatccagcagattgctgctgccctggcccagtgcatgggccccagccgggagctggtgtgccgcagctgcctgaagcagaccctgcacaagctggaggccatgatgctgatcctgcaggccgagaccacagctggcaccgtgacccccacagccatcggggacagcatcctgaacatcactggagacctgatccacctggccagcagtgatgtgcgggccccccagcccagcgagctgggcgctgagagccccagcaggatggtggccagccaggcctacaacctgaccagcgccctgatgaggatcctgatgaggagccgggtgctgaatgaggagcccctgaccctggccggggaggagatcgtggcccagggcaagagaagtgaccccaggagcctgctgtgctatggaggagcccctggccctggctgccacttcagcatccctgaggccttcagcggggccctggccaacctgagtgatgtggtgcagctgatcttcctggtggacagcaaccccttccccttcggctacatcagcaactacacagtgtccaccaaggtggcctccatggccttccagacccaggccggggcccagatccccatcgagcggctggccagcgagcgggccatcaccgtgaaggtgcccaacaacagcgactgggccgcccggggccacaggagcagcgccaacagcgccaacagcgtggtggtgcagccccaggcctctgtgggcgctgtggtgaccctggacagcagcaacccagctgctggcctgcacctgcagctgaactacaccctgctggatggccactacctgtctgaggagcctgagccctacctggccgtgtacctgcacagcgagccccggcccaatgagcacaactgcagcgccagccgccgcatccggcctgagagcctgcagggcgctgaccaccggccctacaccttcttcatcagccctggcagccgggaccctgctggcagctaccacctgaacctgagcagccacttccgctggagcgccctgcaggtgtctgtgggcctgtacaccagcctgtgccagtacttcagcgaggaggacatggtgtggaggacagagggcctgctgcccctggaggagaccagcccccggcaggccgtgtgcctgaccaggcacctgacagccttcggggccagcctgtttgtgccccccagccacgtgcgctttgtgtttcctgagcccacagcagatgtgaactacatcgtgatgctgacctgtgctgtgtgcctggtgacctacatggtgatggccgccatcctgcacaagctggaccagctggatgccagccggggccgggccatccccttctgtggccagaggggccgcttcaagtatgagatcctggtgaagacaggctggggccggggcagcggcaccacagcccacgtgggcatcatgctgtatggagtggacagccgcagcggccaccgccacctggatggagaccgggccttccacaggaacagcctggacatcttcagaattgccaccccccacagcctgggctctgtgtggaagatccgggtgtggcatgacaacaagggcctgagccctgcctggttcctgcagcacgtgattgtgcgggacctgcagacagcccggagcgccttcttcctggtgaatgactggctgtctgtggagacagaggccaatggaggcctggtggagaaggaggtgctggccgccagtgatgctgccctgctgcgcttccggcggctgctggtggccgagctgcagaggggcttctttgacaagcacatctggctgagcatctgggacaggcctcccaggagccgcttcacccgcatccagagggccacctgctgcgtgctgctgatctgcctcttcctgggcgccaatgctgtgtggtacggggctgtgggggacagcgcctacagcacaggccacgtgtcccggctgagccccctgtctgtggacacagtggccgtgggcctggtgtcctctgtggtggtgtaccctgtgtacctggccatcctcttcctgttcaggatgagccgcagcaaggtggccggcagccccagccccaccccagctggccagcaggtgctggacatcgacagctgcctggacagctctgtgctggacagcagcttcctgaccttcagcggcctgcatgctgaggcctttgtgggccagatgaagagtgacctcttcctggatgacagcaagagcctggtgtgctggcccagcggggagggcaccctgtcctggccagacctgctgagtgaccccagcatcgtgggcagcaacctgcggcagctggcccggggccaggccggccacggcctgggccctgaggaggatggcttcagcctggccagcccctacagccctgccaagagcttcagcgccagtgatgaggacctgatccagcaggtgctggccgagggcgtgagcagccctgcccccacccaggacacccacatggagacagacctgctgagcagcctgagcagcaccccaggagagaagacagagaccctggccctgcagaggctgggggagctgggcccccccagccctggcctgaactgggagcagccccaggccgcccggctgagcaggacaggcctggtggagggcctgaggaagaggctgctgcctgcctggtgtgccagcctggcccacggcctgagcctgctgctggtggccgtggccgtggccgtgtctggctgggtgggcgccagcttccccccaggagtgtctgtggcctggctgctgagcagcagcgccagcttcctggccagcttcctgggctgggagcccctgaaggtgctgctggaggccctgtacttcagcctggtggccaagaggctgcacccagatgaagatgacaccctggtggagagccctgctgtgacccctgtgtctgcccgggtgccccgggtgcggcccccccacggctttgccctcttcctggccaaggaggaggccaggaaggtgaagaggctgcacggcatgctgcggagcctgctggtgtacatgctgttcctgctggtgaccctgctggccagctatggagatgccagctgccacggccacgcctaccgcctgcagagcgccatcaagcaggagctgcacagccgggccttcctggccatcaccaggtctgaggagctgtggccctggatggcccacgtgctgctgccctacgtgcacggcaaccagagcagccctgagctgggccccccccggctgcggcaggtgcggctgcaggaggccctgtacccagaccccccaggcccccgggtgcacacctgcagcgctgctgggggcttcagcaccagtgactatgatgtgggctgggagagcccccacaacggcagcggcacctgggcctacagcgccccagacctgctgggcgcctggagctggggcagctgtgctgtgtatgacagcggcggctacgtgcaggagctgggcctgagcctggaggagagccgggaccggctgcgcttcctgcagctgcacaactggctggacaacagaagcagagctgtgttcctggagctgacccgctacagccctgctgtgggcctgcatgctgctgtgaccctgcggctggagttccctgctgctggccgggccctggccgccctgtctgtgcggccctttgccctgcggcggctgtctgctggcctgagcctgcccctgctgacctctgtgtgcctgctgctgtttgctgtgcactttgctgtggccgaggcccggacctggcaccgggagggccgctggagggtgctgcggctgggcgcctgggcccgctggctgctggtggccctgacagctgccacagccctggtgcggctggcccagctgggcgctgctgaccggcagtggaccaggtttgtgcggggccggccccggcgcttcaccagctttgaccaggtggcccagctgagcagcgctgcccggggcctggccgccagcctgctcttcctgctgctggtgaaggccgcccagcagctgcgctttgtgcggcagtggagcgtgtttgggaagaccctgtgccgggccctgcctgagctgctgggcgtgaccctgggcctggtggtgctgggcgtggcctatgcccagctggccatcctgctggtgagcagctgtgtggacagcctgtggagcgtggcccaggccctgctggtgctgtgccccggcaccggcctgagcaccctgtgcccagctgagagctggcacctgagccccctgctgtgtgtgggcctgtgggccctgcggctgtggggcgccctgcggctgggcgctgtgatcctgcgctggagataccacgccctgcggggggagctgtacagacctgcctgggagccccaggactatgagatggtggagctgttcctgcggcggctgcggctgtggatgggcctgagcaaggtgaaggagttccgccacaaggtgcgctttgagggcatggagcccctgcccagccgcagcagccggggcagcaaggtgtccccagatgtgcccccaccttctgctggcagtgatgccagccaccccagcaccagcagcagccagctggatggcctgtctgtgtccctgggccgcctgggcacccgctgtgagcctgagcccagccggctgcaggccgtgtttgaggccctgctgacccagtttgaccggctgaaccaggccacagaagatgtgtaccagctggagcagcagctgcacagcctgcagggcagaagaagcagccgggccccagctggcagcagccggggccccagccctggcctgcggcctgccctgcccagccggctggcccgggccagccggggcgtggacctggccaccggccccagcaggacccccctgcgggccaagaacaaggtgcaccccagcagcacctag

SEQ ID NO: 164593 - DNA, 3693 bp, Artificial Sequence
  Description of Artificial Sequence: Synthetic coding sequence
atggtggccgccagccccaacccagctgctgtgaacacctctgtgaccctgtctgctgagctggccggcggcagcggcgtggtgtacacctggagcctggaggagggcctgtcctgggagaccagcgagcccttcaccacccacagcttccccaccccaggcctgcacctggtgaccatgacagctggcaaccccctgggcagcgccaatgccaccgtggaggtggatgtgcaggtgcctgtgtctggcctgagcatccgggccagcgagcccggcggcagctttgtggccgccggcagctctgtgcccttctggggccagctggccaccggcaccaacgtgtcctggtgctgggccgtgcctgggggcagcagcaagaggggcccccacgtgaccatggtgtttcctgatgctggcaccttcagcatccggctgaatgccagcaatgctgtgtcctgggtgtctgccacctacaacctgacagctgaggagcccatcgtgggcctggtgctgtgggccagcagcaaggtggtggcccctggccagctggtgcacttccagatcctgctggccgccggcagcgctgtgaccttccggctgcaggtgggcggggccaaccctgaggtgctgcccggcccccgcttcagccacagcttcccccgggtgggggaccacgtggtgtctgtgcggggcaagaaccacgtgtcctgggcccaggcccaggtgcgcatcgtggtgctggaggccgtgtctggcctgcaggtgcccaactgctgtgagcccggcatcgccactggaacagaaagaaacttcaccgcccgggtgcagaggggcagccgggtggcctatgcctggtacttcagcctgcagaaggtgcagggcgacagcctggtgatcctgagcggcagagatgtgacctacacccctgtggccgccggcctgctggagatccaggtgcgggccttcaatgccctgggcagcgagaacagaaccctggtgctggaggtgcaggatgctgtgcagtatgtggccctgcagagcggcccctgcttcaccaacagaagtgcccagtttgaggccgccaccagccccagccccaggagagtggcctaccactgggactttggagatggcagccctggccaggacacagatgagcccagggctgagcacagctacctgcggcctggggactacagagtgcaggtgaatgccagcaacctggtgtccttctttgtggcccaggccaccgtgacagtgcaggtgctggcctgccgggagcctgaggtggatgtggtgctgcccctgcaggtgctgatgagaagaagccagaggaactacctggaggcccacgtggacctgcgggactgtgtgacctaccagacagagtaccgctgggaggtgtacagaacagccagctgccagaggcctggccggcctgcccgggtggccctgcccggggtggatgtgtcccggccccggctggtgctgccccggctggccctgcctgtgggccactactgctttgtgtttgtggtgtcctttggagacacccccctgacccagagcatccaggccaacgtgacagtggcccctgagcggctggtgcccatcattgaaggaggcagctacagagtgtggagcgacacccgggacctggtgctggatggcagcgagagctatgaccccaacctggaggatggagaccagacccccctgtccttccactgggcctgtgtggccagcacccagcgggaggccggcggctgtgccctgaactttggcccccggggcagcagcacagtgaccatcccccgggagcggctggccgccggcgtggagtacaccttcagcctgactgtgtggaaggccggcaggaaggaggaggccaccaaccagacagtgctgatccgcagcggccgggtgcccatcgtgtccctggagtgtgtgtcctgcaaggcccaggccgtgtatgaggtgagccgcagcagctatgtgtacctggagggccgctgcctgaactgcagcagcggcagcaagaggggccgctgggccgcccggaccttcagcaacaagaccctggtgctggatgagaccaccaccagcactggatctgctggcatgaggctggtgctgcggcggggcgtgctgagagatggagagggctacaccttcaccctgactgtgctgggccgctctggagaggaggagggctgtgccagcatccggctgagccccaacagaccacccctgggcggcagctgccgcctcttccccctgggcgctgtgcacgccctgaccaccaaggtgcactttgaatgtacaggctggcatgatgctgaagatgctggggcccccctggtgtatgccctgctgctgcggcgctgccggcagggccactgtgaggagttctgtgtgtacaagggcagcctgagcagctatggagctgtgctgcccccaggcttccggccccactttgaggtgggcctggccgtggtggtgcaggaccagctgggcgctgctgtggtggccctgaacagaagcctggccatcaccctgcctgagcccaatggaagtgccaccggcctgactgtgtggctgcacggcctgacagcctctgtgctgcccggcctgctgcggcaggccgacccccagcacgtgattgagtacagcctggccctggtgacagtgctgaatgaatatgagcgggccctggatgtggccgctgagcccaagcatgagcggcagcaccgggcccagatcaggaagaacatcacagagaccctggtgtccctgcgggtgcacacagtggatgacatccagcagattgctgctgccctggcccagtgcatgggccccagccgggagctggtgtgccgcagctgcctgaagcagaccctgcacaagctggaggccatgatgctgatcctgcaggccgagaccacagctggcaccgtgacccccacagccatcggggacagcatcctgaacatcactggagacctgatccacctggccagcagtgatgtgcgggccccccagcccagcgagctgggcgctgagagccccagcaggatggtggccagccaggcctacaacctgaccagcgccctgatgaggatcctgatgaggagccgggtgctgaatgaggagcccctgaccctggccggggaggagatcgtggcccagggcaagagaagtgaccccaggagcctgctgtgctatggaggagcccctggccctggctgccacttcagcatccctgaggccttcagcggggccctggccaacctgagtgatgtggtgcagctgatcttcctggtggacagcaaccccttccccttcggctacatcagcaactacacagtgtccaccaaggccccacccaccccacccacccccctgtggagcagccccaggcctccttctgtgctgtggagcccctggacagctgccaccctgcggcccggctgcatctgcagcagcaccatccgctgctggacagccaccacctgcctgaggaacctgagccccacctggcagagcacctacaccaggagccctggccccatgagcaccacagcccggctggccggcggcagcgcccagagccacagccgggtgctgaccaccggccccacccccagcagcttccccagaggagctgagacccagaggggcgtgaccatctag

SEQ ID NO: 164594 - DNA, 12909 bp, Artificial Sequence
  Description of Artificial Sequence: Synthetic coding sequence
atgcccccagctgccccagcccggctggccctggccctgggcctgggcctgtggctgggcgccctggccggcggccctggccggggctgcggcccctgtgagcccccctgcctgtgtggccctgcccctggagctgcctgccgggtgaactgcagcggccggggcctgcggaccctgggccctgccctgcgcatcccagcagatgccacagccctggatgtgagccacaacctgctgcgggccctggatgtgggcctgctggccaacctgagcgccctggccgagctggacatcagcaacaacaagatcagcaccctggaggagggcatctttgccaacctcttcaacctgtctgagatcaacctgagcggcaacccctttgaatgtgactgtggcctggcctggctgccccgctgggccgaggagcagcaggtgcgggtggtgcagcctgaggccgccacctgtgccggccctggcagcctggccggccagcccctgctgggcatccccctgctggacagcggctgtggggaggagtatgtggcctgcctgcctgacaacagcagcggcaccgtggccgctgtgtccttctctgctgcccacgagggcctgctgcagcctgaggcctgcagcgccttctgcttcagcacaggccagggcctggccgccctgtctgagcagggctggtgcctgtgtggggccgcccagcccagcagcgccagctttgcctgcctgagcctgtgcagcggccccccacctcctccagcccccacctgccggggccccaccctgctgcagcacgtgtttcctgccagccctggggccaccctggtgggcccccacggccccctggccagcggccagctggccgccttccacatcgccgcccccctgcctgtgacagccacccgctgggactttggagatggcagcgctgaggtggatgctgctggccctgctgccagccacagatatgtgctgcccggccgctaccacgtgacagctgtgctggccctgggcgccggcagcgccctgctgggcacagatgtgcaggtggaggccgccccagctgccctggagctggtgtgccccagctctgtgcagagtgatgagagcctggacctgagcatccagaacagaggaggcagcggcctggaggccgcctacagcatcgtggccctgggggaggagcccgcccgggctgtgcaccccctgtgccccagcgacacagagatcttccctggaaatggccactgctaccgcctggtggtggagaaggccgcctggctgcaggcccaggagcagtgccaggcctgggccggggccgccctggccatggtggacagccctgctgtgcagcgcttcctggtgtcccgggtgaccaggagcctggatgtgtggattggcttcagcacagtgcagggcgtggaggtgggccctgccccccagggcgaggccttcagcctggagagctgccagaactggctgcctggagagccccacccagccacagctgagcactgtgtgcggctgggccccaccggctggtgcaacacagacctgtgcagcgccccccacagctatgtgtgtgagctgcagcccggcggccctgtgcaggatgctgagaacctgctggtgggcgcccccagcggggacctgcagggccccctgacccccctggcccagcaggacggcctgagcgcccctcatgagcctgtggaggtgatggtgtttcctggcctgcggctgagccgggaggccttcctgaccacagctgagtttggcacccaggagctgcggcggcctgcccagctgcggctgcaggtgtaccgcctgctgagcacagctggcaccccagaaaatggaagtgagcctgagagccgcagcccagacaacagaacccagctggccccagcctgcatgcctgggggccgctggtgccctggggccaacatctgcctgcccctggatgccagctgccacccccaggcctgtgccaacggctgcaccagcggccctggcctgcccggggccccctatgccctgtggagggagttcctgttctctgtgcctgctggccccccagcccagtacagcgtgaccctgcacggccaggatgtgctgatgctgcccggggacctggtgggcctgcagcatgatgctggccctggggccctgctgcactgcagccctgcccctggccaccctggcccccgggccccctacctgagcgccaatgccagctcctggctgccccacctgcctgcccagctggagggcacctgggcctgcccagcctgtgccctgcggctgctggccgccacagagcagctgactgtgctgctgggcctgcggcccaaccctggcctgcggctgcccggccgctatgaggtgcgggcagaggtgggcaatggagtgagccgccacaacctgagctgcagctttgatgtggtgtcccctgtggccggcctgcgggtcatctacccagcccccagagatggccgcctgtatgtgcccaccaatggaagtgccctggtgctgcaggtggacagcggggccaatgccacagccacagcccgctggccaggcggctctgtgtctgccaggtttgaaaatgtgtgcccagccctggtggccacctttgtgcccggctgcccctgggagaccaatgacaccctcttctctgtggtggccctgccctggctgtctgagggggagcacgtggtggatgtggtggtggagaacagcgccagccgggccaacctgagcctgcgggtgacagctgaggagcccatctgtggcctgcgggccacccccagccctgaggcccgggtgctgcagggcgtgctggtgcgctacagccctgtggtggaggccggcagtgacatggtgttccgctggaccatcaatgacaagcagagcctgaccttccagaatgtggtgttcaacgtcatctaccagagcgctgctgtgttcaagctgagcctgacagccagcaaccacgtgtccaatgtgacagtgaactacaacgtgacagtggagaggatgaacaggatgcagggcctgcaggtgtccacagtgcctgctgtgctgagccccaatgccaccctggccctgacagctggggtgctggtggacagcgctgtggaggtggccttcctgtggacctttggagatggagagcaggccctgcaccagttccagcccccctacaatgaaagcttccctgtgcctgaccccagcgtggcccaggtgctggtggagcacaacgtgatgcacacctacgccgcccctggagagtacctgctgactgtgctggccagcaatgcctttgagaacctgacccagcaggtgcctgtgtctgtgcgggccagcctgcccagcgtggccgtgggcgtgtctgatggagtgctggtggccggccggcctgtgaccttctacccccaccccctgcccagccctgggggcgtgctgtacacctgggactttggagatggcagccctgtgctgacccagagccagcctgctgccaaccacacctacgccagccggggcacctaccacgtgcggctggaggtgaacaacacagtgtctggagctgctgcccaggctgatgtgcgggtgtttgaggagctgcggggcctgtctgtggacatgagcctggccgtggagcagggcgcccctgtggtggtgtctgctgctgtgcagacaggagacaacatcacctggacctttgacatgggagatggcaccgtgctgagcggccctgaggccaccgtggagcacgtgtacctgcgggcccagaactgcaccgtgacagtgggcgccgccagccctgctggccacctggcccggagcctgcacgtgctggtgtttgtgctggaggtgctgcgggtggagcctgctgcctgcatccccacccagccagatgcccggctgacagcctacgtgacaggcaacccagcccactacctgtttgactggacctttggagatggcagcagcaacaccaccgtgcggggctgccccaccgtgacccacaacttcaccaggagcggcaccttccccctggccctggtgctgagcagccgggtgaacagagcccactacttcaccagcatctgtgtggagcctgaggtgggcaatgtgaccctgcagcctgagcggcagtttgtgcagctgggagatgaggcctggctggtggcctgtgcctggccacccttcccctaccgctacacctgggactttggaacagaggaggccgcccccacccgggcccggggccctgaggtgaccttcatctacagagaccccggcagctacctggtgacagtgacagccagcaacaacatctctgctgccaatgattctgccctggtggaggtgcaggagcctgtgctggtgaccagcatcaaggtgaatggcagcctgggcctggagctgcagcagccctacctgttctctgctgtgggccggggccgcccagccagctacctgtgggacctgggagatggcggctggctggagggccctgaggtgacccacgcctacaacagcactggagacttcaccgtgcgggtggccggctggaatgaggtgagccgctctgaggcctggctgaatgtgacagtgaagagaagagtgcggggcctggtggtgaatgccagcaggacagtggtgcccctgaatggatctgtgtccttcagcaccagcctggaggccggcagtgatgtgcgctacagctgggtgctgtgtgaccgctgcacccccatccctgggggccccaccatctcctacaccttccgctctgtgggcaccttcaacatcatcgtgacagcagaaaatgaggtgggcagcgcccaggacagcatctttgtgtatgtgctgcagctgattgagggcctgcaggtggtgggcggcggccgctacttccccaccaaccacacagtgcagctgcaggccgtggtgagagatggcaccaacgtgtcctacagctggacagcctggagggaccggggccctgccctggccggcagcggcaagggcttcagcctgactgtgctggaggccggcacctaccacgtgcagctgcgggccaccaacatgctgggcagcgcctgggccgactgcaccatggactttgtggagcctgtgggctggctgatggtggccgccagccccaacccagctgctgtgaacacctctgtgaccctgtctgctgagctggccggcggcagcggcgtggtgtacacctggagcctggaggagggcctgtcctgggagaccagcgagcccttcaccacccacagcttccccaccccaggcctgcacctggtgaccatgacagctggcaaccccctgggcagcgccaatgccaccgtggaggtggatgtgcaggtgcctgtgtctggcctgagcatccgggccagcgagcccggcggcagctttgtggccgccggcagctctgtgcccttctggggccagctggccaccggcaccaacgtgtcctggtgctgggccgtgcctgggggcagcagcaagaggggcccccacgtgaccatggtgtttcctgatgctggcaccttcagcatccggctgaatgccagcaatgctgtgtcctgggtgtctgccacctacaacctgacagctgaggagcccatcgtgggcctggtgctgtgggccagcagcaaggtggtggcccctggccagctggtgcacttccagatcctgctggccgccggcagcgctgtgaccttccggctgcaggtgggcggggccaaccctgaggtgctgcccggcccccgcttcagccacagcttcccccgggtgggggaccacgtggtgtctgtgcggggcaagaaccacgtgtcctgggcccaggcccaggtgagaattgtggtgctggaggccgtgtctggcctgcaggtgcccaactgctgtgagcccggcatcgccaccggcacagagaggaacttcaccgcccgggtgcagaggggcagccgggtggcctatgcctggtacttcagcctgcagaaggtgcagggcgacagcctggtgatcctgagcggcagagatgtgacctacacccctgtggccgccggcctgctggagatccaggtgcgggccttcaatgccctgggctctgaaaatagaaccctggtgctggaggtgcaggatgctgtgcagtatgtggccctgcagagcggcccctgcttcaccaacagaagtgcccagtttgaagctgccaccagccccagcccccggcgggtggcctaccactgggactttggagatggcagccctggccaggacacagatgagcccagggctgagcacagctacctgcggcctggggactacagagtgcaggtgaatgccagcaacctggtgtccttctttgtggcccaggccaccgtgacagtgcaggtgctggcctgccgggagcctgaggtggatgtggtgctgcccctgcaggtgctgatgaggaggagccagaggaactacctggaggcccacgtggacctgcgggactgtgtgacctaccagacagagtaccgctgggaggtgtacagaacagccagctgccagaggcctggccgcccagcccgggtggccctgcccggggtggatgtgtcccggccccggctggtgctgccccggctggccctgcctgtgggccactactgctttgtgtttgtggtgtcctttggagacacccccctgacccagagcatccaggccaacgtgacagtggcccctgagcggctggtgcccatcatcgagggcggcagctacagagtgtggagcgacacccgggacctggtgctggatggcagcgagagctatgaccccaacctggaggatggagaccagacccccctgtccttccactgggcctgtgtggccagcacccagcgggaggccggcggctgtgccctgaactttggcccccggggcagcagcacagtgaccatcccccgggagcggctggccgccggcgtggagtacaccttcagcctgactgtgtggaaggccggcaggaaggaggaggccaccaaccagacagtgctgatccgcagcggccgggtgcccatcgtgtccctggagtgtgtgtcctgcaaggcccaggccgtgtatgaggtgagccgcagcagctatgtgtacctggagggccgctgcctgaactgcagcagcggcagcaagaggggccgctgggccgcccggaccttcagcaacaagaccctggtgctggatgagaccaccaccagcacaggcagcgctggcatgaggctggtgctgcggcggggcgtgctgagagatggagagggctacaccttcaccctgactgtgctgggccgcagcggggaggaggagggctgtgccagcatccggctgagccccaaccggccccccctgggcggcagctgccgcctcttccccctgggcgctgtgcacgccctgaccaccaaggtgcactttgagtgcaccggctggcatgatgctgaagatgctggggcccccctggtgtatgccctgctgctgcggcgctgccggcagggccactgtgaggagttctgtgtgtacaagggcagcctgagcagctatggagctgtgctgcccccaggcttccggccccactttgaggtgggcctggccgtggtggtgcaggaccagctgggcgctgctgtggtggccctgaacagaagcctggccatcaccctgcctgagcccaacggcagcgccaccggcctgactgtgtggctgcacggcctgacagcctctgtgctgcccggcctgctgcggcaggccgacccccagcacgtgattgagtacagcctggccctggtgacagtgctgaatgaatatgaaagagccctggatgtggccgctgagcccaagcatgagcggcagcaccgggcccagatcaggaagaacatcacagagaccctggtgtccctgcgggtgcacacagtggatgacatccagcagattgctgctgccctggcccagtgcatgggccccagccgggagctggtgtgccgcagctgcctgaagcagaccctgcacaagctggaggccatgatgctgatcctgcaggccgagaccacagctggcaccgtgacccccacagccatcggggacagcatcctgaacatcaccggggacctgatccacctggccagcagtgatgtgcgggccccccagcccagcgagctgggcgctgagagccccagcaggatggtggccagccaggcctacaacctgaccagcgccctgatgaggatcctgatgaggagccgggtgctgaatgaggagcccctgaccctggccggggaggagatcgtggcccagggcaagagaagtgaccccaggagcctgctgtgctacggcggggcccctggccctggctgccacttcagcatccctgaggccttcagcggggccctggccaacctgagtgatgtggtgcagctgatcttcctggtggacagcaaccccttccccttcggctacatcagcaactacacagtgtccaccaaggtggcctccatggccttccagacccaggccggggcccagatccccatcgagcggctggccagcgagcgggccatcaccgtgaaggtgcccaacaacagcgactgggccgcccggggccacaggagcagcgccaacagcgccaacagcgtggtggtgcagccccaggcctctgtgggcgctgtggtgaccctggacagcagcaacccagctgctggcctgcacctgcagctgaactacaccctgctggatggccactacctgtctgaggagcctgagccctacctggccgtgtacctgcacagcgagccccggcccaatgagcacaactgcagcgccagccgccgcatccggcctgagagcctgcagggcgctgaccaccggccctacaccttcttcatcagccctggcagccgggaccctgctggcagctaccacctgaacctgagcagccacttccgctggagcgccctgcaggtgtctgtgggcctgtacaccagcctgtgccagtacttcagcgaggaggacatggtgtggaggacagagggcctgctgcccctggaggagaccagcccccggcaggccgtgtgcctgaccaggcacctgacagcctttggagccagcctgtttgtgccccccagccacgtgcgctttgtgtttcctgagcccacagcagatgtgaactacatcgtgatgctgacctgtgctgtgtgcctggtgacctacatggtgatggccgccatcctgcacaagctggaccagctggatgccagccggggccgggccatccccttctgtggccagaggggccgcttcaagtatgagatcctggtgaagacaggctggggccggggcagcggcaccacagcccacgtgggcatcatgctgtatggagtggacagccgcagcggccaccgccacctggatggagaccgggccttccacaggaacagcctggacatcttccgcatcgccaccccccacagcctgggctctgtgtggaagatccgggtgtggcatgacaacaagggcctgagccctgcctggttcctgcagcacgtgattgtgcgggacctgcagacagcccggagcgccttcttcctggtgaatgactggctgtctgtggagacagaggccaacggcggcctggtggagaaggaggtgctggccgccagtgatgctgccctgctgcgcttccggcggctgctggtggccgagctgcagaggggcttctttgacaagcacatctggctgagcatctgggaccggccccccaggagccgcttcacccgcatccagagggccacctgctgcgtgctgctgatctgcctcttcctgggcgccaatgctgtgtggtatggagctgtgggggacagcgcctacagcactggacatgtgtcccggctgagccccctgtctgtggacacagtggccgtgggcctggtgtcctctgtggtggtgtaccctgtgtacctggccatcctcttcctgttcaggatgagccgcagcaaggtggccggcagccccagccccaccccagctggccagcaggtgctggacatcgacagctgcctggacagctctgtgctggacagcagcttcctgaccttcagcggcctgcacgccgaggcctttgtgggccagatgaagagtgacctcttcctggatgacagcaagagcctggtgtgctggcccagcggggagggcaccctgtcctggccagacctgctgagtgaccccagcatcgtgggcagcaacctgcggcagctggcccggggccaggccggccacggcctgggcccagaagaagatggcttcagcctggccagcccctacagccctgccaagagcttcagcgccagtgatgaagatctcatccagcaggtgctggccgagggcgtgagcagccctgcccccacccaggacacccacatggagacagacctgctgagcagcctgagcagcaccccaggagagaagacagagaccctggccctgcagaggctgggggagctgggcccccccagccctggcctgaactgggagcagccccaggccgcccggctgagcaggacaggcctggtggagggcctgaggaagaggctgctgcctgcctggtgtgccagcctggcccacggcctgagcctgctgctggtggccgtggccgtggccgtgtctggctgggtgggcgccagcttccccccaggagtgtctgtggcctggctgctgagcagcagcgccagcttcctggccagcttcctgggctgggagcccctgaaggtgctgctggaggccctgtacttcagcctggtggccaagaggctgcacccagatgaagatgacaccctggtggagagccctgctgtgacccctgtgtctgcccgggtgccccgggtgcggccccctcatggctttgccctcttcctggccaaggaggaggccaggaaggtgaagaggctgcacggcatgctgcggagcctgctggtgtacatgctgttcctgctggtgaccctgctggccagctatggagatgccagctgccacggccacgcctaccgcctgcagagcgccatcaagcaggagctgcacagccgggccttcctggccatcaccaggtctgaggagctgtggccctggatggcccacgtgctgctgccctacgtgcacggcaaccagagcagccctgagctgggccccccccggctgcggcaggtgcggctgcaggaggccctgtacccagaccccccaggcccccgggtgcacacctgcagcgctgctgggggcttcagcaccagtgactatgatgtgggctgggagagcccccacaatggaagtggcacctgggcctacagcgccccagacctgctgggcgcctggagctggggcagctgtgctgtgtatgattctgggggctacgtgcaggagctgggcctgagcctggaggagagccgggaccggctgcgcttcctgcagctgcacaactggctggacaacagaagcagagctgtgttcctggagctgacccgctacagccctgctgtgggcctgcacgccgctgtgaccctgcggctggagttccctgctgctggccgggccctggccgccctgtctgtgcggccctttgccctgcggcggctgtctgctggcctgagcctgcccctgctgacctctgtgtgcctgctgctgtttgctgtgcactttgctgtggccgaggcccggacctggcaccgggagggccgctggagggtgctgcggctgggcgcctgggcccgctggctgctggtggccctgacagctgccacagccctggtgcggctggcccagctgggcgctgctgaccggcagtggaccaggtttgtgcggggccggccccggcgcttcaccagctttgaccaggtggcccagctgagcagcgctgcccggggcctggccgccagcctgctcttcctgctgctggtgaaggccgcccagcagctgcgctttgtgcggcagtggagcgtgtttgggaagaccctgtgccgggccctgcctgagctgctgggcgtgaccctgggcctggtggtgctgggcgtggcctatgcccagctggccatcctgctggtgagcagctgtgtggacagcctgtggagcgtggcccaggccctgctggtgctgtgccccggcaccggcctgagcaccctgtgcccagctgagagctggcacctgagccccctgctgtgtgtgggcctgtgggccctgcggctgtggggcgccctgcggctgggcgccgtcatcctgcgctggagataccacgccctgcggggggagctgtacagacctgcctgggagccccaggactatgagatggtggagctgttcctgcggcggctgcggctgtggatgggcctgagcaaggtgaaggagttccgccacaaggtgcgctttgagggcatggagcccctgcccagccgcagcagccggggcagcaaggtgtccccagatgtgcccccacccagcgctggcagtgatgccagccaccccagcaccagcagcagccagctggatggcctgtctgtgtccctgggccgcctgggcacccgctgtgagcctgagcccagccggctgcaggccgtgtttgaggccctgctgacccagtttgaccggctgaaccaggccacagaagatgtgtaccagctggagcagcagctgcacagcctgcagggccgccgcagcagccgggccccagctggcagcagccggggccccagccctggcctgcggcctgccctgcccagccggctggcccgggccagcagaggagtggacctggccaccggccccagcaggacccccctgcgggccaagaacaaggtgcaccccagcagcacctag

SEQ ID NO: 164595 - DNA, 8550 bp, Artificial Sequence
  Description of Artificial Sequence: Synthetic coding sequence
atggccgaggaggccgcccagaacatcagtgatgaccaggagcgctgcctgcaggccgcctgctgcctgagctttggaggagagctgtctgtgtccacagacaagtcctggggcctgcacctgtgcagctgcagccccccaggcggcggcctgtgggtggaggtgtatgccaaccacgtgctgctgatgtctgatggaaaatgtggctgcccctggtgtgccctgaatggcaaggccgaggaccgggagagccagagccccagcagcagcgccagccggcagaagaacatctggaagaccaccagcgaggccgccctgtctgtggtgaatgagaagacccaggccgtggtgaatgagaagacccaggcccccctggactgtgacaacagcgctgaccgcatcccccacaagcccttcatcatcatcgcccgggcctggagcagcggcggcccccgcttccaccaccggcggctgtgtgccactggaacagctgacagcaccttcagcgccctgctgcagctgcagggcaccaccagcgctgctgccccctgcagcctgaagatggaggccagctgctgcgtgctgcggctgctgtgctgtgccgaggatgtggccaccggcctgctgcccggcaccgtgaccatggagacccccaccaaggtggcccggcccacccagaccagcagccagagggtgcccctgtggcccatcagccacttccccaccagccccaggagcagccacggcctgcccccaggcatccccaggacccccagcttcaccgccagccagagcggcagcgagatcctgtacccacccacccagcacccccctgtggccatcctggccaggaacagcgacaacttcatgaaccctgtgctgaactgcagcctggaggtggaggcccgggccccacccaacctgggcttccgggtgcacatggccagcggggaggccctgtgcctgatgatggactttggagacagcagcggcgtggagatgaggctgcacaacatgtctgaggccatggctgtgacagcctaccaccagtacagcaagggcatcttcttccacctgctgcacttccagctggacatgagcacctacaaggaggccgagacccagaacaccaccctgaatgtgtacctgtgccagagcgagaacagctgcctggaggacagcgaccccagcaacctgggctatgagctgatcagcgcctttgtgaccaagggcgtgtacatgctgaaggctgtgatctacaatgagttccacggcacagaggtggagctgggcccctactacgtggagattggacatgaagctgtgtctgccttcatgaacagcagctctgtgcatgaagatgaggtgctggtgtttgctgacagccaggtgaaccagaagagcacagtggtgatccaccacttccccagcatccccagctacaacgtgtccttcatcagccagacccaggtgggggacagccaggcctggcacagcatgacagtgtggtacaagatgcagagcgtgtctgtgtacaccaacggcaccgtgtttgccacagacacagacatcaccttcaccgctgtgaccaaggagaccatccccctggagtttgagtggtactttggagaggacccccctgtgaggaccaccagccgcagcatcaagaagaggctgagcatcccccagtggtacagagtgatggtgaaggccagcaacaggatgagctctgtggtgtctgagccccacgtgatccgggtgcagaagaagatcgtggccaaccggctgaccagccccagcagcgccctggtgaatgcctctgtggcctttgagtgctggatcaactttggaacagatgtggcctacctgtgggactttggagatggcaccgtgtccctgggcagcagcagcagcagccacgtgtacagccgggagggggagttcaccgtggaggtgctggccttcaacaacgtgtctgccagcaccctgcggcagcagctgttcatcgtgtgtgagccctgccagccccccctggtgaagaacatgggccctgggaaggtgcagatctggaggagccagcctgtgcggctgggcgtgacctttgaagctgctgtgttctgtgacatcagccagggcctgagctacacctggaacctgatggacagcgagggcctgcctgtgtccctgcctgctgctgtggacacccaccggcagaccctcatcctgcccagccacaccctggagtatggcaactacacagccctggccaaggtgcagatcgagggctctgtggtgtacagcaactactgtgtgggcctggaggtgcgggcccaggcccctgtgtctgtcatcagcgagggcacccacctgttcttcagcaggaccaccagcagccccatcgtgctgcggggcacccagagctttgatcctgatgatcctggggccaccctgcgctaccactgggagtgtgccacagctggcagccctgcccacccctgctttgacagcagcacagcccaccagctggatgctgctgcccccaccgtgtcctttgaggcccagtggctgagtgacagctatgaccagttcctggtgatgctgcgggtgtcctctgggggcaggaacagcagcgagaccagggtcttcctgagcccctacccagattctgccttccgctttgtgcacatctcctgggtgtccttcaaggacacctttgtgaactggaatgatgagctgagcctgcaggccatgtgtgaggactgcagcgagatccccaacctgagctacagctgggacctcttcctggtgaatgccacagagaagaaccgcatcgaggtgcccttctgccgggtggtgggcctgctgggcagcctgggcctgggcgccatcagcgagagcagccagctgaacctgctgcccacagagcccggcacagctgaccctgatgccaccaccacccccttcagccgggagcccagccctgtgaccctgggccagcctgccaccagcgccccccggggcacccccacagagcccatgactggagtgtactggatccccccagctggggacagcgctgtgctgggggaggcccctgaggagggcagcctggacctggagcccggcccccagagcaagggcagcctgatgacaggccgctctgagaggagccagcccacccacagcccagacccccacctgagtgactttgaggcctactacagcgacatccaggaggccatccccagcggcggccggcagcctgccaaggacaccagcttccctggcagcggccccagcctgtctgctgaggagagccctggagatggagacaacctggtggaccccagcctgtctgctggccgggcagagcctgtgctgatgattgactggcccaaggccctgctgggccgggctgtgttccagggctacagcagcagcggcatcacagagcagacagtgaccatcaagccctacagcctgagcagtggagagacctacgtgctgcaggtgtctgtggccagcaagcacggcctgctgggcaaggcccagctgtacctgactgtgaacccagccccccgggacatggcctgccaggtgcagccccaccacggcctggaggcccacacagtgttttctgtgttctgcatgtctgggaagccagacttccactatgagttctcctaccagatcggcaacaccagcaagcacaccctgtaccacggccgggacacccagtactactttgtgctgcctgctggggagcacctggacaactacaaggtgatggtgtccacagagatcacagatggcaagggcagcaaggtgcagccctgcaccgtggtggtgacagtgctgccccgctaccacggcaatgactgcctgggagaagatctctacaacagcagcctgaagaacctgagcaccctgcagctgatgggcagctacacagagatccggaactacatcaccgtcatcacccgcatcctgagccggctgagcaaggaggacaagacagccagctgcaaccagtggagccgcatccaggatgccctgatcagctctgtgtgccgcctggcctttgtggaccaggaggagatgattggctctgtgctgatgctgcgggacctggtgtccttcagcaacaagctgggcttcatgtctgctgtgctgatcctgaagtacacccgggccctgctggcccagggccagttcagcggcccctttgtgattgacaagggcgtgcggctggagctgattggcctcatcagccgggtgtgggaggtgtctgagcaggagaacagcaaggaggaggtgtacagacatgaggagggcatcaccgtcatcagtgacctgctgctgggctgcctgagcctgaaccacgtgtccacaggccagatggagttccgcaccctgctgcactacaacctgcagagctctgtgcagagcctgggctctgtgcaggtgcacctgcccggggacctggccggccacagccctgctggagctgagacccagagcccctgctacatcagccagctgatcctcttcaagaagaacccctacccaggcagccaggcccctggccagattggaggagtggtgggcctgaacctgtacacctgcagcagcagaagacccatcaaccggcagtggctgaggaagcctgtgatggtggagtttggagaggaggatggcctggacaacagaagaaacaagaccacctttgtgctgctgcgggacaaggtgaacctgcaccagttcacagagctgtctgagaacccccaggagagcctgcagattgaaattgagttcagcaagcctgtgacccgggccttccctgtgatgctgctggtgcgcttcagcgagaagcccacccccagcgacttcctggtgaagcagatctacttctgggatgagagcatcgtgcagatctacatcccagctgccagccagaaggatgcctctgtgggctacctgagcctgctggatgctgactatgacaggaagccacccaaccgctacctggccaaggctgtgaactacacagtgcacttccagtggatccgctgcctcttctgggacaagcgggagtggaagtctgagcgcttcagcccccagcccggcaccagccctgagaaggtgaactgcagctaccaccggctggccgcctttgccctgctgcggaggaagctgaaggccagctttgaggtgtctgacatcagcaagctgcagagccaccctgagaacctgctgcccagcatcttcatcatgggcagcgtcatcctgtatggcttcctggtggccaagagccggcaggtggaccaccacgagaagaagaaggccggctacatcttcctgcaggaggccagcctgcccggccaccagctgtatgctgtggtgattgacaccggcttccgggccccagcccggctgaccagcaaggtgtacatcgtgctgtgtggggacaatggcctgtctgagaccaaggagctgagctgcccagagaagcccctgtttgagaggaacagccgccacaccttcatcctgagcgccccagcccagctgggcctgctgaggaagatccggctgtggcatgacagccggggccccagccctggctggttcatcagccacgtgatggtgaaggagctgcacacaggccagggctggttcttccctgcccagtgctggctgtctgctggaagacatgatggccgggtggagcgggagctgacctgcctgcagggcggcctgggcttcaggaagctgttctactgcaagttcacagagtacctggaggacttccacgtgtggctgtctgtgtacagccggcccagcagcagccgctacctgcacaccccccggctgactgtgtccttcagcctgctgtgtgtgtatgcctgcctgacagccctggtggccgccggcggccaggagcagccccacctggatgtgagccccaccctgggcagcttccgggtgggcctgctgtgcaccctgctggccagccctggggcccagctgctgagcctgctcttccggctgagcaaggaggcccctggcagcgcccgggtggagccccacagccccctgcggggcggggcccagacagaggccccccacggccccaacagctggggccgcatcccagatgcccaggagcccaggaagcagcctgccagcgccatcctgagcggcagcggccgggcccagaggaaggccgccagtgacaatggaacagcctgcccagcccccaagctgcaggtgcatggagctgaccacagcaggaccagcctgatgggcaagagccactgctgccccccccacacccaggcccccagcagcggcctggagggcctgatgccccagtggagccgggccctgcagccctggtggagcagcgctgtgtgggccatctgtggcacagccagcctggcctgcagcctgggcaccggcttcctggcctacagatttggccaggagcagtgtgtgcagtggctgcacctgctgagcctgtctgtggtgtgctgcatcttcatcacccagcccctgatggtgtgcctgatggccctgggctttgcctggaagagaagagctgacaaccacttcttcacagagagcctgtgtgaggccacccgggacctggacagcgagctggccgagaggtcctggacccggctgcccttcagcagcagctgcagcatcccagactgtgccggggaggtggagaaggtgctggccgcccggcagcaggcccggcacctgcgctgggcccacccccccagcaaggcccagctgcggggcacccggcagaggatgagaagagagagcaggacccgggccgccctgcgggacatctccatggacatcctgatgctgctgctgctgctgtgtgtgatctacggccgcttcagccaggatgagtacagcctgaaccaggccatcaggaaggagttcaccagaaatgccaggaactgcctgggcggcctgaggaacattgctgactggtgggactggagcctgaccaccctgctggatggcctgtacccaggcggcacccccagcgcccgggtgcctggggcccagcccggggccctgggcggcaagtgctacctgattggcagcagcgtcatccggcagctgaaggtgttccccaggcacctgtgcaagccaccccggcccttcagcgccctgattgaagattccatccccacctgcagccctgaggtgggcggccctgagaacccctacctgattgatcctgagaaccagaatgtgaccctgaatggacctgggggctgcggcacccgggaggactgtgtgctgagcctgggccgcaccaggacagaggcccacacagccctgagccggctgcgggcctccatgtggattgacaggagcaccagggctgtgtctgtgcacttcaccctgtacaacccccccacccagctgttcacctctgtgtccctgcgggtggagatcctgcccaccggcagcctggtgcccagcagcctggtggagagcttcagcatcttcagaagtgacagcgccctgcagtaccacctgatgctgccccagctggtgttcctggccctgagcctcatccacctgtgtgtgcagctgtacaggatgatggacaagggcgtgctgagctactggaggaagcccaggaactggctggagctgtctgtggtgggcgtgtccctgacctactatgctgtgtctggccacctggtgaccctggccggagatgtgaccaaccagttccaccggggcctgtgccgggccttcatggacctgaccctgatggcctcctggaaccagagggcccgctggctgcggggcatcctgctcttcctgttcaccctgaagtgtgtgtacctgcccggcatccagaacaccatggccagctgcagctccatgatgaggcacagcctgcccagcatctttgtggccggcctggtgggcgccctgatgctggccgccctgagccacctgcaccgcttcctgctgtccatgtgggtgctgcccccaggcaccttcacagatgccttccctggcctgctcttccacttccccaggaggagccagaaggactgcctgctgggcctgagcaagagtgaccagagggccatggcctgctacttcggcatcctgctgattgtgtctgccaccctgtgcttcggcatgctgcggggcttcctgatgaccctgccccagaagaggaagagcttccagagcaagagctttgtgcggctgaaggatgtgacagcctacatgtgggagaaggtgctgaccttcctgcggctggagacccccaagctggaggaggccgagatggtggagaaccacaactactacctggatgaatttgccaacctgctggatgagctgctgatgaagatcaatggcctgagtgacagcctgcagctgcccctgctggagaagaccagcaacaacacaggagaggccaggacagaggagagccccctggtggacatcagcagctaccaggccgctgagcctgctgacatcaaggacttctag

SEQ ID NO: 164596 - DNA, 495 bp, Artificial Sequence
  Description of Artificial Sequence: Synthetic coding sequence
tgagtgggcggccctgagaacccctacctgattgatcctgagaaccagaatgtgaccctgaatggacctgggggctgcggcacccgggaggactgtgtgctgagcctgggccgcaccaggacagaggcccacacagccctgagccggctgcgggcctccatgtggattgacaggagcaccagggctgtgtctgtgcacttcaccctgtacaacccccccacccagctgttcacctctgtgtccctgcgggtggagatcctgcccaccggcagcctggtgcccagcagcctggtggagagcttcagcatcttcagaagtgacagcgccctgcagtaccacctgatgctgccccagctggtgttcctggccctgagcctcatccacctgtgtgtgcagctgtacaggatgatggacaagggcgtgctgagctactggaggaagcccaggaactggctggaggtggccagcctggtgtccttctcctttgagaagtag

SEQ ID NO: 164597 - DNA, 2907 bp, Artificial Sequence
  Description of Artificial Sequence: Synthetic coding sequence
atggtgaacagcagccgggtgcagccccagcagcctggagatgccaagaggcccccagccccccgggccccagaccccggccgcctgatggccggctgtgccgctgtgggcgccagcctggccgcccctgggggcctgtgtgagcagaggggcctggagattgagatgcagaggatccggcaggccgccgcccgggaccccccagctggagctgctgccagccccagcccccccctgagcagctgcagccggcaggcctggagccgggacaaccctggctttgaggccgaggaggaggaggaggaggtggagggggaggagggcggcatggtggtggagatggatgtggagtggaggcctggcagcagaagatctgctgccagcagcgctgtgtcctctgtgggcgcccggagccggggcctgggcggctaccatggagctggccaccccagcggcagaagaagaagaagagaggaccagggccccccctgccccagccctgtgggcggcggggaccccctgcaccgccacctgcccctggagggccagcccccccgggtggcctgggccgagcggctggtgcggggcctgcggggcctgtggggcacccggctgatggaggagagcagcaccaaccgggagaagtacctgaagtctgtgctgcgggagctggtgacctacctgctcttcctgattgtgctgtgcatcctgacctacggcatgatgagcagcaatgtgtactactacaccaggatgatgagccagctgttcctggacacccctgtgtccaagacagagaagaccaacttcaagaccctgagctccatggaggacttctggaagttcacagagggcagcctgctggatggcctgtactggaagatgcagcccagcaaccagacagaagctgacaacagaagcttcatcttctatgagaacctgctgctgggcgtgccccgcatccggcagctgcgggtgagaaatggcagctgcagcatcccccaggacctgagagatgagatcaaggaatgttatgatgtgtacagcgtgtccagtgaagatcgggcccccttcggccccagaaatggaacagcctggatctacaccagcgagaaggacctgaatggcagcagccactggggcatcatcgccacctacagcggggccggctactacctggacctgagcaggacccgggaggagacagctgcccaggtggccagcctgaagaagaatgtgtggctggaccggggcacccgggccaccttcatcgacttctctgtgtacaatgccaacatcaacctcttctgtgtggtgcggctgctggtggagttccctgccaccggcggcgtcatccccagctggcagttccagcccctgaagctgatccgctacgtgaccacctttgacttcttcctggccgcctgtgagatcatcttctgcttcttcatcttctactacgtggtggaggagatcctggagatccgcatccacaagctgcactacttccgctccttctggaactgcctggatgtggtgattgtggtgctgtctgtggtggccatcggcatcaacatctaccgcaccagcaatgtggaggtgctgctgcagttcctggaggaccagaacaccttccccaactttgagcacctggcctactggcagatccagttcaacaacattgctgctgtgacagtgttctttgtgtggatcaagctgttcaagttcatcaacttcaacagaaccatgagccagctgagcaccaccatgagccgctgtgccaaggacctgtttggatttgccatcatgttcttcatcatcttcctggcctatgcccagctggcctacctggtgtttggcacccaggtggatgacttcagcaccttccaggagtgcatcttcacccagttccgcatcatcctgggggacatcaactttgctgagattgaggaggccaacagagtgctgggccccatctacttcaccacctttgtgttcttcatgttcttcatcctgctgaacatgttcctggccatcatcaatgacacctacagcgaggtgaagagtgacctggcccagcagaaggccgagatggagctgagtgacctgatcaggaagggctaccacaaggccctggtgaagctgaagctgaagaagaacacagtggatgacatcagcgagagcctgcggcagggcggcggcaagctgaactttgatgagctgcggcaggacctgaagggcaagggccacacagatgctgagattgaggccatcttcaccaagtatgaccaggatggagaccaggagctgacagaacatgagcaccagcagatgagagatgacctggagaaggagcgggaggacctggacctggaccacagcagcctgccccggcccatgagcagccgctccttccccaggagcctggatgacagcgaggaggatgatgatgaggacagcggccacagcagcagaagaagaggcagcatcagcagcggcgtgtcctatgaggagttccaggtgctggtgcggcgggtggacaggatggagcacagcatcggcagcatcgtgtccaagattgatgctgtgattgtgaagctggagatcatggagcgggccaagctgaagagaagagaggtgctgggccgcctgctggatggagtggccgaggatgagcggctgggccgggacagcgagatccaccgggagcagatggagcggctggtgcgggaggagctggagcgctgggagagtgatgatgctgccagccagatcagccacggcctgggcacccctgtgggcctgaatggccagccccggcccaggagcagccggcccagcagcagccagagcacagagggcatggagggcgctggaggaaatggcagcagcaatgtgcacgtgtag

SEQ ID NO: 164598 - DNA, 1161 bp, Artificial Sequence
  Description of Artificial Sequence: Synthetic coding sequence
atgagccagctgagcaccaccatgagccgctgtgccaaggacctgtttggatttgccatcatgttcttcatcatcttcctggcctatgcccagctggcctacctggtgtttggcacccaggtggatgacttcagcaccttccaggagtgcatcttcacccagttccgcatcatcctgggggacatcaactttgctgagattgaggaggccaacagagtgctgggccccatctacttcaccacctttgtgttcttcatgttcttcatcctgctgaacatgttcctggccatcatcaatgacacctacagcgaggtgaagagtgacctggcccagcagaaggccgagatggagctgagtgacctgatcaggaagggctaccacaaggccctggtgaagctgaagctgaagaagaacacagtggatgacatcagcgagagcctgcggcagggcggcggcaagctgaactttgatgagctgcggcaggacctgaagggcaagggccacacagatgctgagattgaggccatcttcaccaagtatgaccaggatggagaccaggagctgacagaacatgagcaccagcagatgagagatgacctggagaaggagcgggaggacctggacctggaccacagcagcctgccccggcccatgagcagccgctccttccccaggagcctggatgacagcgaggaggatgatgatgaggacagcggccacagcagcagaagaagaggcagcatcagcagcggcgtgtcctatgaggagttccaggtgctggtgcggcgggtggacaggatggagcacagcatcggcagcatcgtgtccaagattgatgctgtgattgtgaagctggagatcatggagcgggccaagctgaagagaagagaggtgctgggccgcctgctggatggagtggccgaggatgagcggctgggccgggacagcgagatccaccgggagcagatggagcggctggtgcgggaggagctggagcgctgggagagtgatgatgctgccagccagatcagccacggcctgggcacccctgtgggcctgaatggccagccccggcccaggagcagccggcccagcagcagccagagcacagagggcatggagggcgctggaggaaatggcagcagcaatgtgcacgtgtag

SEQ ID NO: 164599 - DNA, 1161 bp, Artificial Sequence; identical to SEQ ID NO: 164598
  Description of Artificial Sequence: Synthetic coding sequence

SEQ ID NO: 164600 - DNA, 2418 bp, Artificial Sequence
  Description of Artificial Sequence: Synthetic coding sequence
atgaatgctgtgggcagccctgagggccaggagctgcagaagctgggcagcggggcctgggacaacccagcctacagcggcccccccagcccccacggcaccctgcgggtgtgcaccatcagcagcacaggccccctgcagccccagcccaagaagccagaagatgagccccaggagacagcctaccgcacccaggtgagcagctgctgcctgcacatctgccagggcatccggggcctgtggggcaccaccctgacagaaaatacagcagaaaatcgggagctgtacatcaagaccaccctgcgggagctgctggtgtacatcgtgttcctggtggacatctgcctgctgacctacggcatgaccagcagcagcgcctactactacaccaaggtgatgtctgagctgttcctgcacacccccagcgacaccggggtgtccttccaggccatcagctccatggctgacttctgggactttgcccagggccccctgctggacagcctgtactggaccaagtggtacaacaaccagagcctgggccacggcagccacagcttcatctactatgagaacatgctgctgggcgtgccccggctgcggcagctgaaggtgagaaatgacagctgtgtggtgcatgaggacttccgggaggacatcctgagctgctatgatgtgtacagcccagacaaggaggagcagctgcccttcggccccttcaatggaacagcctggacctaccacagccaggatgagctgggcggcttcagccactggggccgcctgaccagctacagcggcggcggctactacctggacctgcccggcagccggcagggcagcgctgaggccctgcgggccctgcaggagggcctgtggctggaccggggcaccagggtggtgttcatcgacttctctgtgtacaatgccaacatcaacctcttctgtgtgctgcggctggtggtggagttccctgccactggaggagccatccccagctggcagatcagaacagtgaagctgatccgctacgtgagcaactgggacttcttcatcgtgggctgtgaggtgatcttctgtgtgttcatcttctactacgtggtggaggagatcctggagctgcacatccaccggctgcgctacctgagcagcatctggaacatcctggacctggtggtgatcctgctgagcatcgtggccgtgggcttccacatcttccgcaccctggaggtgaaccggctgatgggcaagctgctgcagcagcccaacacctacgccgactttgagttcctggccttctggcagacccagtacaacaacatgaatgctgtgaacctcttctttgcctggatcaagatcttcaagtacatctccttcaacaagaccatgacccagctgagcagcaccctggcccgctgtgccaaggacatcctgggctttgctgtgatgttcttcatcgtgttctttgcctatgcccagctgggctacctgctgtttggcacccaggtggagaacttcagcaccttcatcaagtgcatcttcacccagttccgcatcatcctgggggactttgactacaatgccatcgacaatgccaaccgcatcctgggccctgcctactttgtgacctacgtgttctttgtgttctttgtgctgctgaacatgttcctggccatcatcaatgacacctacagcgaggtgaaggaggagctggccggccagaaggatgagctgcagctgagtgacctgctgaagcagggctacaacaagaccctgctgcggctgcggctgaggaaggagcgggtgtctgatgtgcagaaggtgctgcagggcggggagcaggagatccagtttgaggacttcaccaacaccctgcgggagctgggccatgctgagcacgagatcacagagctgacagccaccttcaccaagtttgacagagatggcaaccgcatcctggatgagaaggagcaggagaagatgaggcaggacctggaggaggagcgggtggccctgaacacagaaattgagaagctgggccgcagcatcgtgagcagcccccagggcaagagcggccctgaggccgcccgggccggcggctgggtgtctggagaggagttctacatgctgacccggcgggtgctgcagctggagaccgtgctggagggcgtggtgtcccagattgatgctgtgggcagcaagctgaagatgctggagaggaagggctggctggcccccagccctggggtgaaggagcaggccatctggaagcacccccagcctgccccagctgtgaccccagacccctggggcgtgcagggcggccaggagagcgaggtgccctacaagcgggaggaggaggccctggaggagcggcggctgagcagaggagagatccccaccctgcagaggagctag

SEQ ID NO: 164601 - DNA, 2193 bp, Artificial Sequence
  Description of Artificial Sequence: Synthetic coding sequence
atgaatgctgtgggcagccctgagggccaggagctgcagaagctgggcagcggggcctgggacaacccagcctacagcggcccccccagcccccacggcaccctgcgggtgtgcaccatcagcagcacaggccccctgcagccccagcccaagaagccagaagatgagccccaggagacagcctaccgcacccaggtgagcagctgctgcctgcacatctgccagggcatccggggcctgtggggcaccaccctgacagaaaatacagcagaaaatcgggagctgtacatcaagaccaccctgcgggagctgctggtgtacatcgtgttcctggtggacatctgcctgctgacctacggcatgaccagcagcagcgcctactactacaccaaggtgatgtctgagctgttcctgcacacccccagcgacaccggggtgtccttccaggccatcagctccatggctgacttctgggactttgcccagggccccctgctggacagcctgtactggaccaagtggtacaacaaccagagcctgggccacggcagccacagcttcatctactatgagaacatgctgctgggcgtgccccggctgcggcagctgaaggtgagaaatgacagctgtgtggtgcatgaggacttccgggaggacatcctgagctgctatgatgtgtacagcccagacaaggaggagcagctgcccttcggccccttcaatggaacagccctggtggtggagttccctgccaccggcggggccatccccagctggcagatcagaacagtgaagctgatccgctacgtgagcaactgggacttcttcatcgtgggctgtgaggtgatcttctgtgtgttcatcttctactacgtggtggaggagatcctggagctgcacatccaccggctgcgctacctgagcagcatctggaacatcctggacctggtggtgatcctgctgagcatcgtggccgtgggcttccacatcttccgcaccctggaggtgaaccggctgatgggcaagctgctgcagcagcccaacacctatgctgactttgagttcctggccttctggcagacccagtacaacaacatgaatgctgtgaacctcttctttgcctggatcaagatcttcaagtacatctccttcaacaagaccatgacccagctgagcagcaccctggcccgctgtgccaaggacatcctgggctttgctgtgatgttcttcatcgtgttctttgcctatgcccagctgggctacctgctgtttggcacccaggtggagaacttcagcaccttcatcaagtgcatcttcacccagttccgcatcatcctgggggactttgactacaatgccatcgacaatgccaaccgcatcctgggccctgcctactttgtgacctacgtgttctttgtgttctttgtgctgctgaacatgttcctggccatcatcaatgacacctacagcgaggtgaaggaggagctggccggccagaaggatgagctgcagctgagtgacctgctgaagcagggctacaacaagaccctgctgcggctgcggctgaggaaggagcgggtgtctgatgtgcagaaggtgctgcagggcggggagcaggagatccagtttgaggacttcaccaacaccctgcgggagctgggccacgccgagcacgagatcacagagctgacagccaccttcaccaagtttgacagagatggcaaccgcatcctggatgagaaggagcaggagaagatgaggcaggacctggaggaggagcgggtggccctgaacacagaaattgagaagctgggccgcagcatcgtgagcagcccccagggcaagagcggccctgaggccgcccgggccggcggctgggtgtctggagaggagttctacatgctgaccaggagagtgctgcagctggagaccgtgctggagggcgtggtgtcccagattgatgctgtgggcagcaagctgaagatgctggagaggaagggctggctggcccccagccctggggtgaaggagcaggccatctggaagcacccccagcctgccccagctgtgaccccagacccctggggcgtgcagggcggccaggagagcgaggtgccctacaagcgggaggaggaggccctggaggagcggcggctgagcagaggagagatccccaccctgcagaggagctag

SEQ ID NO: 164602 - DNA, 2328 bp, Artificial Sequence
  Description of Artificial Sequence: Synthetic coding sequence
atgaatgctgtgggcagccctgagggccaggagctgcagaagctgggcagcggggcctgggacaacccagcctacagcggcccccccagcccccacggcaccctgcgggtgtgcaccatcagcagcacaggccccctgcagccccagcccaagaagccagaagatgagccccaggagacagcctaccgcacccaggtgagcagctgctgcctgcacatctgccagggcatccggggcctgtggggcaccaccctgacagaaaatacagcagaaaatcgggagctgtacatcaagaccaccctgcgggagctgctggtgtacatcgtgttcctggtggacatctgcctgctgacctacggcatgaccagcagcagcgcctactactacaccaaggtgatgtctgagctgttcctgcacacccccagcgacaccggggtgtccttccaggccatcagctccatggctgacttctgggactttgcccagggccccctgctggacagcctgtactggaccaagtggtacaacaaccagagcctgggccacggcagccacagcttcatctactatgagaacatgctgctgggcgtgccccggctgcggcagctgaaggtgagaaatgacagctgtgtggtgcatgaggacttccgggaggacatcctgagctgctatgatgtgtacagcccagacaaggaggagcagctgcccttcggccccttcaatggaacagcctggacctaccacagccaggatgagctgggcggcttcagccactggggccgcctgaccagctacagcggcggcggctactacctggacctgcccggcagccggcagggcagcgctgaggccctgcgggccctgcaggagggcctgtggctggaccggggcaccagggtggtgttcatcgacttctctgtgtacaatgccaacatcaacctcttctgtgtgctgcggctggtggtggagttccctgcccggcgctgccaccccatcctggccaacccccacagccaggccgaccccctgtgccagcagctgttcttcatcgtgggctgtgaggtgatcttctgtgtgttcatcttctactacgtggtggaggagatcctggagctgcacatccaccggctgcgctacctgagcagcatctggaacatcctggacctggtggtgatcctgctgagcatcgtggccgtgggcttccacatcttccgcaccctggaggtgaaccggctgatgggcaagctgctgcagcagcccaacacctacgccgactttgagttcctggccttctggcagacccagtacaacaacatgaatgctgtgaacctcttctttgcctggatcaagatcttcaagtacatctccttcaacaagaccatgacccagctgagcagcaccctggcccgctgtgccaaggacatcctgggctttgctgtgatgttcttcatcgtgttctttgcctatgcccagctgggctacctgctgtttggcacccaggtggagaacttcagcaccttcatcaagtgcatcttcacccagttccgcatcatcctgggggactttgactacaatgccatcgacaatgccaaccgcatcctgggccctgcctactttgtgacctacgtgttctttgtgttctttgtgctgctgaacatgttcctggccatcatcaatgacacctacagcgaggtgaaggaggagctggccggccagaaggatgagctgcagctgagtgacctgctgaagcagggctacaacaagaccctgctgcggctgcggctgaggaaggagcgggtgtctgatgtgcagaaggtgctgcagggcggggagcaggagatccagtttgaggacttcaccaacaccctgcgggagctgggccatgctgagcacgagatcacagagctgacagccaccttcaccaagtttgacagagatggcaaccgcatcctggatgagaaggagcaggagaagatgaggcaggacctggaggaggagcgggtggccctgaacacagaaattgagaagctgggccgcagcatcgtgagcagcccccagggcaagagcggccctgaggccgcccgggccggcggctgggtgtctggagaggagttctacatgctgacccggcgggtgctgcagctggagaccgtgctggagggcgtggtgtcccagattgatgctgtgggcagcaagctgaagatgctggagaggaagggctggctggcccccagccctggggtgaaggagcaggccatctggaagcacccccagcctgccccagctgtgaccccagacccctggggccctggctgggccggggagtag

SEQ ID NO: 164603 - DNA, 2283 bp, Artificial Sequence
  Description of Artificial Sequence: Synthetic coding sequence
atgaatgctgtgggcagccctgagggccaggagctgcagaagctgggcagcggggcctgggacaacccagcctacagcggcccccccagcccccacggcaccctgcgggtgtgcaccatcagcagcacaggccccctgcagccccagcccaagaagccagaagatgagccccaggagacagcctaccgcacccaggtgagcagctgctgcctgcacatctgccagggcatccggggcctgtggggcaccaccctgacagaaaatacagcagaaaatcgggagctgtacatcaagaccaccctgcgggagctgctggtgtacatcgtgttcctggtggacatctgcctgctgacctacggcatgaccagcagcagcgcctactactacaccaaggtgatgtctgagctgttcctgcacacccccagcgacaccggggtgtccttccaggccatcagctccatggctgacttctgggactttgcccagggccccctgctggacagcctgtactggaccaagtggtacaacaaccagagcctgggccacggcagccacagcttcatctactatgagaacatgctgctgggcgtgccccggctgcggcagctgaaggtgagaaatgacagctgtgtggtgcatgaggacttccgggaggacatcctgagctgctatgatgtgtacagcccagacaaggaggagcagctgcccttcggccccttcaatggaacagcctggacctaccacagccaggatgagctgggcggcttcagccactggggccgcctgaccagctacagcggcggcggctactacctggacctgcccggcagccggcagggcagcgctgaggccctgcgggccctgcaggagggcctgtggctggaccggggcaccagggtggtgttcatcgacttctctgtgtacaatgccaacatcaacctcttctgtgtgctgcggctggtggtggagttccctgccactggaggagccatccccagctggcagatcagaacagtgaagctgatccgctacgtgagcaactgggacttcttcatcgtgggctgtgaggtgatcttctgtgtgttcatcttctactacgtggtggaggagatcctggagctgcacatccaccggctgcgctacctgagcagcatctggaacatcctggacctggtggtgatcctgctgagcatcgtggccgtgggcttccacatcttccgcaccctggaggtgaaccggctgatgggcaagctgctgcagcagcccaacacctacgccgactttgagttcctggccttctggcagacccagtacaacaacatgaatgctgtgaacctcttctttgcctggatcaagatcttcaagtacatctccttcaacaagaccatgacccagctgagcagcaccctggcccgctgtgccaaggacatcctgggctttgctgtgatgttcttcatcgtgttctttgcctatgcccagctgggctacctgctgtttggcacccaggtggagaacttcagcaccttcatcaagtgcatcttcacccagttccgcatcatcctgggggactttgactacaatgccatcgacaatgccaaccgcatcctgggccctgcctactttgtgacctacgtgttctttgtgttctttgtgctgctgaacatgttcctggccatcatcaatgacacctacagcgaggtgaaggaggagctggccggccagaaggatgagctgcagctgagtgacctgctgaagcagggctacaacaagaccctgctgcggctgcggctgaggaaggagcgggtgtctgatgtgcagaaggtgctgcagggcggggagcaggagatccagtttgaggacttcaccaacaccctgcgggagctgggccatgctgagcacgagatcacagagctgacagccaccttcaccaagtttgacagagatggcaaccgcatcctggatgagaaggagcaggagaagatgaggcaggacctggaggaggagcgggtggccctgaacacagaaattgagaagctgggccgcagcatcgtgagcagcccccagggcaagagcggccctgaggccgcccgggccggcggctgggtgtctggagaggagttctacatgctgacccggcgggtgctgcagctggagaccgtgctggagggcgtggtgtcccagattgatgctgtgggcagcaagctgaagatgctggagaggaagggctggctggcccccagccctggggtgcgcttccccatcaaggagaagaggaagccctag

SEQ ID NO: 164604 - DNA, 1842 bp, Artificial Sequence
  Description of Artificial Sequence: Synthetic coding sequence
atggccgaggccagccgctggcaccggggcggggccagcaagcacaagctgcactacaggaaggaggtggagatcaccaccaccctgcaggagctgctgctgtacttcatcttcctgatcaacctgtgcatcctgaccttcggcatggtgaacccccacatgtactacctgaacaaggtgatgagcagcctcttcctggacacctctgtgcctggagaggagaggaccaacttcaagagcatccgcagcatcacagacttctggaagttcatggagggccccctgctggagggcctgtactgggacagctggtacaacaaccagcagctgtacaacctgaagaacagcagccgcatctactatgagaacatcctgctgggcgtgccccgggtgcggcagctgaaggtgaggaacaacacctgcaaggtgtacagcagcttccagagcctgatgtctgaatgttatggcaagtacaccagcgccaatgaagacctgagcaactttggcctgcagatcaacacagagtggagatacagcaccagcaacaccaacagcccctggcactggggcttcctgggcgtgtacagaaatggaggctacatcttcaccctgagcaagagcaagtctgagaccaagaacaagttcatcgacctgcggctgaacagctggatcacccggggcaccagggtcatcttcatcgacttcagcctgtacaatgccaacgtgaacctcttctgcatcatccggctggtggccgagttccctgccactggaggcatcctgacctcctggcagttctacagcgtgaagctgctgcgctacgtgtcctactatgactacttcatcgccagctgtgagatcaccttctgcatcttcctgtttgtgttcaccacccaggaggtgaagaagatcaaggagttcaagagcgcctacttcaagagcatctggaactggctggagctgctgctgctgctgctgtgctttgtggccgtgtccttcaacacctactacaacgtgcagatcttcctgctgctgggccagctgctgaagagcacagagaagtacagcgacttctacttcctggcctgctggcacatctactacaacaacatcatcgccatcaccatcttctttgcctggatcaagatcttcaagttcatctccttcaacaagaccatgagccagctgagcagcaccctgagccgctgtgtgaaggacatcgtgggctttgccatcatgttcttcatcatcttctttgcctatgcccagctgggcttcctggtgtttggcagccaggtggatgacttcagcaccttccagaacagcatctttgcccagttcagaattgtgctgggggacttcaactttgctggcatccagcaggccaaccccatcctgggccccatctacttcatcaccttcatcttctttgtgttctttgtgctgctgaacatgttcctggccatcatcaatgacacctacagcgaggtgaaggctgactacagcattggaagaaggctggactttgagctgggcaagatgatcaagcagagctacaagaatgtgctggagaagttccggctgaagaaggcccagaaggatgaggacaagaagaccaagggcagcggggacctggccgagcaggcccggcgggagggctttgatgaaaatgagatccagaatgctgagcagatgaagaagtggaaggagcggctggagaagaagtactacagcatggagatccaggatgactaccagcctgtgacccaggaggagttcagagatggcaccaccaccaagtacaagatgaggttctctgaatgtctgaccaagaggatctag

SEQ ID NO: 164605 - DNA, 1773 bp, Artificial Sequence
  Description of Artificial Sequence: Synthetic coding sequence
atggccgaggccagccgctggcaccggggcgtgaccttcggcatggtgaacccccacatgtactacctgaacaaggtgatgagcagcctcttcctggacacctctgtgcctggagaggagaggaccaacttcaagagcatccgcagcatcacagacttctggaagttcatggagggccccctgctggagggcctgtactgggacagctggtacaacaaccagcagctgtacaacctgaagaacagcagccgcatctactatgagaacatcctgctgggcgtgccccgggtgcggcagctgaaggtgaggaacaacacctgcaaggtgtacagcagcttccagagcctgatgtctgaatgttatggcaagtacaccagcgccaatgaagacctgagcaactttggcctgcagatcaacacagagtggagatacagcaccagcaacaccaacagcccctggcactggggcttcctgggcgtgtacagaaatggaggctacatcttcaccctgagcaagagcaagtctgagaccaagaacaagttcatcgacctgcggctgaacagctggatcacccggggcaccagggtcatcttcatcgacttcagcctgtacaatgccaacgtgaacctcttctgcatcatccggctggtggccgagttccctgccactggaggcatcctgacctcctggcagttctacagcgtgaagctgctgcgctacgtgtcctactatgactacttcatcgccagctgtgagatcaccttctgcatcttcctgtttgtgttcaccacccaggaggtgaagaagatcaaggagttcaagagcgcctacttcaagagcatctggaactggctggagctgctgctgctgctgctgtgctttgtggccgtgtccttcaacacctactacaacgtgcagatcttcctgctgctgggccagctgctgaagagcacagagaagtacagcgacttctacttcctggcctgctggcacatctactacaacaacatcatcgccatcaccatcttctttgcctggatcaagatcttcaagttcatctccttcaacaagaccatgagccagctgagcagcaccctgagccgctgtgtgaaggacatcgtgggctttgccatcatgttcttcatcatcttctttgcctatgcccagctgggcttcctggtgtttggcagccaggtggatgacttcagcaccttccagaacagcatctttgcccagttcagaattgtgctgggggacttcaactttgctggcatccagcaggccaaccccatcctgggccccatctacttcatcaccttcatcttctttgtgttctttgtgctgctgaacatgttcctggccatcatcaatgacacctacagcgaggtgaaggctgactacagcattggaagaaggctggactttgagctgggcaagatgatcaagcagagctacaagaatgtgctggagaagttccggctgaagaaggcccagaaggatgaggacaagaagaccaagggcagcggggacctggccgagcaggcccggcgggagggctttgatgaaaatgagatccagaatgctgagcagatgaagaagtggaaggagcggctggagaagaagtactacagcatggagatccaggatgactaccagcctgtgacccaggaggagttccgggagctgttcctgtatgctgtggagctggagaaggagctgcactacatcaacctgaagctgaaccaggtggtgaggaaggtgtctgccctgtag

SEQ ID NO: 164606 - DNA, 1875 bp, Artificial Sequence
  Description of Artificial Sequence: Synthetic coding sequence
atggccgaggccagccgctggcaccggggcggggccagcaagcacaagctgcactacaggaaggaggtggagatcaccaccaccctgcaggagctgctgctgtacttcatcttcctgatcaacctgtgcatcctgaccttcggcatggtgaacccccacatgtactacctgaacaaggtgatgagcagcctcttcctggacacctctgtgcctggagaggagaggaccaacttcaagagcatccgcagcatcacagacttctggaagttcatggagggccccctgctggagggcctgtactgggacagctggtacaacaaccagcagctgtacaacctgaagaacagcagccgcatctactatgagaacatcctgctgggcgtgccccgggtgcggcagctgaaggtgaggaacaacacctgcaaggtgtacagcagcttccagagcctgatgtctgaatgttatggcaagtacaccagcgccaatgaagacctgagcaactttggcctgcagatcaacacagagtggagatacagcaccagcaacaccaacagcccctggcactggggcttcctgggcgtgtacagaaatggaggctacatcttcaccctgagcaagagcaagtctgagaccaagaacaagttcatcgacctgcggctgaacagctggatcacccggggcaccagggtcatcttcatcgacttcagcctgtacaatgccaacgtgaacctcttctgcatcatccggctggtggccgagttccctgccactggaggcatcctgacctcctggcagttctacagcgtgaagctgctgcgctacgtgtcctactatgactacttcatcgccagctgtgagatcaccttctgcatcttcctgtttgtgttcaccacccaggaggtgaagaagatcaaggagttcaagagcgcctacttcaagagcatctggaactggctggagctgctgctgctgctgctgtgctttgtggccgtgtccttcaacacctactacaacgtgcagatcttcctgctgctgggccagctgctgaagagcacagagaagtacagcgacttctacttcctggcctgctggcacatctactacaacaacatcatcgccatcaccatcttctttgcctggatcaagatcttcaagttcatctccttcaacaagaccatgagccagctgagcagcaccctgagccgctgtgtgaaggacatcgtgggctttgccatcatgttcttcatcatcttctttgcctatgcccagctgggcttcctggtgtttggcagccaggtggatgacttcagcaccttccagaacagcatctttgcccagttcagaattgtgctgggggacttcaactttgctggcatccagcaggccaaccccatcctgggccccatctacttcatcaccttcatcttctttgtgttctttgtgctgctgaacatgttcctggccatcatcaatgacacctacagcgaggtgaaggctgactacagcattggaagaaggctggactttgagctgggcaagatgatcaagcagagctacaagaatgtgctggagaagttccggctgaagaaggcccagaaggatgaggacaagaagaccaagggcagcggggacctggccgagcaggcccggcgggagggctttgatgaaaatgagatccagaatgctgagcagatgaagaagtggaaggagcggctggagaagaagtactacagcatggagatccaggatgactaccagcctgtgacccaggaggagttccgggagctgttcctgtatgctgtggagctggagaaggagctgcactacatcaacctgaagctgaaccaggtggtgaggaaggtgtctgccctgtag

SEQ ID NO: 164607 - DNA, 1809 bp, Artificial Sequence
  Description of Artificial Sequence: Synthetic coding sequence
atggccgaggccagccgctggcaccggggcggggccagcaagcacaagctgcactacaggaaggaggtggagatcaccaccaccctgcaggagctgctgctgtacttcatcttcctgatcaacctgtgcatcctgaccttcggcatggtgaacccccacatgtactacctgaacaaggtgatgagcagcctcttcctggacacctctgtgcctggagaggagaggaccaacttcaagagcatccgcagcatcacagacttctggaagttcatggagggccccctgctggagggcctgtactgggacagctggtacaacaaccagcagctgtacaacctgaagaacagcagccgcatctactatgagaacatcctgctgggcgtgccccgggtgcggcagctgaaggtgaggaacaacacctgcaaggtgtacagcagcttccagagcctgatgtctgaatgttatggcaagtacaccagcgccaatgaagacctgagcaactttggcctgcagatcaacacagagtggagatacagcaccagcaacaccaacagcccctggcactggggcttcctgggcgtgtacagaaatggaggctacatcttcaccctgagcaagagcaagtctgagaccaagaacaagttcatcgacctgcggctgaacagctggatcacccggggcaccagggtcatcttcatcgacttcagcctgtacaatgccaacgtgaacctcttctgcatcatccggctggtggccgagttccctgccactggaggcatcctgacctcctggcagttctacagcgtgaagctgctgcgctacgtgtcctactatgactacttcatcgccagctgtgagatcaccttctgcatcttcctgtttgtgttcaccacccaggaggtgaagaagatcaaggagttcaagagcgcctacttcaagagcatctggaactggctggagctgctgctgctgctgctgctgaagagcacagagaagtacagcgacttctacttcctggcctgctggcacatctactacaacaacatcatcgccatcaccatcttctttgcctggatcaagatcttcaagttcatctccttcaacaagaccatgagccagctgagcagcaccctgagccgctgtgtgaaggacatcgtgggctttgccatcatgttcttcatcatcttctttgcctatgcccagctgggcttcctggtgtttggcagccaggtggatgacttcagcaccttccagaacagcatctttgcccagttcagaattgtgctgggggacttcaactttgctggcatccagcaggccaaccccatcctgggccccatctacttcatcaccttcatcttctttgtgttctttgtgctgctgaacatgttcctggccatcatcaatgacacctacagcgaggtgaaggctgactacagcattggaagaaggctggactttgagctgggcaagatgatcaagcagagctacaagaatgtgctggagaagttccggctgaagaaggcccagaaggatgaggacaagaagaccaagggcagcggggacctggccgagcaggcccggcgggagggctttgatgaaaatgagatccagaatgctgagcagatgaagaagtggaaggagcggctggagaagaagtactacagcatggagatccaggatgactaccagcctgtgacccaggaggagttccgggagctgttcctgtatgctgtggagctggagaaggagctgcactacatcaacctgaagctgaaccaggtggtgaggaaggtgtctgccctgtag

SEQ ID NO: 164608 - DNA, 1572 bp, Artificial Sequence
  Description of Artificial Sequence: Synthetic coding sequence
atggccgaggccagccgctggcaccggggcggggccagcaagcacaagctgcactacaggaaggaggtggagatcaccaccaccctgcaggagctgctgctgtacttcatcttcctgatcaacctgtgcatcctgaccttcggcatggtgaacccccacatgtactacctgaacaaggtgatgagcagcctcttcctggacacctctgtgcctggagaggagaggaccaacttcaagagcatccgcagcatcacagacttctggaagttcatggagggccccctgctggagggcctgtactgggacagctggtacaacaaccagcagctgtacaacctgaagaacagcagccgcatctactatgagaacatcctgctgggcgtgccccgggtgcggcagctgaaggtgaggaacaacacctgcaaggtgtacagcagcttccagagcctgatgtctgaatgttatggcaagtacaccagcgccaatgaagacctgagcaactttggcctgcagatcaacacagagtggagatacagcaccagcaacaccaacagcccctggcactggggcttcctgggcgtgtacagaaatggaggctacatcttcaccctgagcaagagcaagtctgagaccaagaacaagttcatcgacctgcggctgaacagctggatcacccggggcaccagggtcatcttcatcgacttcagcctgtacaatgccaacgtgaacctcttctgcatcatccggctggtggccgagttccctgccactggaggcatcctgacctcctggcagttctacagcgtgaagctgctgcgctacgtgtcctactatgactacttcatcgccagctgtgagatcaccttctgcatcttcctgtttgtgttcaccacccaggaggtgaagaagatcaaggagttcaagagcgcctacttcaagagcatctggaactggctggagctgctgctgctgctgctgtgctttgtggccgtgtccttcaacacctactacaacgtgcagatcttcctgctgctgggccagctgctgaagagcacagagaagtacagcgacttctacttcctggcctgctggcacatctactacaacaacatcatcgccatcaccatcttctttgcctggatcaagaacatgttcctggccatcatcaatgacacctacagcgaggtgaaggctgactacagcatcggccggcggctggactttgagctgggcaagatgatcaagcagagctacaagaatgtgctggagaagttccggctgaagaaggcccagaaggatgaggacaagaagaccaagggcagcggggacctggccgagcaggcccggcgggagggctttgatgaaaatgagatccagaatgctgagcagatgaagaagtggaaggagcggctggagaagaagtactacagcatggagatccaggatgactaccagcctgtgacccaggaggagttccgggagctgttcctgtatgctgtggagctggagaaggagctgcactacatcaacctgaagctgaaccaggtggtgaggaaggtgtctgccctgtag

SEQ ID NO: 164609 - DNA, 1836 bp, Artificial Sequence
  Description of Artificial Sequence: Synthetic coding sequence
atggaggagctggtggtggaggtgcggggcagcaatggagccttctacaaggcctttgtgaaggatgtgcatgaagattccatcaccgtggcctttgagaacaactggcagcctgaccggcagatccccttccatgatgtgcgcttccccccacctgtgggctacaacaaggacatcaatgaaagtgatgaggtggaggtgtacagccgggccaatgagaaggagccctgctgctggtggctggccaaggtgaggatgatcaagggggagttctacgtgattgaatatgctgcctgtgatgccacctacaatgagatcgtgaccatcgagcggctgcggtctgtgaaccccaacaagccagccaccaaggacaccttccacaagatcaagctggatgtgcctgaggacctgcggcagatgtgtgccaaggaggccgcccacaaggacttcaagaaggctgtgggcgccttctctgtgacctatgaccctgagaactaccagctggtgatcctgagcatcaatgaggtgaccagcaagagggcccacatgctgattgacatgcacttccgcagcctgcggaccaagctgagcctcatcatgagaaatgaggaggccagcaagcagctggagagcagccggcagctggccagccgcttccacgagcagttcatcgtgcgggaggacctgatgggcctggccatcggcacccatggagccaacatccagcaggccaggaaggtgcctggggtgacagccatcgacctggatgaggacacctgcaccttccacatctatggagaggaccaggatgctgtgaagaaggcccgctccttcctggagtttgctgaagatgtgatccaggtgcccaggaacctggtgggcaaggtgattggcaagaatggcaagctgatccaggagatcgtggacaagtctggagtggtgcgggtgcgcatcgaggctgaaaatgagaagaatgtgccccaggaggaggagatcatgccacccaacagcctgcccagcaacaacagccgggtgggccccaatgcccctgaggagaagaagcacctggacatcaaggagaacagcacccacttcagccagcccaacagcaccaaggtgcagaggggcatggtgccctttgtgtttgtgggcaccaaggacagcatcgccaatgccaccgtgctgctggactaccacctgaactacctgaaggaggtggaccagctgcggctggagcggctgcagattgatgagcagctgcggcagattggagccagcagccggcccccacccaacagaacagacaaggagaagagctatgtgacagatgatggccagggcatgggccggggcagccggccctacagaaacagaggccacggccggcggggccctggctacaccagcggcaccaacagcgaggccagcaatgccagcgagacagaaagtgaccacagagatgagctgagtgactggagcctggcccccacagaggaggagcgggagagcttcctgcggagaggagatggaagaagaagaggaggcggcggccggggccagggcggccggggccggggcggcggcttcaagggaaatgatgaccacagcaggacagacaaccggcccaggaacccccgggaggccaagggccgcaccacagatggcagcctgcagatccgggtggactgcaacaatgaaagatctgtgcacaccaagaccctgcagaacaccagcagcgagggcagccggctgaggacaggcaaggacaggaaccagaagaaggagaagccagattctgtggatggccagcagcccctggtgaatggagtgccctag

SEQ ID NO: 164610 - DNA, 513 bp, Artificial Sequence
  Description of Artificial Sequence: Synthetic coding sequence
atgcccctgcctgtggccctgcagacccggctggccaagaggggcatcctgaagcacctggagcctgagcctgaggaggagatcatcgcagaagattatgatgatgatcctgtggactatgaggccacccggctggagggcctgcccccatcctggtacaaggtgtttgaccccagctgtggcctgccctactactggaatgctgacacagacctggtgtcctggctgagcccccatgaccccaacagcgtggtgaccaagagcgccaagaagctgcggagcagcaatgctgctgtgtccaggaaggatgaggagctggaccccatggaccccagcagctacagtgatgccccccggggcacctggagcacaggcctgcccaagagaaatgaggccaagacaggagctgacaccacagctgctggccccctcttccagcagaggccctaccccagccctggagctgtgctgcgggccaatgctgaggccagcaggaccaagcagcaggactag

SEQ ID NO: 164611 - DNA, 204 bp, Artificial Sequence
  Description of Artificial Sequence: Synthetic coding sequence
atgcccctgcctgtggccctgcagacccggctggccaagaggggcatcctgaagcacctggagcctgagcctgaggaggagatcatcgcagaagattatgatgatgatcctgtggactatgaggccacccggctggagggcctgcccccatcctggtacaaggtgtttgaccccagctgccccggctggagcgccatggtgtag

SEQ ID NO: 164612 - DNA, 798 bp, Artificial Sequence
  Description of Artificial Sequence: Synthetic coding sequence
atgcccctgcctgtggccctgcagacccggctggccaagaggggcatcctgaagcacctggagcctgagcctgaggaggagatcatcgcagaagattatgatgatgatcctgtggactatgaggccacccggctggagggcctgcccccatcctggtacaaggtgtttgaccccagctgtggcctgccctactactggaatgctgacacagacctggtgtcctggctgagcccccatgaccccaacagcgtggtgaccaagagcgccaagaagctgcggagcagcaatgctgatgctgaggagaagctggacaggagccatgacaagagtgaccggggccatgacaagagtgacaggagccatgagaagctggaccggggccatgacaagagtgaccggggccatgacaagagtgaccgggaccgggagcggggctatgacaaggtggaccgggagcgggagcgggaccgggagcgggaccgggaccggggctatgacaaggctgaccgggaggagggcaaggagcggcggcaccaccggcgggaggagctggccccctaccccaagagcaagaaggctgtgtccaggaaggatgaggagctggaccccatggaccccagcagctacagtgatgccccccggggcacctggagcacaggcctgcccaagagaaatgaggccaagacaggagctgacaccacagctgctggccccctcttccagcagaggccctaccccagccctggagctgtgctgcgggccaatgctgaggccagcaggaccaagcagcaggactag

SEQ ID NO: 164613 - DNA, 513 bp, Artificial Sequence; identical to SEQ ID NO: 164610
  Description of Artificial Sequence: Synthetic coding sequence

SEQ ID NO: 164614 - DNA, 798 bp, Artificial Sequence; identical to SEQ ID NO: 164612
  Description of Artificial Sequence: Synthetic coding sequence

SEQ ID NO: 164615 - DNA, 642 bp, Artificial Sequence
  Description of Artificial Sequence: Synthetic coding sequence
atgcccctgcctgtggccctgcagacccggctggccaagaggggcatcctgaagcacctggagcctgagcctgaggaggagatcatcgcagaagattatgatgatgatcctgtggactatgaggccacccggctggagggcctgcccccatcctggtacaaggtgtttgaccccagctgtggcctgccctactactggaatgctgacacagacctggtgtcctggctgagcccccatgaccccaacagcgtggtgaccaagagcgccaagaagctgcggagcagcaatgctgatgctgaggagaagctggacaggagccatgacaagagtgaccggggccatgacaagagtgacaggagccatgagaagctggaccggggccatgacaagagtgaccggggccatgacaagagtgaccgggaccgggagcggggctatgacaaggtggaccgggagcgggagcgggaccgggagcgggaccgggaccggggctatgacaaggctgaccgggaggagggcaaggagcggcggcaccaccggcgggaggagctggccccctaccccaagagcaagaaggctgtgtccaggaaggatgaggagctggaccccatggaccccagcagctacagtgatgccccctag

SEQ ID NO: 164616 - DNA, 798 bp, Artificial Sequence; identical to SEQ ID NO: 164612
  Description of Artificial Sequence: Synthetic coding sequence

SEQ ID NO: 164617 - DNA, 453 bp, Artificial Sequence
  Description of Artificial Sequence: Synthetic coding sequence
tgaattgccacctacctgctgcacctgctggtgcagcctgaggaggagatcatcgccgaggactatgatgatgatcctgtggactatgaggccacccggctggagggcctgccccccagctggtacaaggtgtttgaccccagctgtggcctgccctactactggaatgctgacacagacctggtgtcctggctgagcccccatgaccccaacagcgtggtgaccaagagcgccaagaagctgcggagcagcaatgctgctgtgtccaggaaggatgaggagctggaccccatggaccccagcagctacagtgatgccccccggggcacctggagcacaggcctgcccaagagaaatgaggccaagacaggagctgacaccacagctgctggccccctcttccagcagaggccctaccccagccctggagctgtgctgcgggccaatgcctag

SEQ ID NO: 164618 - DNA, 699 bp, Artificial Sequence
  Description of Artificial Sequence: Synthetic coding sequence
atgggctctgtgctgagcacagattctgggaagagcgccccagccagcgccacagcccgggccctggagaggagaagagatcctgagctgcctgtgaccagctttgactgtgctgtgtgcctggaggtgctgcaccagcctgtgaggacccgctgtggccacgtgttctgccgcagctgcatcgccaccagcctgaagaacaacaagtggacctgcccctactgccgggcctacctgcccagcgagggcgtgcctgccacagatgtggccaagaggatgaagtctgagtacaagaactgtgccgagtgtgacaccctggtgtgcctgtctgagatgagggcccacatccgcacctgccagaagtacatcgacaagtatggccccctgcaggagctggaggagacagctgcccgctgtgtgtgccccttctgccagcgggagctgtatgaggacagcctgctggaccactgcatcacccaccacagaagtgaaagaagacctgtgttctgccccctgtgccgcctcatcccagatgagaaccccagcagcttcagcggcagcctcatccgccacctgcaggtgagccacaccctcttctatgatgacttcatcgacttcaacatcatcgaggaggccctgatcagaagagtgctggacaggagcctgctggagtatgtgaaccacagcaacaccacctag

SEQ ID NO: 164619 - DNA, 1986 bp, Artificial Sequence
  Description of Artificial Sequence: Synthetic coding sequence
atggagaagctgggcgtggagcctgaggaggagggcggcggagatgatgatgaagaagatgctgaggcctgggccatggagctggctgatgtgggcgccgccgccagcagccagggcgtgcatgaccaggtgctgcccaccccaaatgccagcagccgggtgattgtgcacgtggacctggactgcttctacgcccaggtggagatgatcagcaaccctgagctgaaggacaagcccctgggcgtgcagcagaagtacctggtggtgacctgcaactatgaggccaggaagctgggcgtgaagaagctgatgaatgtgagagatgccaaggagaagtgcccccagctggtgctggtgaatggagaggacctgacccgctaccgggagatgagctacaaggtgacagagctgctggaggagttcagccctgtggtggagcggctgggctttgatgagaactttgtggacctgacagagatggtggagaagaggctgcagcagctgcagagtgatgagctgtctgctgtgacagtgtctggccacgtgtacaacaaccagtgcatcggctacaagacagccaagtgcctggaggccctgggcatcaacagcgtgcgggacctgcagaccttcagccccaagatcctggagaaggagctgggcatctctgtggcccagaggatccagaagctgagctttggagaggacaacagccctgtgatcctgagcggccccccccagagcttctctgaagaagattccttcaagaagtgcagcagcgaggtggaggccaagaacaagattgaggagctgctggccagcctgctgaacagagtgtgccaggacggcaggaagccccacacagtgcggctcatcatccgccgctacagcagcgagaagcactacggccgggagagccggcagtgccccatccccagccacgtgatccagaagctgggcaccggcaactatgatgtgatgacccccatggtggacatcctgatgaagctgttcaggaacatggtgaatgtgaagatgcccttccacctgaccctgctgtctgtgtgcttctgcaacctgaaggccctgaacacagccaagaagggcctgattgactactacctgatgcccagcctgagcaccaccagccgcagcggcaagcacagcttcaagatgaaggacacccacatggaggacttccccaaggacaaggagaccaacagagacttcctgcccagcggcagaattgagagcaccaggacccgggagagccccctggacaccaccaacttcagcaaggagaaggacatcaatgagttccccctgtgcagcctgcctgagggcgtggaccaggaggtgttcaagcagctgcctgtggacatccaggaggagatcctgagcggcaagagccgggagaagttccagggcaagggctctgtgtcctgccccctgcacgccagccggggcgtgctgtccttcttcagcaagaagcagatgcaggacatccccatcaacccccgggaccacctgagcagcagcaagcaggtgtcctctgtgagcccctgtgagcccggcaccagcggcttcaacagcagcagcagcagctacatgagcagccagaaggactacagctactacctggacaaccggctgaaggatgagcgcatcagccagggccccaaggagccccagggcttccacttcaccaacagcaacccagctgtgtctgccttccacagcttccccaacctgcagagcgagcagctgttcagcaggaaccacaccacagacagccacaagcagacagtggccacagacagccatgagggcctgacagagaaccgggagccagacagcgtggatgagaagatcaccttccccagcgacatcgacccccaggtgttctatgagctgcctgaggccgtgcagaaggagctgctggccgagtggaagagagctggcagtgacttccacatcggccacaagtag

SEQ ID NO: 164620 - DNA, 2223 bp, Artificial Sequence; identical to SEQ ID NO: 161194
  Description of Artificial Sequence: Synthetic coding sequence

SEQ ID NO: 164621 - DNA, 2613 bp, Artificial Sequence
  Description of Artificial Sequence: Synthetic coding sequence
atggacagcaccaaggagaagtgtgacagctacaaggatgacctgctgctgaggatgggcctgaatgacaacaaggccggcatggagggcctggacaaggagaagatcaacaagatcatcatggaggccaccaagggcagccgcttctatggaaatgagctgaagaaggagaagcaggtgaaccagagaattgagaacatgatgcagcagaaggcccagatcaccagccagcagctgaggaaggcccagctgcaggtggacagatttgccatggagctggagcagagcaggaacctgagcaacaccatcgtgcacatcgacatggatgccttctatgctgctgtggagatgagggacaaccctgagctgaaggacaagcccatcgctgtgggctccatgtccatgctgagcaccagcaactaccacgcccggcgcttcggcgtgcgggccgccatgcctggcttcatcgccaagaggctgtgcccccagctgatcatcgtgccccccaactttgacaagtacagagctgtgtccaaggaggtgaaggagatcctggccgactatgaccccaacttcatggccatgagcctggatgaggcctacctgaacatcaccaagcacctggaggagcggcagaactggccagaggacaagaggcgctacttcatcaagatgggcagctctgtggagaatgacaaccctgggaaggaggtgaacaagctgtctgagcacgagaggagcatcagccccctgctgtttgaggagagccccagtgatgtgcagcccccaggggaccccttccaggtgaactttgaggagcagaacaacccccagatcctgcagaacagcgtggtgtttggcaccagcgcccaggaggtggtgaaggagatccgcttcagaattgagcagaagaccaccctgacagccagcgctggcatcgcccccaacaccatgctggccaaggtgtgcagcgacaagaacaagcccaacggccagtaccagatcctgcccaaccggcaggccgtgatggacttcatcaaggacctgcccatcaggaaggtgtctggaattggcaaggtgacagagaagatgctgaaggccctgggcatcatcacctgcacagagctgtaccagcagagggccctgctgagcctgctcttcagcgagacctcctggcactacttcctgcacatcagcctgggcctgggcagcacccacctgaccagagatggagagaggaagtccatgtctgtggagaggaccttcagcgagatcaacaaggccgaggagcagtacagcctgtgccaggagctgtgcagcgagctggcccaggacctgcagaaggagcggctgaagggccgcacagtgaccatcaagctgaagaatgtgaactttgaggtgaagacccgggccagcacagtgtcctctgtggtgtccacagctgaggagatctttgccatcgccaaggagctgctgaagacagaaattgatgctgacttcccccaccccctgcggctgcggctgatgggcgtgcgcatcagcagcttccccaatgaggaggacaggaagcaccagcagaggagcatcatcggcttcctgcaggccggcaaccaggccctgagcgccacagagtgcaccctggagaagacagacaaggacaagtttgtgaagcccctggagatgagccacaagaagagcttctttgacaagaagaggtctgagaggaagtggagccaccaggacaccttcaagtgtgaggccgtgaacaagcagagcttccagaccagccagcccttccaggtgctgaagaagaagatgaatgaaaacctggagatcagcgagaacagtgatgactgccagatcctgacctgccctgtgtgcttccgggcccagggctgcatcagcctggaggccctgaacaagcacgtggatgaatgtctggatggccccagcatcagcgagaacttcaagatgttcagctgcagccacgtgtctgccaccaaggtgaacaagaaggaaaatgtgcctgccagcagcctgtgtgagaagcaggactatgaggcccaccccaagatcaaggagatcagctctgtggactgcatcgccctggtggacaccatcgacaacagcagcaaggccgagagcattgatgccctgagcaacaagcacagcaaggaggagtgcagcagcctgcccagcaagagcttcaacatcgagcactgccaccagaacagcagcagcacagtgtccctggagaatgaagatgtgggcagcttccggcaggagtaccggcagccctacctgtgtgaggtgaagacaggccaggccctggtgtgccctgtgtgcaatgtggagcagaagaccagtgacctgaccctcttcaacgtgcacgtggatgtgtgcctgaacaagagcttcatccaggagctgaggaaggacaagttcaaccctgtgaaccagcccaaggagagcagccgcagcacaggcagcagcagcggcgtgcagaaggctgtgaccaggaccaagaggcctggcctgatgaccaagtacagcaccagcaagaagatcaagcccaacaaccccaagcacaccctggacatcttcttcaagtag

SEQ ID NO: 164622 - DNA, 2019 bp, Artificial Sequence
  Description of Artificial Sequence: Synthetic coding sequence
atggacagcaccaaggagaagtgtgacagctacaaggatgacctgctgctgaggatgggcctgaatgacaacaaggccggcatggagggcctggacaaggagaagatcaacaagatcatcatggaggccaccaagggcagccgcttctatggaaatgagctgaagaaggagaagcaggtgaaccagagaattgagaacatgatgcagcagaaggcccagatcaccagccagcagctgaggaaggcccagctgcaggtggacagatttgccatggagctggagcagagcaggaacctgagcaacaccatcgtgcacatcgacatggatgccttctatgctgctgtggagatgagggacaaccctgagctgaaggacaagcccatcgctgtgggctccatgtccatgctgagcaccagcaactaccacgcccggcgcttcggcgtgcgggccgccatgcctggcttcatcgccaagaggctgtgcccccagctgatcatcgtgccccccaactttgacaagtacagagctgtgtccaaggaggtgaaggagatcctggccgactatgaccccaacttcatggccatgagcctggatgaggcctacctgaacatcaccaagcacctggaggagcggcagaactggccagaggacaagaggcgctacttcatcaagatgggcagctctgtggagaatgacaaccctgggaaggaggtgaacaagctgtctgagcacgagaggagcatcagccccctgctgtttgaggagagccccagtgatgtgcagcccccaggggaccccttccaggtgaactttgaggagcagaacaacccccagatcctgcagaacagcgtggtgtttggcaccagcgcccaggaggtggtgaaggagatccgcttcagaattgagcagaagaccaccctgacagccagcgctggggtgcgcatcagcagcttccccaatgaggaggacaggaagcaccagcagaggagcatcatcggcttcctgcaggccggcaaccaggccctgagcgccacagagtgcaccctggagaagacagacaaggacaagtttgtgaagcccctggagatgagccacaagaagagcttctttgacaagaagaggtctgagaggaagtggagccaccaggacaccttcaagtgtgaggccgtgaacaagcagagcttccagaccagccagcccttccaggtgctgaagaagaagatgaatgaaaacctggagatcagcgagaacagtgatgactgccagatcctgacctgccctgtgtgcttccgggcccagggctgcatcagcctggaggccctgaacaagcacgtggatgaatgtctggatggccccagcatcagcgagaacttcaagatgttcagctgcagccacgtgtctgccaccaaggtgaacaagaaggaaaatgtgcctgccagcagcctgtgtgagaagcaggactatgaggcccaccccaagatcaaggagatcagctctgtggactgcatcgccctggtggacaccatcgacaacagcagcaaggccgagagcattgatgccctgagcaacaagcacagcaaggaggagtgcagcagcctgcccagcaagagcttcaacatcgagcactgccaccagaacagcagcagcacagtgtccctggagaatgaagatgtgggcagcttccggcaggagtaccggcagccctacctgtgtgaggtgaagacaggccaggccctggtgtgccctgtgtgcaatgtggagcagaagaccagtgacctgaccctcttcaacgtgcacgtggatgtgtgcctgaacaagagcttcatccaggagctgaggaaggacaagttcaaccctgtgaaccagcccaaggagagcagccgcagcacaggcagcagcagcggcgtgcagaaggctgtgaccaggaccaagaggcctggcctgatgaccaagtacagcaccagcaagaagatcaagcccaacaaccccaagcacaccctggacatcttcttcaagtag

SEQ ID NO: 164623 - DNA, 2343 bp, Artificial Sequence
  Description of Artificial Sequence: Synthetic coding sequence
atggagctggagcagagcaggaacctgagcaacaccatcgtgcacatcgacatggatgccttctatgctgctgtggagatgagggacaaccctgagctgaaggacaagcccatcgctgtgggctccatgtccatgctgagcaccagcaactaccacgcccggcgcttcggcgtgcgggccgccatgcctggcttcatcgccaagaggctgtgcccccagctgatcatcgtgccccccaactttgacaagtacagagctgtgtccaaggaggtgaaggagatcctggccgactatgaccccaacttcatggccatgagcctggatgaggcctacctgaacatcaccaagcacctggaggagcggcagaactggccagaggacaagaggcgctacttcatcaagatgggcagctctgtggagaatgacaaccctgggaaggaggtgaacaagctgtctgagcacgagaggagcatcagccccctgctgtttgaggagagccccagtgatgtgcagcccccaggggaccccttccaggtgaactttgaggagcagaacaacccccagatcctgcagaacagcgtggtgtttggcaccagcgcccaggaggtggtgaaggagatccgcttcagaattgagcagaagaccaccctgacagccagcgctggcatcgcccccaacaccatgctggccaaggtgtgcagcgacaagaacaagcccaacggccagtaccagatcctgcccaaccggcaggccgtgatggacttcatcaaggacctgcccatcaggaaggtgtctggaattggcaaggtgacagagaagatgctgaaggccctgggcatcatcacctgcacagagctgtaccagcagagggccctgctgagcctgctcttcagcgagacctcctggcactacttcctgcacatcagcctgggcctgggcagcacccacctgaccagagatggagagaggaagtccatgtctgtggagaggaccttcagcgagatcaacaaggccgaggagcagtacagcctgtgccaggagctgtgcagcgagctggcccaggacctgcagaaggagcggctgaagggccgcacagtgaccatcaagctgaagaatgtgaactttgaggtgaagacccgggccagcacagtgtcctctgtggtgtccacagctgaggagatctttgccatcgccaaggagctgctgaagacagaaattgatgctgacttcccccaccccctgcggctgcggctgatgggcgtgcgcatcagcagcttccccaatgaggaggacaggaagcaccagcagaggagcatcatcggcttcctgcaggccggcaaccaggccctgagcgccacagagtgcaccctggagaagacagacaaggacaagtttgtgaagcccctggagatgagccacaagaagagcttctttgacaagaagaggtctgagaggaagtggagccaccaggacaccttcaagtgtgaggccgtgaacaagcagagcttccagaccagccagcccttccaggtgctgaagaagaagatgaatgaaaacctggagatcagcgagaacagtgatgactgccagatcctgacctgccctgtgtgcttccgggcccagggctgcatcagcctggaggccctgaacaagcacgtggatgaatgtctggatggccccagcatcagcgagaacttcaagatgttcagctgcagccacgtgtctgccaccaaggtgaacaagaaggaaaatgtgcctgccagcagcctgtgtgagaagcaggactatgaggcccaccccaagatcaaggagatcagctctgtggactgcatcgccctggtggacaccatcgacaacagcagcaaggccgagagcattgatgccctgagcaacaagcacagcaaggaggagtgcagcagcctgcccagcaagagcttcaacatcgagcactgccaccagaacagcagcagcacagtgtccctggagaatgaagatgtgggcagcttccggcaggagtaccggcagccctacctgtgtgaggtgaagacaggccaggccctggtgtgccctgtgtgcaatgtggagcagaagaccagtgacctgaccctcttcaacgtgcacgtggatgtgtgcctgaacaagagcttcatccaggagctgaggaaggacaagttcaaccctgtgaaccagcccaaggagagcagccgcagcacaggcagcagcagcggcgtgcagaaggctgtgaccaggaccaagaggcctggcctgatgaccaagtacagcaccagcaagaagatcaagcccaacaaccccaagcacaccctggacatcttcttcaagtag

SEQ ID NO: 164624 - DNA, 1386 bp, Artificial Sequence
  Description of Artificial Sequence: Synthetic coding sequence
atggacagcaccaaggagaagtgtgacagctacaaggatgacctgctgctgaggatgggcctgaatgacaacaaggccggcatggagggcctggacaaggagaagatcaacaagatcatcatggaggccaccaagggcagccgcttctatggaaatgagctgaagaaggagaagcaggtgaaccagagaattgagaacatgatgcagcagaaggcccagatcaccagccagcagctgaggaaggcccagctgcaggtggacagatttgccatggagctggagcagagcaggaacctgagcaacaccatcgtgcacatcgacatggatgccttctatgctgctgtggagatgagggacaaccctgagctgaaggacaagcccatcgctgtgggctccatgtccatgctgagcaccagcaactaccacgcccggcgcttcggcgtgcgggccgccatgcctggcttcatcgccaagaggctgtgcccccagctgatcatcgtgccccccaactttgacaagtacagagctgtgtccaaggaggtgaaggagatcctggccgactatgaccccaacttcatggccatgagcctggatgaggcctacctgaacatcaccaagcacctggaggagcggcagaactggccagaggacaagaggcgctacttcatcaagatgggcagctctgtggagaatgacaaccctgggaaggaggtgaacaagctgtctgagcacgagaggagcatcagccccctgctgtttgaggagagccccagtgatgtgcagcccccaggggaccccttccaggtgaactttgaggagcagaacaacccccagatcctgcagaacagcgtggtgtttggcaccagcgcccaggaggtggtgaaggagatccgcttcagaattgagcagaagaccaccctgacagccagcgctggcatcgcccccaacaccatgctggccaaggtgtgcagcgacaagaacaagcccaacggccagtaccagatcctgcccaaccggcaggccgtgatggacttcatcaaggacctgcccatcaggaaggtgtctggaattggcaaggtgacagagaagatgctgaaggccctgggcatcatcacctgcacagagctgtaccagcagagggccctgctgagcctgctcttcagcgagacctcctggcactacttcctgcacatcagcctgggcctgggcagcacccacctgaccagagatggagagaggaagtccatgtctgtggagaggaccttcagcgagatcaacaaggccgaggagcagtacagcctgtgccaggagctgtgcagcgagctggcccaggacctgcagaaggagcggctgaaggtggcccaggtggagtacagaaggctgtag

SEQ ID NO: 164625 - DNA, 2019 bp, Artificial Sequence; identical to SEQ ID NO: 164622
  Description of Artificial Sequence: Synthetic coding sequence

SEQ ID NO: 164626 - DNA, 1470 bp, Artificial Sequence
  Description of Artificial Sequence: Synthetic coding sequence
atggacagcaccaaggagaagtgtgacagctacaaggatgacctgctgctgaggatgggcctgaatgacaacaaggccggcatggagggcctggacaaggagaagatcaacaagatcatcatggaggccaccaagggcagccgcttctatggaaatgagctgaagaaggagaagcaggtgaaccagagaattgagaacatgatgcagcagaaggcccagatcaccagccagcagctgaggaaggcccagctgcaggtggacagatttgccatggagctggagcagagcaggaacctgagcaacaccatcgtgcacatcgacatggatgccttctatgctgctgtggagatgagggacaaccctgagctgaaggacaagcccatcgctgtgggctccatgtccatgctgagcaccagcaactaccacgcccggcgcttcggcgtgcgggccgccatgcctggcttcatcgccaagaggctgtgcccccagctgatcatcgtgccccccaactttgacaagtacagagctgtgtccaaggaggtgaaggagatcctggccgactatgaccccaacttcatggccatgagcctggatgaggcctacctgaacatcaccaagcacctggaggagcggcagaactggccagaggacaagaggcgctacttcatcaagatgggcagctctgtggagaatgacaaccctgggaaggaggtgaacaagctgtctgagcacgagaggagcatcagccccctgctgtttgaggagagccccagtgatgtgcagcccccaggggaccccttccaggtgaactttgaggagcagaacaacccccagatcctgcagaacagcgtggtgtttggcaccagcgcccaggaggtggtgaaggagatccgcttcagaattgagcagaagaccaccctgacagccagcgctggcatcgcccccaacaccatgctggccaaggtgtgcagcgacaagaacaagcccaacggccagtaccagatcctgcccaaccggcaggccgtgatggacttcatcaaggacctgcccatcaggaaggtgtctggaattggcaaggtgacagagaagatgctgaaggccctgggcatcatcacctgcacagagctgtaccagcagagggccctgctgagcctgctcttcagcgagacctcctggcactacttcctgcacatcagcctgggcctgggcagcacccacctgaccagagatggagagaggaagtccatgtctgtggagaggaccttcagcgagatcaacaaggccgaggagcagtacagcctgtgccaggagctgtgcagcgagctggcccaggacctgcagaaggagcggctgaaggtgtttggctacctggtgttccccatgaagaggacaggcaacaccaacaagggggccctgctggccttctaccgcctggagaccaagccctgccagcccctgtctgtgcactag

SEQ ID NO: 164627 - DNA, 426 bp, Artificial Sequence
  Description of Artificial Sequence: Synthetic coding sequence
atggacagcaccaaggagaagtgtgacagctacaaggatgacctgctgctgaggatgggcctgaatgacaacaaggccggcatggagggcctggacaaggagaagatcaacaagatcatcatggaggccaccaagggcagccgcttctatggaaatgagctgaagaaggagaagcaggtgaaccagagaattgagaacatgatgcagcagaaggcccagatcaccagccagcagctgaggaaggcccagctgcaggtggacagatttgccatggagctggagcagagcaggaacctgagcaacaccatcgtgcacatcgacatggatgccttctatgctgctgtggagatgagggacaaccctgagctgaaggacaagcccatcgctgtgggctccatgtccatgctgagcaccagcaactactag

SEQ ID NO: 164628 - DNA, 1419 bp, Artificial Sequence
  Description of Artificial Sequence: Synthetic coding sequence
atggacagcaccaaggagaagtgtgacagctacaaggatgacctgctgctgaggatgggcctgaatgacaacaaggccggcatggagggcctggacaaggagaagatcaacaagatcatcatggaggccaccaagggcagccgcttctatggaaatgagctgaagaaggagaagcaggtgaaccagagaattgagaacatgatgcagcagaaggcccagatcaccagccagcagctgaggaaggcccagctgcaggtggacagatttgccatggagctggagcagagcaggaacctgagcaacaccatcgtgcacatcgacatggatgccttctatgctgctgtggagatgagggacaaccctgagctgaaggacaagcccatcgctgtgggctccatgtccatgctgagcaccagcaactaccacgcccggcgcttcggcgtgcgggccgccatgcctggcttcatcgccaagaggctgtgcccccagctgatcatcgtgccccccaactttgacaagtacagagctgtgtccaaggaggtgaaggagatcctggccgactatgaccccaacttcatggccatgagcctggatgaggcctacctgaacatcaccaagcacctggaggagcggcagaactggccagaggacaagaggcgctacttcatcaagatgggcagctctgtggagaatgacaaccctgggaaggaggtgaacaagctgtctgagcacgagaggagcatcagccccctgctgtttgaggagagccccagtgatgtgcagcccccaggggaccccttccaggtgaactttgaggagcagaacaacccccagatcctgcagaacagcgtggtgtttggcaccagcgcccaggaggtggtgaaggagatccgcttcagaattgagcagaagaccaccctgacagccagcgctggcatcgcccccaacaccatgctggccaaggtgtgcagcgacaagaacaagcccaacggccagtaccagatcctgcccaaccggcaggccgtgatggacttcatcaaggacctgcccatcaggaaggtgtctggaattggcaaggtgacagagaagatgctgaaggccctgggcatcatcacctgcacagagctgtaccagcagagggccctgctgagcctgctcttcagcgagacctcctggcactacttcctgcacatcagcctgggcctgggcagcacccacctgaccagagatggagagaggaagtccatgtctgtggagaggaccttcagcgagatcaacaaggccgaggagcagtacagcctgtgccaggagctgtgcagcgagctggcccaggacctgcagaaggagcggctgaaggtgctgtactttgacatggtgtccctggtgttcaagttcttcaacagcaagatgctgccctag

SEQ ID NO: 164629 - DNA, 1911 bp, Artificial Sequence
  Description of Artificial Sequence: Synthetic coding sequence
atgaagtgcaagtgccctgtgatctgcttcaatgccaaggactttgtgcgcatcgtgctgcagttctttggaaatgatggctcctggaagcacgtggccgacttcatcggcctggaccccagaattgctgcctggctgattgaccccagtgatgccacccccagctttgaggacctggtggagaagtactgtgagaagagcatcaccgtgaaggtgaacagcacctacggcaacagcagcagaaatattgtgaaccagaatgtgcgggagaacctgaagaccctgtaccgcctgaccatggacctgtgcagcaagctgaaggactatggcctgtggcagctgttccgcaccctggagctgcccctcatccccatcctggccgtgatggagagccacgccatccaggtgaacaaggaggagatggagaagaccagcgccctgctgggcgcccggctgaaggagctggagcaggaggcccactttgtggccggggagcgcttcctgatcaccagcaacaaccagctgcgggagatcctgtttgggaagctgaagctgcacctgctgagccagaggaacagcctgcccaggacaggcctgcagaagtaccccagcaccagcgaggccgtgctgaatgccctgcgggacctgcaccccctgcccaagatcatcctggagtaccggcaggtgcacaagatcaagagcacctttgtggatggcctgctggcctgcatgaagaagggcagcatcagcagcacctggaaccagacaggcaccgtgacaggccgcctgagcgccaagcaccccaacatccagggcatcagcaagcaccccatccagatcaccacccccaagaacttcaagggcaaggaggacaagatcctgaccatcagcccccgggccatgtttgtgagcagcaagggccacaccttcctggccgctgacttcagccagatcgagctgcgcatcctgacccacctgagcggggaccctgagctgctgaagctgttccaggagagcgagagagatgatgtgttcagcaccctgaccagccagtggaaggatgtgcctgtggagcaggtgacccatgctgaccgggagcagaccaagaaggtggtgtatgctgtggtgtatggagctgggaaggagcggctggccgcctgcctgggcgtgcccatccaggaggccgcccagttcctggagagcttcctgcagaagtacaagaagatcaaggactttgcccgggccgccatcgcccagtgccaccagacaggctgtgtggtgtccatcatgggcagaagaagacccctgccccgcatccacgcccatgaccagcagctgcgggcccaggccgagcggcaggccgtgaactttgtggtgcagggcagcgctgctgacctgtgcaagctggccatgattcatgtgttcaccgctgtggccgccagccacaccctgacagcccggctggtggcccagatccatgatgagctgctgtttgaggtggaggacccccagatcccagaatgtgccgccctggtgcggaggaccatggagagcctggagcaggtgcccctgaaggtgtccctgtctgctggccgctcctggggccacctggtgcccctgcaggaggcctggctgcggcaggcccacgtggccctgagcctgcctgccacagcctggctgcccctgggccccctgcctgcccccagcccccacccctgcatcttccggctgcactttgtgtgcagcccccggcagcagtgggaggagaggacaggcttccagcagagcatcgtgtggcccagccccaggagccctgccctgtatgcccctggccgcatcaaccccctgggcctgggctggccagccatcccctggagcaagtgcctgtgcaaggccctgctgatcctgtag

SEQ ID NO: 164630 - DNA, 936 bp, Artificial Sequence
  Description of Artificial Sequence: Synthetic coding sequence
atggctgtgggcagccaggactatggcctgtggcagctgttccgcaccctggagctgcccctcatccccatcctggccgtgatggagagccacgccatccaggtgaacaaggaggagatggagaagaccagcgccctgctgggcgcccggctgaaggagctggagcaggaggcccactttgtggccggggagcgcttcctgatcaccagcaacaaccagctgcgggagatcctgtttgggaagctgaagctgcacctgctgagccagaggaacagcctgcccaggacaggcctgcagaagtaccccagcaccagcgaggccgtgaacatccagggcatcagcaagcaccccatccagatcaccacccccaagaacttcaagggcaaggaggacaagatcctgaccatcagcccccgggccatgtttgtgagcagcaagggccacaccttcctggccgctgacttcagccagatcgagctgcgcatcctgacccacctgagcggggaccctgagctgctgaagctgttccaggagagcgagagagatgatgtgttcagcaccctgaccagccagtggaaggatgtgcctgtggagcaggtgacccatgctgaccgggagcagaccaagaaggtggtgtatgctgtggtgtatggagctgggaaggagcggctggccgcctgcctgggcgtgcccatccaggaggccgcccagttcctggagagcttcctgcagaagtacaagaagatcaaggactttgcccgggccgccatcgcccagtgccaccagacaggctgtgtggtgtccatcatgggcagaagaagacccctgccccgcatccacgcccatgaccagcagctgcgggcccaggccgagcggcaggccgtgaactttgtggtgcaggcccagagccagcacctgtgtgtggaggtgccctag

SEQ ID NO: 164631 - DNA, 2703 bp, Artificial Sequence
  Description of Artificial Sequence: Synthetic coding sequence
atggagaactatgaggccctggtgggctttgacctgtgcaacacccccctgagctctgtggcccagaagatcatgtctgccatgcacagcggggacctggtggacagcaagacctggggcaagagcacagagaccatggaggtgatcaacaagagctctgtgaagtacagcgtgcagctggaggacaggaagacccagagccctgagaagaaggacctgaagagcctgcggagccagaccagccggggcagcgccaagctgagcccccagagcttctctgtgcggctgacagaccagctgtctgctgaccagaagcagaagagcatcagcagcctgaccctgagcagctgcctgatcccccagtacaaccaggaggcctctgtgctgcagaagaagggccacaagaggaagcacttcctgatggagaacatcaacaatgaaaataaaggcagcatcaacctgaagaggaagcacatcacctacaacaacctgtctgagaagaccagcaagcagatggccctggaggaggacacagatgatgctgagggctacctgaacagcggcaacagcggggccctgaagaagcacttctgtgacatccgccacctggatgactgggccaagagccagctgattgagatgctgaagcaggccgccgccctggtgatcaccgtgatgtacacagatggcagcacccagctgggcgctgaccagacccctgtgtcctctgtgcggggcatcgtggtgctggtgaagaggcaggccgagggcggccacggctgcccagatgccccagcctgtggccctgtgctggagggctttgtgtctgatgacccctgcatctacatccagatcgagcacagcgccatctgggaccaggagcaggaggcccaccagcagtttgccagaaatgtgctcttccagaccatgaagtgcaagtgccctgtgatctgcttcaatgccaaggactttgtgagaattgtgctgcagttctttggaaatgatggctcctggaagcacgtggccgacttcatcggcctggaccccagaattgctgcctggctgattgaccccagtgatgccacccccagctttgaggacctggtggagaagtactgtgagaagagcatcaccgtgaaggtgaacagcacctacggcaacagcagcaggaacatcgtgaaccagaatgtgcgggagaacctgaagaccctgtaccgcctgaccatggacctgtgcagcaagctgaaggactatggcctgtggcagctgttccgcaccctggagctgcccctcatccccatcctggccgtgatggagagccacgccatccaggtgaacaaggaggagatggagaagaccagcgccctgctgggcgcccggctgaaggagctggagcaggaggcccactttgtggccggggagcgcttcctgatcaccagcaacaaccagctgcgggagatcctgtttgggaagctgaagctgcacctgctgagccagaggaacagcctgcccaggacaggcctgcagaagtaccccagcaccagcgaggccgtgctgaatgccctgcgggacctgcaccccctgcccaagatcatcctggagtaccggcaggtgcacaagatcaagagcacctttgtggatggcctgctggcctgcatgaagaagggcagcatcagcagcacctggaaccagacaggaacagtgacaggccgcctgagcgccaagcaccccaacatccagggcatcagcaagcaccccatccagatcaccacccccaagaacttcaagggcaaggaggacaagatcctgaccatcagcccccgggccatgtttgtgagcagcaagggccacaccttcctggccgctgacttcagccagatcgagctgcgcatcctgacccacctgagcggggaccctgagctgctgaagctgttccaggagagcgagagagatgatgtgttcagcaccctgaccagccagtggaaggatgtgcctgtggagcaggtgacccacgccgaccgggagcagaccaagaaggtggtgtatgctgtggtgtatggagctgggaaggagcggctggccgcctgcctgggcgtgcccatccaggaggccgcccagttcctggagagcttcctgcagaagtacaagaagatcaaggactttgcccgggccgccatcgcccagtgccaccagacaggctgtgtggtgtccatcatgggcagaagaagacccctgccccgcatccacgcccatgaccagcagctgcgggcccaggccgagcggcaggccgtgaactttgtggtgcagggcagcgctgctgacctgtgcaagctggccatgatccacgtgttcaccgctgtggccgccagccacaccctgacagcccggctggtggcccagatccatgatgagctgctgtttgaggtggaggacccccagatcccagaatgtgccgccctggtgcggaggaccatggagagcctggagcaggtgcaggccctggagctgcagctgcaggtgcccctgaaggtgtccctgtctgctggccgctcctggggccacctggtgcccctgcaggaggcctggggccccccacctggcccctgcaggacagagagccccagcaacagcctggccgcccctggcagccctgccagcacccagcccccacccctgcacttcagccccagcttctgcctgtag

SEQ ID NO: 164632 - DNA, 2703 bp, Artificial Sequence; identical to SEQ ID NO: 164631
  Description of Artificial Sequence: Synthetic coding sequence

SEQ ID NO: 164633 - DNA, 3033 bp, Artificial Sequence
  Description of Artificial Sequence: Synthetic coding sequence
aggatggatggcaagaggcggcccggccctggccctggggtgccccccaagagggcccggggcggcctgtgggatgatgatgatgccccccggcccagccagtttgaggaggacctggccctgatggaggagatggaggccgagcaccggctgcaggagcaggaggaggaggagctgcagagcgtgctggagggcgtggctgatggccaggtgccccccagcgccatcgacccccgctggctgcggcccaccccaccagccctggacccccagacagagcccctcatcttccagcagctggagattgaccactacgtgggccctgcccagcctgtgcctgggggccccccacccagccggggctctgtgcctgtgctgcgggcctttggagtgacagatgagggcttctctgtgtgctgccacatccacggctttgccccctacttctacaccccagcccctcctggctttggacctgagcacatgggagacctgcagcgggagctgaacctggccatcagccgggacagcagaggaggccgggagctgaccggccctgctgtgctggccgtggagctgtgcagccgggagagcatgtttggctaccacggccacggccccagccccttcctgcgcatcaccgtggccctgccccggctggtggccccagcccggcggctgctggagcagggcatccgggtggccggcctgggcacccccagctttgccccctatgaggccaacgtggactttgagatccgcttcatggtggacacagacatcgtgggctgcaactggctggagctgcctgctgggaagtatgccctgcggctgaaggagaaggccacccagtgccagctggaggctgatgtgctgtggagcgatgtggtgagccaccccccagagggcccctggcagagaattgcccccctgcgggtgctgagctttgatattgaatgtgccggcaggaagggcatcttccctgagcctgagcgggaccccgtcatccagatctgcagcctgggcctgcgctggggcgagcctgagcccttcctgcggctggccctgaccctgcggccctgtgcccccatcctgggcgccaaggtgcagagctatgagaaggaggaggacctgctgcaggcctggagcaccttcatccgcatcatggaccctgatgtgatcaccggctacaacatccagaactttgacctgccctacctgatcagccgggcccagaccctgaaggtgcagaccttccccttcctgggccgggtggccggcctgtgcagcaacatccgggacagcagcttccagagcaagcagacaggccggcgggacaccaaggtggtgtccatggtgggccgggtgcagatggacatgctgcaggtgctgctgcgggagtacaagctgcggagctacaccctgaatgctgtgtccttccacttcctgggggagcagaaggaggatgtgcagcacagcatcatcacagacctgcagaatggaaatgaccagacccggcggcggctggccgtgtactgcctgaaggatgcctacctgcccctgcggctgctggagcggctgatggtgctggtgaatgctgtggagatggcccgggtgactggagtgcccctgagctacctgctgagccggggccagcaggtgaaggtggtgtcccagctgctgcggcaggccatgcatgagggcctgctgatgcctgtggtgaagtctgagggcggggaggactacacaggagccaccgtcatcgagcccctgaagggctactatgatgtgcccatcgccaccctggacttcagcagcctgtaccccagcatcatgatggcccacaacctgtgctacaccaccctgctgcggcctggaacagcccagaagctgggcctgacagaggaccagttcatccgcacccccactggagatgaatttgtgaagacctctgtgaggaagggcctgctgccccagatcctggagaacctgctgagcgccaggaagagggccaaggccgagctggccaaggagacagaccccctgcggcggcaggtgctggatggccggcagctggccctgaaggtgtctgccaacagcgtgtatggcttcaccggggcccaggtgggcaagctgccctgcctggagatcagccagagcgtgacaggcttcggccggcagatgattgagaagaccaagcagctggtggagagcaagtacacagtggagaatggctacagcaccagcgccaaggtggtgtatggagacacagattctgtgatgtgccgcttcggcgtgtcctctgtggccgaggccatggccctgggccgggaggccgctgactgggtgtctggccacttccccagccccatccggctggagtttgagaaggtgtacttcccctacctgctgatcagcaagaagagatatgccggcctgctcttcagcagcaggccagatgcccatgacaggatggactgcaagggcctggaggccgtgcggcgggacaactgccccctggtggccaacctggtgacagccagcctgcggcggctgctgattgaccgggaccctgagggcgctgtggcccacgcccaggatgtgatcagtgacctgctgtgcaacagaattgacatcagccagctggtgatcaccaaggagctgaccagggctgccagtgactatgctgggaagcaggcccacgtggagctggccgagaggacccgctgcagctgctggagcacagcctgccccctgaccaggagcaccacctggagcagctcctggcccagccccagctgtgccagcagcagccccagctgggcccgggctgtgccccggctgtgctactgcggcggcaccaccagggctgcccggcgctgcagccgggcccgctgggccgcctcctggcccagccccaatgctgccacagctgccctggccgccgcccagtgcagcgccacccgggagccctgtgtgtcctctgccagccctggcagcctgagctgcatcagaagacgctaccccatctag

SEQ ID NO: 164634 - DNA, 3324 bp, Artificial Sequence
  Description of Artificial Sequence: Synthetic coding sequence
atggatggcaagagaagacctggccctggccctggggtgccccccaagagggcccggggcggcctgtgggatgatgatgatgccccccggcccagccagtttgaggaggacctggccctgatggaggagatggaggccgagcaccggctgcaggagcaggaggaggaggagctgcagagcgtgctggagggcgtggctgatggccaggtgcccccatctgccatcgacccccgctggctgcggcccaccccaccagccctggacccccagacagagcccctcatcttccagcagctggagattgaccactacgtgggccctgcccagcctgtgcctgggggccccccacccagccggggctctgtgcctgtgctgcgggccttcggcgtgacagatgagggcttctctgtgtgctgccacatccacggctttgccccctacttctacaccccagcccctcctggcttcggccctgagcacatgggagacctgcagcgggagctgaacctggccatcagccgggacagccggggcggccgggagctgactggacctgctgtgctggccgtggagctgtgcagccgggagagcatgtttggctaccacggccacggccccagccccttcctgcgcatcaccgtggccctgccccggctggtggccccagcccggcggctgctggagcagggcatccgggtggccggcctgggcacccccagctttgccccctatgaggccaacgtggactttgagatccgcttcatggtggacacagacatcgtgggctgcaactggctggagctgcctgctgggaagtatgccctgcggctgaaggagaaggccacccagtgccagctggaggctgatgtgctgtggagcgatgtggtgagccaccccccagagggcccctggcagagaattgcccccctgcgggtgctgagctttgatattgaatgtgccggcaggaagggcatcttccctgagcctgagcgggaccctgtgatccagatctgcagcctgggcctgcgctggggcgagcctgagcccttcctgcggctggccctgaccctgcggccctgtgcccccatcctgggcgccaaggtgcagagctatgagaaggaggaggacctgctgcaggcctggagcaccttcatccgcatcatggaccctgatgtgatcaccggctacaacatccagaactttgacctgccctacctgatcagccgggcccagaccctgaaggtgcagaccttccccttcctgggccgggtggccggcctgtgcagcaacatccgggacagcagcttccagagcaagcagacaggaagaagagacaccaaggtggtgtccatggtgggccgggtgcagatggacatgctgcaggtgctgctgcgggagtacaagctgcggagctacaccctgaatgctgtgtccttccacttcctgggggagcagaaggaggatgtgcagcacagcatcatcacagacctgcagaatggaaatgaccagacccggcggcggctggccgtgtactgcctgaaggatgcctacctgcccctgcggctgctggagcggctgatggtgctggtgaatgctgtggagatggcccgggtgactggagtgcccctgagctacctgctgagccggggccagcaggtgaaggtggtgtcccagctgctgcggcaggccatgcatgagggcctgctgatgcctgtggtgaagtctgagggcggggaggactacaccggggccaccgtgattgagcccctgaagggctactatgatgtgcccatcgccaccctggacttcagcagcctgtaccccagcatcatgatggcccacaacctgtgctacaccaccctgctgcggcccggcacagcccagaagctgggcctgacagaggaccagttcatccgcacccccactggagatgaatttgtgaagacctctgtgaggaagggcctgctgccccagatcctggagaacctgctgagcgccaggaagagggccaaggccgagctggccaaggagacagaccccctgcggcggcaggtgctggatggccggcagctggccctgaaggtgtctgccaacagcgtgtatggcttcaccggggcccaggtgggcaagctgccctgcctggagatcagccagagcgtgactggatttggccggcagatgattgagaagaccaagcagctggtggagagcaagtacacagtggagaatggctacagcaccagcgccaaggtggtgtatggagacacagacagcgtgatgtgccgctttggagtgtcctctgtggccgaggccatggccctgggccgggaggccgctgactgggtgtctggccacttccccagccccatccggctggagtttgagaaggtgtacttcccctacctgctgatcagcaagaagagatatgccggcctgctcttcagcagcaggccagatgcccatgacaggatggactgcaagggcctggaggccgtgagaagagacaactgccccctggtggccaacctggtgacagccagcctgcggcggctgctgattgaccgggaccctgagggcgctgtggcccacgcccaggacgtcatcagtgacctgctgtgcaacagaattgacatcagccagctggtgatcaccaaggagctgacccgggccgccagtgactatgccggcaagcaggcccacgtggagctggccgagaggatgaggaagagggaccccggcagcgcccccagcctgggggacagagtgccctacgtgatcatctctgctgccaagggcgtggccgcctacatgaagtctgaggaccccctgtttgtgctggagcacagcctgcccatcgacacccagtactacctggagcagcagctggccaagcccctgctgcgcatctttgagcccatcctgggggagggccgggcagaggccgtgctgctgcggggggaccacacccgctgcaagacagtgctgaccgggaaggtgggcggcctgctggcctttgccaagagaagaaactgctgcatcggctgcaggacagtgctgagccaccagggcgctgtgtgtgagttctgccagccccgggagagcgagctgtaccagaaggaggtgagccacctgaatgccctggaggagcgcttcagccggctgtggacccagtgccagcgctgccagggcagcctgcatgaagatgtgatctgcaccagccgggactgccccatcttctacatgaggaagaaggtgaggaaggacctggaggaccaggagcagctgctgcggagatttggacctcctggccctgaggcctggtag

SEQ ID NO: 164635 - DNA, 1410 bp, Artificial Sequence
  Description of Artificial Sequence: Synthetic coding sequence
atgttttctgagcaggccgcccagagggcccacaccctgctgagcccccccagcgccaacaatgccacctttgcccgggtgcctgtggccacctacaccaacagcagccagcccttccggctgggggagaggagcttcagccggcagtatgcccacatctatgccaccaggctcatccagatgaggcccttcctggagaacagagcccagcagcactggggcagcggcgtgggcgtgaagaagctgtgtgagctgcagcctgaggagaagtgctgcgtggtgggcaccctcttcaaggccatgcccctgcagcccagcatcctgcgggaggtgtctgaggagcacaacctgctgccccagcccccaagaagcaagtacatccacccagatgatgagctggtgctggaggatgagctgcagaggatcaagctgaagggcaccattgatgtgtccaagctggtgactggaacagtgctggccgtgtttggatctgtgagagatgatggcaagttcctggtggaggactactgctttgctgacctggccccccagaagccagccccacccctggacacagacagatttgtgctgctggtgtctggcctgggcctgggcggcggcggcggggagagcctgctgggcacccagctgctggtggatgtggtgacaggccagctgggagatgaaggagagcagtgcagcgctgcccacgtgtccagggtcatcctggccggcaacctgctgagccacagcacccagagccgggacagcatcaacaaggccaagtacctgaccaagaagacccaggccgcctctgtggaggccgtgaagatgctggatgagatcctgctgcagctgagcgcctctgtgcctgtggatgtgatgcctggagaatttgaccccaccaactacaccctgccccagcagcccctgcacccctgcatgttccccctggccacagcctacagcaccctgcagctggtgaccaacccctaccaggccaccattgatggagtgcgcttcctgggcaccagcggccagaatgtgtctgacatcttccgctacagctccatggaggaccacctggagatcctggagtggaccctgcgggtgcgccacatcagccccacagccccagacaccctgggctgctaccccttctacaagacagaccccttcatcttcccagaatgtccccacgtgtacttctgtggcaacacccccagctttggcagcaagatcatccggggccctgaggaccagacagtgctgctggtgacagtgcctgacttcagcgccacccagacagcctgcctggtgaacctgcggagcctggcctgccagcccatctccttcagcggctttggagcagaagatgatgacctgggcggcctgggcctgggcccctag

SEQ ID NO: 164636 - DNA, 447 bp, Artificial Sequence
  Description of Artificial Sequence: Synthetic coding sequence
atgttttctgagcaggccgcccagagggcccacaccctgctgagcccccccagcgccaacaatgccacctttgcccgggtgcctgtggccacctacaccaacagcagccagcccttccggctgggggagaggagcttcagccggcagtatgcccacatctatgccaccaggctcatccagatgaggcccttcctggagaacagagcccagcagcactggggcagcggcgtgggcgtgaagaagctgtgtgagctgcagcctgaggagaagtgctgcgtggtgggcaccctcttcaaggccatgcccctgcagcccagcatcctgcgggaggtgtctgaggagcacaacctgctgccccagcccccaagaagcaagtacatccacccagatgatgagctggtgctggaggatgagctgcagaggatcaagctgaagggcaccatctag

SEQ ID NO: 164637 - DNA, 663 bp, Artificial Sequence
  Description of Artificial Sequence: Synthetic coding sequence
atgttttctgagcaggccgcccagagggcccacaccctgctgagcccccccagcgccaacaatgccacctttgcccgggtgcctgtggccacctacaccaacagcagccagcccttccggctgggggagaggagcttcagccggcagtatgcccacatctatgccaccaggctcatccagatgaggcccttcctggagaacagagcccagcagcactggggcagcggcgtgggcgtgaagaagctgtgtgagctgcagcctgaggagaagtgctgcgtggtgggcaccctcttcaaggccatgcccctgcagcccagcatcctgcgggaggtgtctgaggagcacaacctgctgccccagcccccaagaagcaagtacatccacccagatgatgagctggtgctggaggatgagctgcagaggatcaagctgaagggcaccattgatgtgtccaagctggtgactggaacagtgctggccgtgtttggatctgtgagagatgatggcaagttcctggtggaggactactgctttgctgacctggccccccagaagccagccccacccctggacacagacagatttgtgctgctggtgtctggcctgggcctgggcggcggcggcggggagagcctgctgggcacccagctgctggtggactag

SEQ ID NO: 164638 - DNA, 1410 bp, Artificial Sequence; identical to SEQ ID NO: 164635
  Description of Artificial Sequence: Synthetic coding sequence

SEQ ID NO: 164639 - DNA, 468 bp, Artificial Sequence
  Description of Artificial Sequence: Synthetic coding sequence
atgttttctgagcaggccgcccagagggcccacaccctgctgagcccccccagcgccaacaatgccacctttgcccgggtgcctgtggccacctacaccaacagcagccagcccttccggctgggggagaggagcttcagccggcagtatgcccacatctatgccaccaggctcatccagatgaggcccttcctggagaacagagcccagcagcactggggcagcggcgtgggcgtgaagaagctgtgtgagctgcagcctgaggagaagtgctgcgtggtgggcaccctcttcaaggccatgcccctgcagcccagcatcctgcgggaggtgtctgaggagcacaacctgctgccccagcccccaagaagcaagtacatccacccagatgatgagctggtgctggaggatgagctgcagaggatcaagctgaagggcaccattgatgtgtccaagctggtgacctag

SEQ ID NO: 164640 - DNA, 771 bp, Artificial Sequence
  Description of Artificial Sequence: Synthetic coding sequence
atgtttcctgtgctgcccggcagccacctgctgctgaacaacccagccctggagttcatcaagtatgtgtgcaaggtgctgagcctggacaccaacatcaccaaccaggtgaacaagctgaacagagacctgctgcggctggtggatgtgggggagttcagcgaggaggcccagttccgggacccctgccgctcctatgtgctgcctgaggtgatctgccgcagctgcaacttctgccgggacctggacctgtgcaaggacagcagcttctctgaagatggagctgtgctgccccagtggctgtgcagcaactgccaggccccctatgacagcagcgccatcgagatgaccctggtggaggtgctgcagaagaagctgatggccttcaccctgcaggacctgaaggaggccgacacccccaagtgtgaggagaaggagaggaggaagcgggagctgcacagcagcgccaccggccgcagctgccgcggggccagcgagcagaggctgggagatgcccccagctgccgggtggtggtgcacggcgtgcaggcctgcaggatggagggcgtgtgcctgaagtgccggggcgtgaaggagacctccatgcctgtgtactgcagctgtgccggggactttgccctgaccatccacacccaggtgttcatggagcagatcggcatcttcagaaatattgcccagcactacggcatgagctacctgctggagaccctggagtggctgctgcagaagaacccccagctgggccactag

SEQ ID NO: 164641 - DNA, 6861 bp, Artificial Sequence
  Description of Artificial Sequence: Synthetic coding sequence
atgagcctgcggagcggcggcagaagaagagctgaccctggagcagatggagaggccagcagagatgatggagccaccagctctgtgtctgccctgaagaggctggagaggagccagtggacagacaagatggacctgcgcttcggctttgagcggctgaaggagcccggggagaagacaggctggctgatcaacatgcaccccacagagatcctggatgaggacaagaggctgggcagcgctgtggactactacttcatccaggatgatggcagccgcttcaaggtggccctgccctacaagccctacttctacatcgccaccaggaagggctgtgagcgggaggtgagcagcttcctgagcaagaagttccagggcaagatcgccaaggtggagaccgtgcccaaggaggacctggacctgcccaaccacctggtgggcctgaagaggaactacatccggctgtccttccacacagtggaggacctggtgaaggtgaggaaggagatcagccctgctgtgaagaagaaccgggagcaggaccacgccagtgatgcctacacagccctgctgagctctgtgctgcagagaggaggagtcatcacagatgaggaggagaccagcaagaagattgctgaccagctggacaacatcgtggacatgagagaatatgatgtgccctaccacatccggctgagcattgacctgaagatccacgtggcccactggtacaacgtgcgctacagaggaaatgccttccctgtggagatcaccaggagagatgacctggtggagaggccagaccctgtggtgctggcctttgacatcgagaccaccaagctgcccctgaagttcccagatgctgagacagaccagatcatgatgatctcctacatgattgatggccagggctacctgatcaccaaccgggagatcgtgtctgaagatattgaggactttgagttcacccccaagccagaatatgagggccccttctgtgtgttcaatgaaccagatgaggcccacctgatccagcgctggtttgagcacgtgcaggagaccaagcccaccatcatggtgacctacaatggagacttctttgactggccctttgtggaggcccgggctgctgtgcacggcctgtccatgcagcaggagatcggcttccagaaggacagccagggcgagtacaaggccccccagtgcatccacatggactgcctgcgctgggtgaagagggacagctacctgcctgtgggcagccacaacctgaaggctgctgccaaggccaagctgggctatgaccctgtggagctggaccctgaggacatgtgcaggatggccacagagcagccccagaccctggccacctacagcgtgtctgatgctgtggccacctactacctgtacatgaagtatgtgcaccccttcatctttgccctgtgcaccatcatccccatggagccagatgaggtgctgaggaaaggaagtggcaccctgtgtgaggccctgctgatggtgcaggccttccacgccaacatcatcttccccaacaagcaggagcaggagttcaacaagctgacagatgatggccacgtgctggacagcgagacctacgtgggcggccacgtggaggccctggagagcggggtcttcagaagtgacatcccctgccgcttcaggatgaacccagctgcctttgacttcctgctgcagagggtggagaagaccctgcggcatgccctggaggaggaggagaaggtgcctgtggagcaggtgaccaactttgaggaggtgtgtgatgagatcaagagcaagctggccagcctgaaggatgtgcccagcagaattgagtgccccctcatctaccacctggatgtgggcgccatgtaccccaacatcatcctgaccaaccggctgcagcccagcgccatggtggatgaggccacctgtgccgcctgtgacttcaacaagccaggggccaactgccagaggaagatggcctggcagtggagaggagagttcatgcctgccagccgctctgagtaccaccgcatccagcaccagctggagagcgagaagttccccccactcttccctgagggccctgcccgggccttccacgagctgagccgggaggagcaggccaagtatgagaagaggcggctggccgactactgcaggaaggcctacaagaagatccacatcaccaaggtggaggagcggctgaccaccatctgccagcgggagaacagcttctacgtggacacagtgcgggccttccgggaccggcgctatgagttcaagggcctgcacaaggtgtggaagaagaagctgtctgctgctgtggaggtgggagatgctgctgaggtgaagcgctgcaagaacatggaggtgctgtatgacagcctgcagctggcccacaagtgcatcctgaacagcttctacggctacgtgatgaggaagggggcccgctggtacagcatggagatggccggcatcgtgtgcttcaccggggccaacatcatcacccaggcccgggagctgattgagcagatcggccggcccctggagctggacacagatggcatctggtgtgtgctgcccaacagcttccctgagaactttgtgttcaagaccaccaacgtgaagaagcccaaggtgaccatctcctacccaggggccatgctgaacatcatggtgaaggagggcttcaccaatgaccagtaccaggagctggccgagcccagcagcctgacctacgtgaccaggtctgagaacagcatcttctttgaggtggatggcccctacctggccatgatcctgcctgccagcaaggaggagggcaagaagctgaagaagagatatgctgtgttcaatgaagatggcagcctggccgagctgaagggctttgaggtgaagagaagaggagagctgcagctgatcaagatcttccagagctctgtgtttgaggccttcctgaagggcagcaccctggaggaggtgtatggctctgtggccaaggtggccgactactggctggatgtgctgtacagcaaggccgccaacatgccagattctgagctgtttgagctgatcagtgaaaatagatccatgagcaggaagctggaggactatggagagcagaagagcaccagcatcagcacagccaagaggctggccgagttcctgggggaccagatggtgaaggatgctggcctgagctgccgctacatcatcagcaggaagccagagggcagccctgtgacagagcgggccatccccctggccatcttccaggccgagcccaccgtgaggaagcacttcctgaggaagtggctgaagagcagcagcctgcaggactttgacatccgggccatcctggactgggactactacatcgagcggctgggcagcgccatccagaagatcatcaccatcccagctgccctgcagcaggtgaagaaccctgtgccccgggtgaagcacccagactggctgcacaagaagctgctggagaagaatgatgtgtacaagcagaagaagatcagcgagctgttcaccctggagggccggcggcaggtgaccatggccgaggccagcgaggacagcccccggcccagcgccccagacatggaggactttggcctggtgaagctgccccaccctgctgcccctgtgacagtgaagaggaagagggtgctgtgggagagccaggaggagagccaggacctgacccccaccgtgccctggcaggagatcctgggccagcccccagccctgggcaccagccaggaggagtggctggtgtggctgcgcttccacaagaagaagtggcagctgcaggcccggcagaggctggcccggaggaagaggcagaggctggagagcgctgagggcgtgctgcggcctggggccatcagagatggccctgccaccggcctgggcagcttcctgcggaggacagcccggagcatcctggacctgccctggcagatcgtgcagatcagcgagaccagccaggccggcctcttccggctgtgggccctggtgggcagtgacctgcactgcatccggctgagcatccccagggtcttctacgtgaaccagagggtggccaaggccgaggagggcgccagctacaggaaggtgaacagagtgctgcccaggagcaacatggtgtacaacctgtatgagtacagcgtgcctgaggacatgtaccaggagcacatcaatgagatcaatgctgagctgagcgccccagacattgaaggagtgtatgagacccaggtgcccctgctcttccgggccctggtgcacctgggctgtgtgtgtgtggtgaacaagcagctggtgcgccacctgagcggctgggaggccgagacctttgccctggagcacctggagatgaggagcctggcccagttctcctacctggagcccggcagcatccgccacatctacctgtaccaccacgcccaggcccacaaggccctgtttggcatcttcatccccagccagaggcgggcctctgtgtttgtgctggacacagtgcgcagcaaccagatgcccagcctgggcgccctgtacagcgctgagcacggcctgctgctggagaaggtgggccctgagctgctgcccccacccaagcacacctttgaggtgcgggcagagacagacctgaagaccatctgccgggccatccagcgcttcctgctggcctacaaggaggagcggcggggccccaccctgattgctgtgcagagctcctgggagctgaagaggctggccagcgagatccctgtgctggaggagttccccctggtgcccatctgtgtggccgacaagatcaactatggagtgctggactggcagagacatggagcccggaggatgatccgccactacctgaacctggacacctgcctgagccaggcctttgagatgagccgctacttccacatccccatcggcaacctgcctgaggacatcagcacctttggaagtgacctcttctttgcccggcacctgcagaggcacaaccacctgctgtggctgagccccacagcccggccagacctgggcggcaaggaggctgatgacaactgcctggtgatggagtttgatgaccaggccaccgtggagatcaacagcagcggctgctacagcacagtgtgtgtggagctggacctgcagaacctggccgtgaacaccatcctgcagagccaccacgtgaatgacatggagggcgctgacagcatgggcatcagctttgatgtgatccagcaggccagcctggaggacatgatcactggaggccaggccgccagcgccccagccagctatgatgaaacagccctgtgcagcaacaccttccgcatcctgaagtccatggtggtgggctgggtgaaggagatcacccagtaccacaacatctatgctgacaaccaggtgatgcacttctaccgctggctgcggagccccagcagcctgctgcatgaccctgccctgcacaggaccctgcacaacatgatgaagaagctgttcctgcagctgattgctgagttcaagaggctgggcagcagcgtcatctatgccaacttcaaccgcatcatcctgtgcaccaagaagagaagagtggaggatgccatcgcctacgtggagtacatcaccagcagcatccacagcaaggagaccttccacagcctgaccatctccttcagccgctgctgggagttcctgctgtggatggaccccagcaactacggcggcatcaagggcaaggtgagcagccgcatccactgcggcctgcaggacagccagaaggccggcggcgcagaagatgagcaggagaatgaagatgatgaggaggagagagatggagaggaggaggaggaggccgaggagagcaatgtggaggacctgctggagaacaactggaacatcctgcagttcctgccccaggccgccagctgccagaactacttcctgatgattgtgtctgcctacatcgtggccgtgtaccactgcatgaaggatggcctgcggcgcagcgcccctggcagcacccctgtgagaagaagaggagccagccagctgagccaggaggccgagggcgctgtgggcgccctgcccggcatgatcaccttcagccaggactatgtggccaatgagctgacccagagcttcttcaccatcacccagaagatccagaagaaggtgacaggcagcaggaacagcacagagctgtctgagatgtttcctgtgctgcccggcagccacctgctgctgaacaacccagccctggagttcatcaagtatgtgtgcaaggtgctgagcctggacaccaacatcaccaaccaggtgaacaagctgaacagagacctgctgcggctggtggatgtgggggagttcagcgaggaggcccagttccgggacccctgccgctcctatgtgctgcctgaggtgatctgccgcagctgcaacttctgccgggacctggacctgtgcaaggacagcagcttctctgaagatggagctgtgctgccccagtggctgtgcagcaactgccaggccccctatgacagcagcgccatcgagatgaccctggtggaggtgctgcagaagaagctgatggccttcaccctgcaggacctggtgtgcctgaagtgccggggcgtgaaggagacctccatgcctgtgtactgcagctgtgccggggactttgccctgaccatccacacccaggtgttcatggagcagatcggcatcttcagaaatattgcccagcactacggcatgagctacctgctggagaccctggagtggctgctgcagaagaacccccagctgggccactag

SEQ ID NO: 164642 - DNA, 3330 bp, Artificial Sequence
  Description of Artificial Sequence: Synthetic coding sequence
atgcaccccacagagatcctggatgaggacaagaggctgggcagcgctgtggactactacttcatccaggatgatggcagccgcttcaaggtggccctgccctacaagccctacttctacatcgccaccaggaagggctgtgagcgggaggtgtcctccttcctgagcaagaagttccagggcaagatcgccaaggtggagaccgtgcccaaggaggacctggacctgcccaaccacctggtgggcctgaagaggaactacatccggctgtccttccacacagtggaggacctggtgaaggtgaggaaggagatcagccctgctgtgaagaagaaccgggagcaggaccacgccagtgatgcctacacagccctgctgagctctgtgctgcagagaggaggagtcatcacagatgaggaggagaccagcaagaagattgctgaccagctggacaacatcgtggacatgagagaatatgatgtgccctaccacatccggctgagcattgacctgaagatccacgtggcccactggtacaacgtgcgctacagaggaaatgccttccctgtggagatcaccaggagagatgacctggtggagaggccagaccctgtggtgctggcctttgatattgagaccaccaagctgcccctgaagttcccagatgctgagacagaccagatcatgatgatctcctacatgattgatggccagggctacctgatcaccaaccgggagatcgtgtctgaggacattgaagattttgagttcacccccaagccagaatatgagggccccttctgtgtgttcaatgaaccagatgaggcccacctgatccagcgctggtttgaacatgtgcaggagaccaagcccaccatcatggtgacctacaacggggacttctttgactggccctttgtggaggcccgggctgctgtgcacggcctgtccatgcagcaggagatcggcttccagaaggacagccagggcgagtacaaggccccccagtgcatccacatggactgcctgcgctgggtgaagagggacagctacctgcctgtgggcagccacaacctgaaggccgccgccaaggccaagctgggctatgaccctgtggagctggaccctgaggacatgtgcaggatggccacagagcagccccagaccctggccacctacagcgtgtctgatgctgtggccacctactacctgtacatgaagtatgtgcaccccttcatctttgccctgtgcaccatcatccccatggagccagatgaggtgctgaggaagggcagcggcaccctgtgtgaggccctgctgatggtgcaggccttccacgccaacatcatcttccccaacaagcaggagcaggagttcaacaagctgacagatgatggccacgtgctggacagcgagacctacgtgggcggccacgtggaggccctggagagcggggtcttcagaagtgacatcccctgccgcttcaggatgaacccagctgcctttgacttcctgctgcagagggtggagaagaccctgcggcatgccctggaggaggaggagaaggtgcctgtggagcaggtgaccaactttgaggaggtgtgtgatgagatcaagagcaagctggccagcctgaaggatgtgcccagcagaattgaatgtcccctcatctaccacctggatgtgggcgccatgtaccccaacatcatcctgaccaaccggctgcagcccagcgccatggtggatgaggccacctgtgccgcctgtgacttcaacaagccaggggccaactgccagaggaagatggcctggcagtggagaggagagttcatgcctgccagccgctctgagtaccaccgcatccagcaccagctggagagcgagaagtttcctcctctcttccctgagggccctgcccgggccttccacgagctgagccgggaggagcaggccaagtatgagaagaggcggctggccgactactgcaggaaggcctacaagaagatccacatcaccaaggtggaggagcggctgaccaccatctgccagagagaaaattccttctacgtggacacagtgcgggccttccgggacagaagatatgagttcaagggcctgcacaaggtgtggaagaagaagctgtctgctgctgtggaggtgggagatgctgctgaggtgaagcgctgcaagaacatggaggtgctgtatgacagcctgcagctggcccacaagtgcatcctgaacagcttctacggctacgtgatgaggaaaggagcccgctggtacagcatggagatggccggcatcgtgtgcttcaccggggccaacatcatcacccaggcccgggagctgattgagcagatcggccggcccctggagctggacacagatggcatctggtgtgtgctgcccaacagcttcccagaaaattttgtgttcaagaccaccaacgtgaagaagcccaaggtgaccatctcctacccaggggccatgctgaacatcatggtgaaggagggcttcaccaatgaccagtaccaggagctggccgagcccagcagcctgacctacgtgaccaggagtgaaaattccatcttctttgaggtggatggcccctacctggccatgatcctgcctgccagcaaggaggagggcaagaagctgaagaagagatatgctgtgttcaatgaagatggcagcctggccgagctgaagggctttgaggtgaagagaagaggagagctgcagctgatcaagatcttccagagctctgtgtttgaggccttcctgaagggcagcaccctggaggaggtgtatggctctgtggccaaggtggccgactactggctggatgtgctgtacagcaaggccgccaacatgccagacagcgagctgtttgagctgatcagcgagaacagatccatgagcaggaagctggaggactatggagagcagaagagcaccagcatcagcacagccaagaggctggccgagttcctgggggaccagatggtgaaggatgctggcctgagctgccgctacatcatcagcaggaagccagagggcagccctgtgacagagcgggccatccccctggccatcttccaggccgagcccaccgtgaggaagcacttcctgaggaagtggctgaagagcagcagcctgcaggactttgacatccgggccatcctggactgggactactacatcgagcggctgggcagcgccatccagaagatcatcaccatcccagctgccctgcagcaggtgaagaaccctgtgccccgggtgaagcacccagactggctgcacaagacagctggggaggagtag

SEQ ID NO: 164643 - DNA, 1491 bp, Artificial Sequence
  Description of Artificial Sequence: Synthetic coding sequence
atggagggcatcctgaagtccatggtggtgggctgggtgaaggagatcacccagtaccacaacatctatgctgacaaccaggtgatgcacttctaccgctggctgcggagccccagcagcctgctgcatgaccctgccctgcacaggaccctgcacaacatgatgaagaagctgttcctgcagctgattgctgagttcaagaggctgggcagcagcgtcatctatgccaacttcaaccgcatcatcctgtgcaccaagaagagaagagtggaggatgccatcgcctacgtggagtacatcaccagcagcatccacagcaaggagaccttccacagcctgaccatctccttcagccgctgctgggagttcctgctgtggatggaccccagcaactacggcggcatcaagggcaaggtgagcagccgcatccactgcggcctgcaggacagccagaaggccggcggcgcagaagatgagcaggagaatgaagatgatgaggaggagagagatggagaggaggaggaggaggccgaggagagcaatgtggaggacctgctggagaacaactggaacatcctgcagttcctgccccaggccgccagctgccagaactacttcctgatgattgtgtctgcctacatcgtggccgtgtaccactgcatgaaggatggcctgcggcgcagcgcccctggcagcacccctgtgagaagaagaggagccagccagctgagccaggaggccgagggcgctgtgggcgccctgcccggcatgatcaccttcagccaggactatgtggccaatgagctgacccagagcttcttcaccatcacccagaagatccagaagaaggtgacaggcagcaggaacagcacagagctgtctgagatgtttcctgtgctgcccggcagccacctgctgctgaacaacccagccctggagttcatcaagtatgtgtgcaaggtgctgagcctggacaccaacatcaccaaccaggtgaacaagctgaacagagacctgctgcggctggtggatgtgggggagttcagcgaggaggcccagttccgggacccctgccgctcctatgtgctgcctgaggtgatctgccgcagctgcaacttctgccgggacctggacctgtgcaaggacagcagcttctctgaagatggagctgtgctgccccagtggctgtgcagcaactgccaggccccctatgacagcagcgccatcgagatgaccctggtggaggtgctgcagaagaagctgatggccttcaccctgcaggacctggtgtgcctgaagtgccggggcgtgaaggagacctccatgcctgtgtactgcagctgtgccggggactttgccctgaccatccacacccaggtgttcatggagcagatcggcatcttcagaaatattgcccagcactacggcatgagctacctgctggagaccctggagtggctgctgcagaagaacccccagctgggccactag

SEQ ID NO: 164644 - DNA, 6894 bp, Artificial Sequence
  Description of Artificial Sequence: Synthetic coding sequence
atgagccggcccctgggcctgaagagcttccccaggcacaagcaggcccccctgcccctgagcctgaccttccacggctgcctgctgctgcggagagatgatggagccaccagctctgtgtctgccctgaagaggctggagaggagccagtggacagacaagatggacctgcgctttggatttgagcggctgaaggagcctggagagaagacaggctggctgatcaacatgcaccccacagagatcctggatgaggacaagaggctgggcagcgctgtggactactacttcatccaggatgatggcagccgcttcaaggtggccctgccctacaagccctacttctacatcgccaccaggaagggctgtgagcgggaggtgtcctccttcctgagcaagaagttccagggcaagatcgccaaggtggagaccgtgcccaaggaggacctggacctgcccaaccacctggtgggcctgaagaggaactacatccggctgtccttccacacagtggaggacctggtgaaggtgaggaaggagatcagccctgctgtgaagaagaaccgggagcaggaccacgccagtgatgcctacacagccctgctgagctctgtgctgcagagaggaggagtcatcacagatgaggaggagaccagcaagaagattgctgaccagctggacaacatcgtggacatgagagaatatgatgtgccctaccacatccggctgagcattgacctgaagatccacgtggcccactggtacaacgtgcgctacagaggaaatgccttccctgtggagatcaccaggagagatgacctggtggagaggccagaccctgtggtgctggcctttgatattgagaccaccaagctgcccctgaagttcccagatgctgagacagaccagatcatgatgatctcctacatgattgatggccagggctacctgatcaccaaccgggagatcgtgtctgaggacattgaagattttgagttcacccccaagccagaatatgagggccccttctgtgtgttcaatgaaccagatgaggcccacctgatccagcgctggtttgaacatgtgcaggagaccaagcccaccatcatggtgacctacaacggggacttctttgactggccctttgtggaggcccgggctgctgtgcacggcctgtccatgcagcaggagatcggcttccagaaggacagccagggcgagtacaaggccccccagtgcatccacatggactgcctgcgctgggtgaagagggacagctacctgcctgtgggcagccacaacctgaaggccgccgccaaggccaagctgggctatgaccctgtggagctggaccctgaggacatgtgcaggatggccacagagcagccccagaccctggccacctacagcgtgtctgatgctgtggccacctactacctgtacatgaagtatgtgcaccccttcatctttgccctgtgcaccatcatccccatggagccagatgaggtgctgaggaagggcagcggcaccctgtgtgaggccctgctgatggtgcaggccttccacgccaacatcatcttccccaacaagcaggagcaggagttcaacaagctgacagatgatggccacgtgctggacagcgagacctacgtgggcggccacgtggaggccctggagagcggggtcttcagaagtgacatcccctgccgcttcaggatgaacccagctgcctttgacttcctgctgcagagggtggagaagaccctgcggcatgccctggaggaggaggagaaggtgcctgtggagcaggtgaccaactttgaggaggtgtgtgatgagatcaagagcaagctggccagcctgaaggatgtgcccagcagaattgaatgtcccctcatctaccacctggatgtgggcgccatgtaccccaacatcatcctgaccaaccggctgcagcccagcgccatggtggatgaggccacctgtgccgcctgtgacttcaacaagccaggggccaactgccagaggaagatggcctggcagtggagaggagagttcatgcctgccagccgctctgagtaccaccgcatccagcaccagctggagagcgagaagtttcctcctctcttccctgagggccctgcccgggccttccacgagctgagccgggaggagcaggccaagtatgagaagaggcggctggccgactactgcaggaaggcctacaagaagatccacatcaccaaggtggaggagcggctgaccaccatctgccagagagaaaattccttctacgtggacacagtgcgggccttccgggacagaagatatgagttcaagggcctgcacaaggtgtggaagaagaagctgtctgctgctgtggaggtgggagatgctgctgaggtgaagcgctgcaagaacatggaggtgctgtatgacagcctgcagctggcccacaagtgcatcctgaacagcttctacggctacgtgatgaggaaaggagcccgctggtacagcatggagatggccggcatcgtgtgcttcaccggggccaacatcatcacccaggcccgggagctgattgagcagatcggccggcccctggagctggacacagatggcatctggtgtgtgctgcccaacagcttcccagaaaattttgtgttcaagaccaccaacgtgaagaagcccaaggtgaccatctcctacccaggggccatgctgaacatcatggtgaaggagggcttcaccaatgaccagtaccaggagctggccgagcccagcagcctgacctacgtgaccaggagtgaaaattccatcttctttgaggtggatggcccctacctggccatgatcctgcctgccagcaaggaggagggcaagaagctgaagaagagatatgctgtgttcaatgaagatggcagcctggccgagctgaagggctttgaggtgaagagaagaggagagctgcagctgatcaagatcttccagagctctgtgtttgaggccttcctgaagggcagcaccctggaggaggtgtatggctctgtggccaaggtggccgactactggctggatgtgctgtacagcaaggccgccaacatgccagacagcgagctgtttgagctgatcagcgagaacagatccatgagcaggaagctggaggactatggagagcagaagagcaccagcatcagcacagccaagaggctggccgagttcctgggggaccagatggtgaaggatgctggcctgagctgccgctacatcatcagcaggaagccagagggcagccctgtgacagagcgggccatccccctggccatcttccaggccgagcccaccgtgaggaagcacttcctgaggaagtggctgaagagcagcagcctgcaggactttgacatccgggccatcctggactgggactactacatcgagcggctgggcagcgccatccagaagatcatcaccatcccagctgccctgcagcaggtgaagaaccctgtgccccgggtgaagcacccagactggctgcacaagaagctgctggagaagaatgatgtgtacaagcagaagaagatcagcgagctgttcaccctggagggccggcggcaggtgaccatggccgaggccagcgaggacagcccccggcccagcgccccagacatggaggactttggcctggtgaagctgccccaccctgctgcccctgtgacagtgaagaggaagagggtgctgtgggagagccaggaggagagccaggacctgacccccaccgtgccctggcaggagatcctgggccagcccccagccctgggcaccagccaggaggagtggctggtgtggctgcgcttccacaagaagaagtggcagctgcaggcccggcagaggctggcccggaggaagaggcagaggctggagagcgctgagggcgtgctgcggcctggggccatcagagatggccctgccaccggcctgggcagcttcctgcggaggacagcccggagcatcctggacctgccctggcagatcgtgcagatcagcgagaccagccaggccggcctcttccggctgtgggccctggtgggcagtgacctgcactgcatccggctgagcatccccagggtcttctacgtgaaccagagggtggccaaggccgaggagggcgccagctacaggaaggtgaacagagtgctgcccaggagcaacatggtgtacaacctgtatgagtacagcgtgcctgaggacatgtaccaggagcacatcaatgagatcaatgctgagctgagcgccccagacatcgagggcgtgtatgagacccaggtgcccctgctcttccgggccctggtgcacctgggctgtgtgtgtgtggtgaacaagcagctggtgcgccacctgagcggctgggaggccgagacctttgccctggagcacctggagatgaggagcctggcccagttctcctacctggagcccggcagcatccgccacatctacctgtaccaccacgcccaggcccacaaggccctgtttggcatcttcatccccagccagaggcgggcctctgtgtttgtgctggacacagtgcgcagcaaccagatgcccagcctgggcgccctgtacagcgctgagcacggcctgctgctggagaaggtgggccctgagctgctgcccccacccaagcacacctttgaggtgcgggcagagacagacctgaagaccatctgccgggccatccagcgcttcctgctggcctacaaggaggagcggcggggccccaccctgattgctgtgcagagctcctgggagctgaagaggctggccagcgagatccctgtgctggaggagttccccctggtgcccatctgtgtggccgacaagatcaactacggcgtgctggactggcagagacatggagcccggaggatgatccgccactacctgaacctggacacctgcctgagccaggcctttgagatgagccgctacttccacatccccatcggcaacctgcctgaggacatcagcaccttcggcagtgacctcttctttgcccggcacctgcagaggcacaaccacctgctgtggctgagccccacagcccggccagacctgggcggcaaggaggctgatgacaactgcctggtgatggagtttgatgaccaggccaccgtggagatcaacagcagcggctgctacagcacagtgtgtgtggagctggacctgcagaacctggccgtgaacaccatcctgcagagccaccacgtgaatgacatggagggcgctgacagcatgggcatcagctttgatgtgatccagcaggccagcctggaggacatgatcaccggcggccaggccgccagcgccccagccagctatgatgaaacagccctgtgcagcaacaccttccgcatcctgaagtccatggtggtgggctgggtgaaggagatcacccagtaccacaacatctatgctgacaaccaggtgatgcacttctaccgctggctgcggagccccagcagcctgctgcatgaccctgccctgcacaggaccctgcacaacatgatgaagaagctgttcctgcagctgattgctgagttcaagaggctgggcagcagcgtcatctatgccaacttcaaccgcatcatcctgtgcaccaagaagagaagagtggaggatgccatcgcctacgtggagtacatcaccagcagcatccacagcaaggagaccttccacagcctgaccatctccttcagccgctgctgggagttcctgctgtggatggaccccagcaactatggaggcatcaagggcaaggtgagcagccgcatccactgcggcctgcaggacagccagaaggccggcggcgcagaagatgagcaggagaatgaagatgatgaggaggagagagatggagaggaggaggaggaggccgaggagagcaatgtggaggacctgctggagaacaactggaacatcctgcagttcctgccccaggccgccagctgccagaactacttcctgatgattgtgtctgcctacatcgtggccgtgtaccactgcatgaaggatggcctgcggcgcagcgcccctggcagcacccctgtgagaagaagaggagccagccagctgagccaggaggccgagggcgctgtgggcgccctgcccggcatgatcaccttcagccaggactatgtggccaatgagctgacccagagcttcttcaccatcacccagaagatccagaagaaggtgacaggcagcaggaacagcacagagctgtctgagatgtttcctgtgctgcccggcagccacctgctgctgaacaacccagccctggagttcatcaagtatgtgtgcaaggtgctgagcctggacaccaacatcaccaaccaggtgaacaagctgaacagagacctgctgcggctggtggatgtgggggagttcagcgaggaggcccagttccgggacccctgccgctcctatgtgctgcctgaggtgatctgccgcagctgcaacttctgccgggacctggacctgtgcaaggacagcagcttctctgaagatggagctgtgctgccccagtggctgtgcagcaactgccaggccccctatgacagcagcgccatcgagatgaccctggtggaggtgctgcagaagaagctgatggccttcaccctgcaggacctggtgtgcctgaagtgccggggcgtgaaggagacctccatgcctgtgtactgcagctgtgccggggactttgccctgaccatccacacccaggtgttcatggagcagatcggcatcttcaggaacatcgcccagcactacggcatgagctacctgctggagaccctggagtggctgctgcagaagaacccccagctgggccactag

SEQ ID NO: 164645 - DNA, 6780 bp, Artificial Sequence
  Description of Artificial Sequence: Synthetic coding sequence
atgagcctgcggagcggcggcagaagaagagctgaccctggagcagatggagaggccagcagagatgatggagccaccagctctgtgtctgccctgaagaggctggagaggagccagtggacagacaagatggacctgcgcttcggctttgagcggctgaaggagcccggggagaagacaggctggctgatcaacatgcaccctgtggccctgccctacaagccctacttctacatcgccaccaggaagggctgtgagcgggaggtgtcctccttcctgagcaagaagttccagggcaagatcgccaaggtggagaccgtgcccaaggaggacctggacctgcccaaccacctggtgggcctgaagaggaactacatccggctgtccttccacacagtggaggacctggtgaaggtgaggaaggagatcagccctgctgtgaagaagaaccgggagcaggaccacgccagtgatgcctacacagccctgctgagctctgtgctgcagagaggaggagtcatcacagatgaggaggagaccagcaagaagattgctgaccagctggacaacatcgtggacatgagagaatatgatgtgccctaccacatccggctgagcattgacctgaagatccacgtggcccactggtacaacgtgcgctacagaggaaatgccttccctgtggagatcaccaggagagatgacctggtggagaggccagaccctgtggtgctggcctttgatattgagaccaccaagctgcccctgaagttcccagatgctgagacagaccagatcatgatgatctcctacatgattgatggccagggctacctgatcaccaaccgggagatcgtgtctgaggacattgaagattttgagttcacccccaagccagaatatgagggccccttctgtgtgttcaatgaaccagatgaggcccacctgatccagcgctggtttgaacatgtgcaggagaccaagcccaccatcatggtgacctacaacggggacttctttgactggccctttgtggaggcccgggctgctgtgcacggcctgtccatgcagcaggagatcggcttccagaaggacagccagggcgagtacaaggccccccagtgcatccacatggactgcctgcgctgggtgaagagggacagctacctgcctgtgggcagccacaacctgaaggccgccgccaaggccaagctgggctatgaccctgtggagctggaccctgaggacatgtgcaggatggccacagagcagccccagaccctggccacctacagcgtgtctgatgctgtggccacctactacctgtacatgaagtatgtgcaccccttcatctttgccctgtgcaccatcatccccatggagccagatgaggtgctgaggaagggcagcggcaccctgtgtgaggccctgctgatggtgcaggccttccacgccaacatcatcttccccaacaagcaggagcaggagttcaacaagctgacagatgatggccacgtgctggacagcgagacctacgtgggcggccacgtggaggccctggagagcggggtcttcagaagtgacatcccctgccgcttcaggatgaacccagctgcctttgacttcctgctgcagagggtggagaagaccctgcggcatgccctggaggaggaggagaaggtgcctgtggagcaggtgaccaactttgaggaggtgtgtgatgagatcaagagcaagctggccagcctgaaggatgtgcccagcagaattgaatgtcccctcatctaccacctggatgtgggcgccatgtaccccaacatcatcctgaccaaccggctgcagcccagcgccatggtggatgaggccacctgtgccgcctgtgacttcaacaagccaggggccaactgccagaggaagatggcctggcagtggagaggagagttcatgcctgccagccgctctgagtaccaccgcatccagcaccagctggagagcgagaagtttcctcctctcttccctgagggccctgcccgggccttccacgagctgagccgggaggagcaggccaagtatgagaagaggcggctggccgactactgcaggaaggcctacaagaagatccacatcaccaaggtggaggagcggctgaccaccatctgccagagagaaaattccttctacgtggacacagtgcgggccttccgggacagaagatatgagttcaagggcctgcacaaggtgtggaagaagaagctgtctgctgctgtggaggtgggagatgctgctgaggtgaagcgctgcaagaacatggaggtgctgtatgacagcctgcagctggcccacaagtgcatcctgaacagcttctacggctacgtgatgaggaaaggagcccgctggtacagcatggagatggccggcatcgtgtgcttcaccggggccaacatcatcacccaggcccgggagctgattgagcagatcggccggcccctggagctggacacagatggcatctggtgtgtgctgcccaacagcttcccagaaaattttgtgttcaagaccaccaacgtgaagaagcccaaggtgaccatctcctacccaggggccatgctgaacatcatggtgaaggagggcttcaccaatgaccagtaccaggagctggccgagcccagcagcctgacctacgtgaccaggagtgaaaattccatcttctttgaggtggatggcccctacctggccatgatcctgcctgccagcaaggaggagggcaagaagctgaagaagagatatgctgtgttcaatgaagatggcagcctggccgagctgaagggctttgaggtgaagagaagaggagagctgcagctgatcaagatcttccagagctctgtgtttgaggccttcctgaagggcagcaccctggaggaggtgtatggctctgtggccaaggtggccgactactggctggatgtgctgtacagcaaggccgccaacatgccagacagcgagctgtttgagctgatcagcgagaacagatccatgagcaggaagctggaggactatggagagcagaagagcaccagcatcagcacagccaagaggctggccgagttcctgggggaccagatggtgaaggatgctggcctgagctgccgctacatcatcagcaggaagccagagggcagccctgtgacagagcgggccatccccctggccatcttccaggccgagcccaccgtgaggaagcacttcctgaggaagtggctgaagagcagcagcctgcaggactttgacatccgggccatcctggactgggactactacatcgagcggctgggcagcgccatccagaagatcatcaccatcccagctgccctgcagcaggtgaagaaccctgtgccccgggtgaagcacccagactggctgcacaagaagctgctggagaagaatgatgtgtacaagcagaagaagatcagcgagctgttcaccctggagggccggcggcaggtgaccatggccgaggccagcgaggacagcccccggcccagcgccccagacatggaggactttggcctggtgaagctgccccaccctgctgcccctgtgacagtgaagaggaagagggtgctgtgggagagccaggaggagagccaggacctgacccccaccgtgccctggcaggagatcctgggccagcccccagccctgggcaccagccaggaggagtggctggtgtggctgcgcttccacaagaagaagtggcagctgcaggcccggcagaggctggcccggaggaagaggcagaggctggagagcgctgagggcgtgctgcggcctggggccatcagagatggccctgccaccggcctgggcagcttcctgcggaggacagcccggagcatcctggacctgccctggcagatcgtgcagatcagcgagaccagccaggccggcctcttccggctgtgggccctggtgggcagtgacctgcactgcatccggctgagcatccccagggtcttctacgtgaaccagagggtggccaaggccgaggagggcgccagctacaggaaggtgaacagagtgctgcccaggagcaacatggtgtacaacctgtatgagtacagcgtgcctgaggacatgtaccaggagcacatcaatgagatcaatgctgagctgagcgccccagacatcgagggcgtgtatgagacccaggtgcccctgctcttccgggccctggtgcacctgggctgtgtgtgtgtggtgaacaagcagctggtgcgccacctgagcggctgggaggccgagacctttgccctggagcacctggagatgaggagcctggcccagttctcctacctggagcccggcagcatccgccacatctacctgtaccaccacgcccaggcccacaaggccctgtttggcatcttcatccccagccagaggcgggcctctgtgtttgtgctggacacagtgcgcagcaaccagatgcccagcctgggcgccctgtacagcgctgagcacggcctgctgctggagaaggtgggccctgagctgctgcccccacccaagcacacctttgaggtgcgggcagagacagacctgaagaccatctgccgggccatccagcgcttcctgctggcctacaaggaggagcggcggggccccaccctgattgctgtgcagagctcctgggagctgaagaggctggccagcgagatccctgtgctggaggagttccccctggtgcccatctgtgtggccgacaagatcaactacggcgtgctggactggcagagacatggagcccggaggatgatccgccactacctgaacctggacacctgcctgagccaggcctttgagatgagccgctacttccacatccccatcggcaacctgcctgaggacatcagcaccttcggcagtgacctcttctttgcccggcacctgcagaggcacaaccacctgctgtggctgagccccacagcccggccagacctgggcggcaaggaggctgatgacaactgcctggtgatggagtttgatgaccaggccaccgtggagatcaacagcagcggctgctacagcacagtgtgtgtggagctggacctgcagaacctggccgtgaacaccatcctgcagagccaccacgtgaatgacatggagggcgctgacagcatgggcatcagctttgatgtgatccagcaggccagcctggaggacatgatcaccggcggccaggccgccagcgccccagccagctatgatgaaacagccctgtgcagcaacaccttccgcatcctgaagtccatggtggtgggctgggtgaaggagatcacccagtaccacaacatctatgctgacaaccaggtgatgcacttctaccgctggctgcggagccccagcagcctgctgcatgaccctgccctgcacaggaccctgcacaacatgatgaagaagctgttcctgcagctgattgctgagttcaagaggctgggcagcagcgtcatctatgccaacttcaaccgcatcatcctgtgcaccaagaagagaagagtggaggatgccatcgcctacgtggagtacatcaccagcagcatccacagcaaggagaccttccacagcctgaccatctccttcagccgctgctgggagttcctgctgtggatggaccccagcaactatggaggcatcaagggcaaggtgagcagccgcatccactgcggcctgcaggacagccagaaggccggcggcgcagaagatgagcaggagaatgaagatgatgaggaggagagagatggagaggaggaggaggaggccgaggagagcaatgtggaggacctgctggagaacaactggaacatcctgcagttcctgccccaggccgccagctgccagaactacttcctgatgattgtgtctgcctacatcgtggccgtgtaccactgcatgaaggatggcctgcggcgcagcgcccctggcagcacccctgtgagaagaagaggagccagccagctgagccaggaggccgagggcgctgtgggcgccctgcccggcatgatcaccttcagccaggactatgtggccaatgagctgacccagagcttcttcaccatcacccagaagatccagaagaaggtgacaggcagcaggaacagcacagagctgtctgagatgtttcctgtgctgcccggcagccacctgctgctgaacaacccagccctggagttcatcaagtatgtgtgcaaggtgctgagcctggacaccaacatcaccaaccaggtgaacaagctgaacagagacctgctgcggctggtggatgtgggggagttcagcgaggaggcccagttccgggacccctgccgctcctatgtgctgcctgaggtgatctgccgcagctgcaacttctgccgggacctggacctgtgcaaggacagcagcttctctgaagatggagctgtgctgccccagtggctgtgcagcaactgccaggccccctatgacagcagcgccatcgagatgaccctggtggaggtgctgcagaagaagctgatggccttcaccctgcaggacctggtgtgcctgaagtgccggggcgtgaaggagacctccatgcctgtgtactgcagctgtgccggggactttgccctgaccatccacacccaggtgttcatggagcagatcggcatcttcaggaacatcgcccagcactacggcatgagctacctgctggagaccctggagtggctgctgcagaagaacccccagctgggccactag

SEQ ID NO: 164646 - DNA, 480 bp, Artificial Sequence
  Description of Artificial Sequence: Synthetic coding sequence
atgatcaagttcttcctgatggtgaacaagcagggccagacccggctgagcaagtactatgagcacgtggacatcaacaagaggaccctgctggagacagaggtgatcaagagctgcctgagccgcagcaatgagcagtgcagcttcatcgagtacaaggacttcaagctgatctaccggcagtatgctgccctcttcatcgtggtgggcgtgaatgacacagaaaatgagatggccatctatgagttcatccacaactttgtggaggtgctggatgagtacttcagccgggtgtctgagctggatgtgtccttcttcaacacagtgttccacagcacctggcagatgcacagcggcccctaccaggagcccattgatgagctgcccaagatctgcagcgccctggagccccagcagacctgcttctccccagacagcagcagcttcaagggggccgccagcaccacccccatctactag

SEQ ID NO: 164647 - DNA, 1506 bp, Artificial Sequence
  Description of Artificial Sequence: Synthetic coding sequence
atggcccctgagcggctgcggagccgggccctgagcgccttcaagctgcggggcctgctgctgcggggggaggccatcaagtacctgacagaggccctgcagagcatcagcgagctggagctggaggacaagctggagaagatcatcaatgctgtggagaagcagcccctgagcagcaacatgattgaaagatctgtggtggaggccgctgtgcaggagtgcagccagagcgtggatgagaccatcctgctgatgaccaaccacccagcccccaacctgtttggcaccccccgggacaaggccgagatgttccgggagcgctacaccatcctgcaccagaggacccacagacatgagctgttcaccccacctgtgattggcagccacccagatgaaagtggcagcaagttccagctgaagaccatcgagaccctgctgggcagcaccaccaagattggagatgccatcgtgctgggcatgatcacccagctgaaggagggcaagttcttcctggaggaccccactggaacagtgcagctggacctgagcaaggcccagttccacagcggcctgtacacagaggcctgctttgtgctggccgagggctggtttgaggaccaggtgttccacgtgaatgccttcggcttccccccaacagagcccagcagcaccacccgggcctactacggcaacatcaacttctttggaggccccagcaacacctctgtgaagaccagcgccaagctgaagcagctggaggaggagaacaaggatgccatgtttgtgttcctgagtgatgtgtggctggaccaggtggaggtgctggagaagctgcgcatcatgtttgctggctacagccctgccccacccacctgcttcatcctgtgtggcaacttcagcagcgccccctacggcaagaaccaggtgcaggccctgaaggacagcctgaagaccctggccgacatcatctgtgagtacccagacatccaccagagcagcagatttgtgtttgtgcccggccctgaggaccccggcttcggcagcatcctgcccaggcctcccctggccgagagcatcaccaatgagttccggcagagggtgcccttcagcgtcttcaccaccaacccctgccgcatccagtactgcacccaggagatcaccgtcttccgggaggacctggtgaacaagatgtgcaggaactgtgtgcgcttccccagcagcaacctggccatccccaaccactttgtgaagaccatcctgagccagggccacctgacccccctgcccctgtatgtgtgccctgtgtactgggcctatgactatgccctgcgggtgtaccctgtgcctgacctgctggtgattgctgacaagtatgaccccttcaccaccaccaacacagaatgtctgtgcatcaaccctggcagcttccccaggagcggcttctccttcaaggtgttctaccccagcaacaagacagtggaggacagcaagctgcagggcttctag

SEQ ID NO: 164648 - DNA, 1509 bp, Artificial Sequence
  Description of Artificial Sequence: Synthetic coding sequence
atggcccctgagcggctgcggagccgggccctgagcgccttcaagctgcggggcctgctgctgcggggggaggccatcaagtacctgacagaggccctgcagagcatcagcgagctggagctggaggacaagctggagaagatcatcaatgctgtggagaagcagcccctgagcagcaacatgattgaaagatctgtggtggaggccgctgtgcaggagtgcagccagagcgtggatgagaccatcgagcacgtgttcaacatcattggagcctttgacatccccaggtttgtgtacaacagcgagaggaagaagttcctgcccctgctgatgaccaaccacccagcccccaacctgtttggcaccccccgggacaaggccgagatgttccgggagcgctacaccatcctgcaccagaggacccacagacatgagctgttcaccccacctgtgattggcagccacccagatgaaagtggcagcaagttccagctgaagaccatcgagaccctgctgggcagcaccaccaagattggagatgccatcgtgctgggcatgatcacccagctgaaggagggcaagttcttcctggaggaccccactggaacagtgcagctggacctgagcaaggcccagttccacagcggcctgtacacagaggcctgctttgtgctggccgagggctggtttgaggaccaggtgttccacgtgaatgccttcggcttccccccaacagagcccagcagcaccacccgggcctactacggcaacatcaacttctttggaggccccagcaacacctctgtgaagaccagcgccaagctgaagcagctggaggaggagaacaaggatgccatgtttgtgttcctgagtgatgtgtggctggaccaggtggaggtgctggagaagctgcgcatcatgtttgctggctacagccctgccccacccacctgcttcatcctgtgtggcaacttcagcagcgccccctacggcaagaaccaggtgcaggccctgaaggacagcctgaagaccctggccgacatcatctgtgagtacccagacatccaccagagcagcagatttgtgtttgtgcccggccctgaggaccccggcttcggcagcatcctgcccaggcctcccctggccgagagcatcaccaatgagttccggcagagggtgcccttcagcgtcttcaccaccaacccctgccgcatccagtactgcacccaggagatcaccgtcttccgggaggacctggtgaacaagatgtgcaggaactgtgtgcgcttccccagcagcaacctggccatccccaaccactttgtgaagaccatcctgagccagggccacctgacccccctgcccctgtatgtgtgccctgtgtactgggcctatgactatgccctgcgggtgtaccctgtgcctgacctgctggtgattgctgacaagtatgaccccttcaccaccaccaacacagaatgtctgtgcatcaaccctgtgaggatgtag

SEQ ID NO: 164649 - DNA, 444 bp, Artificial Sequence
  Description of Artificial Sequence: Synthetic coding sequence
atggccgagaggcctgaggacctgaacctgcccaatgctgtgatcacccgcatcatcaaggaggccctgcctgatggagtgaacatcagcaaggaggcccggagcgccatcagccgggccgcctctgtgtttgtgctgtatgccaccagctgtgccaacaactttgccatgaagggcaagaggaagaccctgaatgccagtgatgtgctgagcgccatggaggagatggagttccagagatttgtgacccccctgaaggaggccctggaggcctacagaagagagcagaagggcaagaaggaggccagcgagcagaagaagaaggacaaggacaagaagacagacagcgaggagcaggacaagagcagagatgaagataatgatgaagatgaggagcggctggaggaggaggagcagaatgaggaggaggaggtggacaactag

SEQ ID NO: 164650 - DNA, 444 bp, Artificial Sequence; identical to SEQ ID NO: 164649
  Description of Artificial Sequence: Synthetic coding sequence

SEQ ID NO: 164651 - DNA, 1245 bp, Artificial Sequence
  Description of Artificial Sequence: Synthetic coding sequence
atggccaccggccaggacagagtggtggccctggtggacatggactgcttctttgtgcaggtggagcagaggcagaacccccacctgaggaacaagccctgtgctgtggtgcagtacaagtcctggaagggcggcggcatcatcgctgtgtcctatgaggcccgggcctttggagtgaccaggtccatgtgggcagatgatgccaagaagctgtgcccagacctgctgctggcccaggtgcgggagagccggggcaaggccaacctgaccaagtaccgggaggcctctgtggaggtgatggagatcatgagcagatttgctgtgattgagcgggccagcattgatgaggcctacgtggacctgaccagcgctgtgcaggagcggctgcagaagctgcagggccagcccatctctgctgacctgctgcccagcacctacatcgagggcctgccccagggccccaccacagctgaggagaccgtgcagaaggagggcatgaggaagcagggcctcttccagtggctggacagcctgcagattgacaacctgaccagcccagacctgcagctgactgtgggcgccgtcatcgtggaggagatgagagctgccatcgagcgggagaccggcttccagtgcagcgctggcatcagccacaacaaggtgctggccaagctggcctgtggcctgaacaagcccaaccggcagaccctggtgagccacggctctgtgccccagctgttcagccagatgcccatcaggaagatccgcagcctgggcggcaagctgggcgcctctgtgattgagatcctgggcatcgagtacatgggagagctgacccagttcacagagagccagctgcagagccactttggagagaagaatggctcctggctgtatgccatgtgccggggcattgaacatgaccctgtgaagccccggcagctgcccaagaccatcggctgcagcaagaacttccctgggaagacagccctggccacccgggagcaggtgcagtggtggctgctgcagctggcccaggagctggaggagcggctgaccaaggacagaaatgacaatgacagagtggccacccagctggtggtgtccatccgggtgcagggcgacaagaggctgagcagcctgcggcgctgctgtgccctgaccaggtatgatgcccacaagatgagccatgatgccttcaccgtcatcaagaactgcaacaccagcggcatccagacagaatag

SEQ ID NO: 164652 - DNA, 2142 bp, Artificial Sequence
  Description of Artificial Sequence: Synthetic coding sequence
atggccaccggccaggacagagtggtggccctggtggacatggactgcttctttgtgcaggtggagcagaggcagaacccccacctgaggaacaagccctgtgctgtggtgcagtacaagtcctggaagggcggcggcatcatcgctgtgtcctatgaggcccgggcctttggagtgaccaggtccatgtgggcagatgatgccaagaagctgtgcccagacctgctgctggcccaggtgcgggagagccggggcaaggccaacctgaccaagtaccgggaggcctctgtggaggtgatggagatcatgagcagatttgctgtgattgagcgggccagcattgatgaggcctacgtggacctgaccagcgctgtgcaggagcggctgcagaagctgcagggccagcccatctctgctgacctgctgcccagcacctacatcgagggcctgccccagggccccaccacagctgaggagaccgtgcagaaggagggcatgaggaagcagggcctcttccagtggctggacagcctgcagattgacaacctgaccagcccagacctgcagctgactgtgggcgccgtcatcgtggaggagatgagagctgccatcgagcgggagaccggcttccagtgcagcgctggcatcagccacaacaaggtgctggccaagctggcctgtggcctgaacaagcccaaccggcagaccctggtgagccacggctctgtgccccagctgttcagccagatgcccatcaggaagatccgcagcctgggcggcaagctgggcgcctctgtgattgagatcctgggcatcgagtacatgggagagctgacccagttcacagagagccagctgcagagccactttggagagaagaatggctcctggctgtatgccatgtgccggggcattgaacatgaccctgtgaagccccggcagctgcccaagaccatcggctgcagcaagaacttccctgggaagacagccctggccacccgggagcaggtgcagtggtggctgctgcagctggcccaggagctggaggagcggctgaccaaggacagaaatgacaatgacagagtggccacccagctggtggtgtccatccgggtgcagggcgacaagaggctgagcagcctgcggcgctgctgtgccctgaccaggtatgatgcccacaagatgagccatgatgccttcaccgtcatcaagaactgcaacaccagcggcatccagacagagtggagcccccccctgaccatgctgttcctgtgtgccaccaagttcagcgccagcgcccccagcagcagcacagacatcaccagcttcctgagcagtgaccccagcagcctgcccaaggtgcctgtgaccagcagcgaggccaagacccagggcagcggccctgctgtgacagccaccaagaaggccaccaccagcctggagagcttcttccagaaggctgctgagcggcagaaggtgaaggaggccagcctgagcagcctgacagcccccacccaggcccccatgagcaacagccccagcaagcccagcctgcccttccagaccagccagagcactggaacagagcccttcttcaagcagaagagcctgctgctgaagcagaagcagctgaacaacagctctgtgagcagcccccagcagaacccctggagcaactgcaaggccctgcccaacagcctgcccacagagtacccaggctgtgtgcctgtgtgtgagggcgtgtccaagctggaggagagcagcaaggccaccccagctgagatggacctggcccacaacagccagagcatgcacgccagcagcgccagcaagtctgtgctggaggtgacccagaaggccacccccaaccccagcctgctggccgctgaggaccaggtgccctgtgagaagtgtggcagcctggtgcctgtgtgggacatgcctgagcacatggactaccactttgccctggagctgcagaagagcttcctgcagccccacagcagcaacccccaggtggtgtctgctgtgagccaccagggcaagaggaaccccaagagccccctggcctgcaccaacaagaggcccaggcctgagggcatgcagaccctggagagcttcttcaagcccctgacccactag

SEQ ID NO: 164653 - DNA, 219 bp, Artificial Sequence
  Description of Artificial Sequence: Synthetic coding sequence
atgtgggcagatgatgccaagaagctgtgcccagacctgctgctggcccaggtgcgggagagccggggcaaggccaacctgaccaagtaccgggaggcctctgtggaggtgatggagatcatgagcagatttgctgtgattgagcgggccagcattgatgaggcctacgtggacctgaccagcgctgtgcaggagcggctgcagaagctgcagggctag

SEQ ID NO: 164654 - DNA, 1956 bp, Artificial Sequence
  Description of Artificial Sequence: Synthetic coding sequence
atgtgggcagatgatgccaagaagctgtgcccagacctgctgctggcccaggtgcgggagagccggggcaaggccaacctgaccaagtaccgggaggcctctgtggaggtgatggagatcatgagcagatttgctgtgattgagcgggccagcattgatgaggcctacgtggacctgaccagcgctgtgcaggagcggctgcagaagctgcagggccagcccatctctgctgacctgctgcccagcacctacatcgagggcctgccccagggccccaccacagctgaggagaccgtgcagaaggagggcatgaggaagcagggcctcttccagtggctggacagcctgcagattgacaacctgaccagcccagacctgcagctgactgtgggcgccgtcatcgtggaggagatgagagctgccatcgagcgggagaccggcttccagtgcagcgctggcatcagccacaacaaggtgctggccaagctggcctgtggcctgaacaagcccaaccggcagaccctggtgagccacggctctgtgccccagctgttcagccagatgcccatcaggaagatccgcagcctgggcggcaagctgggcgcctctgtgattgagatcctgggcatcgagtacatgggagagctgacccagttcacagagagccagctgcagagccactttggagagaagaatggctcctggctgtatgccatgtgccggggcattgaacatgaccctgtgaagccccggcagctgcccaagaccatcggctgcagcaagaacttccctgggaagacagccctggccacccgggagcaggtgcagtggtggctgctgcagctggcccaggagctggaggagcggctgaccaaggacagaaatgacaatgacagagtggccacccagctggtggtgtccatccgggtgcagggcgacaagaggctgagcagcctgcggcgctgctgtgccctgaccaggtatgatgcccacaagatgagccatgatgccttcaccgtcatcaagaactgcaacaccagcggcatccagacagagtggagcccccccctgaccatgctgttcctgtgtgccaccaagttcagcgccagcgcccccagcagcagcacagacatcaccagcttcctgagcagtgaccccagcagcctgcccaaggtgcctgtgaccagcagcgaggccaagacccagggcagcggccctgctgtgacagccaccaagaaggccaccaccagcctggagagcttcttccagaaggctgctgagcggcagaaggtgaaggaggccagcctgagcagcctgacagcccccacccaggcccccatgagcaacagccccagcaagcccagcctgcccttccagaccagccagagcactggaacagagcccttcttcaagcagaagagcctgctgctgaagcagaagcagctgaacaacagctctgtgagcagcccccagcagaacccctggagcaactgcaaggccctgcccaacagcctgcccacagagtacccaggctgtgtgcctgtgtgtgagggcgtgtccaagctggaggagagcagcaaggccaccccagctgagatggacctggcccacaacagccagagcatgcacgccagcagcgccagcaagtctgtgctggaggtgacccagaaggccacccccaaccccagcctgctggccgctgaggaccaggtgccctgtgagaagtgtggcagcctggtgcctgtgtgggacatgcctgagcacatggactaccactttgccctggagctgcagaagagcttcctgcagccccacagcagcaacccccaggtggtgtctgctgtgagccaccagggcaagaggaaccccaagagccccctggcctgcaccaacaagaggcccaggcctgagggcatgcagaccctggagagcttcttcaagcccctgacccactag

SEQ ID NO: 164655 - DNA, 3720 bp, Artificial Sequence
  Description of Artificial Sequence: Synthetic coding sequence
atgagccggctgctgtggaggaaggtggccggggccaccgtgggccctggccctgtgcctgcccctggccgctgggtgagcagctctgtgcctgccagtgaccccagtgatggccagaggcggcggcagcagcagcagcagcagcagcagcagcagcagcagcagccccagcagccccaggtgctgagcagcgagggcggccagctgcggcacaaccccctggacatccagatgctgagccggggcctgcacgagcagatcttcggccagggcggggagatgcctggagaggccgctgtgagaagatctgtggagcacctgcagaagcacggcctgtggggccagcctgctgtgcccctgcctgatgtggagctgcggctgccccccctgtatggagacaacctggaccagcacttccggctgctggcccagaagcagagcctgccctacctggaggccgccaacctgctgctgcaggcccagctgccccccaagcccccagcctgggcctgggccgagggctggaccaggtatggccctgagggggaggccgtgcctgtggccatccctgaggagcgggccctggtgtttgatgtggaggtgtgcctggccgagggcacctgccccaccctggccgtggccatcagccccagcgcctggtacagctggtgcagccagaggctggtggaggagcgctacagctggaccagccagctgagccctgctgacctgatccccctggaggtgcccactggagccagcagccccacccagagggactggcaggagcagctggtggtgggccacaacgtgtcctttgaccgggcccacatccgggagcagtacctgatccagggcagcaggatgaggttcctggacaccatgtccatgcacatggccatcagcggcctgagcagcttccagaggagcctgtggattgctgccaagcagggcaagcacaaggtgcagccccccaccaagcagggccagaagagccagaggaaggcccggcggggccctgccatcagctcctgggactggctggacatcagctctgtgaacagcctggccgaggtgcaccggctgtatgtgggcggcccccccctggagaaggagccccgggagctgtttgtgaagggcaccatgaaggacatccgggagaacttccaggacctgatgcagtactgtgcccaggatgtgtgggccacccatgaggtgttccagcagcagctgcccctcttcctggagcgctgcccccaccctgtgaccctggccggcatgctggagatgggcgtgtcctacctgcctgtgaaccagaactgggagcgctacctggccgaggcccagggcacctatgaggagctgcagcgggagatgaagaagagcctgatggacctggccaatgatgcctgccagctgctgtctggagagcgctacaaggaggacccctggctgtgggacctggagtgggacctgcaggagttcaagcagaagaaggccaagaaggtgaagaaggagcccgccacagccagcaagctgcccattgaaggagctggggcccctggggaccccatggaccaggaggacctgggcccctgcagcgaggaggaggagttccagcaggatgtgatggcccgggcctgcctgcagaagctgaagggcaccacagagctgctgcccaagaggccccagcacctgcccggccaccctggctggtacaggaagctgtgcccccggctggatgatcctgcctggaccccaggccccagcctgctgagcctgcagatgagggtgacccccaagctgatggccctgacctgggatggcttccccctgcactacagcgagcggcacggctggggctacctggtgcctggaagaagagacaacctggccaagctgcccaccggcaccaccctggagagcgctggggtggtgtgcccctaccgggccatcgagagcctgtacaggaagcactgcctggagcagggcaagcagcagctgatgccccaggaggccggcctggccgaggagttcctgctgacagacaacagcgccatctggcagacagtggaggagctggactacctggaggtggaggccgaggccaagatggagaacctgcgggctgctgtgcccggccagcccctggccctgacagcccggggcggccccaaggacacccagcccagctaccaccacggcaatggcccctacaatgatgtggacatccctggctgctggttcttcaagctgccccacaaggatggcaacagctgcaatgtgggcagcccctttgccaaggacttcctgcccaagatggaggatggcaccctgcaggccggccctggaggagccagcggcccccgggccctggagatcaacaagatgatctccttctggagaaatgcccacaagaggatcagcagccagatggtggtgtggctgcccaggtctgccctgccccgggccgtcatccgccacccagactatgatgaggagggcctgtatggagccatcctgccccaggtggtgacagctggcaccatcacccggcgggctgtggagcccacctggctgacagccagcaatgcccggccagacagagtgggcagcgagctgaaggccatggtgcaggcccctcctggctacaccctggtgggcgcagatgtggacagccaggagctgtggattgctgctgtgctgggagatgcccactttgctggcatgcacggctgcacagccttcggctggatgaccctgcagggcaggaagagccggggcacagacctgcacagcaagacagccaccaccgtgggcatcagccgggagcacgccaagatcttcaactacggccgcatctatggagctggccagccctttgctgagcggctgctgatgcagttcaaccaccggctgacccagcaggaggccgctgagaaggcccagcagatgtatgctgccaccaagggcctgcgctggtaccgcctgagtgatgaaggagagtggctggtgcgggagctgaacctgcctgtggacagaacagaaggaggctggatcagcctgcaggacctgaggaaggtgcagcgggagacagccaggaagagccagtggaagaagtgggaggtggtggccgagcgggcctggaagggcggcacagaaagtgagatgttcaacaagctggagagcatcgccaccagtgacatccccaggacccctgtgctgggctgctgcatcagccgggccctggagcccagcgctgtgcaggaggagttcatgaccagccgggtgaactgggtggtgcagagcagcgctgtggactacctgcacctgatgctggtggccatgaagtggctgtttgaggagtttgccattgatggccgcttctgcatcagcatccatgatgaggtgcgctacctggtgcgggaggaggaccgctacagagctgccctggccctgcagatcaccaacctgctgacccgctgcatgtttgcctacaagctgggcctgaatgacctgccccagagcgtggccttcttctctgctgtggacatcgaccgctgcctgaggaaggaggtgaccatggactgcaagacccccagcaaccccaccggcatggagcggcgctatggcatcccccagggcgaggccctggacatctaccagatcatcgagctgaccaagggcagcctggagaagaggagccagcccggcccctag

SEQ ID NO: 164656 - DNA, 3720 bp, Artificial Sequence; identical to SEQ ID NO: 164655
  Description of Artificial Sequence: Synthetic coding sequence

SEQ ID NO: 164657 - DNA, 1458 bp, Artificial Sequence
  Description of Artificial Sequence: Synthetic coding sequence
atgaggagccgggtggccgtgcgggcctgccacaaggtgtgccgctgcctgctgagcggctttggaggccgggtggatgctggccagcctgagctgctgacagagaggagcagccccaagggcggccacgtgaagagccacgccgagctggagggcaatggagagcaccctgaggcccctggcagcggggagggcagcgaggccctgctggagatctgccagaggaggcacttcctgagcggcagcaagcagcagctgagccgggacagcctgctgagcggctgccaccctggcttcggccccctgggcgtggagctgaggaagaacctggccgctgagtggtggacctctgtggtggtgttccgggagcaggtgtttcctgtggatgccctgcaccacaagccaggccccctgctgcccggggacagcgccttccggctggtgtctgctgagaccctgcgggagatcctgcaggacaaggagctgagcaaggagcagctggtggccttcctggagaatgtgctgaagaccagcggcaagctgcgggagaacctgctgcatggagccctggagcactacgtgaactgcctggacctggtgaacaagaggctgccctacggcctggcccagattggagtgtgcttccaccctgtgtttgacaccaagcagatcagaaatggagtgaagagcattggagagaagacagaggccagcctggtgtggttcaccccacccaggaccagcaaccagtggctggacttctggctgcggcaccggctgcagtggtggaggaagtttgccatgagccccagcaacttcagcagcagtgactgccaggatgaggagggcaggaaaggaaacaagctgtactacaacttcccctggggcaaggagctgattgagaccctgtggaacctgggggaccacgagctgctgcacatgtacccaggaaatgtgtccaagctgcacggcagagatggcaggaagaatgtggtgccctgtgtgctgtctgtgaatggagacctggaccggggcatgctggcctacctgtatgacagcttccagctgacagagaacagcttcaccaggaagaagaacctgcacaggaaggtgctgaagctgcacccctgcctggcccccatcaaggtggccctggatgtgggccggggccccaccctggagctgcggcaggtgtgccagggcctcttcaatgagctgctggagaatggcatctctgtgtggccaggctacctggagaccatgcagagcagcctggagcagctgtacagcaaatatgatgagatgagcatcctcttcaccgtgctggtgacagagaccaccctggagaatggcctcatccacctgcggagccgggacaccaccatgaaggagatgatgcacatcagcaagctgaaggacttcctgatcaagtacatcagcagcgccaagaatgtgtag

SEQ ID NO: 164658 - DNA, 7773 bp, Artificial Sequence
  Description of Artificial Sequence: Synthetic coding sequence
atgaacctgctgcggcgcagcggcaagagaagaagaagtgaaagtggcagtgacagcttcagcggcagcggcggggacagcagcgccagcccccagttcctgagcggctctgtgctgagccccccacctggcctgggccgctgcctgaaggctgctgctgctggggagtgcaagcccaccgtgcctgactatgaaagagacaagctgctgctggccaactggggcctgcccaaggctgtgctggagaagtaccacagctttggagtgaagaagatgtttgagtggcaggccgagtgcctgctgctgggccaggtgctggagggcaagaacctggtgtacagcgcccccaccagcgctgggaagaccctggtggccgagctgctgatcctgaagagggtgctggagatgaggaagaaggccctcttcatcctgccctttgtgtctgtggccaaggagaagaagtactacctgcagagcctcttccaggaggtgggcatcaaggtggatggctacatgggcagcaccagccccagccgccacttcagcagcctggacattgctgtgtgcaccatcgagcgggccaacggcctcatcaacagactcatcgaggagaacaagatggacctgctgggcatggtggtggtggatgagctgcacatgctgggggacagccaccggggctacctgctggagctgctgctgaccaagatctgctacatcaccaggaagagcgccagctgccaggccgacctggccagcagcctgagcaatgctgtgcagatcgtgggcatgtctgccaccctgcccaacctggagctggtggcctcctggctgaatgctgagctgtaccacacagacttccggcctgtgcccctgctggagagcgtgaaggtgggcaacagcatctatgacagctccatgaagctggtgcgggagtttgagcccatgctgcaggtgaagggagatgaagatcatgtggtgtccctgtgctatgagaccatctgtgacaaccacagcgtgctgctcttctgccccagcaagaagtggtgtgagaagctggccgacatcatcgcccgggagttctacaacctgcaccaccaggccgagggcctggtgaagcccagcgagtgcccccctgtgatcctggagcagaaggagctgctggaggtgatggaccagctgcggcggctgcccagcggcctggacagcgtgctgcagaagacagtgccctggggcgtggccttccaccacgccggcctgacctttgaggagcgggacatcatcgagggcgccttccggcagggcctcatccgggtgctggccgccaccagcaccctgagcagcggcgtgaacctgcctgcccggcgggtcatcatccgcacccccatctttggaggccggcccctggacatcctgacctacaagcagatggtgggccgggccggcaggaagggcgtggacacagtgggggagagcatcctgatctgcaagaacagcgagaagagcaaaggaattgccctgctgcagggcagcctgaagcctgtgcgcagctgcctgcagaggcgggagggggaggaggtgacaggctccatgatccgggccatcctggagatcatcgtgggcggcgtggccagcaccagccaggacatgcacacctacgccgcctgcaccttcctggccgcctccatgaaggagggcaagcagggcatccagaggaaccaggagagcgtgcagctgggcgccatcgaggcctgtgtgatgtggctgctggagaatgagttcatccagagcacagaggccagtgatggaacagagggcaaggtgtaccaccccacccacctgggcagcgccaccctgagcagcagcctgagccctgctgacaccctggacatctttgctgacctgcagagggccatgaagggctttgtgctggagaatgacctgcacatcctgtacctggtgacccccatgtttgaggactggaccaccatcgactggtaccgcttcttctgcctgtgggagaagctgcccacctccatgaagagggtggccgagctggtgggcgtggaggagggcttcctggcccgctgtgtgaagggcaaggtggtggccaggacagagcggcagcaccggcagatggccatccacaagcgcttcttcaccagcctggtgctgctggacctgatcagcgaggtgcccctgcgggagatcaaccagaagtatggctgcaacagaggccagatccagagcctgcagcagagcgctgctgtgtatgccggcatgatcaccgtcttcagcaaccggctgggctggcacaacatggagctgctgctgagccagttccagaagaggctgaccttcggcatccagcgggagctgtgtgacctggtgcgggtgtccctgctgaatgcccagagggcccgggtgctgtatgccagcggcttccacacagtggccgacctggcccgggccaacatcgtggaggtggaggtgatcctgaagaatgctgtgcccttcaagagcgccaggaaggctgtggatgaggaggaggaggccgtggaggagaggaggaacatgaggaccatctgggtgactggaaggaagggcctgacagagcgggaggccgccgccctgattgtggaggaggccaggatgatcctgcagcaggacctggtggagatgggcgtgcagtggaacccctgtgccctgctgcacagcagcacctgcagcctgacccacagcgagagcgaggtgaaggagcacaccttcatcagccagaccaagagcagctacaagaagctgaccagcaagaacaagagcaacaccatcttcagtgacagctacatcaagcacagccccaacatcgtgcaggacctgaacaagagccgggagcacaccagcagcttcaactgcaacttccagaatggaaaccaggagcaccagacctgcagcatcttccgggccaggaagagggccagcctggacatcaacaaggagaagccaggggccagccagaatgaaggcaagaccagtgacaagaaggtggtgcagaccttcagccagaagaccaagaaggcccccctgaacttcaacagcgagaagatgagccgctccttccgctcctggaagaggaggaagcacctgaagaggagccgggacagcagccccctgaaggacagcggggcctgccgcatccacctgcagggccagaccctgagcaaccccagcctgtgtgaggaccccttcaccctggatgagaagaagacagagttcaggaacagcggcccctttgccaagaatgtgtccctgagcggcaaggagaaggacaacaagaccagcttccccctgcagatcaagcagaactgctcctggaacatcaccctgaccaatgacaactttgtggagcacatcgtgacaggcagccagagcaagaatgtgacctgccaggccacctctgtggtgtctgagaagggccggggcgtggccgtggaggccgagaagatcaatgaggtgctgatccagaatggcagcaagaaccagaatgtgtacatgaagcaccacgacatccaccccatcaaccagtacctgaggaagcagagccatgagcagaccagcaccatcaccaagcagaagaacatcatcgagcggcagatgccctgtgaggccgtgtcctcctacatcaacagagacagcaatgtgaccatcaactgtgagcgcatcaagctgaacacagaggagaacaagcccagccacttccaggccctgggagatgacatcagcaggacagtcatccccagcgaggtgctgcccagcgctggggccttcagcaagtctgagggccagcacgagaacttcctgaacatcagccggctgcaggagaagacaggcacctacaccaccaacaagaccaagaacaaccacgtgtctgacctgggcctggtgctgtgtgactttgaagattccttctacctggacacccagagcgagaagatcatccagcagatggccacagaaaatgccaagctgggcgccaaggacaccaacctggccgccggcatcatgcagaagagcctggtgcagcagaacagcatgaacagcttccagaaggagtgccacatccccttccctgctgagcagcaccccctgggcgccaccaagattgaccacctggacctgaagacagtgggcaccatgaagcagagcagtgacagccatggagtggacatcctgaccccagagagccccatcttccacagccccatcctgctggaggagaatggcctcttcctgaagaagaatgaggtgtctgtgacagacagccagctgaacagcttcctgcagggctaccagacccaggagaccgtgaagcctgtgatcctgctgatcccccagaagaggacccccactggagtggagggggagtgcctgcctgtgcctgagaccagcctgaacatgtctgacagcctgctgtttgacagcttcagtgatgactacctggtgaaggagcagctgcctgacatgcagatgaaggagcccctgcccagcgaggtgaccagcaaccacttcagtgacagcctgtgcctgcaggaggacctgatcaagaagagcaatgtgaatgaaaaccaggacacccaccagcagctgacctgcagcaatgatgagagcatcatcttcagcgagatggattctgtgcagatggtggaggccctggacaacgtggacatcttccctgtgcaggagaagaaccacacagtggtgagcccccgggccctggagctgagtgaccctgtgctggatgagcaccaccagggcgaccaggatggaggagaccaggatgaaagagctgagaagagcaagctgaccggcacccggcagaaccacagcttcatctggagcggggccagctttgacctgagccctggcctgcagaggatcctggacaaggtgagcagccccctggagaatgagaagctgaagtccatgaccatcaacttcagcagcctgaacaggaagaacacagagctgaatgaggagcaggaggtgatcagcaacctggagaccaagcaggtgcagggcatctccttcagcagcaacaatgaggtgaagagcaagattgagatgctggagaacaatgccaaccatgatgagaccagcagcctgctgcccaggaaggagagcaacatcgtggatgacaatggcctcatcccccccacccccatccccaccagcgccagcaagctgaccttccctggcatcctggagacccctgtgaacccctggaagaccaacaacgtgctgcagcccggggagagctacctgtttggcagccccagcgacatcaagaaccacgacctgagccctggcagcagaaatggcttcaaggacaacagccccatcagtgacaccagcttcagcctgcagctgagccaggacggcctgcagctgaccccagccagcagcagcagcgagagcctgagcatcattgatgtggccagtgaccagaacctcttccagaccttcatcaaggagtggcgctgcaagaagcgcttcagcatcagcctggcctgtgagaagatccgcagcctgaccagcagcaagacagccaccatcggcagccgcttcaagcaggccagcagcccccaggagatccccatcagagatgatggcttccccatcaagggctgtgatgacaccctggtggtgggcctggccgtgtgctggggcggcagagatgcctactacttcagcctgcagaaggagcagaagcacagcgagatcagcgccagcctggtgccccccagcctggaccccagcctgaccctgaaggacaggatgtggtacctgcagagctgcctgaggaaggagagtgacaaggaatgttctgtggtgatctatgacttcatccagagctacaagatcctgctgctgagctgtggcatcagcctggagcagagctatgaggaccccaaggtggcctgctggctgctggaccctgacagccaggagcccaccctgcacagcatcgtgaccagcttcctgccccatgagctgcccctgctggagggcatggagaccagccagggcatccagagcctgggcctgaatgccggcagcgagcacagcggccgctaccgggcctctgtggagagcatcctgatcttcaacagcatgaaccagctgaacagcctgctgcagaaggagaacctgcaggatgtgttcaggaaggtggagatgcccagccagtactgcctggccctgctggagctgaatggcatcggcttcagcacagcagaatgtgagagccagaagcacatcatgcaggccaagctggatgccatcgagacccaggcctaccagctggccggccacagcttctccttcaccagcagtgatgacattgctgaggtgctcttcctggagctgaagctgccccccaaccgggagatgaagaaccagggcagcaagaagaccctgggcagcacccggcggggcatcgacaatggaaggaagctgcggctgggccggcagttcagcaccagcaaggatgtgctgaacaagctgaaggccctgcaccccctgcccggcctcatcctggagtggaggcgcatcaccaatgccatcaccaaggtggtgttccccctgcagcgggagaagtgcctgaaccccttcctgggcatggagcgcatctaccctgtgtcccagagccacacagccaccggccgcatcaccttcacagagcccaacatccagaatgtgccccgggactttgagatcaagatgcccaccctggtgggggagagcccccccagccaggccgtgggcaagggcctgctgcccatgggccggggcaagtacaagaagggcttctctgtgaacccccgctgccaggcccagatggaggagagagctgctgaccggggcatgcccttcagcatctccatgagacatgcctttgtgcccttccctgggggcagcatcctggccgctgactacagccagctggagctgcgcatcctggcccacctgagccatgaccggcggctcatccaggtgctgaacacaggagcagatgtgttccgcagcattgctgctgagtggaagatgattgagcctgagagcgtgggagatgacctgcggcagcaggccaagcagatctgctacggcatcatctacggcatgggcgccaagagcctgggggagcagatgggcatcaaggaaaatgatgctgcctgctacatcgacagcttcaagagccgctacacaggcatcaaccagttcatgacagagaccgtgaagaactgcaagagagatggctttgtgcagaccatcctgggcagaagacgctacctgcccggcatcaaggacaacaacccctacaggaaggcccacgccgagcggcaggccatcaacaccatcgtgcagggcagcgctgctgacatcgtgaagatcgccaccgtgaacatccagaagcagctggagaccttccacagcaccttcaagagccacggccaccgggagggcatgctgcagagcgaccagacaggcctgagcaggaagaggaagctgcagggcatgttctgccccatccggggcggcttcttcatcctgcagctgcatgatgagctgctgtatgaggtggccgaggaggatgtggtgcaggtggcccagatcgtgaagaatgagatggagagcgctgtgaagctgtctgtgaagctgaaggtgaaggtgaagatcggggcctcctggggcgagctgaaggactttgatgtgtag

SEQ ID NO: 164659 - DNA, 8181 bp, Artificial Sequence
  Description of Artificial Sequence: Synthetic coding sequence
atgaatggccaccgcttcaccttccgcaccaggagcctgctgcccctgcagaagggccagcaccgctgcatcaccaagctgctggcccacaatgacccctggggcatcttccgggcccccagcagcagaagaagctacagcgtgtctggagtgtgccagcctgccatccccaacagcagcctgcacatcccccacaatgcctgctggctgaagtggaagctgtgcagcgagatcgccctgccctaccaccacatcctgggggagaggaggaagctgtgcagcatccgccgctttgaatttgaggactggagagaagatgtgcgcagctgctgccaggcccgggtgctgccccggggccgcaccctgggcctgtggctggccctgattggccgggaggagtttgccatgaacctgctgcggcgcagcggcaagagaagaagaagtgagagcggcagtgacagcttcagcggcagcggcggggacagcagcgccagcccccagttcctgagcggctctgtgctgagccccccacctggcctgggccgctgcctgaaggctgctgctgctggggagtgcaagcccaccgtgcctgactatgagcgggacaagctgctgctggccaactggggcctgcccaaggctgtgctggagaagtaccacagctttggagtgaagaagatgtttgagtggcaggctgaatgtctgctgctgggccaggtgctggagggcaagaacctggtgtacagcgcccccaccagcgctgggaagaccctggtggccgagctgctgatcctgaagagggtgctggagatgaggaagaaggccctcttcatcctgccctttgtgtctgtggccaaggagaagaagtactacctgcagagcctcttccaggaggtgggcatcaaggtggatggctacatgggcagcaccagccccagccgccacttcagcagcctggacattgctgtgtgcaccatcgagcgggccaacggcctcatcaaccggctgattgaggagaacaagatggacctgctgggcatggtggtggtggatgagctgcacatgctgggggacagccaccggggctacctgctggagctgctgctgaccaagatctgctacatcaccaggaagagcgccagctgccaggccgacctggccagcagcctgagcaatgctgtgcagatcgtgggcatgtctgccaccctgcccaacctggagctggtggcctcctggctgaatgctgagctgtaccacacagacttccggcctgtgcccctgctggagagcgtgaaggtgggcaacagcatctatgacagctccatgaagctggtgcgggagtttgagcccatgctgcaggtgaagggagatgaggaccacgtggtgtccctgtgctatgagaccatctgtgacaaccacagcgtgctgctcttctgccccagcaagaagtggtgtgagaagctggccgacatcatcgcccgggagttctacaacctgcaccaccaggccgagggggagggcctggtgaagcccagtgaatgtcctcctgtgatcctggagcagaaggagctgctggaggtgatggaccagctgcggcggctgcccagcggcctggacagcgtgctgcagaagacagtgccctggggcgtggccttccaccacgccggcctgacctttgaggagcgggacatcattgaaggagccttccggcagggcctcatccgggtgctggccgccaccagcaccctgagcagtggagtgaacctgcctgcccggcgggtcatcatccgcacccccatctttggaggccggcccctggacatcctgacctacaagcagatggtgggccgggccggcaggaaaggagtggacacagtggagagcatcctgatctgcaagaacagcgagaagagcaaaggaattgccctgctgcagggcagcctgaagcctgtgcgcagctgcctgcagaggcgggagggggaggaggtgacaggctccatgatccgggccatcctggagatcatcgtgggcggcgtggccagcaccagccaggacatgcacacctacgccgcctgcaccttcctggccgcctccatgaaggagggcaagcagggcatccagaggaaccaggagagcgtgcagctgggcgccatcgaggcctgtgtgatgtggctgctggagaatgagttcatccagagcacagaggccagtgatggaacagagggcaaggtgtaccaccccacccacctgggcagcgccaccctgagcagcagcctgagccctgctgacaccctggacatctttgctgacctgcagagggccatgaagggctttgtgctggagaatgacctgcacatcctgtacctggtgacccccatgtttgaggactggaccaccatcgactggtaccgcttcttctgcctgtgggagaagctgcccacctccatgaagagggtggccgagctggtgggcgtggaggagggcttcctggcccgctgtgtgaagggcaaggtggtggccaggacagagcggcagcaccggcagatggccatccacaagcgcttcttcaccagcctggtgctgctggacctgatcagcgaggtgcccctgcgggagatcaaccagaagtatggctgcaacagaggccagatccagagcctgcagcagagcgctgctgtgtatgccggcatgatcaccgtcttcagcaaccggctgggctggcacaacatggagctgctgctgagccagttccagaagaggctgaccttcggcatccagcgggagctgtgtgacctggtgcgggtgtccctgctgaatgcccagagggcccgggtgctgtatgccagcggcttccacacagtggccgacctggcccgggccaacatcgtggaggtggaggtgatcctgaagaatgctgtgcccttcaagagcgccaggaaggctgtggatgaggaggaggaggccgtggaggagaggaggaacatgaggaccatctgggtgactggaaggaagggcctgacagagcgggaggccgccgccctgattgtggaggaggccaggatgatcctgcagcaggacctggtggagatgggcgtgcagtggaacccctgtgccctgctgcacagcagcacctgcagcctgacccacagcgagagcgaggtgaaggagcacaccttcatcagccagaccaagagcagctacaagaagctgaccagcaagaacaagagcaacaccatcttcagtgacagctacatcaagcacagccccaacatcgtgcaggacctgaacaagagccgggagcacaccagcagcttcaactgcaacttccagaatggaaaccaggagcaccagacctgcagcatcttccgggccaggaagagggccagcctggacatcaacaaggagaagccaggggccagccagaatgaaggcaagaccagtgacaagaaggtggtgcagaccttcagccagaagaccaagaaggcccccctgaacttcaacagcgagaagatgagccgctccttccgctcctggaagaggaggaagcacctgaagaggagccgggacagcagccccctgaaggacagcggggcctgccgcatccacctgcagggccagaccctgagcaaccccagcctgtgtgaggaccccttcaccctggatgagaagaagacagagttcaggaacagcggcccctttgccaagaatgtgtccctgagcggcaaggagaaggacaacaagaccagcttccccctgcagatcaagcagaactgctcctggaacatcaccctgaccaatgacaactttgtggagcacatcgtgacaggcagccagagcaagaatgtgacctgccaggccacctctgtggtgtctgagaagggccggggcgtggccgtggaggccgagaagatcaatgaggtgctgatccagaatggcagcaagaaccagaatgtgtacatgaagcaccacgacatccaccccatcaaccagtacctgaggaagcagagccatgagcagaccagcaccatcaccaagcagaagaacatcatcgagcggcagatgccctgtgaggccgtgtcctcctacatcaacagagacagcaatgtgaccatcaactgtgagcgcatcaagctgaacacagaggagaacaagcccagccacttccaggccctgggagatgacatcagcaggacagtcatccccagcgaggtgctgcccagcgctggggccttcagcaagtctgagggccagcacgagaacttcctgaacatcagccggctgcaggagaagacaggcacctacaccaccaacaagaccaagaacaaccacgtgtctgacctgggcctggtgctgtgtgactttgaagattccttctacctggacacccagagcgagaagatcatccagcagatggccacagaaaatgccaagctgggcgccaaggacaccaacctggccgccggcatcatgcagaagagcctggtgcagcagaacagcatgaacagcttccagaaggagtgccacatccccttccctgctgagcagcaccccctgggcgccaccaagattgaccacctggacctgaagacagtgggcaccatgaagcagagcagtgacagccatggagtggacatcctgaccccagagagccccatcttccacagccccatcctgctggaggagaatggcctcttcctgaagaagaatgaggtgtctgtgacagacagccagctgaacagcttcctgcagggctaccagacccaggagaccgtgaagcctgtgatcctgctgatcccccagaagaggacccccactggagtggagggggagtgcctgcctgtgcctgagaccagcctgaacatgtctgacagcctgctgtttgacagcttcagtgatgactacctggtgaaggagcagctgcctgacatgcagatgaaggagcccctgcccagcgaggtgaccagcaaccacttcagtgacagcctgtgcctgcaggaggacctgatcaagaagagcaatgtgaatgaaaaccaggacacccaccagcagctgacctgcagcaatgatgagagcatcatcttcagcgagatggattctgtgcagatggtggaggccctggacaacgtggacatcttccctgtgcaggagaagaaccacacagtggtgagcccccgggccctggagctgagtgaccctgtgctggatgagcaccaccagggcgaccaggatggaggagaccaggatgaaagagctgagaagagcaagctgaccggcacccggcagaaccacagcttcatctggagcggggccagctttgacctgagccctggcctgcagaggatcctggacaaggtgagcagccccctggagaatgagaagctgaagtccatgaccatcaacttcagcagcctgaacaggaagaacacagagctgaatgaggagcaggaggtgatcagcaacctggagaccaagcaggtgcagggcatctccttcagcagcaacaatgaggtgaagagcaagattgagatgctggagaacaatgccaaccatgatgagaccagcagcctgctgcccaggaaggagagcaacatcgtggatgacaatggcctcatcccccccacccccatccccaccagcgccagcaagctgaccttccctggcatcctggagacccctgtgaacccctggaagaccaacaacgtgctgcagcccggggagagctacctgtttggcagccccagcgacatcaagaaccacgacctgagccctggcagcagaaatggcttcaaggacaacagccccatcagtgacaccagcttcagcctgcagctgagccaggacggcctgcagctgaccccagccagcagcagcagcgagagcctgagcatcattgatgtggccagtgaccagaacctcttccagaccttcatcaaggagtggcgctgcaagaagcgcttcagcatcagcctggcctgtgagaagatccgcagcctgaccagcagcaagacagccaccatcggcagccgcttcaagcaggccagcagcccccaggagatccccatcagagatgatggcttccccatcaagggctgtgatgacaccctggtggtgggcctggccgtgtgctggggcggcagagatgcctactacttcagcctgcagaaggagcagaagcacagcgagatcagcgccagcctggtgccccccagcctggaccccagcctgaccctgaaggacaggatgtggtacctgcagagctgcctgaggaaggagagtgacaaggaatgttctgtggtgatctatgacttcatccagagctacaagatcctgctgctgagctgtggcatcagcctggagcagagctatgaggaccccaaggtggcctgctggctgctggaccctgacagccaggagcccaccctgcacagcatcgtgaccagcttcctgccccatgagctgcccctgctggagggcatggagaccagccagggcatccagagcctgggcctgaatgccggcagcgagcacagcggccgctaccgggcctctgtggagagcatcctgatcttcaacagcatgaaccagctgaacagcctgctgcagaaggagaacctgcaggatgtgttcaggaaggtggagatgcccagccagtactgcctggccctgctggagctgaatggcatcggcttcagcacagcagaatgtgagagccagaagcacatcatgcaggccaagctggatgccatcgagacccaggcctaccagctggccggccacagcttctccttcaccagcagtgatgacattgctgaggtgctcttcctggagctgaagctgccccccaaccgggagatgaagaaccagggcagcaagaagaccctgggcagcacccggcggggcatcgacaatggaaggaagctgcggctgggccggcagttcagcaccagcaaggatgtgctgaacaagctgaaggccctgcaccccctgcccggcctcatcctggagtggaggcgcatcaccaatgccatcaccaaggtggtgttccccctgcagcgggagaagtgcctgaaccccttcctgggcatggagcgcatctaccctgtgtcccagagccacacagccaccggccgcatcaccttcacagagcccaacatccagaatgtgccccgggactttgagatcaagatgcccaccctggtgggggagagcccccccagccaggccgtgggcaagggcctgctgcccatgggccggggcaagtacaagaagggcttctctgtgaacccccgctgccaggcccagatggaggagagagctgctgaccggggcatgcccttcagcatctccatgagacatgcctttgtgcccttccctgggggcagcatcctggccgctgactacagccagctggagctgcgcatcctggcccacctgagccatgaccggcggctcatccaggtgctgaacacaggagcagatgtgttccgcagcattgctgctgagtggaagatgattgagcctgagagcgtgggagatgacctgcggcagcaggccaagcagatctgctacggcatcatctacggcatgggcgccaagagcctgggggagcagatgggcatcaaggaaaatgatgctgcctgctacatcgacagcttcaagagccgctacacaggcatcaaccagttcatgacagagaccgtgaagaactgcaagagagatggctttgtgcagaccatcctgggcagaagacgctacctgcccggcatcaaggacaacaacccctacaggaaggcccacgccgagcggcaggccatcaacaccatcgtgcagggcagcgctgctgacatcgtgaagatcgccaccgtgaacatccagaagcagctggagaccttccacagcaccttcaagagccacggccaccgggagggcatgctgcagagcgaccagacaggcctgagcaggaagaggaagctgcagggcatgttctgccccatccggggcggcttcttcatcctgcagctgcatgatgagctgctgtatgaggtggccgaggaggatgtggtgcaggtggcccagatcgtgaagaatgagatggagagcgctgtgaagctgtctgtgaagctgaaggtgaaggtgaagatcggggcctcctggggcgagctgaaggactttgatgtgtag

SEQ ID NO: 164660 - DNA, 6642 bp, Artificial Sequence
  Description of Artificial Sequence: Synthetic coding sequence
atgcccaccagcaacagccagaaggagctgctggaggtgatggaccagctgcggcggctgcccagcggcctggacagcgtgctgcagaagacagtgccctggggcgtggccttccaccacgccggcctgacctttgaggagcgggacatcattgaaggagccttccggcagggcctcatccgggtgctggccgccaccagcaccctgagcagtggagtgaacctgcctgcccggcgggtcatcatccgcacccccatctttggaggccggcccctggacatcctgacctacaagcagatggtgggccgggccggcaggaaaggagtggacacagtgggggagagcatcctgatctgcaagaacagcgagaagagcaagggcatcgccctgctgcagggcagcctgaagcctgtgcgcagctgcctgcagaggcgggagggggaggaggtgacaggctccatgatccgggccatcctggagatcatcgtgggcggcgtggccagcaccagccaggacatgcacacctatgctgcctgcaccttcctggccgcctccatgaaggagggcaagcagggcatccagaggaaccaggagagcgtgcagctgggcgccatcgaggcctgtgtgatgtggctgctggagaatgagttcatccagagcacagaggccagtgatggaacagagggcaaggtgtaccaccccacccacctgggcagcgccaccctgagcagcagcctgagccctgctgacaccctggacatctttgctgacctgcagagggccatgaagggctttgtgctggagaatgacctgcacatcctgtacctggtgacccccatgtttgaggactggaccaccatcgactggtaccgcttcttctgcctgtgggagaagctgcccacctccatgaagagggtggccgagctggtgggcgtggaggagggcttcctggcccgctgtgtgaagggcaaggtggtggccaggacagagcggcagcaccggcagatggccatccacaagcgcttcttcaccagcctggtgctgctggacctgatcagcgaggtgcccctgcgggagatcaaccagaagtatggctgcaacagaggccagatccagagcctgcagcagagcgctgctgtgtatgccggcatgatcaccgtcttcagcaaccggctgggctggcacaacatggagctgctgctgagccagttccagaagaggctgaccttcggcatccagcgggagctgtgtgacctggtgcgggtgtccctgctgaatgcccagagggcccgggtgctgtatgccagcggcttccacacagtggccgacctggcccgggccaacatcgtggaggtggaggtgatcctgaagaatgctgtgcccttcaagagcgccaggaaggctgtggatgaggaggaggaggccgtggaggagaggaggaacatgaggaccatctgggtgacaggcaggaagggcctgacagagcgggaggccgccgccctgattgtggaggaggccaggatgatcctgcagcaggacctggtggagatgggcgtgcagtggaacccctgtgccctgctgcacagcagcacctgcagcctgacccacagcgagagcgaggtgaaggagcacaccttcatcagccagaccaagagcagctacaagaagctgaccagcaagaacaagagcaacaccatcttcagtgacagctacatcaagcacagccccaacatcgtgcaggacctgaacaagagccgggagcacaccagcagcttcaactgcaacttccagaatggaaaccaggagcaccagacctgcagcatcttccgggccaggaagagggccagcctggacatcaacaaggagaagccaggggccagccagaatgaaggcaagaccagtgacaagaaggtggtgcagaccttcagccagaagaccaagaaggcccccctgaacttcaacagcgagaagatgagccgctccttccgctcctggaagaggaggaagcacctgaagaggagccgggacagcagccccctgaaggacagcggggcctgccgcatccacctgcagggccagaccctgagcaaccccagcctgtgtgaggaccccttcaccctggatgagaagaagacagagttcagaaattctggcccctttgccaagaatgtgtccctgagcggcaaggagaaggacaacaagaccagcttccccctgcagatcaagcagaactgctcctggaacatcaccctgaccaatgacaactttgtggagcacatcgtgacaggcagccagagcaagaatgtgacctgccaggccacctctgtggtgtctgagaagggccggggcgtggccgtggaggccgagaagatcaatgaggtgctgatccagaatggcagcaagaaccagaatgtgtacatgaagcaccacgacatccaccccatcaaccagtacctgaggaagcagagccatgagcagaccagcaccatcaccaagcagaagaacatcatcgagcggcagatgccctgtgaggccgtgagcagctacatcaacagagacagcaatgtgaccatcaactgtgagcgcatcaagctgaacacagaggagaacaagcccagccacttccaggccctgggagatgacatcagcaggacagtcatccccagcgaggtgctgcccagcgctggggccttcagcaagtctgagggccagcacgagaacttcctgaacatcagccggctgcaggagaagacaggcacctacaccaccaacaagaccaagaacaaccacgtgtctgacctgggcctggtgctgtgtgactttgaggacagcttctacctggacacccagagcgagaagatcatccagcagatggccacagaaaatgccaagctgggcgccaaggacaccaacctggccgccggcatcatgcagaagagcctggtgcagcagaacagcatgaacagcttccagaaggagtgccacatccccttccctgctgagcagcaccccctgggcgccaccaagattgaccacctggacctgaagacagtgggcaccatgaagcagagcagtgacagccacggcgtggacatcctgaccccagagagccccatcttccacagccccatcctgctggaggagaatggcctcttcctgaagaagaatgaggtgtctgtgacagacagccagctgaacagcttcctgcagggctaccagacccaggagaccgtgaagcctgtgatcctgctgatcccccagaagaggacccccaccggggtggagggagaatgtctgcctgtgcctgagaccagcctgaacatgtctgacagcctgctgtttgacagcttcagtgatgactacctggtgaaggagcagctgcctgacatgcagatgaaggagcccctgcccagcgaggtgaccagcaaccacttcagtgacagcctgtgcctgcaggaggacctgatcaagaagagcaatgtgaatgaaaaccaggacacccaccagcagctgacctgcagcaatgatgagagcatcatcttcagcgagatggacagcgtgcagatggtggaggccctggacaacgtggacatcttccctgtgcaggagaagaaccacacagtggtgagcccccgggccctggagctgagtgaccctgtgctggatgagcaccaccagggcgaccaggacggcggggaccaggatgagcgggcagagaagagcaagctgaccggcacccggcagaaccacagcttcatctggagcggggccagctttgacctgagccctggcctgcagaggatcctggacaaggtgagcagccccctggagaatgagaagctgaagtccatgaccatcaacttcagcagcctgaacaggaagaacacagagctgaatgaggagcaggaggtgatcagcaacctggagaccaagcaggtgcagggcatctccttcagcagcaacaatgaggtgaagagcaagattgagatgctggagaacaatgccaaccatgatgagaccagcagcctgctgcccaggaaggagagcaacatcgtggatgacaatggcctcatcccccccacccccatccccaccagcgccagcaagctgaccttccctggcatcctggagacccctgtgaacccctggaagaccaacaacgtgctgcagcctggagagagctacctgtttggcagccccagcgacatcaagaaccacgacctgagccctggcagcagaaatggcttcaaggacaacagccccatcagtgacaccagcttcagcctgcagctgagccaggacggcctgcagctgaccccagccagcagcagcagcgagagcctgagcatcattgatgtggccagtgaccagaacctcttccagaccttcatcaaggagtggcgctgcaagaagcgcttcagcatcagcctggcctgtgagaagatccgcagcctgaccagcagcaagacagccaccatcggcagccgcttcaagcaggccagcagcccccaggagatccccatcagagatgatggcttccccatcaagggctgtgatgacaccctggtggtgggcctggccgtgtgctggggcggcagagatgcctactacttcagcctgcagaaggagcagaagcacagcgagatcagcgccagcctggtgccccccagcctggaccccagcctgaccctgaaggacaggatgtggtacctgcagagctgcctgaggaaggagagtgacaaggagtgcagcgtggtgatctatgacttcatccagagctacaagatcctgctgctgagctgtggcatcagcctggagcagagctatgaggaccccaaggtggcctgctggctgctggaccctgacagccaggagcccaccctgcacagcatcgtgaccagcttcctgccccatgagctgcccctgctggagggcatggagaccagccagggcatccagagcctgggcctgaatgccggcagcgagcacagcggccgctaccgggcctctgtggagagcatcctgatcttcaacagcatgaaccagctgaacagcctgctgcagaaggagaacctgcaggatgtgttcaggaaggtggagatgcccagccagtactgcctggccctgctggagctgaatggaattggcttcagcacagcagaatgtgagagccagaagcacatcatgcaggccaagctggatgccatcgagacccaggcctaccagctggccggccacagcttctccttcaccagcagtgatgacattgctgaggtgctcttcctggagctgaagctgccccccaaccgggagatgaagaaccagggcagcaagaagaccctgggcagcacccggcggggcatcgacaatggaaggaagctgcggctgggccggcagttcagcaccagcaaggatgtgctgaacaagctgaaggccctgcaccccctgcccggcctcatcctggagtggaggcgcatcaccaatgccatcaccaaggtggtgttccccctgcagcgggagaagtgcctgaaccccttcctgggcatggagcgcatctaccctgtgtcccagagccacacagccaccggccgcatcaccttcacagagcccaacatccagaatgtgccccgggactttgagatcaagatgcccaccctggtgggggagagcccccccagccaggccgtgggcaagggcctgctgcccatgggccggggcaagtacaagaagggcttctctgtgaacccccgctgccaggcccagatggaggagagagctgctgaccggggcatgcccttcagcatctccatgagacatgcctttgtgcccttccctgggggcagcatcctggccgctgactacagccagctggagctgcgcatcctggcccacctgagccatgacagaagactcatccaggtgctgaacacaggagcagatgtgttccgcagcattgctgctgagtggaagatgattgagcctgagagcgtgggagatgacctgcggcagcaggccaagcagatctgctacggcatcatctacggcatgggcgccaagagcctgggggagcagatgggcatcaaggaaaatgatgctgcctgctacatcgacagcttcaagagccgctacacaggcatcaaccagttcatgacagaaacagtgaagaactgcaagagagatggctttgtgcagaccatcctgggcagaagacgctacctgcccggcatcaaggacaacaacccctacaggaaggcccatgctgagcggcaggccatcaacaccatcgtgcagggcagcgctgctgacatcgtgaagatcgccaccgtgaacatccagaagcagctggagaccttccacagcaccttcaagagccacggccaccgggagggcatgctgcagagcgaccagacaggcctgagcaggaagaggaagctgcagggcatgttctgccccatccggggcggcttcttcatcctgcagctgcatgatgagctgctgtatgaggtggccgaggaggatgtggtgcaggtggcccagatcgtgaagaatgagatggagagcgctgtgaagctgtctgtgaagctgaaggtgaaggtgaagattggagcctcctggggcgagctgaaggactttgatgtgtag

SEQ ID NO: 164661 - DNA, 240 bp, Artificial Sequence
  Description of Artificial Sequence: Synthetic coding sequence
atgggcaggaagaggctcatcacagacagctaccctgtggtgaagaggcgggagggccctgctggccacagcaaaggagagctggcccctgagctgggggaggagccccagcccagagatgaggaggaggccgagctggagctgctgcggcagtttgacctggcctggcagtatggcccctgcaccgtgtctggcatcagcatcccctatgaggcccccaggaagaccagctgcccctag

SEQ ID NO: 164662 - DNA, 324 bp, Artificial Sequence
  Description of Artificial Sequence: Synthetic coding sequence
atgggcaggaagaggctcatcacagacagctaccctgtggtgaagaggcgggagggccctgctggccacagcaaaggagagctggcccctgagctgggggaggagccccagcccagagatgaggaggaggccgagctggagctgctgcggcagtttgacctggcctggcagtatggcccctgcaccggcatcacccggctgcagcgctggtgccgggccaagcagatgggcctggagcccccacctgaggtgtggcaggtgctgaagacccaccctggggacccccgcttccagtgcagcctgtggcacctgtaccccctgtag

SEQ ID NO: 164663 - DNA, 105 bp, Artificial Sequence
  Description of Artificial Sequence: Synthetic coding sequence
atgggcaggaagaggctcatcacagacagctaccctgtggtgaagaggcgggagggccctgctggccacagcaaaggagagctggcccctgagctgggcctgtag

SEQ ID NO: 164664 - DNA, 1266 bp, Artificial Sequence
  Description of Artificial Sequence: Synthetic coding sequence
atggctgacatcagcctggatgagctgatcaggaagagaggagctgctgccaagggccgcctgaatgcccggcctggggtgggcggcgtgcgcagccgggtgggcatccagcagggcctgctgagccagagcaccaggacagccaccttccagcagagatttgatgcccggcagaagattggcctgagtgatgcccggctgaagctgggcgtgaaggatgcccgggagaagctgctgcagaaggatgcccgcttccgcatcaagggcaaggtgcaggatgcccgggagatgctgaacagcaggaagcagcagaccaccgtgccccagaagccccggcaggtggctgatgcccgggagaagatcagcctgaagaggagcagccctgctgccttcatcaacccccccatcggcaccgtgaccccagccctgaagctgaccaagaccatccaggtgccccagcagaaggccatggcccccctgcacccccaccctgctggcatgaggatcaacgtggtgaacaaccaccaggccaagcagaacctgtatgacctggatgaagatgatgatggcatcgcctctgtgcccaccaagcagatgaagtttgctgccagcggcggcttcctgcaccacatggccggcctgagcagcagcaagctgtccatgagcaaggccctgcccctgaccaaggtggtgcagaatgatgcctacacagccccagccctgcccagcagcatccgcaccaaggccctgaccaacatgagcaggaccctggtgaacaaggaggagccccccaaggagctgcctgctgctgagcctgtgctgagccccctggagggcaccaagatgacagtgaacaacctgcacccccgggtgacagaggaggacatcgtggagctgttctgtgtgtgtggggccctgaagagggcccggctggtgcaccctggggtggccgaggtggtgtttgtgaagaaggatgatgccatcacagcctacaagaagtacaacaaccgctgcctggatggccagcccatgaagtgcaacctgcacatgaatggaaatgtcatcaccagtgaccagcccatcctgctgcggctgagtgacagccccagcatgaagaaggagagcgagctgcccaggagagtgaacagcgccagcagcagcaaccccccagctgaggtggaccctgacaccatcctgaaggccctcttcaagagcagcggggcctctgtgaccacccagcccacagagttcaagatcaagctgtag

SEQ ID NO: 164665 - DNA, 558 bp, Artificial Sequence
  Description of Artificial Sequence: Synthetic coding sequence
atggctgacatcagcctggatgagctgatcaggaagagaggagctgctgccaagggccgcctgaatgcccggcctggggtgggcggcgtgcgcagccgggtgggcatccagcagggcctgctgagccagagcaccaggacagccaccttccagcagagatttgatgcccggcagaagattggcctgagtgatgcccggctgaagctgggcgtgaaggatgcccgggagaagctgctgcagaaggatgcccgcttccgcatcaagggcaaggtgcaggatgcccgggagatgctgaacagcaggaagcagcagaccaccgtgccccagaagccccggcaggtggctgatgcccgggagaagatcagcctgaagaggagcagccctgctgccttcatcaacccccccatcggcaccgtgaccccagccctgaagctgaccaagaccatccaggtgggcctgcgggctgtgcccctgctgtgcctggtgtctggaggagcctgggtgggcagccgcagccaggccagctgccccctgcccagcggcagccggccccactag

SEQ ID NO: 164666 - DNA, 1179 bp, Artificial Sequence
  Description of Artificial Sequence: Synthetic coding sequence
atggctgacatcagcctggatgagctgatcaggaagagaggagctgctgccaagggccgcctgaatgcccggcctggggtgggcggcgtgcgcagccgggtgggcatccagcagggcctgctgagccagagcaccaggacagccaccttccagcagagatttgatgcccggcagaagattggcctgagtgatgcccggctgaagctgggcgtgaaggatgcccgggagaagctgctgcagaaggatgcccgcttccgcatcaagggcaaggtgcaggatgcccgggagatgctgaacagcaggaagcagcagaccaccgtgccccagaagccccggcaggtggctgatgcccgggagaagatcagcctgaagaggagcagccctgctgccttcatcaacccccccatcggcaccgtgaccccagccctgaagctgaccaagaccatccagaacctgtatgacctggatgaagatgatgatggcatcgcctctgtgcccaccaagcagatgaagtttgctgccagcggcggcttcctgcaccacatggccggcctgagcagcagcaagctgtccatgagcaaggccctgcccctgaccaaggtggtgcagaatgatgcctacacagccccagccctgcccagcagcatccgcaccaaggccctgaccaacatgagcaggaccctggtgaacaaggaggagccccccaaggagctgcctgctgctgagcctgtgctgagccccctggagggcaccaagatgacagtgaacaacctgcacccccgggtgacagaagaagatattgtggagctgttctgtgtgtgtggggccctgaagagggcccggctggtgcaccctggggtggccgaggtggtgtttgtgaagaaggatgatgccatcacagcctacaagaagtacaacaaccgctgcctggatggccagcccatgaagtgcaacctgcacatgaatggaaatgtcatcaccagtgaccagcccatcctgctgcggctgagtgacagccccagcatgaagaaggagagcgagctgccccggcgggtgaacagcgccagcagcagcaaccccccagctgaggtggaccctgacaccatcctgaaggccctcttcaagagcagcggggcctctgtgaccacccagcccacagagttcaagatcaagctgtag

SEQ ID NO: 164667 - DNA, 690 bp, Artificial Sequence
  Description of Artificial Sequence: Synthetic coding sequence
atggctgacatcagcctggatgagctgatcaggaagagaggagctgctgccaagggccgcctgaatgcccggcctggggtgggcggcgtgcgcagccgggtgggcatccagcagggcctgctgagccagagcaccaggacagccaccttccagcagagatttgatgcccggcagaagattggcctgagtgatgcccggctgaagctgggcgtgaaggatgcccgggagaagctgctgcagaaggatgcccgcttccgcatcaagggcaaggtgcaggatgcccgggagatgctgaacagcaggaagcagcagaccaccgtgccccagaagccccggcaggtggctgatgcccgggagaagatcagcctgaagaggagcagccctgctgccttcatcaacccccccatcggcaccgtgaccccagccctgaagctgaccaagaccatccagaacctgtatgacctggatgaagatgatgatggcatcgcctctgtgcccaccaagcagatgaagtttgctgccagcggcggcttcctgcaccacatggccggcctgagcagcagcaagctgtccatgagcaaggccctgcccctgaccaaggtggtgcagaatgatgcctacacagccccagccctgcccagcagcatccgcaccaaggccctgcctgtgctgaccagccctggcacctag

SEQ ID NO: 164668 - DNA, 561 bp, Artificial Sequence
  Description of Artificial Sequence: Synthetic coding sequence
atggcccccctgcacccccaccctgctggcatgaggatcaacgtggtgaacaaccaccaggccaagcagaacctgtatgacctggatgaagatgatgatggcatcgcctctgtgcccaccaagcagatgaagtttgctgccagcggcggcttcctgcaccacatggccggcctgagcagcagcaagctgtccatgagcaaggccctgcccctgaccaaggtggtgcagaatgatgcctacacagccccagccctgcccagcagcatccgcaccaaggccctgaccaacatgagcaggaccctggtgaacaaggaggagccccccaaggagctgcctgctgctgagcctgtgctgagccccctggagggcaccaagatgacagtgaacaacctgcacccccgggtgacagaggaggacatcgtggagctgttctgtgtgtgtggggccctgaagagggcccggctggtgcaccctggggtggccgaggtggtgtttgtgaagaaggatgatgccatcacagcctacaagaagtacaacaaccgctgcctggatggcggctag

SEQ ID NO: 164669 - DNA, 555 bp, Artificial Sequence
  Description of Artificial Sequence: Synthetic coding sequence
atggctgacatcagcctggatgagctgatcaggaagagaggagctgctgccaagggccgcctgaatgcccggcctggggtgggcggcgtgcgcagccgggtgggcatccagcagggcctgctgagccagagcaccaggacagccaccttccagcagagatttgatgcccggcagaagattggcctgagtgatgcccggctgaagctgggcgtgaaggatgcccgggagaagctgctgcagaaggatgcccgcttccgcatcaagggcaaggtgcaggatgcccgggagatgctgaacagcaggaagcagcagaccaccgtgccccagaagccccggcaggtggctgatgcccgggagaagatcagcctgaagaggagcagccctgctgccttcatcaacccccccatcggcaccgtgaccccagccctgaagctgaccaagaccatccaggtgcccagcttcccctgcccccggcccagcctgagccccaagtggttcaggatgatgcacacccagctgctgctgagcctgcccctgtttgagcagaagccctag

SEQ ID NO: 164670 - DNA, 354 bp, Artificial Sequence
  Description of Artificial Sequence: Synthetic coding sequence
atggctgctgctgctgctgctggcagcggcaccccccgggaggaggagggccctgctggggaggccgccgccagccagccccaggcccccacctctgtgcctggggcccggctgagccggctgcccctggcccgggtgaaggccctggtgaaggctgaccctgatgtgaccctggccggccaggaggccatcttcatcctggcccgggctgctgagctgtttgtggagaccatcgccaaggatgcctactgctgtgcccagcagggcaagaggaagaccctgcagaggcgggacctggacaatgccattgaagctgtggatgaatttgccttcctggagggcaccctggactag

SEQ ID NO: 164671 - DNA, 1029 bp, Artificial Sequence
  Description of Artificial Sequence: Synthetic coding sequence
atggccgccagccaggccgtggaggagatgaggagccgggtggtgctgggggagtttggagtgagaaatgtgcacaccacagacttccctggcaactacagcggctatgatgatgcctgggaccaggacagatttgagaagaacttccgggtggatgtggtgcacatggatgagaacagcctggagtttgacatggtgggcattgatgctgccatcgccaatgccttccgccgcatcctgctggccgaggtgcccaccatggctgtggagaaggtgctggtgtacaacaacaccagcatcgtgcaggatgagatcctggcccaccggctgggcctcatccccatccatgctgacccccggctgtttgagtacagaaaccagggagatgaggagggcacagaaattgacaccctgcagttccggctgcaggtgcgctgcaccaggaacccccacgccgccaaggacagcagtgaccccaatgagctgtatgtgaaccacaaggtgtacaccaggcacatgacctggatccccctgggcaaccaggccgacctcttccctgagggcaccatccggcctgtgcatgatgacatcctgattgcccagctgcggcccggccaggagattgacctgctgatgcactgtgtgaagggcatcggcaaggaccacgccaagttcagccctgtggccacagccagctaccgcctgctgcctgacatcaccctgctggagcctgtggagggggaggccgctgaggagctgagccgctgcttcagccctggggtcatcgaggtgcaggaggtgcagggcaagaaggtggcccgggtggccaacccccggctggacaccttcagccgggagatcttcagaaatgagaagctgaagaaggtggtgcggctggcccgggtgcgggaccactacatctgcaagaaggacctgctggccgctgtggcccacacctgcaaccccagcaccctgggcggccagggcgagtggatcaccggcagccgggagcgggaccaccctggatag

SEQ ID NO: 164672 - DNA, 633 bp, Artificial Sequence
  Description of Artificial Sequence: Synthetic coding sequence
atggctgtggagaaggtgctggtgtacaacaacaccagcatcgtgcaggatgagatcctggcccaccggctgggcctcatccccatccatgctgacccccggctgtttgagtacagaaaccagggagatgaggagggcacagaaattgacaccctgcagttccggctgcaggtgcgctgcaccaggaacccccacgccgccaaggacagcagtgaccccaatgagctgtatgtgaaccacaaggtgtacaccaggcacatgacctggatccccctgggcaaccaggccgacctcttccctgagggcaccatccggcctgtgcatgatgacatcctgattgcccagctgcggcccggccaggagattgacctgctgatgcactgtgtgaagggcatcggcaagaaggtggcccgggtggccaacccccggctggacaccttcagccgggagatcttcagaaatgagaagctgaagaaggtggtgcggctggcccgggtgcgggaccactacatcttctctgtggagagcactggagtgctgcccccagatgtgctggtgtctgaggccatcaaggtgctgatgggcaagtgccgccgcttcctggatgagctggatgctgtgcagatggactag

SEQ ID NO: 164673 - DNA, 1041 bp, Artificial Sequence
  Description of Artificial Sequence: Synthetic coding sequence
atggccgccagccaggccgtggaggagatgaggagccgggtggtgctgggggagtttggagtgagaaatgtgcacaccacagacttccctggcaactacagcggctatgatgatgcctgggaccaggacagatttgagaagaacttccgggtggatgtggtgcacatggatgagaacagcctggagtttgacatggtgggcattgatgctgccatcgccaatgccttccgccgcatcctgctggccgaggtgcccaccatggctgtggagaaggtgctggtgtacaacaacaccagcatcgtgcaggatgagatcctggcccaccggctgggcctcatccccatccatgctgacccccggctgtttgagtacagaaaccagggagatgaggagggcacagaaattgacaccctgcagttccggctgcaggtgcgctgcaccaggaacccccacgccgccaaggacagcagtgaccccaatgagctgtatgtgaaccacaaggtgtacaccaggcacatgacctggatccccctgggcaaccaggccgacctcttccctgagggcaccatccggcctgtgcatgatgacatcctgattgcccagctgcggcccggccaggagattgacctgctgatgcactgtgtgaagggcatcggcaaggaccacgccaagttcagccctgtggccacagccagctaccgcctgctgcctgacatcaccctgctggagcctgtggagggggaggccgctgaggagctgagccgctgcttcagccctggggtcatcgaggtgcaggaggtgcagggcaagaaggtggcccgggtggccaacccccggctggacaccttcagccgggagatcttcagaaatgagaagctgaagaaggtggtgcggctggcccgggtgcgggaccactacatcttctctgtggagagcactggagtgctgcccccagatgtgctggtgtctgaggccatcaaggtgctgatgggcaagtgccgccgcttcctggatgagctggatgctgtgcagatggactag

SEQ ID NO: 164674 - DNA, 369 bp, Artificial Sequence
  Description of Artificial Sequence: Synthetic coding sequence
atggaggaggaccaggagctggagaggaaggccatcgaggagctgctgaaggaggccaagaggggcaagaccagggctgagaccatgggccccatgggctggatgaagtgccccctggccagcaccaacaagcgcttcctgatcaacaccatcaagaacaccctgcccagccacaaggagcaggaccacgagcagaaggagggggacaaggagcccgccaagagccaggcccagaaggaggagaaccccaagaagcacaggagccacccctacaagcacagcttccgggcccggggcagcgccagctacagcccccccaggaagaggagcagccaggacaagtatgagaagaggagcaacagaagatag

SEQ ID NO: 164675 - DNA, 402 bp, Artificial Sequence
  Description of Artificial Sequence: Synthetic coding sequence
atggaggaggaccaggagctggagaggaagatcagcggcctgaagacctccatggccgagggggagaggaagacagccctggagatggtgcaggccgccggcacagacagacactgtgtgacctttgtgctgcacgaggaggaccacaccctgggcaacagcctgcgctacatgatcatgaagaaccctgaggtggagttctgtggctacaccaccacccaccccagcgagagcaagatcaacctgcgcatccagacccggggcaccctgcctgctgtggagcccttccagaggggcctgaatgagctgatgaatgtgtgccagcacgtgctggacaagtttgaggccagcatcaaggactacaaggaccagaaggccagcagaaatgaaagcaccttctag

SEQ ID NO: 164676 - DNA, 402 bp, Artificial Sequence; identical to SEQ ID NO: 164675
  Description of Artificial Sequence: Synthetic coding sequence

SEQ ID NO: 164677 - DNA, 5913 bp, Artificial Sequence
  Description of Artificial Sequence: Synthetic coding sequence
atgcacggcggcggcccccccagcggggacagcgcctgccccctgcggaccatcaagagggtgcagtttggagtgctgagcccagatgagctgaagaggatgtctgtgacagaaggaggcatcaagtacccagagaccacagaaggaggccggcccaagctgggcggcctgatggacccccggcagggcgtgattgaaagaacaggccgctgccagacctgtgccggcaacatgacagagtgccccggccacttcggccacatcgagctggccaagcctgtgttccacgtgggcttcctggtgaagaccatgaaggtgctgcgctgtgtgtgcttcttctgcagcaagctgctggtggacagcaacaaccccaagatcaaggacatcctggccaagagcaagggccagcccaagaagaggctgacccacgtgtatgacctgtgcaagggcaagaacatctgtgagggcggggaggagatggacaacaagtttggagtggagcagccagaaggagatgaggacctgaccaaggagaagggccatggaggctgcggccgctaccagccccgcatccgccgcagcggcctggagctgtatgcagagtggaagcacgtgaatgaagacagccaggagaagaagatcctgctgagccctgagcgggtgcatgagatcttcaagaggatcagtgatgaggagtgctttgtgctgggcatggagcccaggtatgcccggcctgagtggatgattgtgacagtgctgcctgtgccccccctgtctgtgcggcctgctgtggtgatgcagggcagcgccaggaaccaggatgacctgacccacaagctggccgacatcgtgaagatcaacaaccagctgcggagaaatgagcagaatggagctgctgcccacgtgattgctgaagatgtgaagctgctgcagttccacgtggccaccatggtggacaatgagctgcccggcctgccccgggccatgcagaagagcggccggcccctgaagagcctgaagcagaggctgaagggcaaggagggccgggtgcggggcaacctgatgggcaagagggtggacttcagcgccaggacagtcatcaccccagaccccaacctgagcattgaccaggtgggcgtgcccaggagcattgctgccaacatgacctttgctgagatcgtgacccccttcaacatcgaccggctgcaggagctggtgagaagaggcaacagccagtacccaggggccaagtacatcatccgggacaatggagacagaattgacctgcgcttccaccccaagcccagcgacctgcacctgcagacaggctacaaggtggagcggcacatgtgtgatggagacatcgtcatcttcaaccggcagcccaccctgcacaagatgtccatgatgggccaccgggtgcgcatcctgccctggagcaccttccggctgaacctgtctgtgaccaccccctacaatgctgactttgatggagatgagatgaacctgcacctgccccagagcctggagaccagggctgagatccaggagctggccatggtgcccaggatgattgtgaccccccagagcaacagacctgtgatgggcatcgtgcaggacaccctgacagctgtgaggaagttcaccaagagagatgtgttcctggagcggggggaggtgatgaacctgctgatgttcctgagcacctgggatggcaaggtgccccagcctgccatcctgaagccccggcccctgtggacaggcaagcagatcttcagcctcatcatccctggccacatcaactgcatccgcacccacagcacccacccagatgatgaagattctggcccctacaagcacatcagccctggggacaccaaggtggtggtggagaatggagagctgatcatgggcatcctgtgcaagaagagcctgggcaccagcgctggcagcctggtgcacatctcctacctggagatgggccatgacatcaccaggctcttctacagcaacatccagaccgtcatcaacaactggctgctgattgagggccacaccatcggcattggagacagcattgctgacagcaagacctaccaggacatccagaacaccatcaagaaggccaagcaggacgtcatcgaggtgattgagaaggcccacaacaatgagctggagcccaccccaggcaacaccctgcggcagacctttgagaaccaggtgaaccgcatcctgaatgatgcccgggacaagacaggcagcagcgcccagaagagcctgtctgagtacaacaacttcaagtccatggtggtgtctggggccaagggcagcaagatcaacatcagccaggtgattgctgtggtgggccagcagaatgtggagggcaagaggatccccttcggcttcaagcacaggaccctgccccacttcatcaaggatgattatggccctgagagccggggctttgtggagaacagctacctggccggcctgacccccacagagttcttcttccacgccatgggcggccgggagggcctgattgacacagctgtgaagacagctgagaccggctacatccagaggaggctcatcaagtccatggagagcgtgatggtgaagtatgatgccaccgtgaggaacagcatcaaccaggtggtgcagctgcgctatggagaagatggcctggccggggagagcgtggagttccagaacctggccaccctgaagcccagcaacaaggcctttgagaagaagttccgctttgactacaccaatgaaagagccctgcggaggaccctgcaggaggacctggtgaaggatgtgctgagcaatgcccacatccagaatgagctggagcgggagtttgagaggatgagagaagatcgggaggtgctgcgggtcatcttccccaccggggacagcaaggtggtgctgccctgcaacctgctgaggatgatctggaatgcccagaagatcttccacatcaacccccggctgcccagcgacctgcaccccatcaaggtggtggagggcgtgaaggagctgagcaagaagctggtgattgtgaatggagatgaccccctgagccggcaggcccaggagaatgccaccctgctcttcaacatccacctgcggagcaccctgtgcagcaggaggatggccgaggagttccggctgtctggagaggcctttgactggctgctgggggagattgagagcaagttcaaccaggccatcgcccaccctggagagatggtgggcgccctggccgcccagagcctgggggagcccgccacccagatgaccctgaacaccttccactacgccggcgtgtctgccaagaatgtgaccctgggcgtgccccggctgaaggagctgatcaacatcagcaagaagcccaagacccccagcctgaccgtcttcctgctgggccagagcgccagagatgctgagcgggccaaggacatcctgtgccgcctggagcacaccaccctgaggaaggtgacagccaacacagccatctactatgaccccaacccccagagcacagtggtggccgaggaccaggagtgggtgaatgtgtactatgagatgccagactttgatgtggcccgcatcagcccctggctgctgcgggtggagctggacaggaagcacatgacagacaggaagctgaccatggagcagattgctgagaagatcaatgccggctttggagatgacctgaactgcatcttcaatgatgacaatgctgagaagctggtgctgcgcatccgcatcatgaacagtgatgagaacaagatgcaggaggaggaggaggtggtggacaagatggatgatgatgtgttcctgcgctgcatcgagagcaacatgctgacagacatgaccctgcagggcatcgagcagatcagcaaggtgtacatgcacctgccccagacagacaacaagaagaagatcatcatcacagaagatggagagttcaaggccctgcaggagtggatcctggagacagatggagtgtccctgatgagggtgctgtctgagaaggatgtggaccctgtgaggaccaccagcaatgacatcgtggagatcttcaccgtgctgggcattgaagctgtgaggaaggccctggagcgggagctgtaccacgtgatcagctttgatggcagctatgtgaactaccgccacctggccctgctgtgtgacaccatgacctgccggggccacctgatggccatcaccaggcatggagtgaaccggcaggacaccggccccctgatgaagtgcagctttgaggagaccgtggatgtgctgatggaggccgccgcccatggagagagtgaccccatgaagggcgtgtctgagaacatcatgctgggccagctggccccagctggcaccggctgctttgacctgctgctggatgctgagaagtgcaagtatggcatggagatccccaccaacatccctggcctgggcgccgccggccccaccggcatgttctttggaagtgcccccagccccatgggcggcatcagccctgccatgaccccctggaaccagggcgccaccccagcctacggggcctggagccccagcgtgggcagcggcatgaccccaggagctgctggcttcagccccagcgctgccagtgatgccagcggcttcagccctggctacagccctgcctggagccccaccccaggcagccctggcagccctggccccagcagcccctacatccccagccctggaggagccatgagccccagctacagccccaccagccctgcctatgagcccaggagccctgggggctacaccccccagagccccagctacagccccaccagccccagctacagccccaccagccccagctacagccccaccagccccaactacagccccaccagccccagctacagccccaccagccccagctacagccccaccagccccagctacagccccaccagccccagctacagccccaccagccccagctacagccccaccagccccagctacagccccaccagccccagctacagccccaccagccccagctacagccccaccagccccagctacagccccaccagccccagctacagccccaccagccccagctacagccccaccagccccagctacagccccaccagccccagctacagccccaccagccccagctacagccccaccagccccagctacagccccaccagccccaactacagccccaccagccccaactacacccccaccagccccagctacagccccaccagccccagctacagccccaccagccccaactacacccccaccagccccaactacagccccaccagccccagctacagccccaccagccccagctacagccccaccagccccagctacagccccagcagcccccgctacaccccccagagccccacctacacccccagcagccccagctacagccccagcagccccagctacagccctgccagccccaagtacacccccaccagccccagctacagccccagcagccctgagtacacccccaccagccccaagtacagccccaccagccccaagtacagccccaccagccccaagtacagccccaccagccccacctacagccccaccacccccaagtacagccccaccagccccacctacagccccaccagccctgtgtacacccccaccagccccaagtacagccccaccagccccacctacagccccaccagccccaagtacagccccaccagccccacctacagccccaccagccccaagggcagcacctacagccccaccagccctggctacagccccaccagccccacctacagcctgaccagccctgccatcagcccagatgacagtgatgaagaaaattag

SEQ ID NO: 164678 - DNA, 1626 bp, Artificial Sequence
  Description of Artificial Sequence: Synthetic coding sequence
atgcctggccgctgccagagtgatgctgccatgagggtgaatggacctgccagccgggccccagctggctggaccagcggcagcctgcacacaggccccagggctggccggccccgggcccaggcccggggcgtgcggggccggggcctgctgctgcggcccaggcctgccaaggagctgcccctgcccaggaaaggaggagcctgggccccagctggcaaccctggccccctgcaccccctgggcgtggccgtgggcatggccggcagcggccgcctggtgctgcggccctggatccgggagctgatcctgggcagcgagacccccagcagcccccgggccggccagctgctggaggatgctgaggccgctgtggccggccccagccacgccccagacaccagtgatgtgggcgccaccctgctggtgtctgatggcacccacagcgtgcgctgcctggtgacccgggaggccctggacaccagtgactgggaggagaaggagtttggcttccggggcacagagggccgcctgctgctgctgcaggactgtggggtgcacgtgcaggtggccgagggcggggccccagctgagttctacctgcaggtggaccgcttcagcctgctgcccacagagcagccccggctgcgggtgcccggctgcaaccaggacctggatgtgcagaagaagctgtatgactgcctggaggagcacctgtctgagagcaccagcagcaatgccggcctgagcctgagccagctgctggatgagatgagggaggaccaggagcaccagggcgccctggtgtgcctggccgagagctgcctgaccctggagggcccctgcacagcccctcctgtgacccactgggccgccagccgctgcaaggccaccggggaggccgtgtacacagtgcccagctccatgctgtgcatcagtgaaaatgaccagctgatcctgagcagcctgggcccctgccagaggacccagggccctgagctgcccccaccagaccctgccctgcaggacctgagcctgaccctgattgccagcccccccagcagccccagcagcagcggcaccccagccctgcccggccacatgagcagcgaggagagcggcaccagcatcagcctgctgcctgccctgagcctggccgccccagaccccggccagaggagcagcagccagcccagccctgccatctgcagcgccccagccaccctgacccccaggagcccccacgccagcaggacccccagcagccccctgcagagctgcacccccagcctgagccccaggagccacgtgcccagcccccaccaggccctggtgacccggccccagaagcccagcctggagttcaaggagtttgtgggcctgccctgcaagaacagaccacccttccccaggactggagccaccaggggggcccaggagccctgcagcgtgtgggagccccccaagaggcacagagatggcagcgccttccagtatgaatatgagcccccctgcaccagcctgtgtgcccgggtgcaggccgtgcggctgcccccccagctgatggcctgggccctgcacttcctgatggatgcccagcccggcagcgagcccacccccatgtag

SEQ ID NO: 164679 - DNA, 2040 bp, Artificial Sequence
  Description of Artificial Sequence: Synthetic coding sequence
atggacagagtgacccgctaccccatcctgggcatcccccaggcccaccggggcaccggcctggtgctggatggagacaccagctacacctaccacctggtgtgcatgggccctgaggccagcggctggggccaggatgagccccagacctggcccacagaccaccgggcccagcagggcgtgcagaggcagggcgtgtcctacagcgtgcacgcctacacaggccagcccagcccccggggcctgcacagtgaaaatcgggaggatgagggctggcaggtgtaccgcctgggcgccagagatgcccaccagggccggcccacctgggccctgcggccagaagatggagaggacaaggagatgaagacctaccgcctggatgctggagatgctgacccccggcggctgtgtgacctggagcgggagcgctgggccgtcatccagggccaggccgtgaggaagagcagcacagtggccaccctgcagggcaccccagaccatggagaccccaggaccccaggccccccaagaagcacccccctggaggagaatgtggtggaccgggagcagattgacttcctggccgcccggcagcagttcctgagcctggagcaggccaacaagggggccccccacagcagccctgcccggggcaccccagctggcaccacccctggggccagccaggcccccaaggccttcaacaagccccacctggccaatggacatgtggtgcccatcaagccccaggtgaagggcgtggtgcgggaggagaacaaggtgcgggctgtgcccacctgggcctctgtgcaggtggtggatgaccccggcagcctggcctctgtggagagccctggcacccccaaggagacccccatcgagcgggagatccggctggcccaggagcgggaggccgacctgcgggagcagaggggcctgcggcaggccacagaccaccaggagctggtggagatccccacccggcccctgctgaccaagctgagcctcatcacagccccccggcgggagcggggccggcccagcctgtatgtgcagagggacatcgtgcaggagacccagcgggaggaggaccaccggcgggagggcctgcacgtgggccgggccagcaccccagactgggtgtctgagggcccccagcccggcctgcggcgggccctgagcagtgacagcatcctgagccctgccccagatgcccgggctgctgaccctgcccctgaggtgaggaaggtgaaccgcatccccccagatgcctaccagccctacctgagccctggcaccccccagctggagttcagcgcctttggagccttcggcaagcccagcagcctgagcacagctgaggccaaggccgccaccagccccaaggccaccatgagccccaggcacctgtctgagagcagcggcaagcccctgagcaccaagcaggaggccagcaagccaccccggggctgcccccaggccaacagaggagtggtgcgctgggagtacttccggctgcggcccctgcgcttccgggccccagatgagccccagcaggcccaggtgccccacgtgtggggctgggaggtggccggggccccagccctgcggctgcagaagagccagagcagtgacctgctggagcgggagcgggagagcgtgctgcggcgggagcaggaggtggccgaggagaggagaaatgccctcttccctgaggtgttcagccccaccccagatgagaacagcgaccagaacagccgcagcagcagccaggccagcggcatcaccggcagctacagcgtgtctgagagccccttcttcagccccatccacctgcacagcaatgtggcctggacagtggaggaccctgtggacagcgcccctcctggccagaggaagaaggagcagtggtacgccggcatcaaccccagtgatggcatcaacagcgaggtgctggaggccatccgggtgaccaggcacaagaatgccatggccgagcgctgggagagccgcatctatgcctctgaagaagatgactag

SEQ ID NO: 164680 - DNA, 381 bp, Artificial Sequence
  Description of Artificial Sequence: Synthetic coding sequence
atgtctgacaatgaagacaactttgatggagatgactttgatgatgtggaggaggatgagggcctggatgacctggagaatgctgaggaggagggccaggagaatgtggagatcctgcccagcggggagcggccccaggccaaccagaagaggatcaccaccccctacatgaccaagtatgaaagagcccgggtgctgggcacccgggccctgcagatcgccatgtgtgcccctgtgatggtggagctggagggggagacagaccccctgctgattgccatgaaggagctgaagctgctgtggggcctggagtacacagtgctgcggcccagctatgccctggcccacagcctgggcagcttcagcatcagcagcaggtag

SEQ ID NO: 164681 - DNA, 477 bp, Artificial Sequence
  Description of Artificial Sequence: Synthetic coding sequence
atgtctgacaatgaagacaactttgatggagatgactttgatgatgtggaggaggatgagggcctggatgacctggagaatgctgaggaggagggccaggagaatgtggagatcctgcccagcggggagcggccccaggccaaccagaagaggatcaccaccccctacatgaccaagtatgaaagagcccgggtgctgggcacccgggccctgcagatcgccatgtgtgcccctgtgatggtggagctggagggggagacagaccccctgctgattgccatgaaggagctgaatgcccggagcgccagcgagcccccaggagaggagcccccctggatggaccggggcaccagagatgagcacctgcccagctgccccggctgcccagctgtggccagcaacacccgctgctgccccccagctgcctgcctgcccggcatcagcctgagcagaagaagaaggctgcgggaggagtag

SEQ ID NO: 164682 - DNA, 384 bp, Artificial Sequence
  Description of Artificial Sequence: Synthetic coding sequence
atgtctgacaatgaagacaactttgatggagatgactttgatgatgtggaggaggatgagggcctggatgacctggagaatgctgaggaggagggccaggagaatgtggagatcctgcccagcggggagcggccccaggccaaccagaagaggatcaccaccccctacatgaccaagtatgaaagagcccgggtgctgggcacccgggccctgcagatcgccatgtgtgcccctgtgatggtggagctggagggggagacagaccccctgctgattgccatgaaggagctgaaggccaggaagatccccatcatcatccgccgctacctgcctgatggcagctatgaggactggggcgtggatgagctgatcatcacagactag

SEQ ID NO: 164683 - DNA, 519 bp, Artificial Sequence
  Description of Artificial Sequence: Synthetic coding sequence
atgttctaccacatcagcctggagcacgagatcctgctgcacccccgctacttcggccccaacctgctgaacacagtgaagcagaagctgttcacagaggtggagggcacctgcaccgggaagtatggctttgtgattgctgtgaccaccatcgacaacatcggggccggggtcatccagcccggccggggctttgtgctgtaccctgtgaagtacaaggccatcgtgttccggcccttcaagggggaggtggtggatgctgtggtgacccaggtgaacaaggtgggcctcttcacagaaattggccccatgagctgcttcatcagccgccacagcatccccagcgagatggagtttgaccccaacagcaaccccccctgctacaagaccatggatgaagatattgtcatccagcaggatgatgagatccggctgaagatcgtgggcaccagggtggacaagaatgacatctttgccatcggcagcctgatggatgactacctgggcctggtgtcctag

SEQ ID NO: 164684 - DNA, 453 bp, Artificial Sequence
  Description of Artificial Sequence: Synthetic coding sequence
atggccggcatcctgtttgaggacatctttgatgtgaaggacattgatcctgagggcaagaagtttgacagagtgtcccggctgcactgtgagagcgagagcttcaagatggacctgatcctggatgtgaacatccagatctaccctgtggacctgggggacaagttccggctggtgattgccagcaccctgtatgaagatggcaccctggatgatggagagtacaaccccacagatgaccggcccagcagagctgaccagtttgaatatgtgatgtatggcaaggtgtacagaattgaaggagatgagaccagcacagaggccgccacccggctgagcgcctacgtgtcctatggaggcctgctgatgaggctgcagggagatgccaacaacctgcacggctttgaggtggacagccgggtgtacctgctgatgaagaagctggccttctag

SEQ ID NO: 164685 - DNA, 39 bp, Artificial Sequence
  Description of Artificial Sequence: Synthetic coding sequence
atggccggcatcctgtttgaggacatctttgatgtgtag

SEQ ID NO: 164686 - DNA, 450 bp, Artificial Sequence
  Description of Artificial Sequence: Synthetic coding sequence
atggccggcatcctgtttgaggacatctttgatgtgaaggacattgatcctgagggcaagaagtttgacagagtgtcccggctgcactgtgagagcgagagcttcaagatggacctgatcctggatgtgaacatccagatctaccctgtggacctgggggacaagttccggctggtgattgccagcaccctgtatgaagatggcaccctggatgatggagagtacaaccccacagatgaccggcccagcagagctgaccagtttgaatatgtgatgtatggcaaggtgtacagaattgaaggagatgagaccagcacagaggccgccacccggctgagcgcctacgtgtcctatggaggcctgctgatgaggctgcagggagatgccaacaacctgcacggctttgaggtggacagccgggtgtacctgctgatgaagaagctggcctag

SEQ ID NO: 164687 - DNA, 453 bp, Artificial Sequence; identical to SEQ ID NO: 164684
  Description of Artificial Sequence: Synthetic coding sequence

SEQ ID NO: 164688 - DNA, 1491 bp, Artificial Sequence
  Description of Artificial Sequence: Synthetic coding sequence
atggaggagcagcgggaggccctgaggaagatcatcaagaccctggccgtgaagaatgaggagatccagagcttcatctacagcctgaagcagatgctgctgaatgtggaggccaacagcgccaaggtgcaggaggacctggaggccgagttccagagcctcttcagcctgctggaggagctgaaggagggcatgctgatgaagatcaagcaggaccgggccagcaggacctatgagctgcagaaccagctggccgcctgcacccgggccctggagagcagcgaggagctgctggagacagccaaccagaccctgcaggccatggacagcgaggacttcccccaggccgccaagcagatcaaggatggagtgaccatggccccagccttccggctgagcctgaaggccaaggtgtctgacaacatgagccacctgatggtggactttgcccaggagcggcagatgctgcaggccctgaagttcctgcctgtgcccagcgcccctgtgattgacctggccgagagcctggtggccgacaactgtgtgaccctggtgtggaggatgccagatgaggacagcaagattgaccactacgtgctggagtacagaaggaccaactttgagggccccccccggctgaaggaggaccagccctggatggtgattgagggcatccggcagacagagtacaccctgaccggcctgaagtttgacatgaagtacatgaacttccgggtgaaggcctgcaacaaggctgtggccggggagttcagcgagcctgtgaccctggagaccccagccttcatgttccggctggatgccagcaccagccaccagaacctgcgggtggatgacctgtctgtggagtgggatgccatgggcggcaaggtgcaggacatcaaggcccgggagaaggatggcaagggccgcacagccagccccatcaacagccctgcccggggcacccccagccccaagaggatgcccagcggccggggcggccgggaccgcttcaccgctgagagctacacagtgctgggggacaccctgattgatggaggagagcactactgggaggtgcgctatgagccagacagcaaggcctttggagtgggcgtggcctaccgcagcctgggccgctttgagcagctgggcaagacagctgcctcctggtgcctgcacgtgaacaactggctgcaggtgtccttcaccgccaagcacgccaacaaggtgaaggtgctggatgcccctgtgcctgactgcctgggcgtgcactgtgacttccaccagggcctgctgtccttctacaatgcccggaccaagcaggtgctgcacaccttcaagacccgcttcacccagcccctgctgcctgccttcaccgtgtggtgtggcagcttccaggtgaccaccggcctgcaggtgcccagcgctgtgcgctgcctgcagaagaggggcagcgccaccagcagcagcaacaccagcctgacctag

SEQ ID NO: 164689 - DNA, 354 bp, Artificial Sequence
  Description of Artificial Sequence: Synthetic coding sequence
atgaatgcccccccagcctttgagagcttcctgctgtttgaaggagagaagaagatcaccatcaacaaggacaccaaggtgcccaatgcctgcctcttcaccatcaacaaggaggaccacaccctgggcaacatcatcaagagccagctgctgaaggacccccaggtgctgtttgctggctacaaggtgccccaccccctggagcacaagatcatcatccgggtgcagaccaccccagactacagcccccaggaggccttcaccaatgccatcacagacctgatcagcgagctgagcctgctggaggagcgcttccgggtggccatcaaggacaagcaggagggcatcgagtag

SEQ ID NO: 164690 - DNA, 384 bp, Artificial Sequence
  Description of Artificial Sequence: Synthetic coding sequence
atgaatgcccccccagcctttgagagcttcctgctgtttgaaggagagaagaagatcaccatcaacaaggacaccaaggtgcccaatgcctgcctcttcaccatcaacaaggaggaccacaccctgggcaacatcatcaagagccagctgctgaaggacccccaggtgctgtttgctggctacaaggtgccccaccccctggagcacaagatcatcatccgggtgcagaccaccccagactacagcccccaggaggccttcaccaatgccatcacagacctgatcagcgagctgagcctgctggaggagcgcttccgggtgcgggccggccctggaggagcagatggagtggccatcaaggacaagcaggagggcatcgagtag

SEQ ID NO: 164691 - DNA, 351 bp, Artificial Sequence
  Description of Artificial Sequence: Synthetic coding sequence
atgaatgcccccccagcctttgagagcttcctgctgtttgaaggagagaagatcaccatcaacaaggacaccaaggtgcccaaggcctgcctcttcaccatcaacaaggaggaccacaccctgggcaacatcatcaagagccgggcctgcttcccctttgccttctgccgggactgccagtttcctgaggccagccctgccaccctgcctgtgcagcctgctgagctgtgcccccgggcccaccagctgtgtgccccagccctgaagaggcacctgggcggggaggcccaccctgtgcacctgcatgctggagctgccagcaggcctgtgcagcagccccagcacctgtag

SEQ ID NO: 164692 - DNA, 348 bp, Artificial Sequence
  Description of Artificial Sequence: Synthetic coding sequence
atgaatgcccccccagcctttgagagcttcctgctgtttgaaggagagaagatcaccatcaacaaggacaccaaggtgcccaaggcctgcctcttcaccatcaacaaggaggaccacaccctgggcaacatcatcaagagccagctgctgaaggacccccaggtgctgtttgctggctacaaggtgccccaccccctggagcacaagatcatcatccgggtgcagaccaccccagactacagcccccaggaggccttcaccaatgccatcacagacctgatcagcgagctgagcctgctggaggagcgcttccgcacctgcctgctgcccctgcggctgctgccctag

SEQ ID NO: 164693 - DNA, 177 bp, Artificial Sequence
  Description of Artificial Sequence: Synthetic coding sequence
atggacacccagaaggatgtgcagccccccaagcagcagcccatgatctacatctgtggggagtgccacacagaaaatgagatcaagagccgggaccccatccgctgccgggagtgtggctaccgcatcatgtacaagaagaggaccaagaggctggtggtgtttgatgccaggtag

SEQ ID NO: 164694 - DNA, 204 bp, Artificial Sequence
  Description of Artificial Sequence: Synthetic coding sequence
atgatcatccctgtgcgctgcttcacctgtgggaagatcgtgggcaacaagtgggaggcctacctgggcctgctgcaggccgagtacacagaaggagatgccctggatgccctgggcctgaagcgctactgctgcaggaggatgctgctggcccacgtggacctgattgagaagctgctgaactatgcccccctggagaagtag

SEQ ID NO: 164695 - DNA, 204 bp, Artificial Sequence; identical to SEQ ID NO: 164694
  Description of Artificial Sequence: Synthetic coding sequence

SEQ ID NO: 164696 - DNA, 4173 bp, Artificial Sequence
  Description of Artificial Sequence: Synthetic coding sequence
atggtgaaggagcagttccgggagacagatgtggccaagaagatcagccacatctgcttcggcatgaagagccctgaggagatgaggcagcaggcccacatccaggtggtgtccaagaacctgtacagccaggacaaccagcacgcccccctgctgtatggagtgctggaccacaggatgggcaccagcgagaaggaccggccctgtgagacctgtgggaagaacctggccgactgcctgggccactacggctacatcgacctggagctgccctgcttccacgtgggctacttccgggccgtcatcggcatcctgcagatgatctgcaagacctgctgccacatcatgctgagccaggaggagaagaagcagttcctggactacctgaagaggcctggcctgacctacctgcagaagaggggcctgaagaagaagatcagtgacaagtgcaggaagaagaacatctgccaccactgtggggccttcaatggaacagtgaagaagtgtggcctgctgaagatcatccacgagaagtacaagaccaacaagaaggtggtggaccccatcgtgagcaacttcctgcagagctttgaaacagccatcgagcacaacaaggaggtggagcccctgctgggccgggcccaggagaacctgaaccccctggtggtgctgaacctcttcaagaggatcccagcagaagatgtgcccctgctgctgatgaaccctgaggccggcaagcccagcgacctgatcctgacccggctgctggtgccccccctgtgcatccggcccagcgtggtgtctgacctgaagagcggcaccaatgaagatgacctgaccatgaagctgacagagatcatcttcctgaatgatgtgatcaagaagcaccgcatcagcggggccaagacccagatgatcatggaggactgggacttcctgcagctgcagtgtgccctgtacatcaacagcgagctgagcggcatccccctgaacatggcccccaagaagtggacccggggctttgtgcagaggctgaagggcaagcagggccgcttccggggcaacctgagcggcaagagggtggacttcagcggccgcaccgtcatcagcccagaccccaacctgagaattgatgaggtggccgtgcctgtgcacgtggccaagatcctgaccttccctgagaaggtgaacaaggccaacatcaacttcctgaggaagctggtgcagaatggacctgaggtgcaccctggggccaacttcatccagcagaggcacacccagatgaagcgcttcctgaagtatggcaaccgggagaagatggcccaggagctgaagtacggggacatcgtggagcggcacctgattgatggagatgtggtgctcttcaaccggcagcccagcctgcacaagctgagcatcatggcccacctggcccgggtgaagccccacaggaccttccgcttcaatgaatgtgtgtgcaccccctacaatgctgactttgatggagatgagatgaacctgcacctgccccagacagaggaggccaaggccgaggccctggtgctgatgggcaccaaggccaacctggtgaccccaagaaatggagagcccctgattgctgccatccaggacttcctgactggagcctacctgctgaccctgaaggacaccttctttgaccgggccaaggcctgccagatcatcgccagcatcctggtgggcaaggatgagaagatcaaggtgcggctgcccccacccaccatcctgaagcctgtgaccctgtggacaggcaagcagatcttcagcgtcatcctgcggcccagtgatgacaaccctgtgcgggccaacctgcggaccaagggcaagcagtactgtgggaaaggagaggacctgtgtgccaatgacagctatgtgaccatccagaacagcgagctgatgagcggctccatggacaagggcaccctgggcagcggcagcaagaacaacatcttctacatcctgctgcgggactggggccagaatgaggccgcagatgccatgagccggctggcccggctggcccctgtgtacctgagcaacagaggcttcagcatcggcattggagatgtgaccccaggccagggcctgctgaaggccaagtatgagctgctgaatgccggctacaagaagtgtgatgagtacatcgaggccctgaacacaggcaagctgcagcagcagcccggctgcacagctgaggagaccctggaggccctgatcctgaaggagctgagcgtcatccgggaccatgctggcagcgcctgcctgcgggagctggacaagagcaacagccccctgaccatggccctgtgtggcagcaagggcagcttcatcaacatcagccagatgattgcctgtgtgggccagcaggccatcagcggcagccgggtgcctgatggctttgagaacagaagcctgccccactttgagaagcacagcaagctgcctgctgccaagggctttgtggccaacagcttctacagcggcctgacccccacagagttcttcttccacaccatggccggccgggagggcctggtggacacagctgtgaagacagctgagaccggctacatgcagaggcggctggtgaagagcctggaggacctgtgcagccagtatgacctgactgtgcgcagcagcactggagacatcatccagttcatctatggaggagatggcctggaccctgctgccatggagggcaaggatgagcccctggagttcaagagggtgctggacaacatcaaggctgtgttcccctgccccagcgagcccgccctgagcaagaatgaactcatcctgaccacagagagcatcatgaagaagtctgagttcctgtgctgccaggacagcttcctgcaggagatcaagaagttcatcaagggcgtgtctgagaagatcaagaagacccgggacaagtatggcatcaatgacaatggcaccacagagccccgggtgctgtaccagctggaccgcatcacccccacccaggtggagaagttcctggagacctgccgggacaagtacatgagggcccagatggagcccggcagcgctgtgggcgccctgtgtgcccagagcattggagagcccggcacccagatgaccctgaagaccttccactttgctggggtggcctccatgaacatcaccctgggcgtgccccgcatcaaggagatcatcaatgccagcaaggccatcagcacccccatcatcacagcccagctggacaaggatgatgatgctgactatgcccggctggtgaagggcagaattgagaagaccctgctgggggagatcagcgagtacatcgaggaggtgttcctgcctgatgactgcttcatcctggtgaagctgagcctggagcgcatccggctgctgcggctggaggtgaatgctgagaccgtgcgctacagcatctgcaccagcaagctgcgggtgaagccaggagatgtggccgtgcacggggaggccgtggtgtgtgtgaccccccgggagaacagcaagagctccatgtactacgtgctgcagttcctgaaggaggacctgcccaaggtggtggtgcagggcatccctgaggtgtcccgggccgtcatccacattgatgagcagagcggcaaggagaagtacaagctgctggtggagggggacaacctgcgggctgtgatggccacccatggagtgaagggcaccaggaccaccagcaacaacacctatgaggtggagaagaccctgggcatcgaggccgcccggaccaccatcatcaatgagatccagtacaccatggtgaaccacggcatgagcattgaccggcggcacgtgatgctgctgagtgacctgatgacctacaagggggaggtgctgggcatcacccgcttcggcctggccaagatgaaggagagcgtgctgatgctggccagctttgagaagacagctgaccacctgtttgatgctgcctacttcggccagaaggacagcgtgtgtggggtgtctgagtgcatcatcatgggcatccccatgaacattggaacaggcctcttcaagctgctgcacaaggctgaccgggaccccaacccccccaagaggcccctcatctttgacaccaatgagttccacatccccctggtgacctag

SEQ ID NO: 164697 - DNA, 489 bp, Artificial Sequence
  Description of Artificial Sequence: Synthetic coding sequence
atgtactacgtgctgcagttcctgaaggaggacctgcccaaggtggtggtgcagggcatccctgaggtgtcccgggccgtcatccacattgatgagcagagcggcaaggagaagtacaagctgctggtggagggggacaacctgcgggctgtgatggccacccatggagtgaagggcaccaggaccaccagcaacaacacctatgaggtggagaagaccctgggcatcgaggccgcccggaccaccatcatcaatgagatccagtacaccatggtgaaccacggcatgagcattgaccggcggcacgtgatgctgctgagtgacctgatgacctacaagggggaggtgctgggcatcacccgcttcggcctggccaagatgaaggagagcgtgctgatgctggccagctttgagaagacagctgaccacctgtttgatgctgcctacttcggccagaaggacagcgtgtgtgcctggccccagccctag

SEQ ID NO: 164698 - DNA, 4110 bp, Artificial Sequence
  Description of Artificial Sequence: Synthetic coding sequence
atggtgaaggagcagttccgggagacagatgtggccaagaagatcagccacatctgcttcggcatgaagagccctgaggagatgaggcagcaggcccacatccaggtggtgtccaagaacctgtacagccaggacaaccagcacgcccccctgctgtatggagtgctggaccacaggatgggcaccagcgagaaggaccggccctgtgagacctgtgggaagaacctggccgactgcctgggccactacggctacatcgacctggagctgccctgcttccacgtgggctacttccgggccgtcatcggcatcctgcagatgatctgcaagacctgctgccacatcatgctgagccaggaggagaagaagcagttcctggactacctgaagaggcctggcctgacctacctgcagaagaggggcctgaagaagaagatcagtgacaagtgcaggaagaagaacatctgccaccactgtggggccttcaatggaacagtgaagaagtgtggcctgctgaagatcatccacgagaagtacaagaccaacaagaaggtggtggaccccatcgtgagcaacttcctgcagagctttgaaacagccatcgagcacaacaaggaggtggagcccctgctgggccgggcccaggagaacctgaaccccctggtggtgctgaacctcttcaagaggatcccagcagaagatgtgcccctgctgctgatgaaccctgaggccggcaagcccagcgacctgatcctgacccggctgctggtgccccccctgtgcatccggcccagcgtggtgtctgacctgaagagcggcaccaatgaagatgacctgaccatgaagctgacagagatcatcttcctgaatgatgtgatcaagaagcaccgcatcagcggggccaagacccagatgatcatggaggactgggacttcctgcagctgcagtgtgccctgtacatcaacagcgagctgagcggcatccccctgaacatggcccccaagaagtggacccggggctttgtgcagaggctgaagggcaagcagggccgcttccggggcaacctgagcggcaagagggtggacttcagcggccgcaccgtcatcagcccagaccccaacctgagaattgatgaggtggccgtgcctgtgcacgtggccaagatcctgaccttccctgagaaggtgaacaaggccaacatcaacttcctgaggaagctggtgcagaatggacctgaggtgcaccctggggccaacttcatccagcagaggcacacccagatgaagcgcttcctgaagtatggcaaccgggagaagatggcccaggagctgaagtacggggacatcgtggagcggcacctgattgatggagatgtggtgctcttcaaccggcagcccagcctgcacaagctgagcatcatggcccacctggcccgggtgaagccccacaggaccttccgcttcaatgaatgtgtgtgcaccccctacaatgctgactttgatggagatgagatgaacctgcacctgccccagacagaggaggccaaggccgaggccctggtgctgatgggcaccaaggccaacctggtgaccccaagaaatggagagcccctgattgctgccatccaggacttcctgactggagcctacctgctgaccctgaaggacaccttctttgaccgggccaaggcctgccagatcatcgccagcatcctggtgggcaaggatgagaagatcaaggtgcggctgcccccacccaccatcctgaagcctgtgaccctgtggacaggcaagcagatcttcagcgtcatcctgcggcccagtgatgacaaccctgtgcgggccaacctgcggaccaagggcaagcagtactgtgggaaaggagaggacctgtgtgccaatgacagctatgtgaccatccagaacagcgagctgatgagcggctccatggacaagggcaccctgggcagcggcagcaagaacaacatcttctacatcctgctgcgggactggggccagaatgaggccgcagatgccatgagccggctggcccggctggcccctgtgtacctgagcaacagaggcttcagcatcggcattggagatgtgaccccaggccagggcctgctgaaggccaagtatgagctgctgaatgccggctacaagaagtgtgatgagtacatcgaggccctgaacacaggcaagctgcagcagcagcccggctgcacagctgaggagaccctggaggccctgatcctgaaggagctgagcgtcatccgggaccatgctggcagcgcctgcctgcgggagctggacaagagcaacagccccctgaccatggccctgtgtggcagcaagggcagcttcatcaacatcagccagatgattgcctgtgtgggccagcaggccatcagcggcagccgggtgcctgatggctttgagaacagaagcctgccccactttgagaagcacagcaagctgcctgctgccaagggctttgtggccaacagcttctacagcggcctgacccccacagagttcttcttccacaccatggccggccgggagggcctggtggacacagctgtgaagacagctgagaccggctacatgcagaggcggctggtgaagagcctggaggacctgtgcagccagtatgacctgactgtgcgcagcagcactggagacatcatccagttcatctatggaggagatggcctggaccctgctgccatggagggcaaggatgagcccctggagttcaagagggtgctggacaacatcaaggctgtgttcccctgccccagcgagcccgccctgagcaagaatgaactcatcctgaccacagagagcatcatgaagaagtctgagttcctgtgctgccaggacagcttcctgcaggagatcaagaagttcatcaagggcgtgtctgagaagatcaagaagacccgggacaagtatggcatcaatgacaatggcaccacagagccccgggtgctgtaccagctggaccgcatcacccccacccaggtggagaagttcctggagacctgccgggacaagtacatgagggcccagatggagcccggcagcgctgtgggcgccctgtgtgcccagaggaacatcaccctgggcgtgccccgcatcaaggagatcatcaatgccagcaaggccatcagcacccccatcatcacagcccagctggacaaggatgatgatgctgactatgcccggctggtgaagggccgcatcgagaagaccctgctgggggagatcagcgagtacatcgaggaggtgttcctgcctgatgactgcttcatcctggtgaagctgagcctggagcgcatccggctgctgcggctggaggtgaatgctgagaccgtgcgctacagcatctgcaccagcaagctgcgggtgaagccaggagatgtggccgtgcatggagaggccgtggtgtgtgtgaccccccgggagaacagcaagagctccatgtactacgtgctgcagttcctgaaggaggacctgcccaaggtggtggtgcagggcatccctgaggtgtccagagctgtgatccacattgatgagcagagcggcaaggagaagtacaagctgctggtggagggggacaacctgcgggctgtgatggccacccacggcgtgaagggcaccaggaccaccagcaacaacacctatgaggtggagaagaccctgggcattgaagctgcccggaccaccatcatcaatgagatccagtacaccatggtgaaccacggcatgagcattgacagaagacatgtgatgctgctgagtgacctgatgacctacaagggggaggtgctgggcatcaccaggtttggcctggccaagatgaaggagagcgtgctgatgctggccagctttgagaagacagctgaccacctgtttgatgctgcctacttcggccagaaggacagcgtgtgtggggtgtctgagtgcatcatcatgggcatccccatgaacatcggcaccggcctcttcaagctgctgcacaaggctgaccgggaccccaacccccccaagaggcccctcatctttgacaccaatgagttccacatccccctggtgacctag

SEQ ID NO: 164699 - DNA, 753 bp, Artificial Sequence; identical to SEQ ID NO: 149633
  Description of Artificial Sequence: Synthetic coding sequence

SEQ ID NO: 164700 - DNA, 3228 bp, Artificial Sequence
  Description of Artificial Sequence: Synthetic coding sequence
atgaaggccaatgagaaggtgaccagtgatgctgaccccatgtggtacctgaagtacctgaacatctacgtgggcctgcctgatgtggaggagagcttcaacgtgaccaggcctgtgagcccccatgaatgtcggctgcgggacatgacctacagcgcccccatcaccgtggacatcgagtacacccggggcagccagaggatcatcagaaatgccctgcccatcggccgcatgcccatcatgctgcggagcagcaactgtgtgctgaccgggaagaccccagctgagtttgccaagctgaatgaatgtcccctggaccccggcggctacttcatcgtgaagggcgtggagaaggtgatcctgatccaggagcagctgagcaagaaccgcatcatcgtggaggccgacagaaaaggagctgtgggcgcctctgtgaccagcagcacccatgagaagaagagcaggaccaacatggctgtgaagcagggccgcttctacctgcggcacaacaccctgtctgaggacatccccatcgtcatcatcttcaaggccatgggcgtggagagtgaccaggagatcgtgcagatgattggaacagaggagcacgtgatggccgccttcggccccagcctggaggagtgccagaaggcccagatcttcacccagatgcaggccctgaagtacatcggcaacaaggtgcggcggcagaggatgtggggcggcggccccaagaagaccaagattgaggaggcccgggagctgctggccagcaccatcctgacccacgtgcctgtgaaggagttcaacttccgggccaagtgcatctacacagctgtgatggtgcggcgggtcatcctggcccagggcgacaacaaggtggatgaccgggactactacggcaacaagaggctggagctggccggccagctgctgagcctgctgtttgaggacctcttcaagaagttcaacagcgagatgaagaagattgctgaccaggtgatccccaagcagagagctgcccagtttgatgtggtgaagcacatgaggcaggaccagatcaccaacggcatggtgaatgccatcagcactggaaactggagcctgaagcgcttcaagatggaccggcagggcgtgacccaggtgctgagccggctgagctacatcagcgccctgggcatgatgacccgcatcagcagccagtttgagaagaccaggaaggtgtctggccccaggagcctgcagcccagccagtggggcatgctgtgccccagcgacaccccagagggggaggcctgtggcctggtgaagaacctggccctgatgacccacatcaccacagacatggaggatggccccatcgtgaagctggccagcaacctgggcgtggaggatgtgaacctgctgtgtggggaggagctgagctacccaaatgtgttcctggtgttcctgaatggaaacatcctgggcgtcatccgggaccacaagaagctggtgaacaccttccggctgatgagaagagctggctacatcaatgaatttgtgtccatcagcaccaacctgacagacagatgtgtgtacatcagcagtgatggcggccgcctgtgccggccctacatcatcgtgaagaagcagaagccagctgtgaccaacaagcacatggaggagctggcccagggctacagaaactttgaggacttcctgcacgagagcctggtggagtacctggatgtgaatgaggagaatgactgcaacatcgccctgtatgagcacaccatcaacaaggacaccacccacctggagattgagcccttcaccctgctgggcgtgtgtgccggcctcatcccctacccccaccacaaccagagccccaggaacacctaccagtgtgccatgggcaagcaggccatgggcaccatcggctacaaccagaggaacagaattgacaccctgatgtacctgctggcctacccccagaagcccatggtgaagaccaagaccatcgagctgattgaatttgagaagctgcctgctggccagaatgccaccgtggccgtgatgagctacagcggctatgacattgaagatgccctggtgctgaacaaggccagcctggaccggggcttcggccgctgcctggtgtacaagaatgccaagtgcaccctgaagcgctacaccaaccagacctttgacaaggtgatgggccccatgctggatgctgccaccaggaagcccatctggaggcatgagatcctggatgctgatggcatctgcagccctggagagaaggtggagaacaagcaggtgctggtgaacaagtccatgcccaccgtgacccagatccccctggagggcagcaatgtgccccagcagccccagtacaaggatgtgcccatcacctacaagggggccacagacagctacatcgagaaggtgatgatcagcagcaatgcagaagatgccttcctgatcaagatgctgctgcggcagaccaggaggcctgagattggagacaagttcagcagcagacatggccagaagggcgtgtgtggcctcatcgtgccccaggaggacatgcccttctgtgacagcggcatctgcccagacatcatcatgaacccccacggcttccccagcaggatgacagtgggcaagctgattgagctgctggccggcaaggccggcgtgctggatggccgcttccactacggcacagccttcggcggcagcaaggtgaaggatgtgtgtgaggacctggtgagacatggctacaactacctgggcaaggactatgtgaccagcggcatcaccggggagcccctggaggcctacatctacttcggccctgtgtactaccagaagctgaagcacatggtgctggacaagatgcacgcccgggcccggggccccagggctgtgctgacccggcagcccacagagggccgcagcagagatggcggcctgcggctgggggagatggagcgggactgcctgattggctacggggcctccatgctgctgctggagcggctgatgatcagcagtgatgcctttgaggtggatgtgtgtggccagtgtggcctgctgggctacagcggctggtgccactactgcaagagcagctgccacgtgagcagcctgcgcatcccctatgcctgcaagctgctcttccaggagctgcagagcatgaacatcatcccccggctgaagctgagcaagtacaatgaatag

SEQ ID NO: 164701 - DNA, 633 bp, Artificial Sequence
  Description of Artificial Sequence: Synthetic coding sequence
atggatgatgaggaggagacctaccgcctgtggaagatcaggaagaccatcatgcagctgtgccacgaccggggctacctggtgacccaggatgagctggaccagaccctggaggagttcaaggcccagagcggggacaagcccagcgagggccggcccaggagaacagacctgactgtgctggtggcccacaatgatgaccccacagaccagatgtttgtgttcttccctgaggagcccaaggtgggcatcaagaccatcaaggtgtactgccagaggatgcaggaggagaacatcacccgggccctgattgtggtgcagcagggcatgaccccatctgccaagcagagcctggtggacatggcccccaagtacatcctggagcagttcctgcagcaggagctgctgatcaacatcacagagcacgagctggtgcctgagcacgtggtgatgaccaaggaggaggtgacagagctgctggcccgctacaagctgcgggagaaccagctgccccgcatccaggccggggaccctgtggcccgctacttcggcatcaagaggggccaggtggtgaagatcatccggcccagcgagacagctggccgctacatcacctaccgcctggtgcagtag

SEQ ID NO: 164702 - DNA, 1173 bp, Artificial Sequence
  Description of Artificial Sequence: Synthetic coding sequence
atggaggaccccaccctgtacatcgtggagcggcccctgcccggctacccagatgctgaggcccctgagcccagcagcgctggggcccaggccgctgaggagcccagcggggccggcagcgaggagctgatcaagagtgaccaggtgaatggagtgctggtgctgagcctgctggacaagatcatcggggctgtggaccagatccagctgacccaggcccagctggaggagcggcaggccgagatggagggcgctgtgcagagcatccagggcgagctgagcaagctgggcaaggcccacgccaccaccagcaacacagtgtccaagctgctggagaaggtgaggaaggtgtctgtgaatgtgaagacagtgcggggcagcctggagcggcaggccggccagatcaagaagctggaggtgaatgaagctgagctgctgcggcggaggaacttcaaggtgatgatctaccaggatgaggtgaagctgcctgccaagctgagcatcagcaagagcctgaaggagagcgaggccctgcctgagaaggagggggaggagctgggggagggggagaggcctgaggaggatgctgctgccctggagctgagcagtgatgaggccgtggaggtggaggaggtgattgaggagagcagagctgagcgcatcaagaggagcggcctgcggcgggtggatgacttcaagaaggccttcagcaaggagaagatggagaagaccaaggtgaggacccgggagaacctggagaagacccggctgaagaccaaggagaacctggagaagaccaggcacaccctggagaagaggatgaacaagctgggcacccggctggtgcctgctgagcggcgggagaagctgaagaccagccgggacaagctgaggaagagcttcaccccagaccacgtggtgtatgcccggagcaagacagctgtgtacaaggtgccccccttcaccttccacgtgaagaagatccgggagggccaggtggaggtgctgaaggccacagagatggtggaggtgggcgcagatgatgatgaaggaggagctgagcggggggaggccggggacctgcggcggggcagcagcccagatgtgcacgccctgctggagatcacagaggagagtgatgctgtgctggtggacaagagtgacagcgactag

SEQ ID NO: 164703 - DNA, 1038 bp, Artificial Sequence
  Description of Artificial Sequence: Synthetic coding sequence
atggaggaccccaccctgtacatcgtggagcggcccctgcccggctacccagatgctgtggaccagatccagctgacccaggcccagctggaggagcggcaggccgagatggagggcgctgtgcagagcatccagggcgagctgagcaagctgggcaaggcccacgccaccaccagcaacacagtgtccaagctgctggagaaggtgaggaaggtgtctgtgaatgtgaagacagtgcggggcagcctggagcggcaggccggccagatcaagaagctggaggtgaatgaggccgagctgctgcggcggaggaacttcaaggtgatgatctaccaggatgaggtgaagctgcctgccaagctgagcatcagcaagagcctgaaggagagcgaggccctgcctgagaaggagggggaggagctgggggagggggagaggccagaagaagatgctgctgccctggagctgagcagtgatgaagctgtggaggtggaggaggtgattgaggagagcagagctgagcgcatcaagaggagcggcctgcggcgggtggatgacttcaagaaggccttcagcaaggagaagatggagaagaccaaggtgaggacccgggagaacctggagaagacccggctgaagaccaaggagaacctggagaagaccaggcacaccctggagaagaggatgaacaagctgggcacccggctggtgcctgctgagcggcgggagaagctgaagaccagccgggacaagctgaggaagagcttcaccccagaccacgtggtgtatgcccggagcaagacagctgtgtacaaggtgccccccttcaccttccacgtgaagaagatccgggagggccaggtggaggtgctgaaggccacagagatggtggaggtgggcgcagatgatgatgagggcggcgctgagcggggggaggccggggacctgcggcggggcagcagcccagatgtgcacgccctgctggagatcacagaggagagtgatgctgtgctggtggacaagagtgacagcgactag

SEQ ID NO: 164704 - DNA, 2295 bp, Artificial Sequence
  Description of Artificial Sequence: Synthetic coding sequence
atgctgctgtttgtgctgacctgcctgctggccgtgtttcctgccatcagcaccaagagccccatctttggacctgaggaggtgaacagcgtggagggcaacagcgtgtccatcacctgctactacccacccacctctgtgaacagacacaccaggaagtactggtgccggcagggcgcccggggcggctgcatcaccctcatcagcagcgagggctacgtgagcagcaaatatgccggccgggccaacctgaccaacttcccagaaaatggcacctttgtggtgaacatcgcccagctgagccaggatgattctggccgctacaagtgtggcctgggcatcaacagccggggcctgagctttgatgtgtccctggaggtgtcccagggccctggcctgctgaatgacaccaaggtgtacacagtggacctgggccgcacagtgaccatcaactgccccttcaagacagaaaatgcccagaagaggaagagcctgtacaagcagatcggcctgtaccctgtgctggtgattgacagcagcggctacgtgaaccccaactacacaggccgcatccggctggacatccagggcaccggccagctgctcttctctgtggtgatcaaccagctgcggctgagtgatgctggccagtacctgtgccaggccggagatgacagcaacagcaacaagaagaatgctgacctgcaggtgctgaagccagagcctgagctggtgtatgaggacctgcggggctctgtgaccttccactgtgccctgggccctgaggtggccaacgtggccaagttcctgtgccggcagagcagtggagagaactgtgatgtggtggtgaacaccctgggcaagagggccccagcctttgagggccgcatcctgctgaacccccaggacaaggatggcagcttctctgtggtgatcaccggcctgaggaaggaggatgctggccgctacctgtgtggggcccacagtgatggccagctgcaggagggcagccccatccaggcctggcagctgtttgtgaatgaggagagcaccatccccaggagccccaccgtggtgaagggcgtggccggcggctctgtggccgtgctgtgcccctacaacaggaaggagagcaagagcatcaagtactggtgcctgtgggagggcgcccagaatggccgctgccccctgctggtggacagcgagggctgggtgaaggcccagtatgagggccgcctgagcctgctggaggagcctggaaatggcaccttcaccgtcatcctgaaccagctgaccagcagagatgctggcttctactggtgcctgaccaacggggacaccctgtggaggaccaccgtggagatcaagatcatcgagggggagcccaacctgaaggtgcctggaaatgtgacagctgtgctgggggagaccctgaaggtgccctgccacttcccctgcaagttcagcagctatgagaagtactggtgcaagtggaacaacacaggctgccaggccctgcccagccaggatgagggccccagcaaggcctttgtgaactgtgatgagaacagccggctggtgtccctgaccctgaacctggtgaccagggcagatgagggctggtactggtgtggggtgaagcagggccacttctacggggagacagctgctgtgtatgtggccgtggaggagaggaaggccgccggcagcagagatgtgtccctggccaaggcagatgctgccccagatgagaaggtgctggacagcggcttccgggagattgagaacaaggccatccaggacccccggctgtttgctgaggagaaggctgtggccgacacccgggaccaggctgatggcagccgggcctctgtggacagcggcagcagcgaggagcagggcggcagcagccgggccctggtgtccaccctggtgcccctgggcctggtgctggccgtgggcgctgtggccgtgggcgtggcccgggcccggcacaggaagaatgtggacagagtgtccatccgcagctacagaacagacatctccatgtctgactttgagaacagccgggagtttggagccaatgacaacatgggcgccagcagcatcacccaggagaccagcctgggcggcaaggaggagtttgtggccaccacagagagcaccacagagaccaaggagcccaagaaggccaagaggagcagcaaggaggaggccgagatggcctacaaggacttcctgctgcagagcagcacagtggccgctgaggcccaggacggcccccaggaggcctag

SEQ ID NO: 164705 - DNA, 1596 bp, Artificial Sequence
  Description of Artificial Sequence: Synthetic coding sequence
atggatggcatcgtgcctgacattgctgtgggcaccaagaggggcagtgatgagctgttcagcacctgtgtgaccaacggccccttcatcatgagcagcaacagcgccagcgctgccaatggaaatgacagcaagaagttcaagggggacagccgctctgctggggtgcccagcagggtcatccacatcaggaagctgcccattgatgtgacagaaggagaggtgatcagcctgggcctgccctttgggaaggtgaccaacctgctgatgctgaagggcaagaaccaggccttcatcgagatgaacacagaggaggccgccaacaccatggtgaactactacacctctgtgacccctgtgctgcggggccagcccatctacatccagttcagcaaccacaaggagctgaagacagacagcagccccaaccaggcccgggcccaggccgccctgcaggccgtgaacagcgtgcagagcggcaacctggccctggccgccagcgctgctgctgtggatgctggcatggccatggccggccagagccctgtgctgcgcatcatcgtggagaacctcttctaccctgtgaccctggatgtgctgcaccagatcttcagcaagtttggaacagtgctgaagatcatcaccttcaccaagaacaaccagttccaggccctgctgcagtatgctgaccctgtgtctgcccagcacgccaagctgagcctggatggccagaacatctacaatgcctgctgcaccctgagaattgacttcagcaagctgaccagcctgaatgtgaagtacaacaatgacaagagccgggactacaccaggccagacctgcccagcggggacagccagcccagcctggaccagaccatggctgctgccttcggcctgtctgtgcccaacgtgcatggagccctggcccccctggccatccccagcgctgctgctgctgctgctgctgctggccgcatcgccatccctggcctggccggggccggcaacagcgtgctgctggtgagcaacctgaaccctgagcgggtgaccccccagagcctcttcatcctgtttggagtgtatggagatgtgcagagggtgaagatcctcttcaacaagaaggaaaatgccctggtgcagatggctgatggcaaccaggcccagctggccatgagccacctgaatggccacaagctgcacggcaagcccatccgcatcaccctgagcaagcaccagaatgtgcagctgccccgggagggccaggaggaccagggcctgaccaaggactatggcaacagccccctgcaccgcttcaagaagccaggcagcaagaacttccagaacatcttccccccatctgccaccctgcacctgagcaacatcccccccagcgtgtctgaggaggacctgaaggtgctcttcagcagcaatggaggagtggtgaagggcttcaagttcttccagaaggacaggaagatggccctgatccagatgggctctgtggaggaggccgtgcaggccctgattgacctgcacaaccacgacctgggggagaaccaccacctgcgggtgtccttcagcaagagcaccatctag

SEQ ID NO: 164706 - DNA, 594 bp, Artificial Sequence
  Description of Artificial Sequence: Synthetic coding sequence
atggatggcatcgtgcctgacattgctgtgggcaccaagagggtgaccccccagagcctcttcatcctgtttggagtgtatggagatgtgcagagggtgaagatcctcttcaacaagaaggaaaatgccctggtgcagatggctgatggcaaccaggcccagctggccatgagccacctgaatggccacaagctgcacggcaagcccatccgcatcaccctgagcaagcaccagaatgtgcagctgccccgggagggccaggaggaccagggcctgaccaaggactatggcaacagccccctgcaccgcttcaagaagccaggcagcaagaacttccagaacatcttccccccatctgccaccctgcacctgagcaacatcccccccagcgtgtctgaggaggacctgaaggtgctcttcagcagcaatggaggagtggtgaagggcttcaagttcttccagaaggacaggaagatggccctgatccagatgggctctgtggaggaggccgtgcaggccctgattgacctgcacaaccacgacctgggggagaaccaccacctgcgggtgtccttcagcaagagcaccatctag

SEQ ID NO: 164707 - DNA, 1674 bp, Artificial Sequence
  Description of Artificial Sequence: Synthetic coding sequence
atggatggcatcgtgcctgacattgctgtgggcaccaagaggggcagtgatgagctgttcagcacctgtgtgaccaacggccccttcatcatgagcagcaacagcgccagcgctgccaatggaaatgacagcaagaagttcaagggggacagccgctctgctggggtgcccagcagggtcatccacatcaggaagctgcccattgatgtgacagaaggagaggtgatcagcctgggcctgccctttgggaaggtgaccaacctgctgatgctgaagggcaagaaccaggccttcatcgagatgaacacagaggaggccgccaacaccatggtgaactactacacctctgtgacccctgtgctgcggggccagcccatctacatccagttcagcaaccacaaggagctgaagacagacagcagccccaaccaggcccgggcccaggccgccctgcaggccgtgaacagcgtgcagagcggcaacctggccctggccgccagcgctgctgctgtggatgctggcatggccatggccggccagagccctgtgctgcgcatcatcgtggagaacctcttctaccctgtgaccctggatgtgctgcaccagatcttcagcaagtttggaacagtgctgaagatcatcaccttcaccaagaacaaccagttccaggccctgctgcagtatgctgaccctgtgtctgcccagcacgccaagctgagcctggatggccagaacatctacaatgcctgctgcaccctgagaattgacttcagcaagctgaccagcctgaatgtgaagtacaacaatgacaagagccgggactacaccaggccagacctgcccagcggggacagccagcccagcctggaccagaccatggctgctgcctttggagcccctggcatcatcagcgccagcccctatgctggggccggcttcccccccacctttgccatcccccaggccgccggcctgtctgtgcccaacgtgcatggagccctggcccccctggccatccccagcgctgctgctgctgctgctgctgctggccgcatcgccatccctggcctggccggggccggcaacagcgtgctgctggtgagcaacctgaaccctgagcgggtgaccccccagagcctcttcatcctgtttggagtgtatggagatgtgcagagggtgaagatcctcttcaacaagaaggaaaatgccctggtgcagatggctgatggcaaccaggcccagctggccatgagccacctgaatggccacaagctgcacggcaagcccatccgcatcaccctgagcaagcaccagaatgtgcagctgccccgggagggccaggaggaccagggcctgaccaaggactatggcaacagccccctgcaccgcttcaagaagccaggcagcaagaacttccagaacatcttccccccatctgccaccctgcacctgagcaacatcccccccagcgtgtctgaggaggacctgaaggtgctcttcagcagcaatggaggagtggtgaagggcttcaagttcttccagaaggacaggaagatggccctgatccagatgggctctgtggaggaggccgtgcaggccctgattgacctgcacaaccacgacctgggggagaaccaccacctgcgggtgtccttcagcaagagcaccatctag

SEQ ID NO: 164708 - DNA, 1653 bp, Artificial Sequence
  Description of Artificial Sequence: Synthetic coding sequence
atggatggcatcgtgcctgacattgctgtgggcaccaagaggggcagtgatgagctgttcagcacctgtgtgaccaacggccccttcatcatgagcagcaacagcgccagcgctgccaatggaaatgacagcaagaagttcaagggggacagccgctctgctggggtgcccagcagggtcatccacatcaggaagctgcccattgatgtgacagaaggagaggtgatcagcctgggcctgccctttgggaaggtgaccaacctgctgatgctgaagggcaagaaccaggccttcatcgagatgaacacagaggaggccgccaacaccatggtgaactactacacctctgtgacccctgtgctgcggggccagcccatctacatccagttcagcaaccacaaggagctgaagacagacagcagccccaaccaggcccgggcccaggccgccctgcaggccgtgaacagcgtgcagagcggcaacctggccctggccgccagcgctgctgctgtggatgctggcatggccatggccggccagagccctgtgctgcgcatcatcgtggagaacctcttctaccctgtgaccctggatgtgctgcaccagatcttcagcaagtttggaacagtgctgaagatcatcaccttcaccaagaacaaccagttccaggccctgctgcagtatgctgaccctgtgtctgcccagcacgccaagctgagcctggatggccagaacatctacaatgcctgctgcaccctgagaattgacttcagcaagctgaccagcctgaatgtgaagtacaacaatgacaagagccgggactacaccaggccagacctgcccagcggggacagccagcccagcctggaccagaccatggctgctgcctttgccagcccctatgctggggccggcttcccccccacctttgccatcccccaggccgccggcctgtctgtgcccaacgtgcacggggccctggcccccctggccatccccagcgctgctgctgctgctgctgctgctggaagaattgccatccctggcctggccggggccggcaacagcgtgctgctggtgagcaacctgaaccctgagcgggtgaccccccagagcctcttcatcctgtttggagtgtatggagatgtgcagagggtgaagatcctcttcaacaagaaggaaaatgccctggtgcagatggctgatggcaaccaggcccagctggccatgagccacctgaatggccacaagctgcacggcaagcccatccgcatcaccctgagcaagcaccagaatgtgcagctgccccgggagggccaggaggaccagggcctgaccaaggactatggcaacagccccctgcaccgcttcaagaagccaggcagcaagaacttccagaacatcttcccccccagcgccaccctgcacctgagcaacatccccccatctgtgtctgaggaggacctgaaggtgctcttcagcagcaatggaggagtggtgaagggcttcaagttcttccagaaggacaggaagatggccctgatccagatgggctctgtggaggaggccgtgcaggccctgattgacctgcacaaccacgacctgggggagaaccaccacctgcgggtgtccttcagcaagagcaccatctag

SEQ ID NO: 164709 - DNA, 1599 bp, Artificial Sequence
  Description of Artificial Sequence: Synthetic coding sequence
atggatggcatcgtgacagaggtggccgtgggcgtgaagaggggcagtgatgagctgctgagcggctctgtgctgagcagccccaacagcaacatgagctccatggtggtgacagccaatggaaatgacagcaagaagttcaagggggaggacaagatggatggagcccccagccgggtgctgcacatcaggaagctgcctggagaggtgacagaaacagaggtgattgccctgggcctgccctttgggaaggtgaccaacatcctgatgctgaagggcaagaaccaggccttcctggagctggccacagaggaggccgccatcaccatggtgaactactacagcgctgtgaccccccacctgaggaaccagcccatctacatccagtacagcaaccacaaggagctgaagacagacaacaccctgaaccagagggcccaggccgtgctgcaggccgtgacagctgtgcagacagccaacacccccctgagcggcaccaccgtgtctgagagcgctgtgaccccagcccagagccctgtgctgcgcatcatcatcgacaacatgtactaccctgtgaccctggatgtgctgcaccagatcttcagcaagtttggagctgtgctgaagatcatcaccttcaccaagaacaaccagttccaggccctgctgcagtatggagaccctgtgaatgcccagcaggccaagctggccctggatggccagaacatctacaatgcctgctgcaccctgagaattgacttcagcaagctggtgaacctgaatgtgaagtacaacaatgacaagagccgggactacaccaggccagacctgcccagcggagatggccagcctgccctggaccctgccatcgccgccgcctttgccaaggagaccagcctgctggccgtgcctggggccctgagccccctggccatccccaatgctgctgctgctgctgctgctgctgctgctggccgggtgggcatgcctggggtgtctgctgggggcaacacagtgctgctggtgagcaacctgaatgaggagatggtgaccccccagagcctcttcaccctgtttggagtgtatggagatgtgcagagggtgaagatcctgtacaacaagaaggacagcgccctgatccagatggctgatggcaaccagagccagctggccatgaaccacctgaatggccagaagatgtatggcaagatcatccgggtgaccctgagcaagcaccagacagtgcagctgccccgggagggcctggatgaccagggcctgaccaaggactttggaaacagccccctgcaccgcttcaagaagccaggcagcaagaacttccagaacatcttcccccccagcgccaccctgcacctgagcaacatccccccatctgtggccgaggaggacctgcggaccctgtttgccaacacaggaggcaccgtgaaggccttcaagttcttccagagggaccacaagatggccctgctgcagatggccaccgtggaggaggccatccaggccctgattgacctgcacaactacaacctgggggagaaccaccacctgcgggtgtccttcagcaagagcaccatctag

SEQ ID NO: 164710 - DNA, 1614 bp, Artificial Sequence
  Description of Artificial Sequence: Synthetic coding sequence
atggatggcatcgtgacagaggtggccgtgggcgtgaagaggggcagtgatgagctgctgagcggctctgtgctgagcagccccaacagcaacatgagctccatggtggtgacagccaatggaaatgacagcaagaagttcaagggggaggacaagatggatggagcccccagccgggtgctgcacatcaggaagctgcctggagaggtgacagaaacagaggtgattgccctgggcctgccctttgggaaggtgaccaacatcctgatgctgaagggcaagaaccaggccttcctggagctggccacagaggaggccgccatcaccatggtgaactactacagcgctgtgaccccccacctgaggaaccagcccatctacatccagtacagcaaccacaaggagctgaagacagacaacaccctgaaccagagggcccaggccgtgctgcaggccgtgacagctgtgcagacagccaacacccccctgagcggcaccaccgtgtctgagagcgctgtgaccccagcccagagccctgtgctgcgcatcatcatcgacaacatgtactaccctgtgaccctggatgtgctgcaccagatcttcagcaagtttggagctgtgctgaagatcatcaccttcaccaagaacaaccagttccaggccctgctgcagtatggagaccctgtgaatgcccagcaggccaagctggccctggatggccagaacatctacaatgcctgctgcaccctgagaattgacttcagcaagctggtgaacctgaatgtgaagtacaacaatgacaagagccgggactacaccaggccagacctgcccagcggagatggccagcctgccctggaccctgccatcgccgccgcctttgccaaggagaccagcctgctgggcctgcctgtggccgctgtgcctggggccctgagccccctggccatccccaatgctgctgctgctgctgctgctgctgctgctggccgggtgggcatgcctggggtgtctgctgggggcaacacagtgctgctggtgagcaacctgaatgaggagatggtgaccccccagagcctcttcaccctgtttggagtgtatggagatgtgcagagggtgaagatcctgtacaacaagaaggacagcgccctgatccagatggctgatggcaaccagagccagctggccatgaaccacctgaatggccagaagatgtatggcaagatcatccgggtgaccctgagcaagcaccagacagtgcagctgccccgggagggcctggatgaccagggcctgaccaaggactttggaaacagccccctgcaccgcttcaagaagccaggcagcaagaacttccagaacatcttccccccatctgccaccctgcacctgagcaacatcccccccagcgtggccgaggaggacctgcggaccctgtttgccaacacaggaggcaccgtgaaggccttcaagttcttccagagggaccacaagatggccctgctgcagatggccaccgtggaggaggccatccaggccctgattgacctgcacaactacaacctgggggagaaccaccacctgcgggtgtccttcagcaagagcaccatctag

SEQ ID NO: 164711 - DNA, 1611 bp, Artificial Sequence
  Description of Artificial Sequence: Synthetic coding sequence
atggatggcatcgtgacagaggtggccgtgggcgtgaagaggggcagtgatgagctgctgagcggctctgtgctgagcagccccaacagcaacatgagctccatggtggtgacagccaatggaaatgacagcaagaagttcaagggggaggacaagatggatggagcccccagccgggtgctgcacatcaggaagctgcctggagaggtgacagaaacagaggtgattgccctgggcctgccctttgggaaggtgaccaacatcctgatgctgaagggcaagaaccaggccttcctggagctggccacagaggaggccgccatcaccatggtgaactactacagcgctgtgaccccccacctgaggaaccagcccatctacatccagtacagcaaccacaaggagctgaagacagacaacaccctgaaccagagggcccaggccgtgctgcaggccgtgacagctgtgcagacagccaacacccccctgagcggcaccaccgtgtctgagagcgctgtgaccccagcccagagccctgtgctgcgcatcatcatcgacaacatgtactaccctgtgaccctggatgtgctgcaccagatcttcagcaagtttggagctgtgctgaagatcatcaccttcaccaagaacaaccagttccaggccctgctgcagtatggagaccctgtgaatgcccagcaggccaagctggccctggatggccagaacatctacaatgcctgctgcaccctgagaattgacttcagcaagctggtgaacctgaatgtgaagtacaacaatgacaagagccgggactacaccaggccagacctgcccagcggagatggccagcctgccctggaccctgccatcgccgccgcctttgccaaggagaccagcctgctgggcctgcctgtggccgctgtgcctggggccctgagccccctggccatccccaatgctgctgctgctgctgctgctgctgctgctggccgggtgggcatgcctggggtgtctgctgggggcaacacagtgctgctggtgagcaacctgaatgaggagatggtgaccccccagagcctcttcaccctgtttggagtgtatggagatgtgcagagggtgaagatcctgtacaacaagaaggacagcgccctgatccagatggctgatggcaaccagagccagctggccatgaaccacctgaatggccagaagatgtatggcaagatcatccgggtgaccctgagcaagcaccagacagtgcagctgccccgggagggcctggatgaccagggcctgaccaaggactttggaaacagccccctgcaccgcttcaagaagccaggcagcaagaacttccagaacatcttccccccatctgccaccctgcacctgagcaacatcccccccagcgtggccgaggaggacctgcggaccctgtttgccaacacaggaggcaccgtgaaggccttcaagttcttccaggaccacaagatggccctgctgcagatggccaccgtggaggaggccatccaggccctgattgacctgcacaactacaacctgggggagaaccaccacctgcgggtgtccttcagcaagagcaccatctag

SEQ ID NO: 164712 - DNA, 1056 bp, Artificial Sequence
  Description of Artificial Sequence: Synthetic coding sequence
ggcatgaagaggggcagtgatgagctgctgagcggctctgtgctgagcagccccaacagcaacatgagctccatggtggtgacagccaatggaaatgacagcaagaagttcaagggggaggacaagatggatggagcccccagccgggtgctgcacatcaggaagctgcctggagaggtgacagaaacagaggtgattgccctgggcctgccctttgggaaggtgaccaacatcctgatgctgaagggcaagaaccaggccttcctggagctggccacagaggaggccgccatcaccatggtgaactactacagcgctgtgaccccccacctgaggaaccagcccatctacatccagtacagcaaccacaaggagctgaagacagacaacaccctgaaccagagggcccaggccgtgctgcaggccgtgacagctgtgcagacagccaacacccccctgagcggcaccaccgtgtctgagagcgctgtgaccccagcccagagccctgtgctgcgcatcatcatcgacaacatgtactaccctgtgaccctggatgtgctgcaccagatcttcagcaagtttggagctgtgctgaagatcatcaccttcaccaagaacaaccagttccaggccctgctgcagtatggagaccctgtgaatgcccagcaggccaagctggccctggatggccagaacatctacaatgcctgctgcaccctgagaattgacttcagcaagctggtgaacctgaatgtgaagtacaacaatgacaagagccgggactacaccaggccagacctgcccagcggagatggccagcctgccctggaccctgccatcgccgccgcctttgccaaggagaccagcctgctgggcctgcctgtggccgctgtgcctggggccctgagccccctggccatccccaatgctgctgctgctgctgctgctgctgctgctggccgggtgggcatgcctggggtgtctgctgggggcaacacagtgctgctggtgagcaacctgaatgaggaggtgttcatggagatgtgcagcgtgtag

SEQ ID NO: 164713 - DNA, 1647 bp, Artificial Sequence
  Description of Artificial Sequence: Synthetic coding sequence
atgtggagcaacctgaccttctccttcttcggcctgcggaccaaggccaagaagtatgtgacagtgaacaacagaggaagtgatgagctgctgagcggctctgtgctgagcagccccaacagcaacatgagctccatggtggtgacagccaatggaaatgacagcaagaagttcaagggggaggacaagatggatggagcccccagccgggtgctgcacatcaggaagctgcccggggaggtgacagaaacagaggtgattgccctgggcctgccctttgggaaggtgaccaacatcctgatgctgaagggcaagaaccaggccttcctggagctggccacagaggaggccgccatcaccatggtgaactactacagcgctgtgaccccccacctgaggaaccagcccatctacatccagtacagcaaccacaaggagctgaagacagacaacaccctgaaccagagggcccaggccgtgctgcaggccgtgacagctgtgcagacagccaacacccccctgagcggcaccaccgtgtctgagagcgctgtgaccccagcccagagccctgtgctgcgcatcatcatcgacaacatgtactaccctgtgaccctggatgtgctgcaccagatcttcagcaagtttggagctgtgctgaagatcatcaccttcaccaagaacaaccagttccaggccctgctgcagtacggggaccctgtgaatgcccagcaggccaagctggccctggatggccagaacatctacaatgcctgctgcaccctgagaattgacttcagcaagctggtgaacctgaatgtgaagtacaacaatgacaagagccgggactacaccaggccagacctgcccagcggagatggccagcctgccctggaccctgccatcgctgctgcctttgccaaggagaccagcctgctgggcctgcctgtggccgctgtgcctggggccctgagccccctggccatccccaatgctgctgctgctgctgctgctgctgctgctggccgggtgggcatgcctggggtgtctgctgggggcaacacagtgctgctggtgagcaacctgaatgaggagatggtgaccccccagagcctcttcaccctgtttggagtgtatggagatgtgcagagggtgaagatcctgtacaacaagaaggacagcgccctgatccagatggctgatggcaaccagagccagctggccatgaaccacctgaatggccagaagatgtatggcaagatcatccgggtgaccctgagcaagcaccagacagtgcagctgccccgggagggcctggatgaccagggcctgaccaaggactttggaaacagccccctgcaccgcttcaagaagccaggcagcaagaacttccagaacatcttcccccccagcgccaccctgcacctgagcaacatccccccatctgtggccgaggaggacctgcggaccctgtttgccaacacaggaggcaccgtgaaggccttcaagttcttccagagggaccacaagatggccctgctgcagatggccaccgtggaggaggccatccaggccctgattgacctgcacaactacaacctgggggagaaccaccacctgcgggtgtccttcagcaagagcaccatctag

SEQ ID NO: 164714 - DNA, 1596 bp, Artificial Sequence
  Description of Artificial Sequence: Synthetic coding sequence
atggatggcatcgtgacagaggtggccgtgggcgtgaagaggggcagtgatgagctgctgagcggctctgtgctgagcagccccaacagcaacatgagctccatggtggtgacagccaatggaaatgacagcaagaagttcaagggggaggacaagatggatggagcccccagccgggtgctgcacatcaggaagctgcctggagaggtgacagaaacagaggtgattgccctgggcctgccctttgggaaggtgaccaacatcctgatgctgaagggcaagaaccaggccttcctggagctggccacagaggaggccgccatcaccatggtgaactactacagcgctgtgaccccccacctgaggaaccagcccatctacatccagtacagcaaccacaaggagctgaagacagacaacaccctgaaccagagggcccaggccgtgctgcaggccgtgacagctgtgcagacagccaacacccccctgagcggcaccaccgtgtctgagagcgctgtgaccccagcccagagccctgtgctgcgcatcatcatcgacaacatgtactaccctgtgaccctggatgtgctgcaccagatcttcagcaagtttggagctgtgctgaagatcatcaccttcaccaagaacaaccagttccaggccctgctgcagtatggagaccctgtgaatgcccagcaggccaagctggccctggatggccagaacatctacaatgcctgctgcaccctgagaattgacttcagcaagctggtgaacctgaatgtgaagtacaacaatgacaagagccgggactacaccaggccagacctgcccagcggagatggccagcctgccctggaccctgccatcgccgccgcctttgccaaggagaccagcctgctggccgtgcctggggccctgagccccctggccatccccaatgctgctgctgctgctgctgctgctgctgctggccgggtgggcatgcctggggtgtctgctgggggcaacacagtgctgctggtgagcaacctgaatgaggagatggtgaccccccagagcctcttcaccctgtttggagtgtatggagatgtgcagagggtgaagatcctgtacaacaagaaggacagcgccctgatccagatggctgatggcaaccagagccagctggccatgaaccacctgaatggccagaagatgtatggcaagatcatccgggtgaccctgagcaagcaccagacagtgcagctgccccgggagggcctggatgaccagggcctgaccaaggactttggaaacagccccctgcaccgcttcaagaagccaggcagcaagaacttccagaacatcttcccccccagcgccaccctgcacctgagcaacatccccccatctgtggccgaggaggacctgcggaccctgtttgccaacacaggaggcaccgtgaaggccttcaagttcttccaggaccacaagatggccctgctgcagatggccaccgtggaggaggccatccaggccctgattgacctgcacaactacaacctgggggagaaccaccacctgcgggtgtccttcagcaagagcaccatctag

SEQ ID NO: 164715 - DNA, 978 bp, Artificial Sequence
  Description of Artificial Sequence: Synthetic coding sequence
atgagctccatggtggtgacagccaatggaaatgacagcaagaagttcaagggggaggacaagatggatggagcccccagccgggtgctgcacatcaggaagctgcccggggaggtgacagaaacagaggtgattgccctgggcctgccctttgggaaggtgaccaacatcctgatgctgaagggcaagaaccaggccttcctggagctggccacagaggaggccgccatcaccatggtgaactactacagcgctgtgaccccccacctgaggaaccagcccatctacatccagtacagcaaccacaaggagctgaagacagacaacaccctgaaccagagggcccaggccgtgctgcaggccgtgacagctgtgcagacagccaacacccccctgagcggcaccaccgtgtctgagagcgctgtgaccccagcccagagccctgtgctgcgcatcatcatcgacaacatgtactaccctgtgaccctggatgtgctgcaccagatcttcagcaagtttggagctgtgctgaagatcatcaccttcaccaagaacaaccagttccaggccctgctgcagtacggggaccctgtgaatgcccagcaggccaagctggccctggatggccagaacatctacaatgcctgctgcaccctgagaattgacttcagcaagctggtgaacctgaatgtgaagtacaacaatgacaagagccgggactacaccaggccagacctgcccagcggagatggccagcctgccctggaccctgccatcgctgctgcctttgccaaggagaccagcctgctggccgtgcctggggccctgagccccctggccatccccaatgctgctgctgctgctgctgctgctgctgctggccgggtgggcatgcctggggtgtctgctgggggcaacacagtgctgctggtgagcaacctgaatgaggaggtgttcatggagatgtgcagcgtgtag

SEQ ID NO: 164716 - DNA, 615 bp, Artificial Sequence
  Description of Artificial Sequence: Synthetic coding sequence
atgcctggggtgtctgctgggggcaacacagtgctgctggtgagcaacctgaatgaggagatggtgaccccccagagcctcttcaccctgtttggagtgtatggagatgtgcagagggtgaagatcctgtacaacaagaaggacagcgccctgatccagatggctgatggcaaccagagccagctggccatgaaccacctgaatggccagaagatgtatggcaagatcatccgggtgaccctgagcaagcaccagacagtgcagctgccccgggagggcctggatgaccagggcctgaccaaggactttggaaacagccccctgcaccgcttcaagaagccaggcagcaagaacttccagaacatcttcccccccagcgccaccctgcacctgagcaacatccccccatctgtggccgaggaggacctgcggaccctgtttgccaacacaggaggcaccgtgaaggccttcaagttcttccagagggaccacaagatggccctgctgcagatggccaccgtggaggaggccatccaggccctgattgacctgcacaactacaacctgggggagaaccaccacctgcgggtgtccttcagcaagagcaccatctag

SEQ ID NO: 164717 - DNA, 348 bp, Artificial Sequence
  Description of Artificial Sequence: Synthetic coding sequence
atggtgtgcagccctgtgaccctgcgcatcgcccccccagaccggcgcttcagccgcagcgccatccctgagcagatcatcagcagcaccctgagcagccccagcagcaatgccccagacccctgtgccaaggagaccgtgctgagcgccctgaaggagaagaagaagaagaggacagtggaggaggaggaccagatcttcctggatggccaggagaacaagaggagctgcctggtggatggcctgacagatgccagcagcgccttcaaggtgccccggcccggccctgacaccctgcagttcaccgtggatgtgttccactttgccaatgacagcaggaacatgtag

SEQ ID NO: 164718 - DNA, 564 bp, Artificial Sequence
  Description of Artificial Sequence: Synthetic coding sequence
atggtgtgcagccctgtgaccctgcgcatcgcccccccagaccggcgcttcagccgcagcgccatccctgagcagatcatcagcagcaccctgagcagccccagcagcaatgccccagacccctgtgccaaggagaccgtgctgagcgccctgaaggagaagaagaagaagaggacagtggaggaggaggaccagatcttcctggatggccaggagaacaagaggagctgcctggtggatggcctgacagatgccagcagcgccttcaaggtgccccggcccggccctgacaccctgcagttcaccgtggatgtgttccactttgccaatgacagcaggaacatgatctacatcacctgccacctgaaggtgaccctggccgagcaggaccctgatgagctgaacaaggcctgcagcttcagcaagcccagcaacagctggttccctgtggagggcctggccgacatctgccagtgctgcaacaagggggactgtggcacccccagccacagccggcggcagccccgggtggtgtcccagtggagcaccagcgccagcctgtag

SEQ ID NO: 164719 - DNA, 1095 bp, Artificial Sequence
  Description of Artificial Sequence: Synthetic coding sequence
atgtctgccaacagcagccgggtgggccagctgctgctgcagggcagcgcctgcatccgctggaagcaggatgtggagggcgctgtgtaccacctggccaactgcctgctgctgctgggcttcatgggcggcagcggcgtgtatggctgcttctacctgtttggcttcctgtctgctggctacctgtgctgcgtgctgtggggctggttcagcgcctgtggcctggacatcgtgctgtggagcttcctgctggccgtggtgtgcctgctgcagctggcccacctggtgtaccgcctgcgggaggacaccctgcctgaggagtttgacctgctgtacaagaccctgtgcctgcccctgcaggtgcccctgcagacctacaaggagatcgtgcactgctgtgaggagcaggtgctgaccctggccacagagcagacctatgctgtggagggggagacccccatcaaccggctgagcctgctgctgagcggccgggtgcgggtgtcccaggacggccagttcctgcactacatcttcccctaccagttcatggacagccctgagtgggagagcctgcagcccagcgaggagggcgtcttccaggtgaccctgacagctgagaccagctgcagctacatctcctggcccaggaagagcctgcacctgctgctgaccaaggagcgctacatcagctgcctcttcagcgccctgctgggctatgacatcagcgagaagctgtacaccctgaatgacaagctgtttgccaagtttggcctgcgctttgacatccggctgcccagcctgtaccacgtgctgggccccacagctgctgatgctggccctgagagcgagaagggagatgaggaggtgtgtgagcctgctgtgagccccccccaggccacccccaccagcctgcagcagaccccaccctgcagcaccccaccagccaccaccaacttccctgccccacccacccgggcccggctgagcaggccagattctggcatcctggccagccgcatccccctgcagagctacagccaggtgatcagccggggccaggcccccctggcccccacccacaccccagagctgtag

SEQ ID NO: 164720 - DNA, 1083 bp, Artificial Sequence
  Description of Artificial Sequence: Synthetic coding sequence
atgtctgccaacagcagccgggtgggccagctgctgctgcagggcagcgcctgcatccgctggaagcaggatgtggagggcgctgtgtaccacctggccaactgcctgctgctgctgggcttcatgggcggcagcggcgtgtatggctgcttctacctgtttggcttcctgtctgctggctacctgtgctgcgtgctgtggggctggttcagcgcctgtggcctggacatcgtgctgtggagcttcctgctggccgtggtgtgcctgctgcagctggcccacctggtgtaccgcctgcgggaggacaccctgcctgaggagtttgacctgctgtacaagaccctgtgcctgcccctgcaggtgcccctgcagacctacaaggagatcgtgcactgctgtgaggagcaggtgctgaccctggccacagagcagacctatgctgtggagggggagacccccatcaaccggctgagcctgctgctgagcggccgggtgcgggtgtcccaggacggccagttcctgcactacatcttcccctaccagttcatggacagccctgagtgggagagcctgcagcccagcgaggagggcgtcttccaggtgaccctgacagctgagaccagctgcagctacatctcctggcccaggaagagcctgcacctgctgctgaccaaggagcgctacatcagctgcctcttcagcgccctgctgggctatgacatcagcgagaagctgtacaccctgaatgacaagctgtttgccaagtttggcctgcgctttgacatccggctgcccagcctgtaccacgtgctgggccccacagctgctgatgctggccctgagagcgagaagggagatgaggaggtgtgtgagcctgctgtgagccccccccaggccacccccaccagcctgcagcagaccccaccctgcagcaccccaccagccaccaccaacttccctgccccacccacccgggcccggctgagcaggccagattctggcatcctggagattgatgacttccccagctacttccaccagtttggcttcagcggcaaggtggccgccggccgcatcccctag

SEQ ID NO: 164721 - DNA, 1083 bp, Artificial Sequence; identical to SEQ ID NO: 164720
  Description of Artificial Sequence: Synthetic coding sequence

SEQ ID NO: 164722 - DNA, 876 bp, Artificial Sequence
  Description of Artificial Sequence: Synthetic coding sequence
atggagaggaacagcagcctgtggaagaacctgattgatgagcaccctgtgtgcaccacctggaagcaggaggccgagggcgccatctaccacctggccagcatcctgtttgtggtgggcttcatgggcggcagcggcttcttcggcctgctgtatgtgttcagcctgctgggcctgggcttcctgtgcagcgctgtgtgggcctgggtggatgtgtgtgccgctgacatcttctcctggaactttgtgctgtttgtgatctgcttcatgcagtttgtgcacatcgcctaccaggtgcgcagcatcacctttgcccgggagttccaggtgctgtacagcagcctcttccagcccctgggcatcagcctgcccgtcttccgcaccatcgccctgagcagcgaggtggtgaccctggagaaggagcactgctacgccatgcagggcaagaccagcattgacaagctgagcctgctggtgtctggccgcatccgggtgacagtggatggagagttcctgcactacatcttccccctgcagttcctggacagccctgagtgggacagcctgcggcccacagaggagggcatcttccaggtgaccctgacagctgagacagactgccgctacgtgtcctggaggaggaagaagctgtacctgctgtttgcccagcaccgctacatcagccgcctcttctctgtgctgattggaagtgacattgctgacaagctgtatgccctgaatgacagagtgtacatcggcaagcgctaccactatgacatccggctgcccaacttctaccagatgagcaccccagagatccgccgcagccccctgacccagcacttccagaacagccgccgctactgtgacaagtag

SEQ ID NO: 164723 - DNA, 306 bp, Artificial Sequence
  Description of Artificial Sequence: Synthetic coding sequence
atgctgttcctgtgctttgaccgcatccgggtgacagtggatggagagttcctgcactacatcttccccctgcagttcctggacagccctgagtgggacagcctgcggcccacagaggagggcatcttccaggtgaccctgacagctgagacagactgccgctacgtgtcctggaggaggaagaagctgtacctgctgtttgcccagcaccgctacatcagccgcctcttctctgtgctgattggaagtgacattgctgacaagctgtatgccctgaatgacagagtgtacatcggcaagaggtag

SEQ ID NO: 164724 - DNA, 1386 bp, Artificial Sequence
  Description of Artificial Sequence: Synthetic coding sequence
atggccaccttcagccggcaggagttcttccagcagctgctgcagggctgcctgctgcccacagcccagcagggcctggaccagatctggctgctgctggccatctgcctggcctgccgcctgctgtggaggctgggcctgcccagctacctgaagcacgccagcacagtggccggcggcttcttcagcctgtaccacttcttccagctgcacatggtgtgggtggtgctgctgagcctgctgtgctacctggtgctcttcctgtgccgccacagcagccaccggggcgtcttcctgtctgtgaccatcctgatctacctgctgatgggagagatgcacatggtggacacagtgacctggcacaagatgagaggagcccagatgattgtggccatgaaggctgtgtccctgggctttgacctggacagaggagaggtgggcaccgtgcccagccctgtggagttcatgggctacctgtactttgtgggcaccatcgtgtttggcccctggatctccttccacagctacctgcaggccgtgcagggccggcccctgagctgccgctggctgcagaaggtggcccggagcctggccctggccctgctgtgcctggtgctgagcacctgtgtgggcccctacctgttcccctacttcatccccctgaatggagaccggctgctgaggaacaagaagaggaaggcccggggcaccatggtgcgctggctgcgggcctatgaatctgctgtgtccttccacttcagcaactactttgtgggcttcctgtctgaggccacagccaccctggccggggccggcttcacagaggagaaggaccacctggagtgggacctgactgtgtccaagcccctgaatgtggagctgcccaggtccatggtggaggtggtgacctcctggaacctgcccatgagctactggctgaacaactacgtgttcaagaatgccctgcggctgggcaccttctctgctgtgctggtgacctatgctgccagcgccctgctgcacggcttctccttccacctggccgctgtgctgctgagcctggccttcatcacctacgtggagcacgtgctgaggaagaggctggcccgcatcctgagcgcctgtgtgctgagcaagcgctgccccccagactgcagccaccagcaccggctgggcctgggcgtgcgggccctgaacctgctgtttggagccctggccatcttccacctggcctacctgggcagcctgtttgatgtggatgtggatgacaccacagaggagcagggctacggcatggcctacacagtgcacaagtggagcgagctgtcctgggccagccactgggtgaccttcggctgctggatcttctaccgcctcatcggctag

SEQ ID NO: 164725 - DNA, 1368 bp, Artificial Sequence
  Description of Artificial Sequence: Synthetic coding sequence
atggccaccttcagccggcaggagttcttccagcagctgctgcagggctgcctgctgcccacagcccagcagggcctggaccagatctggctgctgctggccatctgcctggcctgccgcctgctgtggaggctgggcctgcccagctacctgaagcacgccagcacagtggccggcggcttcttcagcctgtaccacttcttccagctgcacatggtgtgggtggtgctgctgagcctgctgtgctacctggtgctcttcctgtgccgccacagcagccaccggggcgtcttcctgtctgtgaccatcctgatctacctgctgatgggagagatgcacatggtggacacagtgacctggcacaagatgagaggagcccagatgattgtggccatgaaggctgtgtccctgggctttgacctggacagaggagaggtgggcaccgtgcccagccctgtggagttcatgggctacctgtactttgtgggcaccatcgtgtttggcccctggatctccttccacagctacctgcaggccgtgcagggccggcccctgagctgccgctggctgcagaaggtggcccggagcctggccctggccctgctgtgcctggtgctgagcacctgtgtgggcccctacctgttcccctacttcatccccctgaatggagaccggctgctgaggaagggcaccatggtgcgctggctgcgggcctatgaatctgctgtgtccttccacttcagcaactactttgtgggcttcctgtctgaggccacagccaccctggccggggccggcttcacagaggagaaggaccacctggagtgggacctgactgtgtccaagcccctgaatgtggagctgcccaggtccatggtggaggtggtgacctcctggaacctgcccatgagctactggctgaacaactacgtgttcaagaatgccctgcggctgggcaccttctctgctgtgctggtgacctatgctgccagcgccctgctgcacggcttctccttccacctggccgctgtgctgctgagcctggccttcatcacctacgtggagcacgtgctgaggaagaggctggcccgcatcctgagcgcctgtgtgctgagcaagcgctgccccccagactgcagccaccagcaccggctgggcctgggcgtgcgggccctgaacctgctgtttggagccctggccatcttccacctggcctacctgggcagcctgtttgatgtggatgtggatgacaccacagaggagcagggctacggcatggcctacacagtgcacaagtggagcgagctgtcctgggccagccactgggtgaccttcggctgctggatcttctaccgcctcatcggctag

SEQ ID NO: 164726 - DNA, 1371 bp, Artificial Sequence
  Description of Artificial Sequence: Synthetic coding sequence
atggccaccttcagccggcaggagttcttccagcagctgctgcagggctgcctgctgcccacagcccagcagggcctggaccagatctggctgctgctggccatctgcctggcctgccgcctgctgtggaggctgggcctgcccagctacctgaagcacgccagcacagtggccggcggcttcttcagcctgtaccacttcttccagctgcacatggtgtgggtggtgctgctgagcctgctgtgctacctggtgctcttcctgtgccgccacagcagccaccggggcgtcttcctgtctgtgaccatcctgatctacctgctgatgggagagatgcacatggtggacacagtgacctggcacaagatgagaggagcccagatgattgtggccatgaaggctgtgtccctgggctttgacctggacagaggagaggtgggcaccgtgcccagccctgtggagttcatgggctacctgtactttgtgggcaccatcgtgtttggcccctggatctccttccacagctacctgcaggccgtgcagggccggcccctgagctgccgctggctgcagaaggtggcccggagcctggccctggccctgctgtgcctggtgctgagcacctgtgtgggcccctacctgttcccctacttcatccccctgaatggagaccggctgctgaggaacaagaagaggaaggcccgctggctgcgggcctatgagagcgctgtgtccttccacttcagcaactactttgtgggcttcctgtctgaggccacagccaccctggccggggccggcttcacagaggagaaggaccacctggagtgggacctgactgtgtccaagcccctgaatgtggagctgcccaggtccatggtggaggtggtgacctcctggaacctgcccatgagctactggctgaacaactacgtgttcaagaatgccctgcggctgggcaccttctctgctgtgctggtgacctacgccgccagcgccctgctgcacggcttctccttccacctggccgctgtgctgctgagcctggccttcatcacctacgtggagcacgtgctgaggaagaggctggcccgcatcctgagcgcctgtgtgctgagcaagcgctgccccccagactgcagccaccagcaccggctgggcctgggcgtgcgggccctgaacctgctgtttggagccctggccatcttccacctggcctacctgggcagcctgtttgatgtggatgtggatgacaccacagaggagcagggctacggcatggcctacacagtgcacaagtggagcgagctgtcctgggccagccactgggtgaccttcggctgctggatcttctaccgcctgattggatag

SEQ ID NO: 164727 - DNA, 1368 bp, Artificial Sequence; identical to SEQ ID NO: 164725
  Description of Artificial Sequence: Synthetic coding sequence

SEQ ID NO: 164728 - DNA, 1353 bp, Artificial Sequence
  Description of Artificial Sequence: Synthetic coding sequence
atggccaccttcagccggcaggagttcttccagcagctgctgcagggctgcctgctgcccacagcccagcagggcctggaccagatctggctgctgctggccatctgcctggcctgccgcctgctgtggaggctgggcctgcccagctacctgaagcacgccagcacagtggccggcggcttcttcagcctgtaccacttcttccagctgcacatggtgtgggtggtgctgctgagcctgctgtgctacctggtgctcttcctgtgccgccacagcagccaccggggcgtcttcctgtctgtgaccatcctgatctacctgctgatgggagagatgcacatggtggacacagtgacctggcacaagatgagaggagcccagatgattgtggccatgaaggctgtgtccctgggctttgacctggacagaggagaggtgggcaccgtgcccagccctgtggagttcatgggctacctgtactttgtgggcaccatcgtgtttggcccctggatctccttccacagctacctgcaggccgtgcagggccggcccctgagctgccgctggctgcagaaggtggcccggagcctggccctggccctgctgtgcctggtgctgagcacctgtgtgggcccctacctgttcccctacttcatccccctgaatggagaccggctgctgaggaagtggctgcgggcctatgagagcgctgtgtccttccacttcagcaactactttgtgggcttcctgtctgaggccacagccaccctggccggggccggcttcacagaggagaaggaccacctggagtgggacctgactgtgtccaagcccctgaatgtggagctgcccaggtccatggtggaggtggtgacctcctggaacctgcccatgagctactggctgaacaactacgtgttcaagaatgccctgcggctgggcaccttctctgctgtgctggtgacctacgccgccagcgccctgctgcacggcttctccttccacctggccgctgtgctgctgagcctggccttcatcacctacgtggagcacgtgctgaggaagaggctggcccgcatcctgagcgcctgtgtgctgagcaagcgctgccccccagactgcagccaccagcaccggctgggcctgggcgtgcgggccctgaacctgctgtttggagccctggccatcttccacctggcctacctgggcagcctgtttgatgtggatgtggatgacaccacagaggagcagggctacggcatggcctacacagtgcacaagtggagcgagctgtcctgggccagccactgggtgaccttcggctgctggatcttctaccgcctgattggatag

SEQ ID NO: 164729 - DNA, 1140 bp, Artificial Sequence
  Description of Artificial Sequence: Synthetic coding sequence
atggtgtgggtggtgctgctgagcctgctgtgctacctggtgctcttcctgtgccgccacagcagccacagaggagtcttcctgtctgtgaccatcctgatctacctgctgatgggagagatgcacatggtggacacagtgacctggcacaagatgagaggagcccagatgattgtggccatgaaggctgtgtccctgggctttgacctggacagaggagaggtgggcaccgtgcccagccctgtggagttcatgggctacctgtactttgtgggcaccatcgtgtttggcccctggatctccttccacagctacctgcaggccgtgcagggccggcccctgagctgccgctggctgcagaaggtggcccggagcctggccctggccctgctgtgcctggtgctgagcacctgtgtgggcccctacctgttcccctacttcatccccctgaatggagaccggctgctgaggaagtggctgcgggcctatgaatctgctgtgtccttccacttcagcaactactttgtgggcttcctgtctgaggccacagccaccctggccggggccggcttcacagaggagaaggaccacctggagtgggacctgactgtgtccaagcccctgaatgtggagctgcccaggtccatggtggaggtggtgacctcctggaacctgcccatgagctactggctgaacaactacgtgttcaagaatgccctgcggctgggcaccttctctgctgtgctggtgacctatgctgccagcgccctgctgcacggcttctccttccacctggccgctgtgctgctgagcctggccttcatcacctacgtggagcacgtgctgaggaagaggctggcccgcatcctgagcgcctgtgtgctgagcaagcgctgccccccagactgcagccaccagcaccggctgggcctgggcgtgcgggccctgaacctgctgtttggagccctggccatcttccacctggcctacctgggcagcctgtttgatgtggatgtggatgacaccacagaggagcagggctacggcatggcctacacagtgcacaagtggagcgagctgtcctgggccagccactgggtgaccttcggctgctggatcttctaccgcctcatcggctag

SEQ ID NO: 164730 - DNA, 294 bp, Artificial Sequence
  Description of Artificial Sequence: Synthetic coding sequence
atggccaccttcagccggcaggagttcttccagcagctgctgcagggctgcctgctgcccacagcccagcagggcctggaccagatctggctgctgctggccatctgcctggcctgccgcctgctgtggaggctgggcctgcccagctacctgaagcacgccagcacagtggccggcggcttcttcagcctgtaccacttcttccagctgcacatggtgtgggtggtgctgctgagcctgctgtgctacctggtgctcttcctgtgccgccacagcagccaccggggcgtgtag

SEQ ID NO: 164731 - DNA, 1386 bp, Artificial Sequence; identical to SEQ ID NO: 164724
  Description of Artificial Sequence: Synthetic coding sequence

SEQ ID NO: 164732 - DNA, 2769 bp, Artificial Sequence
  Description of Artificial Sequence: Synthetic coding sequence
atgttcctgcacagcgtgaacctgtggaacctggccttctacgtgttcatggtgttcctggccaccctgggcctgtgggatgtgttcttcggctttgaggagaacaagtgcagcatgagctacatgtttgagtacccagagtaccagaagattgagctgcccaagaagctggccaagcgctacccagcctatgagctgtacctgtatggagagggcagctatgcagaggagcacaagatcctgcccctgaccggcatccctgtgctcttcctgcctggaaatgccggcagctacaagcaggtgcgcagcatcggcagcatcgccctgaggaaggcagaagatattgacttcaagtaccactttgacttcttctctgtgaacttcaatgaggagctggtggccctgtatggaggcagcctgcagaagcagaccaagtttgtgcatgagtgcatcaagaccatcctgaagctgtacaagggccaggagtttgcccccaagtctgtggccatcatcggccacagcatgggcggcctggtggcccgggccctgctgaccctgaagaacttcaagcatgacctgatcaacctgctgatcacccaggccaccccccacgtggcccctgtgatgcccctggaccgcttcatcacagacttctacaccaccgtgaacaactactggatcctgaatgcccggcacatcaacctgaccaccctgtctgtggccggcggcttccgggactaccaggtgcgcagcggcctgaccttcctgcccaagctgagccaccacaccagcgccctgtctgtggtgtcctctgctgtgcccaagacctgggtgtccacagaccacctgagcatcgtgtggtgcaagcagctgcagctgaccaccgtgcgggccttctttgacctgattgatgctgacaccaagcagatcacccagaacagcaagaagaagctgtctgtgctgtaccaccacttcatccgccaccccagcaagcactttgaagaaaatcctgccatcatcagtgacctgaccggcacctccatgtgggtgctggtgaaggtgtccaagtggacctacgtggcctacaatgaaagtgagaagatctacttcaccttccccctggagaaccacaggaagatctacacccacgtgtactgccagagcaccatgctggacaccaacagctggatctttgcctgcatcaacagcacctccatgtgcctgcagggcgtggacctgtcctggaaggccgagctgctgcccaccatcaagtacctgaccctgcggctgcaggactaccccagcctgagccacctggtggtgtatgtgcccagcgtgcggggcagcaagtttgtggtggactgtgagttcttcaagaaggagaagcgctacatccagctgcctgtgacccacctgttctcctttggcctgagcagcaggaaggtggtgctgaacaccaacggcctgtactacaacctggagctgctgaactttggccagatctaccaggccttcaagatcaacgtggtgtccaagtgcagcgctgtgaaggaggagatcaccagcatctaccgcctgcacatcccctggagctatgaggacagcctgaccatcgcccaggcccccagcagcacagagatcagcctgaagctgcacatcgcccagcctgagaacaacacccacgtggccctcttcaagatgtacaccagcagtgactgccgctatgaggtgacagtgaagaccagcttcagccagatcctgggccaggtggtgcgcttccacggcggggccctgcctgcctacgtggtgagcaacatcctgctggcctaccggggccagctgtacagcctcttcagcacaggctgctgcctggagtatgccaccatgctggacaaggaggccaagccctacaaggtggaccccttcgtcatcatcatcaagttcctgctgggctacaagtggttcaaggagctgtgggatgtgctgctgctgcctgagctggatgctgtgatcctgacctgccagagcatgtgcttccccctcatcagcctcatcctcttcctgtttggcacctgcacagcctactggagcggcctgctgagcagcgcctctgtgcggctgctgagcagcctgtggctggccctgaagaggccttctgagctgcccaaggacatcaagatgatcagcccagacctgcccttcctgaccatcgtgctgatcatcgtgtcctggaccacctgtggggccctggccatcctgctgagctacctgtactacgtgttcaaggtggtgcacctgcaggccagcctgaccaccttcaagaacagccagcctgtgaaccccaagcacagcagaagaagtgagaagaagagcaaccaccacaaggacagcagcatccaccacctgcggctgagcgccaatgatgctgaggacagcctgaggatgcacagcaccgtcatcaacctgctgacctggatcgtgctgctgtccatgcccagcctcatctactggctgaagaacctgcgctactacttcaagctgaacccagacccctgcaagcccctggccttcatcctgatccccaccatggccatcctgggcaacacctacacagtgtccatcaagagcagcaagctgctgaagaccaccagccagttccccctgcccctggccgtgggcgtgattgcctttggaagtgcccacctgtaccgcctgccctgctttgtgttcatccccctgctgctgcacgccctgtgcaacttcatgtag

SEQ ID NO: 164733 - DNA, 915 bp, Artificial Sequence
  Description of Artificial Sequence: Synthetic coding sequence
atggaggtgctggagagcaagaagattgagctgcccaagaagctggccaagcgctacccagcctatgagctgtacctgtatggagagggcagctatgcagaggagcacaagatcctgcccctgaccggcatccctgtgctcttcctgcctggaaatgccggcagctacaagcaggtgcgcagcatcggcagcatcgccctgaggaaggcagaagatattgacttcaagtaccactttgacttcttctctgtgaacttcaatgaggagctggtggccctgtatggaggcagcctgcagaagcagaccaagtttgtgcatgagtgcatcaagaccatcctgaagctgtacaagggccaggagtttgcccccaagtctgtggccatcatcggccacagcatgggcggcctggtggcccgggccctgctgaccctgaagaacttcaagcatgacctgatcaacctgctgatcacccaggccaccccccacgtggcccctgtgatgcccctggaccgcttcatcacagacttctacaccaccgtgaacaactactggatcctgaatgcccggcacatcaacctgaccaccctgtctgtggccggcggcttccgggactaccaggtgcgcagcggcctgaccttcctgcccaagctgagccaccacaccagcgccctgtctgtggtgtcctctgctgtgcccaagacctgggtgtccacagaccacctgagcatcgtgtggtgcaagcagctgcagctgaccaccgtgcgggccttctttgacctgattgatgctgacaccaagcagatcacccagaacagcaagaagaagctgtctgtgctgtaccaccacttcatccgccaccccagcaagcactttgaagaaaatcctgccatcatcagtgacctgaccggcatctag

SEQ ID NO: 164734 - DNA, 1779 bp, Artificial Sequence
  Description of Artificial Sequence: Synthetic coding sequence
atgttcctgcacagcgtgaacctgtggaacctggccttctacgtgttcatggtgttcctggccaccctgggcctgtgggatgtgttcttcggctttgaggagaacaagtgcagcatgagctacatgtttgagtacccagagtaccagaagattgagctgcccaagaagctggccaagcgctacccagcctatgagctgtacctgtatggagagggcagctatgcagaggagcacaagatcctgcccctgaccggcatccctgtgctcttcctgcctggaaatgccggcagctacaagcaggtgcgcagcatcggcagcatcgccctgaggaaggcagaagatattgacttcaagtaccactttgacttcttctctgtgaacttcaatgaggagctggtggccctgtatggaggcagcctgcagaagcagaccaagtttgtgcatgagtgcatcaagaccatcctgaagctgtacaagggccaggagtttgcccccaagtctgtggccatcatcggccacagcatgggcggcctggtggcccgggccctgctgaccctgaagaacttcaagcatgacctgatcaacctgctgatcacccaggccaccccccacgtggcccctgtgatgcccctggaccgcttcatcacagacttctacaccaccgtgaacaactactggatcctgaatgcccggcacatcaacctgaccaccctgtctgtggccggcggcttccgggactaccaggtgcgcagcggcctgaccttcctgcccaagctgagccaccacaccagcgccctgtctgtggtgtcctctgctgtgcccaagacctgggtgtccacagaccacctgagcatcgtgtggtgcaagcagctgcagctgaccaccgtgcgggccttctttgacctgattgatgctgacaccaagcagatcacccagaacagcaagaagaagctgtctgtgctgtaccaccacttcatccgccaccccagcaagcactttgaagaaaatcctgccatcatcagtgacctgaccggcacctccatgtgggtgctggtgaaggtgtccaagtggacctacgtggcctacaatgaaagtgagaagatctacttcaccttccccctggagaaccacaggaagatctacacccacgtgtactgccagagcaccatgctggacaccaacagctggatctttgcctgcatcaacagcacctccatgtgcctgcagggcgtggacctgtcctggaaggccgagctgctgcccaccatcaagtacctgaccctgcggctgcaggactaccccagcctgagccacctggtggtgtatgtgcccagcgtgcggggcagcaagtttgtggtggactgtgagttcttcaagaaggagaagcgctacatccagctgcctgtgacccacctgttctcctttggcctgagcagcaggaaggtggtgctgaacaccaacggcctgtactacaacctggagctgctgaactttggccagatctaccaggccttcaagatcaacgtggtgtccaagtgcagcgctgtgaaggaggagatcaccagcatctaccgcctgcacatcccctggagctatgaggacagcctgaccatcgcccaggcccccagcagcacagagatcagcctgaagctgcacatcgcccagcctgagaacaacacccacgtggccctcttcaagatgtacaccagcagtgactgccgctatgaggtgacagtgaagaccagcttcagccagatcctgggccaggtggtggcctag

SEQ ID NO: 164735 - DNA, 1293 bp, Artificial Sequence
  Description of Artificial Sequence: Synthetic coding sequence
atgttcctgcacagcgtgaacctgtggaacctggccttctacgtgttcatggtgttcctggccaccctgggcctgtgggatgtgttcttcggctttgaggagaacaagtgcagcatgagctacatgtttgagtacccagagtaccagagcagcgctgtgcccaagacctgggtgtccacagaccacctgagcatcgtgtggtgcaagcagctgcagctgaccaccgtgcgggccttctttgacctgattgatgctgacaccaagcagatcacccagaacagcaagaagaagctgtctgtgctgtaccaccacttcatccgccaccccagcaagcactttgaagaaaatcctgccatcatcagtgacctgaccggcacctccatgtgggtgctggtgaaggtgtccaagtggacctacgtggcctacaatgaaagtgagaagatctacttcaccttccccctggagaaccacaggaagatctacacccacgtgtactgccagagcaccatgctggacaccaacagctggatctttgcctgcatcaacagcacctccatgtgcctgcagggcgtggacctgtcctggaaggccgagctgctgcccaccatcaagtacctgaccctgcggctgcaggactaccccagcctgagccacctggtggtgtatgtgcccagcgtgcggggcagcaagtttgtggtggactgtgagttcttcaagaaggagaagcgctacatccagctgcctgtgacccacctgttctcctttggcctgagcagcaggaaggtggtgctgaacaccaacggcctgtactacaacctggagctgctgaactttggccagatctaccaggccttcaagatcaacgtggtgtccaagtgcagcgctgtgaaggaggagatcaccagcatctaccgcctgcacatcccctggagctatgaggacagcctgaccatcgcccaggcccccagcagcacagagatcagcctgaagctgcacatcgcccagcctgagaacaacacccacgtggccctcttcaagatgtacaccagcagtgactgccgctatgaggtgacagtgaagaccagcttcagccagatcctgggccaggtggtgcgcttccacggcggggccctgcctgcctacgtggtgagcaacatcctgctggcctaccggggccagctgtacagcctcttcagcacaggctgctgcctggagtatgccaccatgctggacaaggaggccaagccctacaaggtggaccccttcgtcatcatcatcaagttcctgctgtag

SEQ ID NO: 164736 - DNA, 774 bp, Artificial Sequence
  Description of Artificial Sequence: Synthetic coding sequence
atgagccggcccctcatcaccaggagccctgccagccccctgaacaaccagggcatccccaccccagcccagctgaccaagagcaatgcccctgtgcacattgatgtgggcggccacatgtacaccagcagcctggccaccctgaccaagtacccagagagccgcatcggccgcctgtttgatggaacagagcccatcgtgctggacagcctgaagcagcactacttcatcgacagagatggccagatgttccgctacatcctgaacttcctgcggaccagcaagctgctgatcccagatgacttcaaggactacaccctgctgtatgaggaggccaagtacttccagctgcagcccatgctgctggagatggagcgctggaagcaggaccgggagaccggccgcttcagccggccctgtgaatgtctggtggtgcgggtggccccagacctgggggagcgcatcaccctgagcggggacaagagcctcatcgaggaggtgtttcctgagattggagatgtgatgtgcaacagcgtgaatgccggctggaaccacgacagcacccacgtgatccgcttccccctgaatggctactgccacctgaacagcgtgcaggtgctggagcggctgcagcagaggggctttgaaattgtgggcagctgtggcggcggcgtggacagcagccagttctctgaatatgtgctgcggcgggagctgcggaggaccccccgggtgcccagcgtcatccgcatcaagcaggagcccctggactag

SEQ ID NO: 164737 - DNA, 774 bp, Artificial Sequence; identical to SEQ ID NO: 164736
  Description of Artificial Sequence: Synthetic coding sequence

SEQ ID NO: 164738 - DNA, 2598 bp, Artificial Sequence
  Description of Artificial Sequence: Synthetic coding sequence
atggccaggatgcctggcagcggggactgcaacaccagcgctgggggcagcgccagcgctgctgctgctgctgctgagaacaacggggagcggggggagggggagcggggggccggcggccggggcagaagacacagccggccccactactgcagcgctggggaggaggaggaggaggaggaggaggaggatgagatccaggaggtgcagatcactggagatgaggaggaggaggaggatggcggcggcggcctggaggaggatgaggaggaggaggaggaggaggagatgggcctggactgggatgagcccctggagcctgaggacagcgctggggaggagctggagcctgagcctgtgcacatgatcaacatggaccagagcgctgccctggagcctgaggccccaccccggctgctggccccccgggcccggggcggccccccaggagatggcagcgagctggaccctgatgtgctgcagaggcctgagcgggcccggctgtctgagaacacccggctggccaccaggtatgctgtgcgcatcttccgggagtacctgtctgagaaggcccagagcccagactttgagaccatggacaagggggccctgtgccgggtgctgcggagcttctatgcagaggcccggagcaagagcggccagctgtacagcaagagcagcctcatcagcatccgcagcagcctgaaccgctacctgaatgagcccccctactgcaggaccctggacctgaccaaggaccctgagctgcggagcgccaacctgaccctggccgctgtgatcaggaagctggaggagcagggcgccggccctgtggtgcagaagcaggccatcaccagggctgacctgaggaagctgtacaccagcagcgtcttcagcaccaacacccccttcggcctgctgaacaaggtgtggtttgagacctgcatgtacttctgcacccggggccgggagaaccagcgggagctggaggaggacagctttggcctggccatggatgaagatggcaggaagtttgtgtacttcaagagcctgggcccctaccacaagagccgcagcagctcctggagcaagaagagagctgagagcagtgatgaggagaacctgcccaggatgtatgaaacaggaacagagttctgcccctatgccagctttgtgaagtacctgagcaagaggaaccccctgtgcaaggccttcttccagaggccccgggaccactgcagtgaaggagatgtgacctggtatgagaacaaggccatcggcaagaacctgctgggcaccaggatgcagatgctgagcaaggccgccaagctgagcaagacctacaccaaccactgcattggagctgtgtccatcgccaccctgaacagcattgctggcatcggcaccaagctgggcagccctgccccccagggctgctacgccgaggccctgaatggagctgcccggcaccacagccaccacccccccacccaccccagccaccaccaccggccccagccccccagcctgggcaacacctacatcctgcccaaggacagccaggtgggcccagatgtgaagtctgaggccgcccccaagagggccctgtatgaatctgtgtttggaagtggagagatctgtggccccaccagccccaagaggctgtgcatccggcccagcgagcctgtggatgctgtggtggtggtgtctgtgaagcatgaccccctgcccctgctgcctgaggccaacggccacaggagcaccaacagccccaccatcgtgtccccagccatcgtgagccccacccaggacagccggcccaacatgagccggcccctcatcaccaggagccctgccagccccctgaacaaccagggcatccccaccccagcccagctgaccaagagcaatgcccctgtgcacattgatgtgggcggccacatgtacaccagcagcctggccaccctgaccaagtacccagagagccgcatcggccgcctgtttgatggaacagagcccatcgtgctggacagcctgaagcagcactacttcatcgacagagatggccagatgttccgctacatcctgaacttcctgcggaccagcaagctgctgatcccagatgacttcaaggactacaccctgctgtatgaggaggccaagtacttccagctgcagcccatgctgctggagatggagcgctggaagcaggaccgggagaccggccgcttcagccggccctgtgaatgtctggtggtgcgggtggccccagacctgggggagcgcatcaccctgagcggggacaagagcctcatcgaggaggtgtttcctgagattggagatgtgatgtgcaacagcgtgaatgccggctggaaccacgacagcacccacgtgatccgcttccccctgaatggctactgccacctgaacagcgtgcaggtgctggagcggctgcagcagaggggctttgaaattgtgggcagctgtggcggcggcgtggacagcagccagttctctgaatatgtgctgcggcgggagctgcggaggaccccccgggtgcccagcgtcatccgcatcaagcaggagcccctggactag

SEQ ID NO: 164739 - DNA, 774 bp, Artificial Sequence; identical to SEQ ID NO: 164736
  Description of Artificial Sequence: Synthetic coding sequence

SEQ ID NO: 164740 - DNA, 1044 bp, Artificial Sequence
  Description of Artificial Sequence: Synthetic coding sequence
atgagggtggtggtgattggagctggggtgattggcctgagcacagccctgtgcatccacgagcgctaccacagcgtgctgcagcccctggacatcaaggtgtatgctgaccgcttcacccccctgaccaccacagatgtggccgccggcctgtggcagccctacctgagtgaccccaacaacccccaggaggccgactggagccagcagacctttgactacctgctgagccacgtgcacagccccaatgctgagaacctgggcctcttcctgatcagcggctacaacctcttccacgaggccatcccagaccccagctggaaggacacagtgctgggcttcaggaagctgaccccccgggagctggacatgtttcctgactatggctacggctggttccacaccagcctcatcctggagggcaagaactacctgcagtggctgacagagcggctgacagagcggggcgtgaagttcttccagaggaaggtggagagctttgaggaggtggcccgggagggcgcagatgtgattgtgaactgcaccggggtgtgggccggggccctgcagagggaccccctgctgcagcccggccggggccagatcatgaaggtggatgccccctggatgaagcacttcatcctgacccatgaccctgagcggggcatctacaacagcccctacatcatccctggcacccagacagtgaccctgggcggcatcttccagctgggcaactggagcgagctgaacaacatccaggaccacaacaccatctgggagggctgctgccgcctggagcccaccctgaagaatgcccgcatcatcggggagaggacaggcttccggcctgtgcggccccagatccggctggagcgggagcagctgaggacaggccccagcaacacagaggtgatccacaactacggccatggaggctacggcctgaccatccactggggctgtgccctggaggccgccaagctgtttggccgcatcctggaggagaagaagctgagcaggatgccacccagccacctgtag

SEQ ID NO: 164741 - DNA, 399 bp, Artificial Sequence
  Description of Artificial Sequence: Synthetic coding sequence
atgctgaagaacatcgagctgtttgacaagctgagcctgcgcttcaacggccgggtgctcttcatcaaggatgtgattggagatgagatctgctgctggagcttctacggccagggcaggaagattgctgaggtgtgctgcaccagcatcgtgtatgccacagagaagaagcagaccaaggtggagttccctgaggcccgcatctatgaggagaccctgaacatcctgctgtatgaggcccaggacggccggggccctgacaatgccctgctggaggccaccggcggggccgccggccgcagccaccacctggatgaagatgaggagcgggagagaattgagcgggtgcggcgcatccacatcaagaggccagatgaccgggcccacctgcaccagtag

SEQ ID NO: 164742 - DNA, 840 bp, Artificial Sequence
  Description of Artificial Sequence: Synthetic coding sequence
tgaagatactgccgcagccccttctggagcggctacggcaacttctacagcctgcagaagagcggcttcctgcccaccctgggcaccgtgcagcccttcaactactgcaagagcggctggatcctgattgacagatgtgggaagcacttcggcaccatcctgaactacctgagagatggagctgtgcccctgcctgagagccggcgggagattgaggagctgctggccgaggccaagtactacctggtgcagggcctggtggaggagtgccaggccgccctgcagaacaaggacacctatgagcccttctgcaaggtgcctgtgatcaccagcagcaaggaggagcagaagctgattgccaccagcaacaagccagctgtgaagctgctgtacaacagaagcaacaacaagtacagctacaccagcaacagtgatgacaacatgctgaagaacatcgagctgtttgacaagctgagcctgcgcttcaacggccgggtgctcttcatcaaggatgtgattggagatgagatctgctgctggagcttctacggccagggcaggaagattgctgaggtgtgctgcaccagcatcgtgtatgccacagagaagaagcagaccaaggtggagttccctgaggcccgcatctatgaggagaccctgaacatcctgctgtatgaggcccaggacggccggggccctgacaatgccctgctggaggccactggaggagctgctggccgcagccaccacctggatgaagatgaggagcgggagcgcatcgagcgggtgcggcgcatccacatcaagaggccagatgaccgggcccacctgcaccagtag

SEQ ID NO: 164743 - DNA, 864 bp, Artificial Sequence
  Description of Artificial Sequence: Synthetic coding sequence
atgtctggagagagcgtggtgtcctctgctgtgcctgctgctgccaccaggaccaccagcttcaagggcaccagccccagcagcaaatatgtgaagctgaatgtgggcggggccctgtactacaccaccatgcagaccctgaccaagcaggacaccatgctgaaggccatgttttctggccgcatggaggtgctgacagacagcgagggctggatcctgattgacagatgtgggaagcacttcggcaccatcctgaactacctgagagatggagctgtgcccctgcctgagagcagaagagaaattgaggagctgctggccgaggccaagtactacctggtgcagggcctggtggaggagtgccaggccgccctgcagaacaaggacacctatgagcccttctgcaaggtgcctgtgatcaccagcagcaaggaggagcagaagctgattgccaccagcaacaagccagctgtgaagctgctgtacaacagaagcaacaacaagtacagctacaccagggtgctcttcatcaaggatgtgattggagatgagatctgctgctggagcttctacggccagggcaggaagattgctgaggtgtgctgcaccagcatcgtgtatgccacagagaagaagcagaccaaggtggagttccctgaggcccgcatctatgaggagaccctgaacatcctgctgtatgaggcccaggacggccggggccctgacaatgccctgctggaggccactggaggagctgctggccgcagccaccacctggatgaagatgaggagcgggagcgcatcgagcgggtgcggcgcatccacatcaagaggccagatgaccgggcccacctgcaccagtag

SEQ ID NO: 164744 - DNA, 468 bp, Artificial Sequence
  Description of Artificial Sequence: Synthetic coding sequence
atgatggctgtgttcaccagcctgtggagcccctaccagatgctgttctgcagcaacagtgatgacaacatgctgaagaacatcgagctgtttgacaagctgagcctgcgcttcaacggccgggtgctcttcatcaaggatgtgattggagatgagatctgctgctggagcttctacggccagggcaggaagattgctgaggtgtgctgcaccagcatcgtgtatgccacagagaagaagcagaccaaggtggagttccctgaggcccgcatctatgaggagaccctgaacatcctgctgtatgaggcccaggacggccggggccctgacaatgccctgctggaggccactggaggagctgctggccgcagccaccacctggatgaagatgaggagcgggagcgcatcgagcgggtgcggcgcatccacatcaagaggccagatgaccgggcccacctgcaccagtag

SEQ ID NO: 164745 - DNA, 990 bp, Artificial Sequence
  Description of Artificial Sequence: Synthetic coding sequence
atgtctgctgaggccagcggccctgctgctgctgctgcccccagcctggaggcccccaagcccagcggcctggagcccggccctgctgcctacggcctgaagcccctgacccccaacagcaaatatgtgaagctgaatgtgggcggcagcctgcactacaccaccctgcggaccctgaccggccaggacaccatgctgaaggccatgttttctggccgggtggaggtgctgacagatgctgggggctgggtgctgattgacagaagtggccgccacttcggcaccatcctgaactacctgagagatggctctgtgcccctgcctgagagcacccgggagctgggggagctgctgggggaggcccgctactacctggtgcagggcctgattgaggactgccagctggccctgcagcagaagcgggagaccctgagccccctgtgcctgatccccatggtgaccagcccccgggaggagcagcagctgctggccagcaccagcaagcctgtggtgaagctgctgcacaacagaagcaacaacaagtacagctacaccagcaccagtgatgacaacctgctgaagaacatcgagctgtttgacaagctggccctgcgcttccacggccgcctgctcttcctgaaggatgtgctgggagatgagatctgctgctggagcttctacggccagggcaggaagattgctgaggtgtgctgcaccagcatcgtgtatgccacagagaagaagcagaccaaggtggagttccctgaggcccgcatctttgaggagaccctgaacatcctgatctatgagaccccccggggccctgaccctgccctgctggaggccactggaggagctgctggagctggaggagctggccgcggggaggatgaagaaaatcgggagcaccgggtgcggcgcatccacgtgagaagacacatcacccatgatgagcggccccacggccagcagatcgtgttcaaggactag

SEQ ID NO: 164746 - DNA, 990 bp, Artificial Sequence; identical to SEQ ID NO: 164745
  Description of Artificial Sequence: Synthetic coding sequence

SEQ ID NO: 164747 - DNA, 1287 bp, Artificial Sequence
  Description of Artificial Sequence: Synthetic coding sequence
atggccctgagcggcaactgcagccgctactacccccgggagcagggcagcgctgtgcccaacagcttccctgaggtggtggagctgaatgtgggcggccaggtgtacttcaccaggcacagcaccctcatcagcatcccccacagcctgctgtggaagatgttcagccccaagagggacacagccaatgacctggccaaggacagcaagggccgcttcttcatcgacagagatggcttcctgttccgctacatcctggactacctgcgggaccggcaggtggtgctgcctgaccacttccctgagaagggccgcctgaagcgggaggccgagtacttccagctgcctgacctggtgaagctgctgaccccagatgagatcaagcagagcccagatgagttctgccacagcgactttgaagatgccagccagggcagtgacacccgcatctgcccccccagcagcctgctgcctgctgacaggaagtggggcttcatcaccgtgggctaccggggcagctgcaccctgggccgggagggccaggctgatgccaagttcagaagagtgccccgcatcctggtgtgtggccgcatcagcctggccaaggaggtgtttggagagaccctgaatgaaagccgggaccctgaccgggcccctgagcgctacaccagccgcttctacctgaagttcaagcacctggagcgggcctttgacatgctgtctgaatgtggcttccacatggtggcctgcaacagctctgtgacagccagcttcatcaaccagtacacagatgacaagatctggagcagctacacagaatatgtgttctaccgggagcccagccgctggagccccagccactgtgactgctgctgcaagaatggcaagggggacaaggagggggagagcggcaccagctgcaatgacctgagcaccagcagctgtgacagccagagcgaggccagcagcccccaggagaccgtcatctgtggccctgtgacccggcagaccaacatccagaccctggaccggcccatcaagaagggccctgtgcagctgatccagcagagcgagatgaggaggaagagtgacctgctgcggaccctgaccagcggcagccgggagagcaacatgagcagcaagaagaaggctgtgaaggagaagctgagcattgaggaggagctggagaagtgcatccaggacttcctgaagatcaagatcccagaccgcttccctgagaggaagcacccctggcagagcgagctgctgaggaagtaccacctgtag

SEQ ID NO: 164748 - DNA, 1287 bp, Artificial Sequence; identical to SEQ ID NO: 164747
  Description of Artificial Sequence: Synthetic coding sequence

SEQ ID NO: 164749 - DNA, 792 bp, Artificial Sequence
  Description of Artificial Sequence: Synthetic coding sequence
atggccgagctgcagctggaccctgccatggccggcctgggcggcggcggcggcagcggcgtgggagatggcggcggccctgtgcggggcccccccagccccaggcctgctggccccaccccccggggccacggccggcctgctgctgctgtggcccagcccctggagcccggccctggccccccagagagagctgggggcggcggggccgcccgctgggtgcggctgaatgtgggcggcacctactttgtgaccacccggcagaccctgggccgggagcccaagagcttcctgtgccgcctgtgctgccaggaggaccctgagctggacagcgacaaggatgagaccggggcctacctgattgaccgggaccccacctacttcggccccatcctgaactacctgcggcacggcaagctgatcatcaccaaggagctggccgaggagggcgtgctggaggaggccgagttctacaacatcgccagcctggtgcggctggtgaaggagcgcatccgggacaatgaaaatagaaccagccagggccctgtgaagcacgtgtacagagtgctgcagtgccaggaggaggagctgacccagatggtgtccaccatgtctgatggctggaagtttgagcagctgatcagcatcggcagcagctacaactatggaaatgaagaccaggccgagttcctgtgtgtggtgtcccgggagctgaacaacagcaccaatggaattgtgattgagcccagcgagaaggccaagatcctgcaggagcggggcagcaggatgtag

SEQ ID NO: 164750 - DNA, 738 bp, Artificial Sequence
  Description of Artificial Sequence: Synthetic coding sequence
agcctgcccagaaatggacctgcccggctgcgggccggcagcagcggcggcggcggcggcccccgctggaggaactgctcctggacccggcgctggaggggctgggagggcgcccctggccctggccccccagagagagctgggggcggcggggccgcccgctgggtgcggctgaatgtgggcggcacctactttgtgaccacccggcagaccctgggccgggagcccaagagcttcctgtgccgcctgtgctgccaggaggaccctgagctggacagcgacaaggatgagaccggggcctacctgattgaccgggaccccacctacttcggccccatcctgaactacctgcggcacggcaagctgatcatcaccaaggagctggccgaggagggcgtgctggaggaggccgagttctacaacatcgccagcctggtgcggctggtgaaggagcgcatccgggacaatgaaaatagaaccagccagggccctgtgaagcacgtgtacagagtgctgcagtgccaggaggaggagctgacccagatggtgtccaccatgtctgatggctggaagtttgagcagctgatcagcatcggcagcagctacaactatggaaatgaagaccaggccgagttcctgtgtgtggtgtcccgggagctgaacaacagcaccaatggaattgtgattgagcccagcgagaaggccaagatcctgcaggagcggggcagcaggatgtag

SEQ ID NO: 164751 - DNA, 2448 bp, Artificial Sequence
  Description of Artificial Sequence: Synthetic coding sequence
atggccggcggccactgcggcagcttccctgctgctgctgctggcagcggggagatcgtgcagctgaatgtgggcggcacccgcttcagcaccagccggcagaccctgatgtggatcccagacagcttcttcagcagcctgctgagcggccgcatcagcaccctgagagatgaaacaggagccatcttcatcgaccgggaccctgctgcctttgcccccatcctgaacttcctgcggaccaaggagctggacctgcggggcgtgtccatcaacgtgctgcggcatgaagctgagttctacggcatcacccccctggtgcggcggctgctgctgtgtgaggagctggagaggagcagctgtggctctgtgctcttccacggctacctgcccccacctggcatccccagcaggaagatcaacaacacagtgcgctctgctgacagcagaaatggcctgaacagcacagaaggagaggcccggggaaatggcacccagcctgtgctgtctggaactggagaggagaccgtgcggctgggcttccctgtggaccccaggaaggtgctgattgtggccggccaccacaactggatcgtggccgcctatgcccactttgctgtgtgctaccgcatcaaggagagcagcggctggcagcaggtgttcaccagcccctacctggactggaccatcgagcgggtggccctgaatgccaaggtggtgggcggcccccatggagacaaggacaagatggtggccgtggccagcgagagcagcatcatcctgtggagcgtgcaggacggcggcagcggcagcgagattggagtcttcagcctgggcgtgcctgtggatgccctcttcttcatcggcaaccagctggtggccaccagccacacaggcaaggtgggcgtgtggaatgctgtgacccagcactggcaggtgcaggatgtggtgcccatcaccagctatgacacagctggcagcttcctgctgctgggctgcaacaacggcagcatctactacatcgacatgcagaagttccccctgaggatgaaggacaatgacctgctggtgacagagctgtaccatgaccccagcaatgatgccatcacagccctgtctgtgtacctgacccccaagacctctgtgtctggcaactggattgagatcgcctacggcaccagcagcggggctgtgcgggtcatcgtgcagcaccctgagaccgtgggcagcggcccccagctgttccagaccttcaccgtgcacaggagccctgtgaccaagatcatgctgtctgagaagcacctggtgtctgtgtgtgccgacaacaaccacgtgaggacctggacagtgacccgcttccggggcatgatcagcacccagcccggcagcacccccctggccagcttcaagatcctgagcctggaggagacagagagccacggcagctacagcagtggaaatgacatcggcccctttggagagagagatgaccagcaggtgttcatccagaaggtggtgcccatcaccaacaagctgtttgtgcggctgagcagcacaggcaagaggatctgtgagatccaggccgtggactgcaccaccatcagcagcttcaccgtgcgggagtgtgagggcagcagcaggatgggcagccggccccggcgctacctgttcaccggccacaccaacggcagcatccagatgtgggacctgaccacagccatggacatggtgaacaagtctgaggacaaggatgtgggcggccccacagaggaggagctgctgaagctgctggaccagtgtgacctgagcaccagccgctgtgccacccccaacatcagccctgccacctctgtggtgcagcacagccacctgcgggagagcaacagcagcctgcagctgcagcaccacgacaccacccatgaagctgccacctacggctccatgaggccctaccgggagagccccctgctggcccgggcccggaggacagagagcttccacagctacagagacttccagaccatcaacctgaacagaaatgtggagagagctgtgcctgaaaatggaaacctgggccccatccaggccgaggtgaagggggccactggagagtgcaacatcagcgagaggaagagccctggggtggagatcaagagcctgcgggagctggacagcggcctggaggtgcacaagattgctgagggcttcagcgagagcaagaagaggagcagtgaagatgaaaatgaaaacaagattgagttcaggaagaagggcggctttgaaggaggcggcttcctgggcaggaagaaggtgccctacctggccagcagccccagcaccagtgatggcggcacagacagccctggaacagccagccccagccccaccaagaccacccccagccccaggcacaagaagagtgacagcagcggccaggagtacagcctgtag

SEQ ID NO: 164752 - DNA, 723 bp, Artificial Sequence
  Description of Artificial Sequence: Synthetic coding sequence
atggccggcggccactgcggcagcttccctgctgctgctgctggcagcggggagatcgtgcagctgaatgtgggcggcacccgcttcagcaccagccggcagaccctgatgtggatcccagacagcttcttcagcagcctgctgagcggccgcatcagcaccctgagagatgaaacaggagccatcttcatcgaccgggaccctgctgcctttgcccccatcctgaacttcctgcggaccaaggagctggacctgcggggcgtgtccatcaacgtgctgcggcatgaagctgagttctacggcatcacccccctggtgcggcggctgctgctgtgtgaggagctggagaggagcagctgtggctctgtgctcttccacggctacctgcccccacctggcatccccagcaggaagatcaacaacacagtgcgctctgctgacagcagaaatggcctgaacagcacagaaggagaggcccggggaaatggcacccagcctgtgctgtctggaactggagaggagaccgtgcggctgggcttccctgtggaccccaggaaggtgctgattgtggccggccaccacaactggatcgtggccgcctatgcccactttgctgtgtgctacagagtcttctggctgggcaccgtgggccacgcctgcaaccccagcaccctgggcggcagagatggctggagcagccgcagcgcccggcccacctggtag

SEQ ID NO: 164753 - DNA, 567 bp, Artificial Sequence
  Description of Artificial Sequence: Synthetic coding sequence
atgaaggacaatgacctgctggtgacagagctgtaccatgaccccagcaatgatgccatcacagccctgtctgtgtacctgacccccaagacctctgtgtctggcaactggattgagatcgcctacggcaccagcagcggggctgtgcgggtcatcgtgcagcaccctgagaccgtgggcagcggcccccagctgttccagaccttcaccgtgcacaggagccctgtgaccaagatcatgctgtctgagaagcacctggtgtctgtgtgtgccgacaacaaccacgtgaggacctggacagtgacccgcttccggggcatgatcagcacccagcccggcagcacccccctggccagcttcaagatcctgagcctggaggagacagagagccacggcagctacagcagtggaaatgacatcggcccctttggagagagagatgaccagcaggtgttcatccagaaggtggtgcccatcaccaacaagctgtttgtgcggctgagcagcacaggcaagagcctgtgtggggtgtccctggtgagccgcagcagccaggagcccacctag

SEQ ID NO: 164754 - DNA, 642 bp, Artificial Sequence
  Description of Artificial Sequence: Synthetic coding sequence
tgattcagcaccagccggcagaccctgatgtggatcccagacagcttcttcagcagcctgctgagcggccgcatcagcaccctgagagatgagaccggggccatcttcatcgaccgggaccctgctgcctttgcccccatcctgaacttcctgcggaccaaggagctggacctgcggggcgtgtccatcaacgtgctgcggcatgaggccgagttctacggcatcacccccctggtgcggcggctgctgctgtgtgaggagctggagaggagcagctgtggctctgtgctcttccacggctacctgcccccacctggcatccccagcaggaagatcaacaacacagtgcgctctgctgacagcagaaatggcctgaacagcacagaaggagaggcccggggaaatggcacccagcctgtgctgagcggcaccggggaggagaccgtgcggctgggcttccctgtggaccccaggaaggtgctgattgtggccggccaccacaactggatcgtggccgcctatgcccactttgctgtgtgctacagagtcttctggctgggcaccgtgggccacgcctgcaaccccagcaccctgggcggcagagatggctggagcagccgcagcgcccggcccacctggtag

SEQ ID NO: 164755 - DNA, 507 bp, Artificial Sequence
  Description of Artificial Sequence: Synthetic coding sequence
tgagccctgtctgtgtacctgacccccaagacctctgtgtctggcaactggattgagatcgcctacggcaccagcagcggggctgtgcgggtcatcgtgcagcaccctgagaccgtgggcagcggcccccagctgttccagaccttcaccgtgcacaggagccctgtgaccaagatcatgctgtctgagaagcacctggtgtctgtgtgtgccgacaacaaccacgtgaggacctggacagtgacccgcttccggggcatgatcagcacccagcccggcagcacccccctggccagcttcaagatcctgagcctggaggagacagagagccacggcagctacagcagtggaaatgacatcggcccctttggagagagagatgaccagcaggtgttcatccagaaggtggtgcccatcaccaacaagctgtttgtgcggctgagcagcacaggcaagagcctgtgtggggtgtccctggtgagccgcagcagccaggagcccacctag

SEQ ID NO: 164756 - DNA, 870 bp, Artificial Sequence
  Description of Artificial Sequence: Synthetic coding sequence
atggtggtggtgacaggccgggagccagacagccggcggcaggatggagccatgagcagcagtgatgctgaagatgacttcctggagcccgccacccccacagccacccaggccggccacgccctgcccctgctgccccaggagttccctgaggtggtgcccctgaacattggaggagcccacttcaccacccggctgagcaccctgcgctgctatgaggacaccatgctggccgccatgttcagcggccgccactacatccccacagattctgagggccgctacttcatcgacagagatggcacccactttggagatgtgctgaacttcctgcggagcggggacctgcccccccgggagcgggtgcgggctgtgtacaaggaggcccagtactatgccatcggccccctgctggagcagctggagaacatgcagcccctgaagggggagaaggtgcggcaggccttcctgggcctgatgccctactacaaggaccacctggagcgcatcgtggagatcgcccggctgcgggctgtgcagaggaaggccaggtttgccaagctgaaggtgtgtgtgttcaaggaggagatgcccatcaccccctatgaatgtcccctgctgaacagcctgcgctttgagaggtctgagagtgatggccagctgtttgagcaccactgtgaggtggatgtgtcctttggcccctgggaggccgtggctgatgtgtatgacctgctgcactgcctggtgacagacctgagcgcccagggcctgactgtggaccaccagtgcatcggcgtgtgtgacaagcacctggtgaaccactactactgcaagaggcccatctatgagttcaagatcacctggtggtag

SEQ ID NO: 164757 - DNA, 1728 bp, Artificial Sequence
  Description of Artificial Sequence: Synthetic coding sequence
gtgtccaggaagaagatgagcctgaagtctgagcggcggggcatccacgtggaccagagcgacctgctgtgcaagaagggctgcggctactacggcaacccagcctggcagggcttctgcagcaagtgctggagggaggagtaccacaaggcccggcagaagcagatccaggaggactgggagctggccgagcgggtgctgctgtgctacccaggctggagcgccatggtgcagttccagctgacagccaccagcgcctcctgggcccaggtgatcctgctgctgcagcccccaaatgtgctgggcctgcaggccctgcagcgggaggaggaggaggcctttgccagcagccagagcagccagggcgcccagagcctgaccttcagcaagtttgaggagaagaagaccaatgagaagaccaggaaggtgaccaccgtgaagaagttcttcagcgccagcagccgggtgggcagcaagaaggagatccaggaggccaaggcccccagccccagcatcaaccggcagaccagcattgaaacagacagagtgtccaaggagttcatcgagttcctgaagaccttccacaagacaggccaggagatctacaagcagaccaagctgttcctggagggcatgcactacaagagggacctgagcattgaggagcagagtgaatgtgcccaggacttctaccacaacgtggccgagaggatgcagacccggggcaaggagcggcgcttccaccacgtgggccaggccggcctggagctgctgaccagcggggaccccccagccagcgccagccagagcgctggcaacacaggagtggagcccccccaccctgctgtgcccccagagcgggtggagaagatcatggaccagatcgagaagtacatcatgacccggctgtacaagtatgtgttctgcccagagaccacagatgatgagaagaaggacctggccatccagaagaggatccgggccctgcgctgggtgaccccccagatgctgtgtgtgcctgtgaatgaagacatccctgaggtgtctgacatggtggtgaaggccatcacagacatcatcgagatggacagcaagagggtgccccgggacaagctggcctgcatcaccaagtgcagcaagcacatcttcaatgccatcaagatcaccaagaatgaaccagccagcgcagatgacttcctgcccaccctcatctacatcgtgctgaagggcaaccccccccggctgcagagcaacatccagtacatcacccgcttctgcaaccccagccggctgatgactggagaagatggctactacttcaccaacctgtgctgtgctgtggccttcatcgagaagctggatgcccagagcctgaacctgagccaggaggactttgaccgctacatgagcggccagaccagccccaggaagcaggaggccgagagctggagcccagatgcctgcctgggcgtgaagcagatgtacaagaacctggacctgctgagccagctgaatgaaaggcaggagcgcatcatgaatgaggccaagaagctggagaaggacctgattgactggacagatggcatcgcccgggaggtgcaggacatcgtggagaagtaccccctggagatcaagccacccaaccagcccctggccgccatcgacagtgaaaatgtggagaatgacaagctgcccccacccctgcagccccaggtgtatgccggctag

SEQ ID NO: 164758 - DNA, 1596 bp, Artificial Sequence
  Description of Artificial Sequence: Synthetic coding sequence
atgagcctgaagtcagaaagaagaggcatccacgtggaccagagcgacctgctgtgcaagaagggctgcggctactacggcaacccagcctggcagggcttctgcagcaagtgctggagggaggagtaccacaaggcccggcagaagcagatccaggaggactgggagctggccgagcgggtgctgctgtgctacccaggctggagcgccatggtgcagttccagctgacagccaccagcgcctcctgggcccaggtgatcctgctgctgcagccccccaacgtgctgggcctgcaggccctgcagcgggaggaggaggaggcctttgccagcagccagagcagccagggcgcccagagcctgaccttcagcaagtttgaggagaagaagaccaatgagaagaccaggaaggtgaccaccgtgaagaagttcttcagcgccagcagccgggtgggcagcaagaaggagatccaggaggccaaggcccccagccccagcatcaaccggcagaccagcattgaaacagacagagtgtccaaggagttcatcgagttcctgaagaccttccacaagacaggccaggagatctacaagcagaccaagctgttcctggagggcatgcactacaagagggacctgagcattgaggagcagagtgaatgtgcccaggacttctaccacaacgtggccgagaggatgcagacccggggcaaggtgcccccagagcgggtggagaagatcatggaccagatcgagaagtacatcatgacccggctgtacaagtatgtgttctgcccagagaccacagatgatgagaagaaggacctggccatccagaagaggatccgggccctgcgctgggtgaccccccagatgctgtgtgtgcctgtgaatgaagacatccctgaggtgtctgacatggtggtgaaggccatcacagacatcatcgagatggacagcaagagggtgccccgggacaagctggcctgcatcaccaagtgcagcaagcacatcttcaatgccatcaagatcaccaagaatgaaccagccagcgcagatgacttcctgcccaccctcatctacatcgtgctgaagggcaaccccccccggctgcagagcaacatccagtacatcacccgcttctgcaaccccagccggctgatgactggagaagatggctactacttcaccaacctgtgctgtgctgtggccttcatcgagaagctggatgcccagagcctgaacctgagccaggaggactttgaccgctacatgagcggccagaccagccccaggaagcaggaggccgagagctggagcccagatgcctgcctgggcgtgaagcagatgtacaagaacctggacctgctgagccagctgaatgaaaggcaggagcgcatcatgaatgaggccaagaagctggagaaggacctgattgactggacagatggcatcgcccgggaggtgcaggacatcgtggagaagtaccccctggagatcaagccacccaaccagcccctggccgccatcgacagtgaaaatgtggagaatgacaagctgcccccacccctgcagccccaggtgtatgccggctag

SEQ ID NO: 164759 - DNA, 1476 bp, Artificial Sequence
  Description of Artificial Sequence: Synthetic coding sequence
atgagcctgaagtcagaaagaagaggcatccacgtggaccagagcgacctgctgtgcaagaagggctgcggctactacggcaacccagcctggcagggcttctgcagcaagtgctggagggaggagtaccacaaggcccggcagaagcagatccaggaggactgggagctggccgagcggctgcagcgggaggaggaggaggcctttgccagcagccagagcagccagggcgcccagagcctgaccttcagcaagtttgaggagaagaagaccaatgagaagaccaggaaggtgaccaccgtgaagaagttcttcagcgccagcagccgggtgggcagcaagaaggagatccaggaggccaaggcccccagccccagcatcaaccggcagaccagcattgaaacagacagagtgtccaaggagttcatcgagttcctgaagaccttccacaagacaggccaggagatctacaagcagaccaagctgttcctggagggcatgcactacaagagggacctgagcattgaggagcagagtgaatgtgcccaggacttctaccacaacgtggccgagaggatgcagacccggggcaaggtgcccccagagcgggtggagaagatcatggaccagatcgagaagtacatcatgacccggctgtacaagtatgtgttctgcccagagaccacagatgatgagaagaaggacctggccatccagaagaggatccgggccctgcgctgggtgaccccccagatgctgtgtgtgcctgtgaatgaagacatccctgaggtgtctgacatggtggtgaaggccatcacagacatcatcgagatggacagcaagagggtgccccgggacaagctggcctgcatcaccaagtgcagcaagcacatcttcaatgccatcaagatcaccaagaatgaaccagccagcgcagatgacttcctgcccaccctcatctacatcgtgctgaagggcaaccccccccggctgcagagcaacatccagtacatcacccgcttctgcaaccccagccggctgatgactggagaagatggctactacttcaccaacctgtgctgtgctgtggccttcatcgagaagctggatgcccagagcctgaacctgagccaggaggactttgaccgctacatgagcggccagaccagccccaggaagcaggaggccgagagctggagcccagatgcctgcctgggcgtgaagcagatgtacaagaacctggacctgctgagccagctgaatgaaaggcaggagcgcatcatgaatgaggccaagaagctggagaaggacctgattgactggacagatggcatcgcccgggaggtgcaggacatcgtggagaagtaccccctggagatcaagccacccaaccagcccctggccgccatcgacagtgaaaatgtggagaatgacaagctgcccccacccctgcagccccaggtgtatgccggctag

SEQ ID NO: 164760 - DNA, 1476 bp, Artificial Sequence; identical to SEQ ID NO: 164759
  Description of Artificial Sequence: Synthetic coding sequence

SEQ ID NO: 164761 - DNA, 1224 bp, Artificial Sequence
  Description of Artificial Sequence: Synthetic coding sequence
atgagcctgaagtcagaaagaagaggcatccacgtggaccagagcgacctgctgtgcaagaagggctgcggctactacggcaacccagcctggcagggcttctgcagcaagtgctggagggaggagtaccacaaggcccggcagaagcagatccaggaggactgggagctggccgagcggctgcagcgggaggaggaggaggcctttgccagcagccagagcagccagggcgcccagagcctgaccttcagcaagtttgaggagaagaagaccaatgagaagaccaggaaggtgaccaccgtgaagaagttcttcagcgccagcagccgggtgggcagcaagaagcccccagagcgggtggagaagatcatggaccagatcgagaagtacatcatgacccggctgtacaagtatgtgttctgcccagagaccacagatgatgagaagaaggacctggccatccagaagaggatccgggccctgcgctgggtgaccccccagatgctgtgtgtgcctgtgaatgaagacatccctgaggtgtctgacatggtggtgaaggccatcacagacatcatcgagatggacagcaagagggtgccccgggacaagctggcctgcatcaccaagtgcagcaagcacatcttcaatgccatcaagatcaccaagaatgaaccagccagcgcagatgacttcctgcccaccctcatctacatcgtgctgaagggcaaccccccccggctgcagagcaacatccagtacatcacccgcttctgcaaccccagccggctgatgactggagaagatggctactacttcaccaacctgtgctgtgctgtggccttcatcgagaagctggatgcccagagcctgaacctgagccaggaggactttgaccgctacatgagcggccagaccagccccaggaagcaggaggccgagagctggagcccagatgcctgcctgggcgtgaagcagatgtacaagaacctggacctgctgagccagctgaatgaaaggcaggagcgcatcatgaatgaggccaagaagctggagaaggacctgattgactggacagatggcatcgcccgggaggtgcaggacatcgtggagaagtaccccctggagatcaagccacccaaccagcccctggccgccatcgacagtgaaaatgtggagaatgacaagctgcccccacccctgcagccccaggtgtatgccggctag

SEQ ID NO: 164762 - DNA, 867 bp, Artificial Sequence
  Description of Artificial Sequence: Synthetic coding sequence
atggtggtggtgacaggccgggagccagacagccggcggcaggatggagccatgagcagcagtgatgctgaagatgacttcctggagcccgccacccccacagccacccaggccggccacgccctgcccctgctgccccaggagttccctgaggtggtgcccctgaacattggaggagcccacttcaccacccggctgagcaccctgcgctgctatgaggacaccatgctggccgccatgttcagcggccgccactacatccccacagattctgagggccgctacttcatcgacagagatggcacccactttggagatgtgctgaacttcctgcggagcggggacctgcccccccgggagcgggtgcgggctgtgtacaaggaggcccagtactatgccatcggccccctgctggagcagctggagaacatgcagcccctgaagggggagaaggtgcggcaggccttcctgggcctgatgccctactacaaggaccacctggagcgcatcgtggagatcgcccggctgcgggctgtgcagaggaaggccaggtttgccaagctgaaggtgtgtgtgttcaaggaggagatgcccatcaccccctatgaatgtcccctgctgaacagcctgcgctttgagaggtctgagagtgatggccagctgtttgagcaccactgtgaggtggatgtgtcctttggcccctgggaggccgtggctgatgtgtatgacctgctgcactgcctggtgacagacctgagcgcccagggcctgactgtggaccaccagtgcatcggcgtgtgtgacaagcacctggtgaaccactactactgcaagaggcccatctatgagttcaagatcacctggtag

SEQ ID NO: 164763 - DNA, 663 bp, Artificial Sequence
  Description of Artificial Sequence: Synthetic coding sequence
atgaagggctacggccacacagtgcccctgagtgatggcggcaaggccttctgcatcatctacagcgtcatcggcatccccttcaccctgctcttcctgacagctgtggtgcagaggatcaccgtgcacgtgacccggcggcctgtgctgtacttccacatccgctggggcttcagcaagcaggtggtggccatcgtgcatgctgtgctgctgggctttgtgacagtgtcctgcttcttcttcatcccagctgctgtgttttctgtgctggaggatgactggaacttcctggagagcttctacttctgcttcatcagcctgagcaccatcggcctgggggactatgtgcctggagagggctacaaccagaagttccgggagctgtacaagattggcatcacctgctacctgctgctgggcctcatcgccatgctggtggtgctggagaccttctgtgagctgcacgagctgaagaagttcaggaagatgttttatgtgaagaaggacaaggatgaggaccaggtgcacatcatcgagcatgaccagctgtccttcagcagcatcacagaccaggccgccggcatgaaggaggaccagaagcagaatgagccctttgtggccacccagagcagcgcctgtgtggatggccctgccaaccactag

SEQ ID NO: 164764 - DNA, 1011 bp, Artificial Sequence
  Description of Artificial Sequence: Synthetic coding sequence
atgctgcagagcctggccggcagcagctgtgtgcggctggtggagcggcacaggtctgcctggtgcttcggcttcctggtgctgggctacctgctgtacctggtgtttggagctgtggtgttcagctctgtggagctgccctatgaggacctgctgcggcaggagctgaggaagctgaagaggcgcttcctggaggagcacgagtgcctgtctgagcagcagctggagcagttcctgggccgggtgctggaggccagcaactacggcgtgtctgtgctgagcaatgccagcggcaactggaactgggacttcaccagcgccctcttctttgccagcacagtgctgagcaccaccggctacggccacacagtgcccctgagtgatggcggcaaggccttctgcatcatctacagcgtcatcggcatccccttcaccctgctcttcctgacagctgtggtgcagaggatcaccgtgcacgtgacccggcggcctgtgctgtacttccacatccgctggggcttcagcaagcaggtggtggccatcgtgcatgctgtgctgctgggctttgtgacagtgtcctgcttcttcttcatcccagctgctgtgttttctgtgctggaggatgactggaacttcctggagagcttctacttctgcttcatcagcctgagcaccatcggcctgggggactatgtgcctggagagggctacaaccagaagttccgggagctgtacaagattggcatcacctgctacctgctgctgggcctcatcgccatgctggtggtgctggagaccttctgtgagctgcacgagctgaagaagttcaggaagatgttttatgtgaagaaggacaaggatgaggaccaggtgcacatcatcgagcatgaccagctgtccttcagcagcatcacagaccaggccgccggcatgaaggaggaccagaagcagaatgagccctttgtggccacccagagcagcgcctgtgtggatggccctgccaaccactag

SEQ ID NO: 164765 - DNA, 729 bp, Artificial Sequence
  Description of Artificial Sequence: Synthetic coding sequence
gtgctgcgggtgctgagcccagacctggtgcggcggctgctgaacctggccgtgcgggccttccaggtgcccaagggggagagcctgaacttccctgagagcaccccaggctacggccacacagtgcccctgagtgatggcggcaaggccttctgcatcatctacagcgtcatcggcatccccttcaccctgctcttcctgacagctgtggtgcagaggatcaccgtgcacgtgacccggcggcctgtgctgtacttccacatccgctggggcttcagcaagcaggtggtggccatcgtgcatgctgtgctgctgggctttgtgacagtgtcctgcttcttcttcatcccagctgctgtgttttctgtgctggaggatgactggaacttcctggagagcttctacttctgcttcatcagcctgagcaccatcggcctgggggactatgtgcctggagagggctacaaccagaagttccgggagctgtacaagattggcatcacctgctacctgctgctgggcctcatcgccatgctggtggtgctggagaccttctgtgagctgcacgagctgaagaagttcaggaagatgttttatgtgaagaaggacaaggatgaggaccaggtgcacatcatcgagcatgaccagctgtccttcagcagcatcacagaccaggccgccggcatgaaggaggaccagaagcagaatgagccctttgtggccacctag

SEQ ID NO: 164766 - DNA, 1632 bp, Artificial Sequence
  Description of Artificial Sequence: Synthetic coding sequence
atggaggatggcttcaagggggacagaacagagggctgccgcagtgacagcgtggccgtgcctgctgctgcccctgtgtgccagcccaagagcgccaccaacggccagcccccagccccagcccccacccccaccccccggctgagcatcagcagccgggccaccgtggtggccaggatggagggcaccagccagggcggcctgcagacagtgatgaagtggaagacagtggtggccatctttgtggtggtggtggtgtacctggtgactggaggcctggtgttccgggccctggagcagccctttgagagcagccagaagaacaccatcgccctggagaaggccgagttcctgcgggaccacgtgtgtgtgagcccccaggagctggagaccctcatccagcacgccctggatgctgacaatgctggggtgagccccatcggcaacagcagcaacaacagcagccactgggacctgggcagcgccttcttctttgctggcaccgtcatcaccaccatcggctacggcaacatcgcccccagcacagagggcggcaagatcttctgcatcctgtatgccatcttcggcatccccctgtttggcttcctgctggccggcattggagaccagctgggcaccatctttgggaagagcatcgcccgggtggagaaggtgttcaggaagaagcaggtgtcccagaccaagatccgggtcatcagcaccatcctcttcatcctggccggctgcatcgtgtttgtgaccatcccagctgtgatcttcaagtacatcgagggctggacagccctggagagcatctactttgtggtggtgaccctgaccaccgtgggctttggagactttgtggccggcggcaatgccggcatcaactaccgggagtggtacaagcccctggtgtggttctggatcctggtgggcctggcctactttgctgctgtgctgtccatgattggagactggctgcgggtgctgagcaagaagaccaaggaggaggtgggggagatcaaggcccatgctgctgagtggaaggccaacgtgacagctgagttccgggagacccggcggcggctgtctgtggagatccatgacaagctgcagagagctgccaccatccgctccatggagcggcggcggctgggcctggaccagagggcccacagcctggacatgctgagccctgagaagaggtctgtgtttgctgccctggacaccggccgcttcaaggccagcagccaggagagcatcaacaaccggcccaacaacctgcggctgaagggccctgagcagctgaacaagcacggccagggcgccagcgaggacaacatcatcaacaagtttggcagcaccagccggctgaccaagaggaagaacaaggacctgaagaagaccctgcctgaagatgtgcagaagatctacaagaccttcaggaactacagcctggatgaggagaagaaggaggaggagacagagaagatgtgcaacagcgacaacagcagcacagccatgctgacagactgcatccagcagcacgccgagctggagaatggcatgatccccacagacaccaaggaccgggagcctgagaacaacagcctgctggaggacaggaactag

SEQ ID NO: 164767 - DNA, 1632 bp, Artificial Sequence
  Description of Artificial Sequence: Synthetic coding sequence
atgaagttccccatcgagacccccaggaagcaggtgaactgggaccccaaggtggccgtgcctgctgctgcccctgtgtgccagcccaagagcgccaccaacggccagcccccagccccagcccccacccccaccccccggctgagcatcagcagccgggccaccgtggtggccaggatggagggcaccagccagggcggcctgcagacagtgatgaagtggaagacagtggtggccatctttgtggtggtggtggtgtacctggtgactggaggcctggtgttccgggccctggagcagccctttgagagcagccagaagaacaccatcgccctggagaaggccgagttcctgcgggaccacgtgtgtgtgagcccccaggagctggagaccctcatccagcacgccctggatgctgacaatgctggggtgagccccatcggcaacagcagcaacaacagcagccactgggacctgggcagcgccttcttctttgctggcaccgtcatcaccaccatcggctacggcaacatcgcccccagcacagagggcggcaagatcttctgcatcctgtatgccatcttcggcatccccctgtttggcttcctgctggccggcattggagaccagctgggcaccatctttgggaagagcatcgcccgggtggagaaggtgttcaggaagaagcaggtgtcccagaccaagatccgggtcatcagcaccatcctcttcatcctggccggctgcatcgtgtttgtgaccatcccagctgtgatcttcaagtacatcgagggctggacagccctggagagcatctactttgtggtggtgaccctgaccaccgtgggctttggagactttgtggccggcggcaatgccggcatcaactaccgggagtggtacaagcccctggtgtggttctggatcctggtgggcctggcctactttgctgctgtgctgtccatgattggagactggctgcgggtgctgagcaagaagaccaaggaggaggtgggggagatcaaggcccatgctgctgagtggaaggccaacgtgacagctgagttccgggagacccggcggcggctgtctgtggagatccatgacaagctgcagagagctgccaccatccgctccatggagcggcggcggctgggcctggaccagagggcccacagcctggacatgctgagccctgagaagaggtctgtgtttgctgccctggacaccggccgcttcaaggccagcagccaggagagcatcaacaaccggcccaacaacctgcggctgaagggccctgagcagctgaacaagcacggccagggcgccagcgaggacaacatcatcaacaagtttggcagcaccagccggctgaccaagaggaagaacaaggacctgaagaagaccctgcctgaagatgtgcagaagatctacaagaccttcaggaactacagcctggatgaggagaagaaggaggaggagacagagaagatgtgcaacagcgacaacagcagcacagccatgctgacagactgcatccagcagcacgccgagctggagaatggcatgatccccacagacaccaaggaccgggagcctgagaacaacagcctgctggaggacaggaactag

SEQ ID NO: 164768 - DNA, 1617 bp, Artificial Sequence
  Description of Artificial Sequence: Synthetic coding sequence
atgttcttcctgtacacagacttcttcctgagcctggtggccgtgcctgctgctgcccctgtgtgccagcccaagagcgccaccaacggccagcccccagccccagcccccacccccaccccccggctgagcatcagcagccgggccaccgtggtggccaggatggagggcaccagccagggcggcctgcagacagtgatgaagtggaagacagtggtggccatctttgtggtggtggtggtgtacctggtgactggaggcctggtgttccgggccctggagcagccctttgagagcagccagaagaacaccatcgccctggagaaggccgagttcctgcgggaccacgtgtgtgtgagcccccaggagctggagaccctcatccagcacgccctggatgctgacaatgccggcgtgagccccatcggcaacagcagcaacaacagcagccactgggacctgggcagcgccttcttctttgctggcaccgtcatcaccaccatcggctacggcaacatcgcccccagcacagaaggaggcaagatcttctgcatcctgtatgccatcttcggcatccccctgtttggcttcctgctggccggcatcggggaccagctgggcaccatctttgggaagagcatcgcccgggtggagaaggtgttcaggaagaagcaggtgtcccagaccaagatccgggtcatcagcaccatcctcttcatcctggccggctgcatcgtgtttgtgaccatcccagctgtgatcttcaagtacatcgagggctggacagccctggagagcatctactttgtggtggtgaccctgaccaccgtgggctttggagactttgtggccggcggcaatgccggcatcaactaccgggagtggtacaagcccctggtgtggttctggatcctggtgggcctggcctactttgctgctgtgctgtccatgattggagactggctgcgggtgctgagcaagaagaccaaggaggaggtgggggagatcaaggcccacgccgctgagtggaaggccaacgtgacagctgagttccgggagacccggcggcggctgtctgtggagatccatgacaagctgcagagagctgccaccatccgctccatggagcggcggcggctgggcctggaccagagggcccacagcctggacatgctgagccctgagaagaggtctgtgtttgctgccctggacaccggccgcttcaaggccagcagccaggagagcatcaacaaccggcccaacaacctgcggctgaagggccctgagcagctgaacaagcacggccagggcgccagcgaggacaacatcatcaacaagtttggcagcaccagccggctgaccaagaggaagaacaaggacctgaagaagaccctgcctgaagatgtgcagaagatctacaagaccttcaggaactacagcctggatgaggagaagaaggaggaggagacagagaagatgtgcaacagcgacaacagcagcacagccatgctgacagactgcatccagcagcacgccgagctggagaatggcatgatccccacagacaccaaggaccgggagcctgagaacaacagcctgctggaggacagaaattag

SEQ ID NO: 164769 - DNA, 1293 bp, Artificial Sequence
  Description of Artificial Sequence: Synthetic coding sequence
atgagcagccgcagcccccggcccccaccaagaagaagcagaagaaggctgccccggcccagctgctgctgctgctgctgccgccgcagccacctgaatgaagacaccggccgctttgtgctgctggccgccctgattggcctgtacctggtggccggggccaccgtcttcagcgccctggagagccctggagaggccgaggcccgggcccgctggggcgccaccctgaggaacttctctgctgcccatggagtggccgagcctgagctgcgggccttcctgcggcactatgaagctgccctggccgccggcgtgcgggcagatgccctgcggccccgctgggacttccctggggccttctactttgtgggcaccgtggtgtccaccatcggcttcggcatgaccaccccagccaccgtgggcggcaaggccttcctgattgcctacggcctgtttggctgtgccggcaccatcctcttcttcaacctcttcctggagcgcatcatcagcctgctggccttcatcatgagggcctgccgggagcggcagctgcggcgcagcggcctgctgcctgccaccttcagaagaggcagcgccctgtctgaggccgacagcctggccggctggaagcccagcgtgtaccacgtgctgctgatcctgggcctgtttgctgtgctgctgagctgctgtgccagcgccatgtacacctctgtggagggctgggactatgtggacagcctgtacttctgctttgtgaccttcagcaccatcggctttggagacctggtgagcagccagcacgccgcctacagaaaccagggcctgtaccgcctgggcaacttcctgttcatcctgctgggcgtgtgctgcatctacagcctcttcaacgtcatcagcatcctgatcaagcaggtgctgaactggatgctgaggaagctgagctgccgctgctgtgcccgctgctgcccagcccctggggcccccctggccaggagaaatgccatcaccccaggcagccggctgcggcggcggctggccgccctgggcgctgaccctgctgcccgggacagtgatgctgagggccggcggctgtctggagagctgatctccatgagggacctgacagccagcaacaaggtgtccctggccctgctgcagaagcagctgtctgaaacagccaacggctaccccaggtctgtgtgtgtgaacacccggcagaatggcttcagcggcggcgtgggcgccctgggcatcatgaacaaccggctggccgagaccagcgccagcaggtag

SEQ ID NO: 164770 - DNA, 1227 bp, Artificial Sequence
  Description of Artificial Sequence: Synthetic coding sequence
atggccggccggggcttctcctggggccctggccacctgaatgaagataatgcccgcttcctgctgctggccgccctgattgtgctgtacctgctgggcggcgctgctgtgttttctgccctggagctggcccacgagcggcaggccaagcagcgctgggaggagcggctggccaacttcagccggggccacaacctgagcagagatgagctgcggggcttcctgcggcactatgaggaggccacccgggccggcatccgggtggacaacgtgcggccccgctgggacttcaccggggccttctactttgtgggcaccgtggtgtccaccatcggcttcggcatgaccaccccagccaccgtgggcggcaagatcttcctgatcttctacggcctggtgggctgcagcagcaccatcctcttcttcaacctcttcctggagcggctcatcaccatcatcgcctacatcatgaagagctgccaccagaggcagctgcggaggagaggagccctgccccaggagagcctgaaggatgctggccagtgtgaggtggacagcctggccggctggaagcccagcgtgtactacgtgatgctgatcctgtgcacagccagcatcctgatcagctgctgtgccagcgccatgtacacccccatcgagggctggagctactttgacagcctgtacttctgctttgtggccttcagcaccatcggctttggagacctggtgagcagccagaatgcccactatgagagccagggcctgtacagatttgccaactttgtgttcatcctgatgggcgtgtgctgcatctacagcctcttcaacgtcatcagcatcctgatcaagcagagcctgaactggatcctgaggaagatggacagcggctgctgcccccagtgccagaggggcctgctgcggagcagaagaaatgtggtgatgcctggctctgtgaggaaccgctgcaacatcagcattgaaacagatggagtggccgagagtgacacagatggccggcggctgtctggagagatgatctccatgaaggacctgctggccgccaacaaggccagcctggccatcctgcagaagcagctgtctgagatggccaacggctgcccccaccagaccagcaccctggcccgggacaatgagttcagcggcggcgtgggcgcctttgccatcatgaacaaccggctggccgagaccagcggggacagatag

SEQ ID NO: 164771 - DNA, 993 bp, Artificial Sequence
  Description of Artificial Sequence: Synthetic coding sequence
atgaggcggcccagcgtgcgggctgctggcctggtgctgtgcaccctgtgctacctgctggtgggcgctgctgtgtttgatgccctggagagcgaggccgagagcggccggcagaggctgctggtgcagaagagaggagccctgcggaggaagtttggcttctctgctgaggactaccgggagctggagcggctggccctgcaggccgagccccaccgggccggccggcagtggaagtttcctggcagcttctactttgccatcaccgtcatcaccaccatcgagtatggccatgctgcccctggaacagattctgggaaggtgttctgcatgttttatgccctgctgggcatccccctgaccctggtgaccttccagagcctgggggagcggctgaatgctgtggtgcggcggctgctgctggccgccaagtgctgcctgggcctgcgctggacctgtgtgtccacagagaacctggtggtggccggcctgctggcctgtgccgccaccctggccctgggcgctgtggccttcagccactttgagggctggaccttcttccacgcctactactactgcttcatcaccctgaccaccatcggctttggagactttgtggccctgcagagcggggaggccctgcagaggaagctgccctacgtggccttctccttcctgtacatcctgctgggcctgactgtgattggagccttcctgaacctggtggtgctgcgcttcctggtggccagcgctgactggccagagagagctgcccggacccccagccccaggcctcctggggcccctgagagccggggcctgtggctgccccggcggcctgcccggtctgtgggcagcgccagcgtcttctgccacgtgcacaagctggagcgctgtgcccgggacaacctgggcttcagcccccccagcagccctggggtggtgcggggcggccaggccccccggctgggcgcccgctggaagagcatctag

SEQ ID NO: 164772 - DNA, 789 bp, Artificial Sequence
  Description of Artificial Sequence: Synthetic coding sequence
atgcccagcgctggcctgtgcagctgctggggcggccgggtgctgcccctgctgctggcctacgtgtgctacctgctgctgggcgccaccatcttccagctgctggagcggcaggccgaggcccagagccgggaccagttccagctggagaagctgcgcttcctggagaactacacctgcctggaccagtgggccatggagcagtttgtgcaggtgatcatggaggcctgggtgaagggcgtgaaccccaagggcaacagcaccaaccccagcaactgggactttggcagcagcttcttctttgctggcaccgtggtgaccaccatcggctacggcaacctggcccccagcacagaggccggccaggtgttctgtgtgttctacgccctgctgggcatccccctgaatgtcatcttcctgaaccacctgggcaccggcctgcgggcccacctggccgccatcgagcgctgggaggaccggccccggcgcagccaggtgctgcaggtgctgggcctggccctcttcctgaccctgggcaccctggtgatcctgatcttcccccccatggtgttcagccacgtggagggctggagcttcagcgagggcttctactttgccttcatcaccctgagcaccatcggctttggagactatgtggtgggcctgcggcagggctgtggggccaaggccgcccctggccggcggccccggcggggcagcacagctgcccggggcgtgcaggtgaccccccaggacttccccatcagcaagaagggcctgggcagctag

SEQ ID NO: 164773 - DNA, 930 bp, Artificial Sequence
  Description of Artificial Sequence: Synthetic coding sequence
atgcccagcgctggcctgtgcagctgctggggcggccgggtgctgcccctgctgctggcctacgtgtgctacctgctgctgggcgccaccatcttccagctgctggagcggcaggccgaggcccagagccgggaccagttccagctggagaagctgcgcttcctggagaactacacctgcctggaccagtgggccatggagcagtttgtgcaggtgatcatggaggcctgggtgaagggcgtgaaccccaagggcaacagcaccaaccccagcaactgggactttggcagcagcttcttctttgctggcaccgtggtgaccaccatcggctacggcaacctggcccccagcacagaggccggccaggtgttctgtgtgttctacgccctgctgggcatccccctgaatgtcatcttcctgaaccacctgggcaccggcctgcgggcccacctggccgccatcgagcgctgggaggaccggccccggcgcagccaggtgctgcaggtgctgggcctggccctcttcctgaccctgggcaccctggtgatcctgatcttcccccccatggtgttcagccacgtggagggctggagcttcagcgagggcttctactttgccttcatcaccctgagcaccatcggctttggagactatgtggtgggcacagaccccagcaagcactacatctctgtgtaccgcagcctggccgccatctggatcctgctgggcctggcctggctggccctgatcctgcccctgggccccctgctgctgcaccgctgctgccagctgtggctgctgagcctgcggcagggctgtggggccaaggccgcccctggaagaagaccccggcggggcagcacagctgcccggggcgtgcaggtgaccccccaggacttccccatcagcaagaagggcctgggcagctag

SEQ ID NO: 164774 - DNA, 969 bp, Artificial Sequence
  Description of Artificial Sequence: Synthetic coding sequence
atgcccagcgctggcctgtgcagctgctggggcggccgggtgctgcccctgctgctggcctacgtgtgctacctgctgctgggcgccaccatcttccagctgctggagcggcaggccgaggcccagagccgggaccagttccagctggagaagctgcgcttcctggagaactacacctgcctggaccagtgggccatggagcagtttgtgcaggtgatcatggaggcctgggtgaagggcgtgaaccccaagggcaacagcaccaaccccagcaactgggactttggcagcagcttcttctttgctggcaccgtggtgaccaccatcggctacggcaacctggcccccagcacagaggccggccaggtgttctgtgtgttctacgccctgctgggcatccccctgaatgtcatcttcctgaaccacctgggcaccggcctgcgggcccacctggccgccatcgagcgctgggaggaccggccccggcgcagccaggtgctgcaggtgctgggcctggccctcttcctgaccctgggcaccctggtgatcctgatcttcccccccatggtgttcagccacgtggagggctggagcttcagcgagggcttctactttgccttcatcaccctgagcaccatcggctttggagactatgtggtgggccaccccctgaacttcatcacccccagcggcctgctgcccagccaggagcccttccagacccctcatggcaagccagagagccagcagatccctggcagcttccagaaggtgtcctccatgaatgtgtggcccctgagcggcatgcacagccctggcctggccttccccctgcctgactgcaacatcccagaccaggagcgcttccggcccctgcaccctggggcctggaagttctggcccctgcccctgcccagcagcaacagcaagtgggcccccatgtggctgggcagcagcgcccaggtgtag

SEQ ID NO: 164775 - DNA, 885 bp, Artificial Sequence
  Description of Artificial Sequence: Synthetic coding sequence
atgcccagcgctggcctgtgcagctgctggggcggccgggtgctgcccctgctgctggcctacgtgtgctacctgctgctgggcgccaccatcttccagctgctggagcggcaggccgaggcccagagccgggaccagttccagctggagaagctgcgcttcctggagaactacacctgcctggaccagtgggccatggagcagtttgtgcaggtgatcatggaggcctgggtgaagggcgtgaaccccaagggcaacagcaccaaccccagcaactgggactttggcagcagcttcttctttgctggcaccgtggtgaccaccatcggctacggcaacctggcccccagcacagaggccggccaggtgttctgtgtgttctacgccctgctgggcatccccctgaatgtcatcttcctgaaccacctgggcaccggcctgcgggcccacctggccgccatcgagcgctgggaggaccggccccggcgcagccaggtgctgcaggtgctgggcctggccctcttcctgaccctgggcaccctggtgatcctgatcttcccccccatggtgttcagccacgtggagggctggagcttcagcgagggcttctactttgccttcatcaccctgagcaccatcggctttggagactatgtggtgggcacagaccccagcaagcactacatctctgtgtaccgcagcctggccgccatctggatcctgctgggcctggcctggctggccctgatcctgcccctgggccccctgctgctgcaccgctgctgccagctgtggctgctgagccggggcctgggcgtgaaggatggagctgccagtgaccccagcggcctgccccggccccagaagatccccatcagcgcctag

SEQ ID NO: 164776 - DNA, 594 bp, Artificial Sequence
  Description of Artificial Sequence: Synthetic coding sequence
atggagcagtttgtgcaggtgatcatggaggcctgggtgaagggcgtgaaccccaagggcaacagcaccaaccccagcaactgggactttggcagcagcttcttctttgctggcaccgtggtgaccaccatcggctacggcaacctggcccccagcacagaagctggccaggtgttctgtgtgttctacgccctgctgggcatccccctgaatgtcatcttcctgaaccacctgggcaccggcctgcgggcccacctggccgccatcgagcgctgggaggaccggcccaggaggagccaggtgctgcaggtgctgggcctggccctcttcctgaccctgggcaccctggtgatcctgatcttcccccccatggtgttcagccacgtggagggctggagcttcagcgagggcttctactttgccttcatcaccctgagcaccatcggctttggagactatgtggtgggcctgcggcagggctgtggggccaaggccgcccctggaagaagaccccggcggggcagcacagctgcccggggcgtgcaggtgaccccccaggacttccccatcagcaagaagggcctgggcagctag

SEQ ID NO: 164777 - DNA, 999 bp, Artificial Sequence
  Description of Artificial Sequence: Synthetic coding sequence
atgtaccggccccgggcccgggccgcccctgagggccgggtgcggggctgtgctgtgcccagcacagtgctgctgctgctggcctacctggcctacctggccctgggcactggagtcttctggaccctggagggccgggccgcccaggacagcagccgctccttccagagggacaagtgggagctgctgcagaacttcacctgcctggacaggcctgccctggacagcctcatcagagatgtggtgcaggcctacaagaatggagccagcctgctgagcaacaccacctccatgggccgctgggagctggtgggcagcttcttcttctctgtgtccaccatcaccaccatcggctacggcaacctgagccccaacaccatggccgcccggctcttctgcatcttctttgccctggtgggcatccccctgaacctggtggtgctgaaccggctgggccacctgatgcagcagggcgtgaaccactgggccagccggctgggcggcacctggcaggaccctgacaaggcccgctggctggccggcagcggggccctgctgagcggcctgctgctcttcctgctgctgccccccctgctcttcagccacatggagggctggagctacacagagggcttctactttgccttcatcaccctgagcacagtgggctttggagactatgtgattggcatgaaccccagccagcgctaccccctgtggtacaagaacatggtgtccctgtggatcctgtttggcatggcctggctggccctgatcatcaagctgatcctgagccagctggagaccccaggccgggtgtgcagctgctgccaccacagcagcaaagaagacttcaagagccagagctggaggcagggccctgaccgggagcctgagagccacagcccccagcagggctgctacccagagggccccatgggcatcatccagcacctggagcccagcgcccatgctgctggctgtgggaaggacagctag

SEQ ID NO: 164778 - DNA, 816 bp, Artificial Sequence
  Description of Artificial Sequence: Synthetic coding sequence
atgtaccggccccgggcccgggccgcccctgagggccgggtgcggggctgtgctgtgcccagcacagtgctgctgctgctggcctacctggcctacctggccctgggcactggagtcttctggaccctggagggccgggccgcccaggacagcagccgctccttccagagggacaagtgggagctgctgcagaacttcacctgcctggacaggcctgccctggacagcctcatcagagatgtggtgcaggcctacaagaatggagccagcctgctgagcaacaccacctccatgggccgctgggagctggtgggcagcttcttcttctctgtgtccaccatcaccaccatcggctacggcaacctgagccccaacaccatggccgcccggctcttctgcatcttctttgccctggtgggcatccccctgaacctggtggtgctgaaccggctgggccacctgatgcagcagggcgtgaaccactgggccagccggctgggcggcacctggcaggaccctgacaaggcccgctggctggccggcagcggggccctgctgagcggcctgctgctcttcctgctgctgccccccctgctcttcagccacatggagggctggagctacacagagggcttctactttgccttcatcaccctgagcacagtgggctttggagactatgtgattgccagctgcctgatcagtgacaccaggaagcccaacagagactggcagaccctggagaggaccagcaagagcagcggcggcctgctgaagtaccgcttcctggccggccacggcggcagccacctgtag

SEQ ID NO: 164779 - DNA, 1155 bp, Artificial Sequence
  Description of Artificial Sequence: Synthetic coding sequence
atggaggtgtctggccacccccaggcccggcgctgctgcccagaggccctgggcaagctgtttcctggcctgtgcttcctgtgcttcctggtgacctacgccctggtgggcgctgtggtgttcagcgccattgaagatggccaggtgctggtggccgcagatgatggagaatttgagaagttcctggaggagctgtgccgcatcctgaactgcagcgagaccgtggtggaggacaggaagcaggacctgcagggccacctgcagaaggtgaagccccagtggttcaacagaaccacccactggagcttcctgagcagcctcttcttctgctgcaccgtcttcagcacagtgggctacggctacatctaccctgtgacccggctgggcaagtacctgtgcatgctgtatgccctgtttggcatccccctgatgttcctggtgctgacagacacaggagacatcctggccaccatcctgagcaccagctacaaccgcttcaggaagttccccttcttcacccggcccctgctgagcaagtggtgccccaagagcctcttcaagaagaagccagaccccaagccagcagatgaggccgtgccccagatcatcatctctgctgaggagctgcccggccccaagctgggcacctgccccagccggcccagctgcagcatggagctgtttgagaggagccacgccctggagaagcagaacaccctgcagctgcccccccaggccatggagaggagcaacagctgcccagagctggtgctgggccgcctgagctacagcatcatcagcaacctggatgaggtgggccagcaggtggagcggctggacatccccctgcccatcatcgccctgattgtgtttgcctacatcagctgtgccgccgccatcctgcccttctgggagacccagctggactttgaaaatgccttctacttctgctttgtgaccctgaccaccatcggctttggagacacagtgctggagcaccccaacttcttcctgttcttcagcatctacatcatcgtgggcatggagatcgtgttcatcgccttcaagctggtgcagaaccggctgattgacatctacaagaatgtgatgctgttctttgccaagggcaagttctaccacctggtgaagaagtag

SEQ ID NO: 164780 - DNA, 459 bp, Artificial Sequence
  Description of Artificial Sequence: Synthetic coding sequence
atgatgaacccccgggccaagagggacttctacctggccgccccagacctgctggaccccaagtctgctgcccagaacagcaagccccggctgtccttcagcaccaagcccaccgtgctggccagccgggtggagagtgacaccaccatcaacgtgatgaagtggaagacagtgtccaccatcttcctggtggtggtgctgtacctgatcattggagccaccgtcttcaaggccctggagcagccccatgagatcagccagaggaccaccatcgtcatccagaagcagaccttcatcagccagcacagctgtgtgaacagcacagagctggatgagctgatccaggacctggagaccagccaccacgcccagaaggccgccaagtacagcgtgtcctccatgccctactgggagttccccagcctggtgttctcctggctggagctggagatctcctag

SEQ ID NO: 164781 - DNA, 1236 bp, Artificial Sequence
  Description of Artificial Sequence: Synthetic coding sequence
atggccgccccagacctgctggaccccaagtctgctgcccagaacagcaagccccggctgtccttcagcaccaagcccaccgtgctggccagccgggtggagagtgacaccaccatcaacgtgatgaagtggaagacagtgtccaccatcttcctggtggtggtgctgtacctgatcatcggggccaccgtcttcaaggccctggagcagccccatgagatcagccagaggaccaccatcgtcatccagaagcagaccttcatcagccagcacagctgtgtgaacagcacagagctggatgagctgatccagcagatcgtggccgccatcaatgccggcatcatccccctgggcaacaccagcaaccagatcagccactgggacctgggcagcagcttcttctttgctggcaccgtcatcaccaccatcggctttggaaacatcagccccaggacagagggcggcaagatcttctgcatcatctatgccctgctgggcatccccctgtttggcttcctgctggccggcgtgggggaccagctgggcaccatctttggaaaaggaattgccaaggtggaggacaccttcatcaagtggaatgtgtcccagaccaagatccgcatcatcagcaccatcatcttcatcctgtttggctgtgtgctgtttgtggccctgcctgccatcatcttcaagcacatcgagggctggagcgccctggatgccatctactttgtggtgatcaccctgaccaccatcggctttggagactatgtggccggcggcagtgacatcgagtacctggacttctacaagcctgtggtgtggttctggatcctggtgggcctggcctactttgctgctgtgctgtccatgattggagactggctgcgggtcatcagcaagaagaccaaggaggaggtgggggagttccgggcccacgccgctgagtggacagccaacgtgacagctgagttcaaggagacccggcggcggctgtctgtggagatctatgacaagttccagagggccaccagcatcaagaggaagctgtctgctgagctggccggcaaccacaaccaggagctgaccccctgcaggaggaccctgtctgtgaaccacctgaccagcgagagagatgtgctgccccccctgctgaagacagagagcatctacctgaatggcctgaccccccactgtgccggggaggagattgctgtgattgagaacatcaagtag

SEQ ID NO: 164782 - DNA, 1269 bp, Artificial Sequence
  Description of Artificial Sequence: Synthetic coding sequence
atgatgaacccccgggccaagagggacttctacctggccgccccagacctgctggaccccaagtctgctgcccagaacagcaagccccggctgtccttcagcaccaagcccaccgtgctggccagccgggtggagagtgacaccaccatcaacgtgatgaagtggaagacagtgtccaccatcttcctggtggtggtgctgtacctgatcattggagccaccgtcttcaaggccctggagcagccccatgagatcagccagaggaccaccatcgtcatccagaagcagaccttcatcagccagcacagctgtgtgaacagcacagagctggatgagctgatccagcagatcgtggccgccatcaatgccggcatcatccccctgggcaacaccagcaaccagatcagccactgggacctgggcagcagcttcttctttgctggcaccgtcatcaccaccatcggcttcggcaacatcagccccaggacagaaggaggcaagatcttctgcatcatctatgccctgctgggcatccccctgtttggcttcctgctggccggcgtgggggaccagctgggcaccatctttgggaagggcatcgccaaggtggaggacaccttcatcaagtggaatgtgtcccagaccaagatccgcatcatcagcaccatcatcttcatcctgtttggctgtgtgctgtttgtggccctgcctgccatcatcttcaagcacatcgagggctggagcgccctggatgccatctactttgtggtgatcaccctgaccaccatcggctttggagactatgtggccggcggcagtgacatcgagtacctggacttctacaagcctgtggtgtggttctggatcctggtgggcctggcctactttgctgctgtgctgtccatgattggagactggctgcgggtcatcagcaagaagaccaaggaggaggtgggggagttccgggcccatgctgctgagtggacagccaacgtgacagctgagttcaaggagacccggcggcggctgtctgtggagatctatgacaagttccagagggccaccagcatcaagaggaagctgtctgctgagctggccggcaaccacaaccaggagctgaccccctgcaggaggaccctgtctgtgaaccacctgaccagcgagagagatgtgctgccccccctgctgaagacagagagcatctacctgaatggcctgaccccccactgtgccggggaggagattgctgtgattgagaacatcaagtag

SEQ ID NO: 164783 - DNA, 1281 bp, Artificial Sequence
  Description of Artificial Sequence: Synthetic coding sequence
atgctgcccagcgccagccgggagcggcccggctaccgggccggcgtggccgccccagacctgctggaccccaagtctgctgcccagaacagcaagccccggctgtccttcagcaccaagcccaccgtgctggccagccgggtggagagtgacaccaccatcaacgtgatgaagtggaagacagtgtccaccatcttcctggtggtggtgctgtacctgatcattggagccaccgtcttcaaggccctggagcagccccatgagatcagccagaggaccaccatcgtcatccagaagcagaccttcatcagccagcacagctgtgtgaacagcacagagctggatgagctgatccagcagatcgtggccgccatcaatgccggcatcatccccctgggcaacaccagcaaccagatcagccactgggacctgggcagcagcttcttctttgctggcaccgtcatcaccaccatcggcttcggcaacatcagccccaggacagaaggaggcaagatcttctgcatcatctatgccctgctgggcatccccctgtttggcttcctgctggccggcgtgggggaccagctgggcaccatctttgggaagggcatcgccaaggtggaggacaccttcatcaagtggaatgtgtcccagaccaagatccgcatcatcagcaccatcatcttcatcctgtttggctgtgtgctgtttgtggccctgcctgccatcatcttcaagcacatcgagggctggagcgccctggatgccatctactttgtggtgatcaccctgaccaccatcggctttggagactatgtggccggcggcagtgacatcgagtacctggacttctacaagcctgtggtgtggttctggatcctggtgggcctggcctactttgctgctgtgctgtccatgattggagactggctgcgggtcatcagcaagaagaccaaggaggaggtgggggagttccgggcccatgctgctgagtggacagccaacgtgacagctgagttcaaggagacccggcggcggctgtctgtggagatctatgacaagttccagagggccaccagcatcaagaggaagctgtctgctgagctggccggcaaccacaaccaggagctgaccccctgcaggaggaccctgtctgtgaaccacctgaccagcgagagagatgtgctgccccccctgctgaagacagagagcatctacctgaatggcctgaccccccactgtgccggggaggagattgctgtgattgagaacatcaagtag

SEQ ID NO: 164784 - DNA, 687 bp, Artificial Sequence
  Description of Artificial Sequence: Synthetic coding sequence
atgatgaacccccgggccaagagggacttctacctggccgccccagacctgctggaccccaagtctgctgcccagaacagcaagccccggctgtccttcagcaccaagcccaccgtgctggccagccgggtggagagtgacaccaccatcaacgtgatgaagtggaagacagtgtccaccatcttcctggtggtggtgctgtacctgatcattggagccaccgtcttcaaggccctggagcagccccatgagatcagccagaggaccaccatcgtcatccagaagcagaccttcatcagccagcacagctgtgtgaacagcacagagctggatgagctgatccagcagatcgtggccgccatcaatgccggcatcatccccctgggcaacaccagcaaccagatcagccactgggacctgggcagcagcttcttctttgctggcaccgtcatcaccaccatcggcttcggcaacatcagccccaggacagaaggaggcaagatcttctgcatcatctatgccctgctgggcatccccctgtttggcttcctgctggccggcgtgggggaccagctgggcaccatctttgggaagggcatcgccaaggtggaggacaccttcatcgtggaccccatcctgaacatctggaccagcatcagcctgagctgtggcagcggcagcctgtag

SEQ ID NO: 164785 - DNA, 471 bp, Artificial Sequence
  Description of Artificial Sequence: Synthetic coding sequence
atgctgcccagcgccagccgggagcggcccggctaccgggccggcgtggccgccccagacctgctggaccccaagtctgctgcccagaacagcaagccccggctgtccttcagcaccaagcccaccgtgctggccagccgggtggagagtgacaccaccatcaacgtgatgaagtggaagacagtgtccaccatcttcctggtggtggtgctgtacctgatcattggagccaccgtcttcaaggccctggagcagccccatgagatcagccagaggaccaccatcgtcatccagaagcagaccttcatcagccagcacagctgtgtgaacagcacagagctggatgagctgatccaggacctggagaccagccaccacgcccagaaggccgccaagtacagcgtgtcctccatgccctactgggagttccccagcctggtgttctcctggctggagctggagatctcctag

SEQ ID NO: 164786 - DNA, 459 bp, Artificial Sequence; identical to SEQ ID NO: 164780
  Description of Artificial Sequence: Synthetic coding sequence

SEQ ID NO: 164787 - DNA, 1185 bp, Artificial Sequence
  Description of Artificial Sequence: Synthetic coding sequence
atgaagaggcagaatgtgaggaccctggccctgattgtgtgcaccttcacctacctgctggtgggcgctgctgtgtttgatgccctggagagcgagcctgagctgattgaaaggcagaggctggagctgcggcagcaggagctgcgggcccgctacaacctgagccagggcggctatgaggagctggagcgggtggtgctgcggctgaagccccacaaggccggcgtgcagtggaggtttgctggcagcttctactttgccatcaccgtcatcaccaccatcggctacggccatgctgcccccagcacagatggcggcaaggtgttctgcatgttttatgccctgctgggcatccccctgaccctggtgatgttccagagcctgggggagcgcatcaacaccctggtgcgctacctgctgcaccgggccaagaagggcctgggcatgagaagagcagatgtgtccatggccaacatggtgctgattggcttcttcagctgcatcagcaccctgtgcattggagctgctgccttcagccactatgagcactggaccttcttccaggcctactactactgcttcatcaccctgaccaccatcggctttggagactatgtggccctgcagaaggaccaggccctgcagacccagccccagtatgtggccttctcctttgtgtacatcctgaccggcctgactgtgattggagccttcctgaacctggtggtgctgcgcttcatgaccatgaatgcagaagatgagaagagagatgctgagcaccgggccctgctgaccagaaatggccaggccggcggcggcggcggcggcggcagcgcccacaccacagacacagccagcagcacagctgctgctgggggcggcggcttcagaaatgtgtatgcagaggtgctgcacttccagagcatgtgcagctgcctgtggtacaagagccgggagaagctgcagtacagcatccccatgatcatcccccgggacctgagcaccagtgacacctgtgtggagcagagccacagcagccctgggggcggcggccgctacagcgacacccccagccgccgctgcctgtgcagcggggcccccaggtctgccatcagctctgtgtccacaggcctgcacagcctgagcaccttccggggcctgatgaagaggaggagctctgtgtag

SEQ ID NO: 164788 - DNA, 816 bp, Artificial Sequence
  Description of Artificial Sequence: Synthetic coding sequence
atgttccagagcctgggggagcgcatcaacaccctggtgcgctacctgctgcaccgggccaagaagggcctgggcatgagaagagcagatgtgtccatggccaacatggtgctgattggcttcttcagctgcatcagcaccctgtgcatcggggctgctgccttcagccactatgagcactggaccttcttccaggcctactactactgcttcatcaccctgaccaccatcggctttggagactatgtggccctgcagaaggaccaggccctgcagacccagccccagtatgtggccttctcctttgtgtacatcctgaccggcctgaccgtcatcggggccttcctgaacctggtggtgctgcgcttcatgaccatgaatgcagaagatgagaagagagatgctgagcaccgggccctgctgaccagaaatggccaggccggcggcggcggcggcggcggcagcgcccacaccacagacacagccagcagcacagctgctgctgggggcggcggcttcagaaatgtgtatgcagaggtgctgcacttccagagcatgtgcagctgcctgtggtacaagagccgggagaagctgcagtacagcatccccatgatcatcccccgggacctgagcaccagtgacacctgtgtggagcagagccacagcagccctgggggcggcggccgctacagcgacacccccagccgccgctgcctgtgcagcggggcccccaggtctgccatcagctctgtgtccacaggcctgcacagcctgagcaccttccggggcctgatgaagagaagaagctctgtgtag

SEQ ID NO: 164789 - DNA, 1182 bp, Artificial Sequence
  Description of Artificial Sequence: Synthetic coding sequence
atgaggagcaccaccctgctggccctgctggccctggtgctgctgtacctggtgtctggggccctggtgttccgggccctggagcagccccatgagcagcaggcccagcgggagctgggggaggtgcgggagaagttcctgcgggcccacccctgtgtgtctgaccaggagctgggcctgctgatcaaggaggtggctgatgccctgggcggcggcgctgaccctgagaccaacagcaccagcaacagcagccacagcgcctgggacctgggcagcgccttcttcttcagcggcaccatcatcaccaccatcggctatggaaatgtggccctgaggacagatgctggccgcctcttctgcatcttctacgccctggtgggcatccccctgtttggcatcctgctggccggcgtgggggaccggctgggcagcagcctgcggcacggcatcggccacatcgaggccatcttcctgaagtggcacgtgcccccagagctggtgcgggtgctgagcgccatgctgttcctgctgattggctgcctgctgtttgtgctgacccccacctttgtgttctgctacatggaggactggagcaagctggaggccatctactttgtgattgtgaccctgaccaccgtgggctttggagactatgtggccggggctgacccccggcaggacagccctgcctaccagcccctggtgtggttctggatcctgctgggcctggcctactttgcctctgtgctgaccaccatcggcaactggctgcgggtggtgtccaggaggaccagggctgagatgggcggcctgacagcccaggccgcctcctggacaggaacagtgacagcccgggtgacccagagagctggccctgctgcccctcctcctgagaaggagcagcccctgctgcccccaccaccctgcccagcccagcccctgggccggcccaggagccccagccccccagagaaggcccagccccccagccccccaacagccagcgccctggactaccccagcgagaacctggccttcattgatgagagcagtgacacccagagcgagcggggctgccccctgccccgggccccccggggcagaagaagacccaacccccccaggaagcctgtgcggccccggggccctggccggccccgggacaagggcgtgcctgtgtag

SEQ ID NO: 164790 - DNA, 1182 bp, Artificial Sequence; identical to SEQ ID NO: 164789
  Description of Artificial Sequence: Synthetic coding sequence

SEQ ID NO: 164791 - DNA, 1182 bp, Artificial Sequence; identical to SEQ ID NO: 164789
  Description of Artificial Sequence: Synthetic coding sequence

SEQ ID NO: 164792 - DNA, 1257 bp, Artificial Sequence
  Description of Artificial Sequence: Synthetic coding sequence
accacagccccccaggagcccccagcccggcccctgcaggccggcagcggggccggccctgcccctggccgggccatgaggagcaccaccctgctggccctgctggccctggtgctgctgtacctggtgtctggggccctggtgttccgggccctggagcagccccatgagcagcaggcccagcgggagctgggggaggtgcgggagaagttcctgcgggcccacccctgtgtgtctgaccaggagctgggcctgctgatcaaggaggtggctgatgccctgggcggcggcgctgaccctgagaccaacagcaccagcaacagcagccacagcgcctgggacctgggcagcgccttcttcttcagcggcaccatcatcaccaccatcggctatggaaatgtggccctgaggacagatgctggccgcctcttctgcatcttctacgccctggtgggcatccccctgtttggcatcctgctggccggcgtgggggaccggctgggcagcagcctgcggcatggaattggccacatcgaggccatcttcctgaagtggcacgtgcccccagagctggtgcgggtgctgagcgccatgctgttcctgctgattggctgcctgctgtttgtgctgacccccacctttgtgttctgctacatggaggactggagcaagctggaggccatctacttcgtcatcgtgaccctgaccaccgtgggctttggagactatgtggccggggctgacccccggcaggacagccctgcctaccagcccctggtgtggttctggatcctgctgggcctggcctactttgcctctgtgctgaccaccatcggcaactggctgcgggtggtgtccaggaggaccagggctgagatgggcggcctgacagcccaggccgcctcctggacaggcaccgtgacagcccgggtgacccagagagctggccctgctgcccctcctcctgagaaggagcagcccctgctgcccccaccaccctgcccagcccagcccctgggccggcccaggagccccagccccccagagaaggcccagccccccagccccccaacagccagcgccctggactaccccagcgagaacctggccttcattgatgagagcagtgacacccagagcgagcggggctgccccctgccccgggccccccggggcagaagaagacccaacccccccaggaagcctgtgcggccccggggccctggccggccccgggacaagggcgtgcctgtgtag

SEQ ID NO: 164793 - DNA, 1368 bp, Artificial Sequence
  Description of Artificial Sequence: Synthetic coding sequence
gtgcacgcctctgtgcacaccagggtgcggggcctgtgggtgccctggagaggaagacatgcccacggcggccggggctgccggggcgtgtgtggagaatgtcgctgggtgaccacagccccccaggagcccccagcccggcccctgcaggccggcagcggggccggccctgcccctggccgggccatgaggagcaccaccctgctggccctgctggccctggtgctgctgtacctggtgtctggggccctggtgttccgggccctggagcagccccatgagcagcaggcccagcgggagctgggggaggtgcgggagaagttcctgcgggcccacccctgtgtgtctgaccaggagctgggcctgctgatcaaggaggtggctgatgccctgggcggcggcgctgaccctgagaccaacagcaccagcaacagcagccacagcgcctgggacctgggcagcgccttcttcttcagcggcaccatcatcaccaccatcggctatggaaatgtggccctgaggacagatgctggccgcctcttctgcatcttctacgccctggtgggcatccccctgtttggcatcctgctggccggcgtgggggaccggctgggcagcagcctgcggcacggcatcggccacatcgaggccatcttcctgaagtggcacgtgcccccagagctggtgcgggtgctgagcgccatgctgttcctgctgattggctgcctgctgtttgtgctgacccccacctttgtgttctgctacatggaggactggagcaagctggaggccatctactttgtgattgtgaccctgaccaccgtgggctttggagactatgtggccggggctgacccccggcaggacagccctgcctaccagcccctggtgtggttctggatcctgctgggcctggcctactttgcctctgtgctgaccaccatcggcaactggctgcgggtggtgtccaggaggaccagggctgagatgggcggcctgacagcccaggccgcctcctggacaggaacagtgacagcccgggtgacccagagagctggccctgctgcccctcctcctgagaaggagcagcccctgctgcccccaccaccctgcccagcccagcccctgggccggcccaggagccccagccccccagagaaggcccagccccccagccccccaacagccagcgccctggactaccccagcgagaacctggccttcattgatgagagcagtgacacccagagcgagcggggctgccccctgccccgggccccccggggcagaagaagacccaacccccccaggaagcctgtgcggccccggggccctggccggccccgggacaagggcgtgcctgtgtag

SEQ ID NO: 164794 - DNA, 1500 bp, Artificial Sequence
  Description of Artificial Sequence: Synthetic coding sequence
atggtggaccggggccccctgctgaccagcgccatcatcttctacctggccatcggggccgccatctttgaggtgctggaggagccccactggaaggaggccaagaagaactactacacccagaagctgcacctgctgaaggagttcccctgcctgggccaggagggcctggacaagatcctggaggtggtgtctgatgctgctggccagggcgtggccatcactggaaaccagaccttcaacaactggaactggcccaatgccatgatctttgctgccaccgtcatcaccaccatcggctatggaaatgtggcccccaagaccccagctggccgcctcttctgtgtgttctacggcctgtttggagtgcccctgtgcctgacctggatcagcgccctgggcaagttctttggaggccgggccaagaggctgggccagttcctgaccaagaggggcgtgtccctgaggaaggcccagatcacctgcaccgtcatcttcatcgtgtggggcgtgctggtgcacctggtgatccccccatttgtgttcatggtgacagagggctggaactacatcgagggcctgtactacagcttcatcaccatcagcaccatcggctttggagactttgtggccggcgtgaaccccagcgccaactaccacgccctgtaccgctactttgtggagctgtggatctacctgggcctggcctggctgagcctgtttgtgaactggaaggtgtccatgtttgtggaggtgcacaaggccatcaagaagagaagaagaagaaggaaggagagctttgagagcagcccccacagcaggaaggccctgcaggtgaagggcagcacagccagcaaggatgtgaacatcttctccttcctgagcaagaaggaggagacctacaatgacctgatcaagcagatcggcaagaaggccatgaagaccagcggcggcggggagactggacctggccctggcctgggcccccagggcggcggcctgcctgccctgccccccagcctggtgcccctggtggtgtacagcaagaacagagtgcccaccctggaggaggtgtcccagaccctgcggagcaaaggacatgtgagccgcagcccagatgaggaggccgtggcccgggcccctgaggacagcagccctgcccctgaggtgttcatgaaccagctggaccgcatcagtgaagaatgtgagccctgggatgcccaggactaccaccccctcatcttccaggatgccagcatcacctttgtgaacacagaagctggcctgagtgatgaggagaccagcaagagcagcctggaggacaacctggccggggaggagagcccccagcagggcgctgaggccaaggcccccctgaacatgggagagttccccagcagcagcgagagcaccttcaccagcacagaaagtgagctgtctgtgccctatgagcagctgatgaatgagtacaacaaggccaacagccccaagggcacctag

SEQ ID NO: 164795 - DNA, 942 bp, Artificial Sequence
  Description of Artificial Sequence: Synthetic coding sequence
atgagaagaggagccctgctggccggggccctggccgcctatgctgcctacctggtgctgggcgccctgctggtggcccggctggagggcccccatgaggcccggctgcgggcagagctggagaccctgcgggcccagctgctgcagaggagcccctgtgtggccgccccagccctggatgcctttgtggagcgggtgctggccgccggccgcctgggccgggtggtgctggccaatgccagcggcagcgccaatgccagtgaccctgcctgggactttgccagcgccctcttctttgccagcaccctcatcaccaccgtgggctacggctacaccacccccctgacagatgctgggaaggccttcagcatcgcctttgccctgctgggcgtgcccaccaccatgctgctgctgacagccagcgcccagaggctgagcctgctgctgacccacgtgcccctgtcctggctgtccatgcgctggggctgggacccccggcgggccgcctgctggcacctggtggccctgctgggcgtggtggtgacagtgtgcttcctggtgcctgctgtgatctttgcccacctggaggaggcctggagcttcctggatgccttctacttctgcttcatcagcctgagcaccatcggcctgggggactatgtgcctggagaggcccctggccagccctaccgggccctgtacaaggtgctggtgacagtgtacctgttcctgggcctggtggccatggtgctggtgctgcagaccttccgccacgtgtctgacctgcacggcctgacagagctgatcctgctgcccccaccctgcccagccagcttcaatgctgatgaagatgacagagtggacatcctgggcccccagcctgagagccaccagcagctgagcgccagcagccacacagattatgccagcatccccaggtag

SEQ ID NO: 164796 - DNA, 924 bp, Artificial Sequence
  Description of Artificial Sequence: Synthetic coding sequence
atgggcggcctgcggccctggagccgctatggcctgctggtggtggcccacctgctggccctgggcctgggcgctgtggtgttccaggccctggagggccccccagcctgccgcctgcaggccgagctgcgggcagagctggccgccttccaggccgagcaccgggcctgcctgcccccaggggccctggaggagctgctgggcacagccctggccacccaggcccacggcgtgtccaccctgggcaacagcagcgagggccgcacctgggacctgcccagcgccctgctgtttgctgccagcatcctgaccaccaccggctacggccacatggcccccctgagccctgggggcaaggccttctgcatggtgtatgctgccctgggcctgcctgccagcctggccctggtggccaccctgcggcactgcctgctgcctgtgctgagccggccccgggcctgggtggccgtgcactggcagctgagccctgcccgggccgccctgctgcaggccgtggccctgggcctgctggtggccagcagctttgtgctgctgcctgccctggtgctgtggggcctgcagggcgactgcagcctgctgggcgctgtgtacttctgcttcagcagcctgagcaccatcggcctggaggacctgctgcccggccggggccgcagcctgcaccctgtgatctaccacctgggccagctggccctgctgggctacctgctgctgggcctgctggccatgctgctggccgtggagaccttcagcgagctgccccaggtgcgggccatgggcaagttcttccggcccagcggccctgtgacagctgaggaccagggcggcatcctgggccaggatgagctggccctgagcaccctgcccccagctgccccagccagcggccaggccccagcctgctag

SEQ ID NO: 164797 - DNA, 759 bp, Artificial Sequence
  Description of Artificial Sequence: Synthetic coding sequence
atgggcggcctgcggccctggagccgctatggcctgctggtggtggcccacctgctggccctgggcctgggcgctgtggtgttccaggccctggagggccccccagcctgccgcctgcaggccgagctgcgggcagagctggccgccttccaggccgagcaccgggcctgcctgcccccaggggccctggaggagctgctgggcacagccctggccacccaggcccacggcgtgtccaccctgggcaacagcagcgagggccgcacctgggacctgcccagcgccctgctgtttgctgccagcatcctgaccaccaccggctacggccacatggcccccctgagccctgggggcaaggccttctgcatggtgtatgctgccctgggcctgcctgccagcctggccctggtggccaccctgcggcactgcctgctgcctgtgctgagccggccccgggcctgggtggccgtgcactggcagctgagccctgcccgggccgccctgctgcaggccgtggccctgggcctgctggtggccagcagctttgtgctgctgcctgccctggtgctgtggggcctgcagggcgactgcagcctgctgggcgctgtgtacttctgcttcagcagcctgagcaccatcggcctggaggacctgctgcccggccggggccgcagcctgcaccctgtgatctaccacctgggccagctggccctgctgggcggcggcaccagcctgcagggcacagcctgggagggctag

SEQ ID NO: 164798 - DNA, 774 bp, Artificial Sequence
  Description of Artificial Sequence: Synthetic coding sequence
atgggcggcctgcggccctggagccgctatggcctgctggtggtggcccacctgctggccctgggcctgggcgctgtggtgttccaggccctggagggccccccagcctgccgcctgcaggccgagctgcgggcagagctggccgccttccaggccgagcaccgggcctgcctgcccccaggggccctggaggagctgctgggcacagccctggccacccaggcccacggcgtgtccaccctgggcaacagcagcgagggccgcacctgggacctgcccagcgccctgctgtttgctgccagcatcctgaccaccaccggctacggccacatggcccccctgagccctgggggcaaggccttctgcatggtgtatgctgccctgggcctgcctgccagcctggccctggtggccaccctgcggcactgcctgctgcctgtgctgagccggccccgggcctgggtggccgtgcactggcagctgagccctgcccgggccgccctgctgcaggccgtggccctgggcctgctggtggccagcagctttgtgctgctgcctgccctggtgctgtggggcctgcagggcgactgcagcctgctgggcgctgtgtacttctgcttcagcagcctgagcaccatcggcctggaggacctgctgcccggccggggccgcagcctgcaccctgtgatctaccacctgggccagctggccctgctgggcaagagcagccacctgacagcctgtggcggccggggcaagaggagcctggactag

SEQ ID NO: 164799 - DNA, 759 bp, Artificial Sequence; identical to SEQ ID NO: 164797
  Description of Artificial Sequence: Synthetic coding sequence

SEQ ID NO: 164800 - DNA, 87 bp, Artificial Sequence
  Description of Artificial Sequence: Synthetic coding sequence
tgactgcaccctgtgatctaccacctgggccagctggccctgctgggcggcggcaccagcctgcagggcacagcctgggagggctag

SEQ ID NO: 164801 - DNA, 1125 bp, Artificial Sequence
  Description of Artificial Sequence: Synthetic coding sequence
atgaagaggcagaatgtgaggaccctgagcctcatcgtgtgcaccttcacctacctgctggtgggcgctgctgtgtttgatgccctggagagtgaccacgagatgagggaggaggagaagctgaaggccgaggagatccgcatcaagggcaagtacaacatcagcagcgaggactaccggcagctggagctggtgatcctgcagagcgagccccaccgggccggcgtgcagtggaagtttgctggcagcttctactttgccatcaccgtcatcaccaccatcggctacggccatgctgcccctggaacagatgctgggaaggccttctgcatgttttatgctgtgctgggcatccccctgaccctggtgatgttccagagcctgggggagaggatgaacacctttgtgcgctacctgctgaagaggatcaagaagtgctgcggcatgaggaacacagatgtgtccatggagaacatggtgacagtgggcttcttcagctgcatgggcaccctgtgcattggagctgctgccttcagccagtgtgaggagtggagcttcttccacgcctactactactgcttcatcaccctgaccaccatcggctttggagactatgtggccctgcagaccaagggggccctgcagaagaagcccctgtatgtggccttctccttcatgtacatcctggtgggcctgactgtgattggagccttcctgaacctggtggtgctgcgcttcctgaccatgaacagtgaagatgaaagaagagatgctgaggagcgggccagcctggccggcaacagaaacagcatggtgatccacatccctgaggagccccggcccagccggccccgctacaaggcagatgtgcctgacctgcagagcgtgtgcagctgcacctgctaccgcagccaggactatggaggccgctctgtggccccccagaacagcttcagcgccaagctggccccccactacttccacagcatctcctacaagattgaggagatcagccccagcaccctgaagaacagcctcttccccagccccatcagcagcatcagccctggcctgcacagcttcacagaccaccagaggctgatgaagaggaggaagtctgtgtag

SEQ ID NO: 164802 - DNA, 1125 bp, Artificial Sequence; identical to SEQ ID NO: 164801
  Description of Artificial Sequence: Synthetic coding sequence

SEQ ID NO: 164803 - DNA, 1125 bp, Artificial Sequence; identical to SEQ ID NO: 164801
  Description of Artificial Sequence: Synthetic coding sequence

SEQ ID NO: 164804 - DNA, 3693 bp, Artificial Sequence
  Description of Artificial Sequence: Synthetic coding sequence
atggcccgggccaagctgcccaggagccccagcgagggcaaggccggccctggaggagccccagctggagctgctgcccctgaggagccccacggcctgagccccctgctgcctgcccggggcggcggctctgtgggcagtgatgtgggccagaggctgcctgtggaggacttcagcctggacagcagcctgagccaggtgcaggtggagttctacgtgaatgaaaacaccttcaaggagcggctgaagctgttcttcatcaagaaccagaggagcagcctgcgcatccgcctcttcaacttcagcctgaagctgctgacctgcctgctgtacatcgtgcgggtgctgctggatgatcctgccctgggcatcggctgctggggctgccccaagcagaactacagcttcaatgacagcagcagcgagatcaactgggcccccatcctgtgggtggagaggaagatgaccctgtgggccatccaggtgattgtggccatcatctccttcctggagaccatgctgctgatctacctgagctacaagggcaacatctgggagcagatcttccgggtgtcctttgtgctggagatgatcaacaccctgcccttcatcatcaccatcttctggccacccctgaggaacctcttcatccctgtgttcctgaactgctggctggccaagcacgccctggagaacatgatcaatgacttccaccgggccatcctgcggacccagagcgccatgttcaaccaggtgctgatcctcttctgcaccctgctgtgcctggtgttcaccggcacctgtggcatccagcacctggagcgggccggggagaacctgagcctgctgaccagcttctacttctgcatcgtgaccttcagcacagtgggctatggagatgtgacccccaagatctggcccagccagctgctggtggtgatcatgatctgtgtggccctggtggtgctgcccctgcagtttgaggagctggtgtacctgtggatggagcggcagaagagcggcggcaactacagccgccaccgggcccagacagagaagcacgtggtgctgtgtgtgagcagcctgaagattgacctgctgatggacttcctgaatgagttctacgcccacccccggctgcaggactactacgtggtgatcctgtgccccacagagatggatgtgcaggtgcggcgggtgctgcagatccccctgtggagccagagggtcatctacctgcagggcagcgccctgaaggaccaggacctgatgagggccaagatggacaacggggaggcctgcttcatcctgagcagcagaaatgaggtggacagaacagctgctgaccaccagaccatcctgcgggcctgggccgtgaaggactttgcccccaactgccccctgtatgtgcagatcctgaagccagagaacaagttccacgtgaagtttgctgaccacgtggtgtgtgaggaggagtgcaagtatgccatgctggccctgaactgcatctgcccagccaccagcaccctcatcaccctgctggtgcacaccagccggggccaggagggccaggagagccctgagcagtggcagaggatgtatggccgctgcagcggaaatgaggtgtaccacatccgcatgggagacagcaagttcttccgggagtatgagggcaagagcttcacctacgccgccttccacgcccacaagaagtatggagtgtgcctgattggcctgaagcgggaggacaacaagagcatcctgctgaaccctggccccaggcacatcctggccgccagtgacacctgcttctacatcaacatcaccaaggaggagaacagcgccttcatcttcaagcaggaggagaagaggaagaagagggccttcagcggccagggcctgcacgagggccctgcccggctgcctgtgcacagcatcatcgcctccatgggcaccgtggccatggacctgcagggcacagagcaccggcccacccagagcggcggcggcggcggcggcagcaagctggccctgcccacagaaaatggcagcggcagcagaagacccagcatcgcccctgtgctggagctggccgacagcagcgccctgctgccctgtgacctgctgagtgaccagagtgaagatgaggtgacccccagtgatgatgagggcctgtctgtggtggagtatgtgaagggctacccacccaacagcccctacatcggcagcagccccaccctgtgccacctgctgcctgtgaaggcccccttctgctgcctgcggctggacaagggctgcaagcacaacagctatgaagatgccaaggcctacggcttcaagaacaagctgatcatcgtgtctgctgagacagctggaaatggcctgtacaacttcatcgtgcccctgcgggcctactaccgcagcaggaaggagctgaaccccatcgtgctgctgctggacaacaagccagaccaccacttcctggaggccatctgctgcttccccatggtgtactacatggagggctctgtggacaacctggacagcctgctgcagtgtggcatcatctatgctgacaacctggtggtggtggacaaggagagcaccatgtctgctgaggaggactacatggctgatgccaagaccatcgtgaatgtgcagaccatgttccgcctcttccccagcctgagcatcaccacagagctgacccaccccagcaacatgaggttcatgcagttccgggccaaggacagctacagcctggccctgagcaagctggagaagcgggagcgggagaatggcagcaacctggccttcatgttccggctgccctttgctgctggccgggtcttcagcatctccatgctggacaccctgctgtaccagagctttgtgaaggactacatgatcaccatcacccggctgctgctgggcctggacaccaccccaggcagcggctacctgtgtgccatgaagatcacagaaggagacctgtggatccgcacctacggccgcctcttccagaagctgtgcagcagcagcgctgagatccccatcggcatctacagaacagagagccacgtgttcagcaccagcgagagccagatctctgtgaatgtggaggactgtgaggacacccgggaggtgaagggcccctggggcagcagagctggcactggaggcagcagccagggccgccacactggaggaggagaccctgctgagcaccccctgctgcggaggaagagcctgcagtgggcccggcggctgagcaggaaggcccccaagcaggccggccgggctgctgctgctgagtggatcagccagcagaggctgagcctgtaccgccgctctgagcggcaggagctgtctgagctggtgaagaacaggatgaagcacctgggcctgcccaccaccggctatgaagatgtggccaacctgacagccagtgatgtgatgaacagagtgaacctgggctacctgcaggatgagatgaatgaccaccagaacaccctgtcctatgtgctgatcaaccccccaccagacacccggctggagcccagcgacatcgtgtacctgatccgcagtgaccccctggcccacgtggccagcagcagccagagcaggaagagcagctgcagccacaagctgagcagctgcaaccctgagaccagagatgagacccagctgtag

SEQ ID NO: 164805 - DNA, 3771 bp, Artificial Sequence
  Description of Artificial Sequence: Synthetic coding sequence
atgcccctgcctgatggagcccggacccctgggggcgtgtgccgggaggcccggggcggcggctacaccaacagaacatttgaatttgatgatggccagtgtgccccccggcggccctgtgctggagatggagccctgctggacacagctggcttcaagatgtctgacctggacagcgaggtgctgcccctgcccccacgctaccgcttccgggacctgctgctgggggaccccagcttccagaatgatgacagagtgcaggtggagttctacgtgaatgaaaacaccttcaaggagcggctgaagctgttcttcatcaagaaccagaggagcagcctgcgcatccgcctcttcaacttcagcctgaagctgctgacctgcctgctgtacatcgtgcgggtgctgctggatgatcctgccctgggcatcggctgctggggctgccccaagcagaactacagcttcaatgacagcagcagcgagatcaactgggcccccatcctgtgggtggagaggaagatgaccctgtgggccatccaggtgattgtggccatcatctccttcctggagaccatgctgctgatctacctgagctacaagggcaacatctgggagcagatcttccgggtgtcctttgtgctggagatgatcaacaccctgcccttcatcatcaccatcttctggccacccctgaggaacctcttcatccctgtgttcctgaactgctggctggccaagcacgccctggagaacatgatcaatgacttccaccgggccatcctgcggacccagagcgccatgttcaaccaggtgctgatcctcttctgcaccctgctgtgcctggtgttcaccggcacctgtggcatccagcacctggagagagctggggagaacctgagcctgctgaccagcttctacttctgcatcgtgaccttcagcacagtgggctatggagatgtgacccccaagatctggcccagccagctgctggtggtgatcatgatctgtgtggccctggtggtgctgcccctgcagtttgaggagctggtgtacctgtggatggagcggcagaagagcggcggcaactacagccgccaccgggcccagacagagaagcacgtggtgctgtgtgtgagcagcctgaagattgacctgctgatggacttcctgaatgagttctacgcccacccccggctgcaggactactacgtggtgatcctgtgccccacagagatggatgtgcaggtgagaagagtgctgcagatccccctgtggagccagagggtcatctacctgcagggcagcgccctgaaggaccaggacctgatgagggccaagatggacaatggagaggcctgcttcatcctgagcagcagaaatgaggtggacagaacagctgctgaccaccagaccatcctgcgggcctgggccgtgaaggactttgcccccaactgccccctgtatgtgcagatcctgaagccagagaacaagttccacgtgaagtttgctgaccacgtggtgtgtgaggaggagtgcaagtatgccatgctggccctgaactgcatctgcccagccaccagcaccctcatcaccctgctggtgcacaccagccggggccaggagggccaggagagccctgagcagtggcagaggatgtatggccgctgcagcggaaatgaggtgtaccacatccgcatgggagacagcaagttcttccgggagtatgagggcaagagcttcacctatgctgccttccacgcccacaagaagtatggagtgtgcctgattggcctgaagcgggaggacaacaagagcatcctgctgaaccctggccccaggcacatcctggccgccagtgacacctgcttctacatcaacatcaccaaggaggagaacagcgccttcatcttcaagcaggaggagaagaggaagaagagggccttcagcggccagggcctgcacgagggccctgcccggctgcctgtgcacagcatcatcgcctccatgggcaccgtggccatggacctgcagggcacagagcaccggcccacccagagcggcggcggcggcggcggcagcaagctggccctgcccacagaaaatggaagtggcagccggcggcccagcatcgcccctgtgctggagctggccgacagcagcgccctgctgccctgtgacctgctgagtgaccagagtgaagatgaggtgacccccagtgatgatgagggcctgtctgtggtggagtatgtgaagggctacccacccaacagcccctacatcggcagcagccccaccctgtgccacctgctgcctgtgaaggcccccttctgctgcctgcggctggacaagggctgcaagcacaacagctatgaagatgccaaggcctacggcttcaagaacaagctgatcatcgtgtctgctgagacagctggaaatggcctgtacaacttcatcgtgcccctgcgggcctactaccgcagcaggaaggagctgaaccccatcgtgctgctgctggacaacaagccagaccaccacttcctggaggccatctgctgcttccccatggtgtactacatggagggctctgtggacaacctggacagcctgctgcagtgtggcatcatctatgctgacaacctggtggtggtggacaaggagagcaccatgtctgctgaggaggactacatggctgatgccaagaccatcgtgaatgtgcagaccatgttccgcctcttccccagcctgagcatcaccacagagctgacccaccccagcaacatgaggttcatgcagttccgggccaaggacagctacagcctggccctgagcaagctggagaagcgggagagagaaaatggcagcaacctggccttcatgttccggctgccctttgctgctggccgggtcttcagcatctccatgctggacaccctgctgtaccagagctttgtgaaggactacatgatcaccatcacccggctgctgctgggcctggacaccaccccaggcagcggctacctgtgtgccatgaagatcacagaaggagacctgtggatccgcacctacggccgcctcttccagaagctgtgcagcagcagcgctgagatccccatcggcatctacagaacagagagccacgtgttcagcaccagcgagccccatgacctgcgggcccagagccagatctctgtgaatgtggaggactgtgaggacacccgggaggtgaagggcccctggggcagcagagctggcactggaggcagcagccagggccgccacactggaggaggagaccctgctgagcaccccctgctgcggaggaagagcctgcagtgggcccggcggctgagcaggaaggcccccaagcaggccggccgggctgctgctgctgagtggatcagccagcagaggctgagcctgtaccgccgctctgagcggcaggagctgtctgagctggtgaagaacaggatgaagcacctgggcctgcccaccaccggctatgaagatgtggccaacctgacagccagtgatgtgatgaacagagtgaacctgggctacctgcaggatgagatgaatgaccaccagaacaccctgtcctatgtgctgatcaaccccccaccagacacccggctggagcccagcgacatcgtgtacctgatccgcagtgaccccctggcccacgtggccagcagcagccagagcaggaagagcagctgcagccacaagctgagcagctgcaaccctgagaccagagatgagacccagctgtag

SEQ ID NO: 164806 - DNA, 3708 bp, Artificial Sequence
  Description of Artificial Sequence: Synthetic coding sequence
atgcccctgcctgatggagcccggacccctgggggcgtgtgccgggaggcccggggcggcggctacaccaacagaacatttgaatttgatgatggccagtgtgccccccggcggccctgtgctggagatggagccctgctggacacagctggcttcaagatgtctgacctggacagcgaggtgctgcccctgcccccacgctaccgcttccgggacctgctgctgggggaccccagcttccagaatgatgacagagtgcaggtggagttctacgtgaatgaaaacaccttcaaggagcggctgaagctgttcttcatcaagaaccagaggagcagcctgcgcatccgcctcttcaacttcagcctgaagctgctgacctgcctgctgtacatcgtgcgggtgctgctggatgatcctgccctgggcatcggctgctggggctgccccaagcagaactacagcttcaatgacagcagcagcgagatcaactgggcccccatcctgtgggtggagaggaagatgaccctgtgggccatccaggtgattgtggccatcatctccttcctggagaccatgctgctgatctacctgagctacaagggcaacatctgggagcagatcttccgggtgtcctttgtgctggagatgatcaacaccctgcccttcatcatcaccatcttctggccacccctgaggaacctcttcatccctgtgttcctgaactgctggctggccaagcacgccctggagaacatgatcaatgacttccaccgggccatcctgcggacccagagcgccatgttcaaccaggtgctgatcctcttctgcaccctgctgtgcctggtgttcaccggcacctgtggcatccagcacctggagagagctggggagaacctgagcctgctgaccagcttctacttctgcatcgtgaccttcagcacagtgggctatggagatgtgacccccaagatctggcccagccagctgctggtggtgatcatgatctgtgtggccctggtggtgctgcccctgcagtttgaggagctggtgtacctgtggatggagcggcagaagagcggcggcaactacagccgccaccgggcccagacagagaagcacgtggtgctgtgtgtgagcagcctgaagattgacctgctgatggacttcctgaatgagttctacgcccacccccggctgcaggactactacgtggtgatcctgtgccccacagagatggatgtgcaggtgagaagagtgctgcagatccccctgtggagccagagggtcatctacctgcagggcagcgccctgaaggaccaggacctgatgagggccaagatggacaatggagaggcctgcttcatcctgagcagcagaaatgaggtggacagaacagctgctgaccaccagaccatcctgcgggcctgggccgtgaaggactttgcccccaactgccccctgtatgtgcagatcctgaagccagagaacaagttccacgtgaagtttgctgaccacgtggtgtgtgaggaggagtgcaagtatgccatgctggccctgaactgcatctgcccagccaccagcaccctcatcaccctgctggtgcacaccagccggggccaggagggccaggagagccctgagcagtggcagaggatgtatggccgctgcagcggaaatgaggtgtaccacatccgcatgggagacagcaagttcttccgggagtatgagggcaagagcttcacctatgctgccttccacgcccacaagaagtatggagtgtgcctgattggcctgaagcgggaggacaacaagagcatcctgctgaaccctggccccaggcacatcctggccgccagtgacacctgcttctacatcaacatcaccaaggaggagaacagcgccttcatcttcaagcaggaggagaagaggaagaagagggccttcagcggccagggcctgcacgagggccctgcccggctgcctgtgcacagcatcatcgcctccatgggcaccgtggccatggacctgcagggcacagagcaccggcccacccagagcggcggcggcggcggcggcagcaagctggccctgcccacagaaaatggaagtggcagccggcggcccagcatcgcccctgtgctggagctggccgacagcagcgccctgctgccctgtgacctgctgagtgaccagagtgaagatgaggtgacccccagtgatgatgagggcctgtctgtggtggagtatgtgaagggctacccacccaacagcccctacatcggcagcagccccaccctgtgccacctgctgcctgtgaaggcccccttctgctgcctgcggctggacaagggctgcaagcacaacagctatgaagatgccaaggcctacggcttcaagaacaagctgatcatcgtgtctgctgagacagctggaaatggcctgtacaacttcatcgtgcccctgcgggcctactaccgcagcaggaaggagctgaaccccatcgtgctgctgctggacaacaagccagaccaccacttcctggaggccatctgctgcttccccatggtgtactacatggagggctctgtggacaacctggacagcctgctgcagtgtggcatcatctatgctgacaacctggtggtggtggacaaggagagcaccatgtctgctgaggaggactacatggctgatgccaagaccatcgtgaatgtgcagaccatgttccgcctcttccccagcctgagcatcaccacagagctgacccaccccagcaacatgaggttcatgcagttccgggccaaggacagctacagcctggccctgagcaagctggagaagcgggagagagaaaatggcagcaacctggccttcatgttccggctgccctttgctgctggccgggtcttcagcatctccatgctggacaccctgctgtaccagagctttgtgaaggactacatgatcaccatcacccggctgctgctgggcctggacaccaccccaggcagcggctacctgtgtgccatgaagatcacagaaggagacctgtggatccgcacctacggccgcctcttccagaagctgtgcagcagcagcgctgagatccccatcggcatctacagaacagagagccacgtgttcagcaccagcgagccccatgacctgcgggcccagagccagatctctgtgaatgtggaggactgtgaggacacccgggaggtgaagggcccctggggcagcagagctggcactggaggcagcagccagggccgccacactggaggaggagaccctgctgagcaccccctgctgcggaggaagagcctgcagtgggcccggcggctgagcaggaaggcccccaagcaggccggccgggctgctgctgctgagtggatcagccagcagaggctgagcctgtaccgccgctctgagcggcaggagctgtctgagctggtgaagaacaggatgaagcacctgggcctgcccaccaccggctatgatgagatgaatgaccaccagaacaccctgtcctatgtgctgatcaaccccccaccagacacccggctggagcccagcgacatcgtgtacctgatccgcagtgaccccctggcccacgtggccagcagcagccagagcaggaagagcagctgcagccacaagctgagcagctgcaaccctgagaccagagatgagacccagctgtag

SEQ ID NO: 164807 - DNA, 3408 bp, Artificial Sequence
  Description of Artificial Sequence: Synthetic coding sequence
atggtggacctggagagcgaggtgccccccctgcccccacgctaccgcttccgggacctgctgctgggggaccagggctggcagaatgatgacagagtgcaggtggagttctacatgaatgaaaacaccttcaaggagcggctgaagctgttcttcatcaagaaccagaggagcagcctgcgcatccgcctcttcaacttcagcctgaagctgctgagctgcctgctgtacatcatccgggtgctgctggagaaccccagccagggcaatgagtggagccacatcttctgggtgaacagaagcctgcccctgtggggcctgcaggtgtctgtggccctgatcagcctgtttgagaccatcctgctgggctacctgagctacaagggcaacatctgggagcagatcctgcgcatccccttcatcctggagatcatcaatgctgtgcccttcatcatcagcatcttctggcccagcctgaggaacctgtttgtgcctgtgttcctgaactgctggctggccaagcacgccctggagaacatgatcaatgacctgcaccgggccatccagaggacccagagcgccatgttcaaccaggtgctgatcctgatcagcaccctgctgtgcctgatcttcacctgcatctgtggcatccagcacctggagagaattggcaagaagctgaacctgtttgacagcctgtacttctgcatcgtgaccttcagcacagtgggctttggagatgtgaccccagagacctggagcagcaagctgtttgtggtggccatgatctgtgtggccctggtggtgctgcccatccagtttgagcagctggcctacctgtggatggagcggcagaagagcggcggcaactacagccgccaccgggcccagacagagaagcacgtggtgctgtgtgtgagcagcctgaagattgacctgctgatggacttcctgaatgagttctacgcccacccccggctgcaggactactacgtggtgatcctgtgccccacagagatggatgtgcaggtgagaagagtgctgcagatccccatgtggagccagagggtcatctacctgcagggcagcgccctgaaggaccaggacctgctgcgggccaagatggatgatgctgaggcctgcttcatcctgagcagccgctgtgaggtggacaggaccagcagtgaccaccagaccatcctgcgggcctgggccgtgaaggactttgcccccaactgccccctgtatgtgcagatcctgaagccagagaacaagttccacatcaagtttgctgaccacgtggtgtgtgaggaggagttcaagtatgccatgctggccctgaactgcatctgcccagccaccagcaccctcatcaccctgctggtgcacaccagccggggccaggagggccagcagagccctgagcagtggcagaagatgtatggccgctgcagcggaaatgaggtgtaccacatcgtgctggaggagagcaccttctttgctgaatatgagggcaagagcttcacctacgccagcttccacgcccacaagaagtttggagtgtgcctgattggagtgagaagagaggacaacaagaacatcctgctgaaccctggcccccgctacatcatgaacagcacagacatctgcttctacatcaacatcaccaaggaggagaacagcgccttcaagaaccaggaccagcagaggaagagcaatgtgagccgctccttctaccacggccccagccggctgcctgtgcacagcatcatcgcctccatgggcaccgtggccatcgacctgcaggacaccagctgccgcagcgccagcggccccaccctgagcctgcccacagagggcagcaaggagatcagaagacccagcatcgcccctgtgctggaggtggccgacaccagcagcatccagacctgtgacctgctgagtgaccagagtgaagatgagaccaccccagatgaggagatgagcagcaacctggagtatgccaagggctacccaccctacagcccctacatcggcagcagccccaccttctgccacctgctgcacgagaaggtgcccttctgctgcctgcggctggacaagagctgccagcacaactactatgaagatgccaaggcctacggcttcaagaacaagctgatcatcgtggccgctgagacagctggaaatggcctgtacaacttcatcgtgcccctgcgggcctactaccggcccaagaaggagctgaaccccatcgtgctgctgctggacaaccccccagacatgcacttcctggatgccatctgctggttccccatggtgtactacatggtgggcagcattgacaacctggatgacctgctgcgctgtggggtgacctttgctgccaacatggtggtggtggacaaggagagcaccatgtctgctgaggaggactacatggctgatgccaagaccatcgtgaatgtgcagaccctcttccgcctcttcagcagcctgagcatcatcacagagctgacccacccagccaacatgaggttcatgcagttccgggccaaggactgctacagcctggccctgagcaagctggagaagaaggagcgggagcggggcagcaacctggccttcatgttccggctgccctttgctgctggccgggtcttcagcatctccatgctggacaccctgctgtaccagagctttgtgaaggactacatgatcagcatcacccggctgctgctgggcctggacaccaccccaggcagcggcttcctgtgcagcatgaagatcacagcagatgacctgtggatccgcacctacgcccggctgtaccagaagctgtgcagcagcactggagatgtgcccatcggcatctacagaacagagagccagaagctgaccaccagcgagagccagatcagcatctctgtggaggagtgggaggacaccaaggacagcaaggagcagggccaccacaggagcaaccacaggaacagcaccagcagtgaccagagcgaccaccccctgctgcggaggaagtccatgcagtgggcccggcggctgagcaggaagggccccaagcacagcggcaagacagctgagaagatcacccagcagaggctgaacctgtacagaagaagtgagcggcaggagctggccgagctggtgaagaacaggatgaagcacctgggcctgagcacagtgggctatgatgagatgaatgaccaccagagcaccctgagctacatcctgatcaaccccagcccagacaccagaattgagctgaatgatgtggtgtacctgatccggccagaccccctggcctacctgcccaacagcgagcccagcagaagaaacagcatctgcaatgtgacaggccaggacagccgggaggagacccagctgtag

SEQ ID NO: 164808 - DNA, 3210 bp, Artificial Sequence
  Description of Artificial Sequence: Synthetic coding sequence
atggtggacctggagagcgaggtgccccccctgcccccacgctaccgcttccgggacctgctgctgggggaccagggctggcagaatgatgacagagtgcaggtggagttctacatgaatgaaaacaccttcaaggagcggctgaagctgttcttcatcaagaaccagaggagcagcctgcgcatccgcctcttcaacttcagcctgaagctgctgagctgcctgctgtacatcatccgggtgctgctggagaaccccagccagggcaatgagtggagccacatcttctgggtgaacagaagcctgcccctgtggggcctgcaggtgtctgtggccctgatcagcctgtttgagaccatcctgctgggctacctgagctacaagggcaacatctgggagcagatcctgcgcatccccttcatcctggagatcatcaatgctgtgcccttcatcatcagcatcttctggcccagcctgaggaacctgtttgtgcctgtgttcctgaactgctggctggccaagcacgccctggagaacatgatcaatgacctgcaccgggccatccagaggacccagagcgccatgttcaaccaggtgctgatcctgatcagcaccctgctgtgcctgatcttcacctgcatctgtggcatccagcacctggagagaattggcaagaagctgaacctgtttgacagcctgtacttctgcatcgtgaccttcagcacagtgggctttggagatgtgaccccagagacctggagcagcaagctgtttgtggtggccatgatctgtgtggccctggtggtgctgcccatccagtttgagcagctggcctacctgtggatggagcggcagaagagcggcggcaactacagccgccaccgggcccagacagagaagcacgtggtgctgtgtgtgagcagcctgaagattgacctgctgatggacttcctgaatgagttctacgcccacccccggctgcaggactactacgtggtgatcctgtgccccacagagatggatgtgcaggtgagaagagtgctgcagatccccatgtggagccagagggtcatctacctgcagggcagcgccctgaaggaccaggacctgctgcgggccaagatggatgatgctgaggcctgcttcatcctgagcagccgctgtgaggtggacaggaccagcagtgaccaccagaccatcctgcgggcctgggccgtgaaggactttgcccccaactgccccctgtatgtgcagatcctgaagccagagaacaagttccacatcaagtttgctgaccacgtggtgtgtgaggaggagttcaagtatgccatgctggccctgaactgcatctgcccagccaccagcaccctcatcaccctgctggtgcacaccagccggggccagtttggagtgtgcctgattggagtgagaagagaggacaacaagaacatcctgctgaaccctggcccccgctacatcatgaacagcacagacatctgcttctacatcaacatcaccaaggaggagaacagcgccttcaagaaccaggaccagcagaggaagagcaatgtgagccgctccttctaccacggccccagccggctgcctgtgcacagcatcatcgcctccatgggcaccgtggccatcgacctgcaggacaccagctgccgcagcgccagcggccccaccctgagcctgcccacagagggcagcaaggagatcagaagacccagcatcgcccctgtgctggaggtggccgacaccagcagcatccagacctgtgacctgctgagtgaccagagtgaagatgagaccaccccagatgaggagatgagcagcaacctggagtatgccaagggctacccaccctacagcccctacatcggcagcagccccaccttctgccacctgctgcacgagaaggtgcccttctgctgcctgcggctggacaagagctgccagcacaactactatgaagatgccaaggcctacggcttcaagaacaagctgatcatcgtggccgctgagacagctggaaatggcctgtacaacttcatcgtgcccctgcgggcctactaccggcccaagaaggagctgaaccccatcgtgctgctgctggacaaccccctggatgacctgctgcgctgtggggtgacctttgctgccaacatggtggtggtggacaaggagagcaccatgtctgctgaggaggactacatggctgatgccaagaccatcgtgaatgtgcagaccctcttccgcctcttcagcagcctgagcatcatcacagagctgacccacccagccaacatgaggttcatgcagttccgggccaaggactgctacagcctggccctgagcaagctggagaagaaggagcgggagcggggcagcaacctggccttcatgttccggctgccctttgctgctggccgggtcttcagcatctccatgctggacaccctgctgtaccagagctttgtgaaggactacatgatcagcatcacccggctgctgctgggcctggacaccaccccaggcagcggcttcctgtgcagcatgaagatcacagcagatgacctgtggatccgcacctacgcccggctgtaccagaagctgtgcagcagcactggagatgtgcccatcggcatctacagaacagagagccagaagctgaccaccagcgaggagacctacatcctgatcttcctgagccagatcagcatctctgtggaggagtgggaggacaccaaggacagcaaggagcagggccaccacaggagcaaccacaggaacagcaccagcagtgaccagagcgaccaccccctgctgcggaggaagtccatgcagtgggcccggcggctgagcaggaagggccccaagcacagcggcaagacagctgagaagatcacccagcagaggctgaacctgtacagaagaagtgagcggcaggagctggccgagctggtgaagaacaggatgaagcacctgggcctgagcacagtgggctatgatgagatgaatgaccaccagagcaccctgagctacatcctgatcaaccccagcccagacaccagaattgagctgaatgatgtggtgtacctgatccggccagaccccctggcctacctgcccaacagcgagcccagcagaagaaacagcatctgcaatgtgacaggccaggacagccgggaggagacccagctgtag

SEQ ID NO: 164809 - DNA, 3336 bp, Artificial Sequence
  Description of Artificial Sequence: Synthetic coding sequence
atggtggacctggagagcgaggtgccccccctgcccccacgctaccgcttccgggacctgctgctgggggaccagggctggcagaatgatgacagagtgcaggtggagttctacatgaatgaaaacaccttcaaggagcggctgaagctgttcttcatcaagaaccagaggagcagcctgcgcatccgcctcttcaacttcagcctgaagctgctgagctgcctgctgtacatcatccgggtgctgctggagaaccccagccagggcaatgagtggagccacatcttctgggtgaacagaagcctgcccctgtggggcctgcaggtgtctgtggccctgatcagcctgtttgagaccatcctgctgggctacctgagctacaagggcaacatctgggagcagatcctgcgcatccccttcatcctggagatcatcaatgctgtgcccttcatcatcagcatcttctggcccagcctgaggaacctgtttgtgcctgtgttcctgaactgctggctggccaagcacgccctggagaacatgatcaatgacctgcaccgggccatccagaggacccagagcgccatgttcaaccaggtgctgatcctgatcagcaccctgctgtgcctgatcttcacctgcatctgtggcatccagcacctggagagaattggcaagaagctgaacctgtttgacagcctgtacttctgcatcgtgaccttcagcacagtgggctttggagatgtgaccccagagacctggagcagcaagctgtttgtggtggccatgatctgtgtggccctggtggtgctgcccatccagtttgagcagctggcctacctgtggatggagcggcagaagagcggcggcaactacagccgccaccgggcccagacagagaagcacgtggtgctgtgtgtgagcagcctgaagattgacctgctgatggacttcctgaatgagttctacgcccacccccggctgcaggactactacgtggtgatcctgtgccccacagagatggatgtgcaggtgagaagagtgctgcagatccccatgtggagccagagggtcatctacctgcagggcagcgccctgaaggaccaggacctgctgcgggccaagatggatgatgctgaggcctgcttcatcctgagcagccgctgtgaggtggacaggaccagcagtgaccaccagaccatcctgcgggcctgggccgtgaaggactttgcccccaactgccccctgtatgtgcagatcctgaagccagagaacaagttccacatcaagtttgctgaccacgtggtgtgtgaggaggagttcaagtatgccatgctggccctgaactgcatctgcccagccaccagcaccctcatcaccctgctggtgcacaccagccggggccaggagggccagcagagccctgagcagtggcagaagatgtatggccgctgcagcggaaatgaggtgtaccacatcgtgctggaggagagcaccttctttgctgaatatgagggcaagagcttcacctacgccagcttccacgcccacaagaagtttggagtgtgcctgattggagtgagaagagaggacaacaagaacatcctgctgaaccctggcccccgctacatcatgaacagcacagacatctgcttctacatcaacatcaccaaggaggagaacagcgccttcaagaaccaggaccagcagaggaagagcaatgtgagccgctccttctaccacggccccagccggctgcctgtgcacagcatcatcgcctccatgggcaccgtggccatcgacctgcaggacaccagctgccgcagcgccagcggccccaccctgagcctgcccacagagggcagcaaggagatcagaagacccagcatcgcccctgtgctggaggtggccgacaccagcagcatccagacctgtgacctgctgagtgaccagagtgaagatgagaccaccccagatgaggagatgagcagcaacctggagtatgccaagggctacccaccctacagcccctacatcggcagcagccccaccttctgccacctgctgcacgagaaggtgcccttctgctgcctgcggctggacaagagctgccagcacaactactatgaagatgccaaggcctacggcttcaagaacaagctgatcatcgtggccgctgagacagctggaaatggcctgtacaacttcatcgtgcccctgcgggcctactaccggcccaagaaggagctgaaccccatcgtgctgctgctggacaaccccctggatgacctgctgcgctgtggggtgacctttgctgccaacatggtggtggtggacaaggagagcaccatgtctgctgaggaggactacatggctgatgccaagaccatcgtgaatgtgcagaccctcttccgcctcttcagcagcctgagcatcatcacagagctgacccacccagccaacatgaggttcatgcagttccgggccaaggactgctacagcctggccctgagcaagctggagaagaaggagcgggagcggggcagcaacctggccttcatgttccggctgccctttgctgctggccgggtcttcagcatctccatgctggacaccctgctgtaccagagctttgtgaaggactacatgatcagcatcacccggctgctgctgggcctggacaccaccccaggcagcggcttcctgtgcagcatgaagatcacagcagatgacctgtggatccgcacctacgcccggctgtaccagaagctgtgcagcagcactggagatgtgcccatcggcatctacagaacagagagccagaagctgaccaccagcgagagccagatcagcatctctgtggaggagtgggaggacaccaaggacagcaaggagcagggccaccacaggagcaaccacaggaacagcaccagcagtgaccagagcgaccaccccctgctgcggaggaagtccatgcagtgggcccggcggctgagcaggaagggccccaagcacagcggcaagacagctgagaagatcacccagcagaggctgaacctgtacagaagaagtgagcggcaggagctggccgagctggtgaagaacaggatgaagcacctgggcctgagcacagtgggctatgatgagatgaatgaccaccagagcaccctgagctacatcctgatcaaccccagcccagacaccagaattgagctgaatgatgtggtgtacctgatccggccagaccccctggcctacctgcccaacagcgagcccagcagaagaaacagcatctgcaatgtgacaggccaggacagccgggaggagacccagctgtag

SEQ ID NO: 164810 - DNA, 1113 bp, Artificial Sequence
  Description of Artificial Sequence: Synthetic coding sequence
atgccctacctgcacctggaccaccagaccatcctgcgggcctgggccgtgaaggactttgcccccaactgccccctgtatgtgcagatcctgaagccagagaacaagttccacatcaagtttgctgaccacgtggtgtgtgaggaggagttcaagtatgccatgctggccctgaactgcatctgcccagccaccagcaccctcatcaccctgctggtgcacaccagccggggccaggagggccagcagagccctgagcagtggcagaagatgtatggccgctgcagcggaaatgaggtgtaccacatcgtgctggaggagagcaccttctttgctgaatatgagggcaagagcttcacctacgccagcttccacgcccacaagaagtttggagtgtgcctgattggagtgcggcgggaggacaacaagaacatcctgctgaaccctggcccccgctacatcatgaacagcacagacatctgcttctacatcaacatcaccaaggaggagaacagcgccttcaagaaccaggaccagcagaggaagagcaatgtgagccgctccttctaccacggccccagccggctgcctgtgcacagcatcatcgcctccatgggcaccgtggccatcgacctgcaggacaccagctgccgcagcgccagcggccccaccctgagcctgcccacagagggcagcaaggagatccggcggcccagcatcgcccctgtgctggaggtggccgacaccagcagcatccagacctgtgacctgctgagtgaccagagtgaagatgagaccaccccagatgaggagatgagcagcaacctggagtatgccaagggctacccaccctacagcccctacatcggcagcagccccaccttctgccacctgctgcacgagaaggtgcccttctgctgcctgcggctggacaagagctgccagcacaactactatgaagatgccaaggcctacggcttcaagaacaagctgatcatcgtggccgctgagacagctggaaatggcctgtacaacttcatcgtgcccctgcgggcctactaccggcccaagaaggagctgaaccccatcgtgctgctgctggacaacccctag

SEQ ID NO: 164811 - DNA, 1572 bp, Artificial Sequence
  Description of Artificial Sequence: Synthetic coding sequence
atcatcaatgacctgcaccgggccatccagaggacccagagcgccatgttcaaccaggtgctgatcctgatcagcaccctgctgtgcctgatcttcacctgcatctgtggcatccagcacctggagcgcatcggcaagaagctgaacctgtttgacagcctgtacttctgcatcgtgaccttcagcacagtgggctttggagatgtgaccccagagacctggagcagcaagctgtttgtggtggccatgatctgtgtggccctggtggtgctgcccatccagtttgagcagctggcctacctgtggatggagcggcagaagagcggcggcaactacagccgccaccgggcccagacagagaagcacgtggtgctgtgtgtgagcagcctgaagattgacctgctgatggacttcctgaatgagttctacgcccacccccggctgcaggactactacgtggtgatcctgtgccccacagagatggatgtgcaggtgcggcgggtgctgcagatccccatgtggagccagagggtcatctacctgcagggcagcgccctgaaggaccaggacctgctgcgggccaagatggatgatgctgaggcctgcttcatcctgagcagccgctgtgaggtggacaggaccagcagtgaccaccagaccatcctgcgggcctgggccgtgaaggactttgcccccaactgccccctgtatgtgcagatcctgaagccagagaacaagttccacatcaagtttgctgaccacgtggtgtgtgaggaggagttcaagtatgccatgctggccctgaactgcatctgcccagccaccagcaccctcatcaccctgctggtgcacaccagccggggccaggagggccagcagagccctgagcagtggcagaagatgtatggccgctgcagcggaaatgaggtgtaccacatcgtgctggaggagagcaccttctttgctgaatatgagggcaagagcttcacctacgccagcttccacgcccacaagaagtttggagtgtgcctgattggagtgcggcgggaggacaacaagaacatcctgctgaaccctggcccccgctacatcatgaacagcacagacatctgcttctacatcaacatcaccaaggaggagaacagcgccttcaagaaccaggaccagcagaggaagagcaatgtgagccgctccttctaccacggccccagccggctgcctgtgcacagcatcatcgcctccatgggcaccgtggccatcgacctgcaggacaccagctgccgcagcgccagcggccccaccctgagcctgcccacagagggcagcaaggagatccggcggcccagcatcgcccctgtgctggaggtggccgacaccagcagcatccagacctgtgacctgctgagtgaccagagtgaagatgagaccaccccagatgaggagatgagcagcaacctggagtatgccaagggctacccaccctacagcccctacatcggcagcagccccaccttctgccacctgctgcacgagaaggtgcccttctgctgcctgcggctggacaagttctag

SEQ ID NO: 164812 - DNA, 1503 bp, Artificial Sequence
  Description of Artificial Sequence: Synthetic coding sequence
atgcccagcagcggccgggccctgctggacagccccctggacagcggcagcctgaccagcctggacagcagcgtcttctgcagcgagggggagggggagcccctggccctgggggactgcttcaccgtgaatgtgggcggcagcagatttgtgctgagccagcaggccctgagctgcttcccccacacccggctgggcaagctggccgtggtggtggccagctacagaagacctggggccctggccgctgtgcccagccccctggagctgtgtgatgatgccaaccctgtggacaatgagtacttctttgacaggagcagccaggccttccgctacgtgctgcactactacagaacaggccgcctgcacgtgatggagcagctgtgtgccctgtccttcctgcaggagatccagtactggggcattgatgagctgagcattgacagctgctgccgggaccgctacttccggaggaaggagctgtctgagaccctggacttcaagaaggacacagaggaccaggagagccagcacgagagcgagcaggacttcagccagggcccctgccccaccgtgcggcagaagctgtggaacatcctggagaagccaggcagcagcacagctgcccgcatctttggagtcatcagcatcatctttgtggtggtgtccatcatcaacatggccctgatgtctgctgagctgtcctggctggacctgcagctgctggagatcctggagtatgtgtgcatctcctggttcaccggggagtttgtgctgcgcttcctgtgtgtgcgggaccgctgccgcttcctgaggaaggtgcccaacatcatcgacctgctggccatcctgcccttctacatcaccctgctggtggagagcctgagcggcagccagaccacccaggagctggagaatgtgggccgcatcgtgcaggtgctgcggctgctgcgggccctgaggatgctgaagctgggccgccacagcacaggcctgcggagcctgggcatgaccatcacccagtgctatgaggaggtgggcctgctgctgctcttcctgtctgtgggcatcagcatcttcagcacagtggagtactttgctgagcagagcatcccagacaccaccttcacctctgtgccctgtgcctggtggtgggccaccacctccatgaccaccgtgggctatggagacatccggccagacaccaccaccgggaagatcgtggccttcatgtgcatcctgagcggcatcctggtgctggccctgcccatcgccatcatcaatgaccgcttcagcgcctgctacttcaccctgaagctgaaggaggccgctgtgcggcagcgggaggccctgaagaagctgaccaagaacatcgccacagacagctacatctctgtgaacctgagagatgtgtatgcccggagcatcatggagatgctgcggctgaagggccgggagcgggccagcaccaggagcagtggaggagatgacttctggttctag

SEQ ID NO: 164813 - DNA, 1503 bp, Artificial Sequence; identical to SEQ ID NO: 164812
  Description of Artificial Sequence: Synthetic coding sequence

SEQ ID NO: 164814 - DNA, 1131 bp, Artificial Sequence
  Description of Artificial Sequence: Synthetic coding sequence
atggagcagctgtgtgccctgtccttcctgcaggagatccagtactggggcattgatgagctgagcattgacagctgctgccgggaccgctacttccggaggaaggagctgtctgagaccctggacttcaagaaggacacagaggaccaggagagccagcacgagagcgagcaggacttcagccagggcccctgccccaccgtgcggcagaagctgtggaacatcctggagaagccaggcagcagcacagctgcccgcatctttggagtcatcagcatcatctttgtggtggtgtccatcatcaacatggccctgatgtctgctgagctgtcctggctggacctgcagctgctggagatcctggagtatgtgtgcatctcctggttcaccggggagtttgtgctgcgcttcctgtgtgtgcgggaccgctgccgcttcctgaggaaggtgcccaacatcatcgacctgctggccatcctgcccttctacatcaccctgctggtggagagcctgagcggcagccagaccacccaggagctggagaatgtgggccgcatcgtgcaggtgctgcggctgctgcgggccctgaggatgctgaagctgggccgccacagcacaggcctgcggagcctgggcatgaccatcacccagtgctatgaggaggtgggcctgctgctgctcttcctgtctgtgggcatcagcatcttcagcacagtggagtactttgctgagcagagcatcccagacaccaccttcacctctgtgccctgtgcctggtggtgggccaccacctccatgaccaccgtgggctatggagacatccggccagacaccaccaccgggaagatcgtggccttcatgtgcatcctgagcggcatcctggtgctggccctgcccatcgccatcatcaatgaccgcttcagcgcctgctacttcaccctgaagctgaaggaggccgctgtgcggcagcgggaggccctgaagaagctgaccaagaacatcgccacagacagctacatctctgtgaacctgagagatgtgtatgcccggagcatcatggagatgctgcggctgaagggccgggagcgggccagcaccaggagcagtggaggagatgacttctggttctag

SEQ ID NO: 164815 - DNA, 1638 bp, Artificial Sequence
  Description of Artificial Sequence: Synthetic coding sequence
atgctgaagcagagcgagcggcggcgctcctggagctaccggccctggaacaccacagaaaatgaaggcagccagcacagaagaagcatctgcagcctgggcgcccggagcggcagccaggccagcatccacggctggacagagggcaactacaactactacattgaagaagatgaagatggagaggaggaggaccagtggaaggatgacctggccgaggaggaccagcaggccggggaggtgaccacagccaagccagagggccccagcgaccccccagccctgctgagcaccctgaatgtgaatgtgggcggccacagctaccagctggactactgtgagctggccggcttccccaagacccggctgggccgcctggccaccagcaccagccgcagccggcagctgagcctgtgtgatgattatgaggagcagacagatgagtacttctttgaccgggaccctgctgtgttccagctggtgtacaacttctacctgtctggagtgctgctggtgctggatggcctgtgcccccggcgcttcctggaggagctgggctactggggcgtgcggctgaagtacaccccccgctgctgccgcatctgctttgaggagaggagagatgagctgtctgagcggctgaagatccagcacgagctgcgggcccaggcccaggtggaggaggccgaggagctgttccgggacatgaggttctacggcccccagaggcggcggctgtggaacctgatggagaagcccttcagctctgtggccgccaaggccatcggcgtggccagcagcacctttgtgctggtgtctgtggtggccctggccctgaacacagtggaggagatgcagcagcacagcggccagggcgagggcggccctgacctgcggcccatcctggagcacgtggagatgctgtgcatgggcttcttcaccctggagtacctgctgcggctggccagcaccccagacctgcggagatttgcccggagcgccctgaacctggtggacctggtggccatcctgcccctgtacctgcagctgctgctggagtgcttcaccggggagggccaccagaggggccagacagtgggctctgtgggcaaggtgggccaggtgctgcgggtgatgaggctgatgaggatcttccgcatcctgaagctggcccggcacagcacaggcctgcgggccttcggcttcaccctgcggcagtgctaccagcaggtgggctgcctgctgctcttcatcgccatgggcatcttcaccttctctgctgctgtgtacagcgtggagcatgatgtgcccagcaccaacttcaccaccatcccccacagctggtggtgggccgctgtgtccatcagcacagtgggctacggggacatgtacccagagacccacctgggccgcttctttgccttcctgtgcatcgccttcggcatcatcctgaatggcatgcccatcagcatcctgtacaacaagttcagtgactactacagcaagctgaaggcctatgagtacaccaccatccggcgggagcggggggaggtgaacttcatgcagagggccaggaagaagattgctgagtgcctgctgggcagcaacccccagctgaccccccggcaggagaactag

SEQ ID NO: 164816 - DNA, 963 bp, Artificial Sequence
  Description of Artificial Sequence: Synthetic coding sequence
atgctgaagcagagcgagcggcggcgctcctggagctaccggccctggaacaccacagaaaatgaaggcagccagcacagaagaagcatctgcagcctgggcgcccggagcggcagccaggccagcatccacggctggacagagggcaactacaactactacattgaagaagatgaagatggagaggaggaggaccagtggaaggatgacctggccgaggaggaccagcaggccggggaggtgaccacagccaagccagagggccccagcgaccccccagccctgctgagcaccctgaatgtgaatgtgggcggccacagctaccagctggactactgtgagctggccggcttccccaagacccggctgggccgcctggccaccagcaccagccgcagccggcagctgagcctgtgtgatgattatgaggagcagacagatgagtacttctttgaccgggaccctgctgtgttccagctggtgtacaacttctacctgtctggagtgctgctggtgctggatggcctgtgcccccggcgcttcctggaggagctgggctactggggcgtgcggctgaagtacaccccccgctgctgccgcatctgctttgaggagaggagagatgagctgtctgagcggctgaagatccagcacctgcgggcccggctgcggggcggggccggggcccagcacagaggaggagatgctgctgccctgggcgccggccggggccggcccaggcctgctgcccaccctggggcccggggagatgctgtgcacggcctgctgcacgcccgggtgcctgctgcccccagcctgcacgcccggcctgaggccctgcgggcccagaggccccagcccggcggccctgggggccaccctgctgccctgcccagcgctgctgcccgggtgctgcacggccggggcccccccaccaggccagatggcggccagaggggctag

SEQ ID NO: 164817 - DNA, 1740 bp, Artificial Sequence
  Description of Artificial Sequence: Synthetic coding sequence
atgagcagctgccgctacaatggaggagtgatgaggcccctgagcaacctgagcgccagcagaagaaacctgcacgagatggattctgaggcccagcccctgcagcccccagcctctgtgggcggcggcggcggggccagcagccccagcgctgctgctgctgctgctgctgctgtgagcagcagcgcccctgagatcgtggtgtccaagccagagcacaacaacagcaacaacctggccctgtatggcaccggcggcggcggcagcactggaggcggcggcggcggcggcggcagcggccacggcagcagcagcggcaccaagagcagcaagaagaagaaccagaacatcggctacaagctgggccaccggcgggccctgtttgagaagaggaagaggctgagtgactatgccctgatcttcggcatgtttggcatcgtggtgatggtgattgaaacagagctgtcctggggcgcctatgacaaggccagcctgtacagcctggccctgaagtgcctgatcagcctgagcaccatcatcctgctgggcctcatcatcgtgtaccacgcccgggagatccagctgttcatggtggacaacggggctgatgactggagaattgccatgacctatgagcgcatcttcttcatctgcctggagatcctggtgtgtgccatccaccccatccctggcaactacaccttcacctggacagcccggctggccttctcctatgcccccagcaccaccacagcagatgtggacatcatcctgagcatccccatgttcctgcggctgtacctgattgcccgggtgatgctgctgcacagcaagctgttcacagatgccagcagccgcagcatcggggccctgaacaagatcaacttcaacaccaggtttgtgatgaagaccctgatgaccatctgccccggcaccgtgctgctggtgttcagcatcagcctgtggatcatcgccgcctggacagtgcgggcctgtgagcgctaccatgaccagcaggatgtgaccagcaacttcctgggcgccatgtggctgatcagcatcaccttcctgagcatcggctatggagacatggtgcccaacacctactgtgggaagggcgtgtgcctgctgaccggcatcatgggcgccggctgcacagccctggtggtggccgtggtggccaggaagctggagctgaccaaggccgagaagcacgtgcacaacttcatgatggacacccagctgaccaagagggtgaagaatgctgctgccaacgtgctgcgggagacctggctgatctacaagaacaccaagctggtgaagaagattgaccacgccaaggtgaggaagcaccagaggaagttcctgcaggccatccaccagctgcggtctgtgaagatggagcagaggaagctgaatgaccaggccaacaccctggtggacctggccaagacccagaacatcatgtatgacatgatcagtgacctgaatgaaagaagtgaagattttgagaagagaattgtgaccctggagaccaagctggagaccctcatcggcagcatccacgccctgcccggcctcatcagccagaccatccggcagcagcagagggacttcatcgaggcccagatggagagctatgacaagcacgtgacctacaatgctgagaggagccgcagcagcagcagaagaagaagaagcagcagcacagccccacccaccagcagcgagagcagctag

SEQ ID NO: 164818 - DNA, 696 bp, Artificial Sequence
  Description of Artificial Sequence: Synthetic coding sequence
atgtggctgatcagcatcaccttcctgagcatcggctatggagacatggtgcccaacacctactgtgggaagggcgtgtgcctgctgaccggcatcatgggcgccggctgcacagccctggtggtggccgtggtggccaggaagctggagctgaccaaggccgagaagcacgtgcacaacttcatgatggacacccagctgaccaagagggtgaagaatgctgctgccaacgtgctgcgggagacctggctgatctacaagaacaccaagctggtgaagaagattgaccacgccaaggtgaggaagcaccagaggaagttcctgcaggccatccaccagctgcggtctgtgaagatggagcagaggaagctgaatgaccaggccaacaccctggtggacctggccaagacccagaacatcatgtatgacatgatcagtgacctgaatgaaagaagtgaagattttgagaagagaattgtgaccctggagaccaagctggagaccctcatcggcagcatccacgccctgcccggcctcatcagccagaccatccggcagcagcagagggacttcatcgaggcccagatggagagctatgacaagcacgtgacctacaatgctgagaggagccgcagcagcagcagaagaagaagaagcagcagcacagccccacccaccagcagcgagagcagctag

SEQ ID NO: 164819 - DNA, 1326 bp, Artificial Sequence
  Description of Artificial Sequence: Synthetic coding sequence
atgagcagctgccgctacaatggaggagtgatgaggcccctgagcaacctgagcgccagcagaagaaacctgcacgagatggattctgaggcccagcccctgcagcccccagcctctgtgggcggcggcggcggggccagcagccccagcgctgctgctgctgctgctgctgctgtgagcagcagcgcccctgagatcgtggtgtccaagccagagcacaacaacagcaacaacctggccctgtatggcaccggcggcggcggcagcactggaggcggcggcggcggcggcggcagcggccacggcagcagcagcggcaccaagagcagcaagaagaagaaccagaacatcggctacaagctgggccaccggcgggccctgtttgagaagaggaagaggctgagtgactatgccctgatcttcggcatgtttggcatcgtggtgatggtgattgaaacagagctgtcctggggcgcctatgacaaggccagcctgtacagcctggccctgaagtgcctgatcagcctgagcaccatcatcctgctgggcctcatcatcgtgtaccacgcccgggagatccagctgttcatggtggacaacggggctgatgactggagaattgccatgacctatgagcgcatcttcttcatctgcctggagatcctggtgtgtgccatccaccccatccctggcaactacaccttcacctggacagcccggctggccttctcctatgcccccagcaccaccacagcagatgtggacatcatcctgagcatccccatgttcctgcggctgtacctgattgcccgggtgatgctgctgcacagcaagctgttcacagatgccagcagccgcagcatcggggccctgaacaagatcaacttcaacaccaggtttgtgatgaagaccctgatgaccatctgccccggcaccgtgctgctggtgttcagcatcagcctgtggatcatcgccgcctggacagtgcgggcctgtgagcgctaccatgaccagcaggatgtgaccagcaacttcctgggcgccatgtggctgatcagcatcaccttcctgagcatcggctatggagacatggtgcccaacacctactgtgggaagggcgtgtgcctgctgaccggcatcatgggcgccggctgcacagccctggtggtggccgtggtggccaggaagctggagctgaccaaggccgagaagcacgtgcacaacttcatgatggacacccagctgaccaagagggtgtcctactacccctacatcttcaaggagaacatcatcgtcatcttctctgtgctgggcaacatggcctag

SEQ ID NO: 164820 - DNA, 2196 bp, Artificial Sequence
  Description of Artificial Sequence: Synthetic coding sequence
atggacaccagcggccacttccatgacagcggcgtgggggacctggatgaggaccccaagtgcccctgccccagcagtggagatgagcagcagcagcagcagcagcagcagcagcagcagcagcccccacctccagcccctcctgctgccccccagcagcccctgggccccagcctgcagccccagcccccccagctgcagcagcagcagcagcagcagcagcagcagcagcagcagcagcccccccaccccctgagccagctggcccagctgcagagccagcctgtgcaccctggcctgctgcacagcagccccacagccttccgggccccacccagcagcaacagcacagccatcctgcaccccagcagccggcagggcagccagctgaacctgaatgaccacctgctgggccacagccccagcagcacagccaccagcggccctgggggcggcagccgccaccggcaggccagccccctggtgcaccggcgggacagcaaccccttcacagaaattgccatgagcagctgcaagtacagcggaggagtgatgaagcccctgagccggctgagcgccagcagaagaaacctgattgaagctgagacagagggccagcccctgcagctgttcagccccagcaaccccccagaaattgtcatcagcagccgggaggacaaccacgcccaccagaccctgctgcaccaccccaatgccacccacaaccaccagcacgccggcaccacagccagcagcaccaccttccccaaggccaacaagaggaagaaccagaacatcggctacaagctgggccacagaagagccctgtttgagaagaggaagaggctgagtgactatgccctgatcttcggcatgtttggaattgtggtgatggtgattgaaacagagctgtcctggggcctgtacagcaaggacagcatgttcagcctggccctgaagtgcctgatcagcctgagcaccatcatcctgctgggcctcatcatcgcctaccacacccgggaggtgcagctgtttgtgattgacaatggagcagatgactggagaattgccatgacctatgaaagaatcctgtacatcagcctggagatgctggtgtgtgccatccaccccatccctggagagtacaagttcttctggacagcccggctggccttctcctacacccccagcagagctgaggctgatgtggacatcatcctgagcatccccatgttcctgcggctgtacctgattgcccgggtgatgctgctgcacagcaagctgttcacagatgccagcagccgcagcattggagccctgaacaagatcaacttcaacaccaggtttgtgatgaagaccctgatgaccatctgccccggcaccgtgctgctggtgttcagcatcagcctgtggatcatcgccgcctggacagtgcgggtgtgtgagcgctaccatgaccagcaggatgtgaccagcaacttcctgggcgccatgtggctgatcagcatcaccttcctgagcatcggctacggggacatggtgccccacacctactgtgggaaaggagtgtgcctgctgaccggcatcatgggcgccggctgcacagccctggtggtggccgtggtggccaggaagctggagctgaccaaggccgagaagcacgtgcacaacttcatgatggacacccagctgaccaagaggatcaagaatgctgctgccaacgtgctgcgggagacctggctgatctacaagcacaccaagctgctgaagaagattgaccacgccaaggtgaggaagcaccagaggaagttcctgcaggccatccaccagctgcggtctgtgaagatggagcagaggaagctgagtgaccaggccaacaccctggtggacctgagcaagatgcagaatgtgatgtatgacctgatcacagagctgaatgacagaagtgaggacctggagaagcagatcggcagcctggagagcaagctggagcacctgacagccagcttcaacagcctgcccctgctgattgctgacaccctgcggcagcagcagcagcagctgctgagcgccatcatcgaggcccggggcgtgtctgtggccgtgggcaccacccacacccccatcagtgacagccccatcggcgtgagcagcaccagcttccccaccccctacaccagcagcagcagctgctag

SEQ ID NO: 164821 - DNA, 1257 bp, Artificial Sequence
  Description of Artificial Sequence: Synthetic coding sequence
atgttcagcctggccctgaagtgcctgatcagcctgagcaccatcatcctgctgggcctcatcatcgcctaccacacccgggaggtgcagctgtttgtgattgacaacggggctgatgactggagaattgccatgacctatgagcgcatcctgtacatcagcctggagatgctggtgtgtgccatccaccccatccctggagagtacaagttcttctggacagcccggctggccttctcctacacccccagcagagctgaggctgatgtggacatcatcctgagcatccccatgttcctgcggctgtacctgattgcccgggtgatgctgctgcacagcaagctgttcacagatgccagcagccgcagcatcggggccctgaacaagatcaacttcaacaccaggtttgtgatgaagaccctgatgaccatctgccccggcaccgtgctgctggtgttcagcatcagcctgtggatcatcgccgcctggacagtgcgggtgtgtgagcgctaccatgaccagcaggatgtgaccagcaacttcctgggcgccatgtggctgatcagcatcaccttcctgagcatcggctatggagacatggtgccccacacctactgtgggaagggcgtgtgcctgctgaccggcatcatgggcgccggctgcacagccctggtggtggccgtggtggccaggaagctggagctgaccaaggccgagaagcacgtgcacaacttcatgatggacacccagctgaccaagaggatcaagaatgctgctgccaacgtgctgcgggagacctggctgatctacaagcacaccaagctgctgaagaagattgaccacgccaaggtgaggaagcaccagaggaagttcctgcaggccatccaccagctgcggtctgtgaagatggagcagaggaagctgagtgaccaggccaacaccctggtggacctgagcaagatgcagaatgtgatgtatgacctgatcacagagctgaatgacagaagtgaggacctggagaagcagatcggcagcctggagagcaagctggagcacctgacagccagcttcaacagcctgcccctgctgattgctgacaccctgcggcagcagcagcagcagctgctgagcgccatcatcgaggcccggggcgtgtctgtggccgtgggcaccacccacacccccatcagtgacagccccatcggcgtgagcagcaccagcttccccaccccctacaccagcagcagcagctgctag

SEQ ID NO: 164822 - DNA, 1281 bp, Artificial Sequence
  Description of Artificial Sequence: Synthetic coding sequence
atggagcggcccatcaaggacagcatgttcagcctggccctgaagtgcctgatcagcctgagcaccatcatcctgctgggcctcatcatcgcctaccacacccgggaggtgcagctgtttgtgattgacaacggggctgatgactggagaattgccatgacctatgagcgcatcctgtacatcagcctggagatgctggtgtgtgccatccaccccatccctggagagtacaagttcttctggacagcccggctggccttctcctacacccccagcagagctgaggctgatgtggacatcatcctgagcatccccatgttcctgcggctgtacctgattgcccgggtgatgctgctgcacagcaagctgttcacagatgccagcagccgcagcatcggggccctgaacaagatcaacttcaacaccaggtttgtgatgaagaccctgatgaccatctgccccggcaccgtgctgctggtgttcagcatcagcctgtggatcatcgccgcctggacagtgcgggtgtgtgagcgctaccatgaccagcaggatgtgaccagcaacttcctgggcgccatgtggctgatcagcatcaccttcctgagcatcggctatggagacatggtgccccacacctactgtgggaagggcgtgtgcctgctgaccggcatcatgggcgccggctgcacagccctggtggtggccgtggtggccaggaagctggagctgaccaaggccgagaagcacgtgcacaacttcatgatggacacccagctgaccaagaggatcaagaatgctgctgccaacgtgctgcgggagacctggctgatctacaagcacaccaagctgctgaagaagattgaccacgccaaggtgaggaagcaccagaggaagttcctgcaggccatccaccagctgcggtctgtgaagatggagcagaggaagctgagtgaccaggccaacaccctggtggacctgagcaagatgcagaatgtgatgtatgacctgatcacagagctgaatgacagaagtgaggacctggagaagcagatcggcagcctggagagcaagctggagcacctgacagccagcttcaacagcctgcccctgctgattgctgacaccctgcggcagcagcagcagcagctgctgagcgccatcatcgaggcccggggcgtgtctgtggccgtgggcaccacccacacccccatcagtgacagccccatcggcgtgagcagcaccagcttccccaccccctacaccagcagcagcagctgctag

SEQ ID NO: 164823 - DNA, 684 bp, Artificial Sequence
  Description of Artificial Sequence: Synthetic coding sequence
ccccacaccctgctggaggaccacctgctgcgggagttcttccaccccctcttcttcctgcaggcccccctgctgctgagcctgcctgcccagtacaatgccttcctgagcggctctgtgtggaccccaggcagcccccgggagcccaagcaggccaaggagaggactggagccaagatcctggtgggggagatcggctgcctggccttctttgaggacatctttggagcccgggtggccctgggctggggcctggtgctgcagggcatccagcccggccccaagatggacaccagcggccacttccatgattctggagtgggggacctggatgaggaccccaagtgcccctgccccagcagtggagatgagcagcagcagcagcagcagcagcagcagcagcagcagcccccacctccagcccccccagctgccccccagcagcccctgggccccagcctgcagccccagcccccccagctgcagcagcagcagcagcagcagcagcagcagcagcagcagcagcccccccaccccctgagccagctggcccagctgcagagccagcctgtgcaccctggcctgctgcacagcagccccacagccttccggcccccatttgtgcagctgcaccgccaccccccacccttcctgcaggcccggcagcctgcccagagccagtag

SEQ ID NO: 164824 - DNA, 1284 bp, Artificial Sequence
  Description of Artificial Sequence: Synthetic coding sequence
atgggcggggacctggtgctgggcctgggcgccctgcggcggaggaagaggctgctggagcaggagaagagcctggccggctgggccctggtgctggccggcactggaattggcctgatggtgctgcacgccgagatgctgtggtttggaggctgctcctgggccctgtacctgttcctggtgaagtgcaccatcagcatcagcaccttcctgctgctgtgcctgattgtggccttccacgccaaggaggtgcagctgttcatgacagacaatggcctgcgggactggagggtggccctgaccggccggcaggccgcccagatcgtgctggagctggtggtgtgtggcctgcacccagcccctgtgcggggccccccctgtgtgcaggacctgggcgcccccctgaccagcccccagccctggccaggcttcctgggccagggcgaggccctgctgagcctggccatgctgctgcggctgtacctggtgcccagggctgtgctgctgcggtctggagtgctgctgaatgccagctaccgcagcatcggggccctgaaccaggtgcgcttccgccactggtttgtggccaagctgtacatgaacacccaccctggccgcctgctgctgggcctgaccctgggcctgtggctgaccacagcctgggtgctgtctgtggccgagcggcaggccgtgaatgccaccggccacctgagtgacaccctgtggctgatccccatcaccttcctgaccatcggctatggagatgtggtgcccggcaccatgtggggcaagatcgtgtgcctgtgcaccggggtgatgggcgtgtgctgcacagccctgctggtggccgtggtggccaggaagctggagttcaacaaggccgagaagcacgtgcacaacttcatgatggacatccagtacaccaaggagatgaaggagagcgctgcccgggtgctgcaggaggcctggatgttctacaagcacaccaggaggaaggagagccacgccgcccggcggcaccagaggaagctgctggccgccatcaatgccttccggcaggtgcggctgaagcacaggaagctgcgggagcaggtgaacagcatggtggacatcagcaagatgcacatgatcctgtatgacctgcagcagaacctgagcagcagccaccgggccctggagaagcagattgacaccctggccggcaagctggatgccctgacagagctgctgagcacagccctgggcccccggcagctgcctgagcccagccagcagagcaagtag

SEQ ID NO: 164825 - DNA, 888 bp, Artificial Sequence
  Description of Artificial Sequence: Synthetic coding sequence
atgcatgaccagcacttccacctgctgacccccctgccccaccggggcctgagctgccagaggggccctgctgtgcatgaccggcagagagctgctggcctggcccggggagctgacagagctgctggaaatgccagctaccgcagcatcggggccctgaaccaggtgcgcttccgccactggtttgtggccaagctgtacatgaacacccaccctggccgcctgctgctgggcctgaccctgggcctgtggctgaccacagcctgggtgctgtctgtggccgagcggcaggccgtgaatgccaccggccacctgagtgacaccctgtggctgatccccatcaccttcctgaccatcggctatggagatgtggtgcccggcaccatgtggggcaagatcgtgtgcctgtgcaccggggtgatgggcgtgtgctgcacagccctgctggtggccgtggtggccaggaagctggagttcaacaaggccgagaagcacgtgcacaacttcatgatggacatccagtacaccaaggagatgaaggagagcgctgcccgggtgctgcaggaggcctggatgttctacaagcacaccaggaggaaggagagccacgccgcccggcggcaccagaggaagctgctggccgccatcaatgccttccggcaggtgcggctgaagcacaggaagctgcgggagcaggtgaacagcatggtggacatcagcaagatgcacatgatcctgtatgacctgcagcagaacctgagcagcagccaccgggccctggagaagcagattgacaccctggccggcaagctggatgccctgacagagctgctgagcacagccctgggcccccggcagctgcctgagcccagccagcagagcaagtag

SEQ ID NO: 164826 - DNA, 1119 bp, Artificial Sequence
  Description of Artificial Sequence: Synthetic coding sequence
atgttcaagcacctgaggaagtgggtggtgacccgcttcttcggccacagccggcagagggcccggctggtgtccaaggatggccgctgcaacatcgagtttggaaatgtggaggcccagagccgcttcatcttctttgtggacatctggaccaccgtgctggacctgaagtggagatacaagatgaccatcttcatcacagccttcctgggctcctggttcttcttcggcctgctgtggtatgctgtggcctacatccacaaggacctgcctgagttccaccccagcgccaaccacaccccctgtgtggagaacatcaatggcctgaccagcgccttcctgttcagcctggagacccaggtgaccatcggctacggcttccgctgtgtgacagagcagtgtgccacagccatcttcctgctgatcttccagagcatcctgggcgtcatcatcaacagcttcatgtgtggggccatcctggccaagatcagccggcccaagaagagggccaagaccatcaccttcagcaagaatgctgtgatcagcaagagaggaggcaagctgtgcctgctgatccgggtggccaacctgaggaagagcctgctgattggcagccacatctacggcaagctgctgaagaccaccgtgaccccagagggggagaccatcatcctggaccagatcaacatcaactttgtggtggatgctggaaatgaaaatctcttcttcatcagccccctgaccatctaccacgtgattgaccacaacagccccttcttccacatggctgctgagaccctgctgcagcaggactttgagctggtggtgttcctggatggcaccgtggagagcaccagcgccacctgccaggtgaggaccagctatgtgcctgaggaggtgctgtggggctacagatttgcccccatcgtgtccaagaccaaggagggcaagtacagagtggacttccacaacttcagcaagacagtggaggtggagaccccccactgtgccatgtgcctgtacaatgagaaggatgtgcgggccaggatgaagaggggctatgacaaccccaacttcatcctgtctgaggtgaatgaaacagatgacaccaagatgtag

SEQ ID NO: 164827 - DNA, 1119 bp, Artificial Sequence; identical to SEQ ID NO: 164826
  Description of Artificial Sequence: Synthetic coding sequence

SEQ ID NO: 164828 - DNA, 912 bp, Artificial Sequence
  Description of Artificial Sequence: Synthetic coding sequence
atggcctggtggctgattgcctttgcccacggggacctggcccccagcgagggcacagctgagccctgtgtgaccagcatccacagcttcagcagcgccttcctgttcagcattgaggtgcaggtgaccatcggctttggaggccgcatggtgacagaggagtgccccctggccatcctgatcctgattgtgcagaacatcgtgggcctgatgatcaatgccatcatgctgggctgcatcttcatgaagacagcccaggcccacagaagagctgagaccctcatcttcagcaagcacgccgtcatcgccctgcggcacggccgcctgtgcttcatgctgcgggtgggggacctgaggaagtccatgatcatcagcgccaccatccacatgcaggtggtgaggaagaccaccagccctgagggggaggtggtgcccctgcaccaggtggacatccccatggagaatggagtgggcggcaacagcatcttcctggtggcccccctcatcatctaccacgtgattgatgccaacagccccctgtatgacctggcccccagcgacctgcaccaccaccaggacctggagatcatcgtcatcctggagggcgtggtggagaccaccggcatcaccacccaggcccggaccagctacctggctgatgagatcctgtggggccagagatttgtgcccatcgtggccgaggaggatggccgctacagcgtggactacagcaagtttggaaacacagtgaaggtgcccacccccctgtgcacagcccggcagctggatgaggaccacagcctgctggaggccctgaccctggccagcgcccggggccccctgaggaagaggtctgtgcccatggccaaggccaagcccaagttcagcatcagcccagacagcctgtcctag

SEQ ID NO: 164829 - DNA, 1302 bp, Artificial Sequence
  Description of Artificial Sequence: Synthetic coding sequence
atgacagctgccagccgggccaacccctacagcatcgtgtccagtgaagaagatggcctgcacctggtgaccatgtctggggccaatggatttggaaatggcaaggtgcacacccggcggcgctgcaggaacagatttgtgaagaagaatggccagtgcaacattgaatttgccaacatggatgagaagagccagcgctacctggccgacatgttcaccacctgtgtggacatccgctggagatacatgctgctgatcttcagcctggccttcctggcctcctggctgctgtttggcatcatcttctgggtgattgctgtggcccatggagacctggagcctgctgagggccggggccgcaccccctgtgtgatgcaggtgcacggcttcatggccgccttcctgttcagcattgagacccagaccaccatcggctacggcctgcgctgtgtgacagaggagtgccctgtggccgtgttcatggtggtggcccagagcatcgtgggctgcatcatcgacagcttcatgattggagccatcatggccaagatggcccggcccaagaagagggcccagaccctgctcttcagccacaatgctgtggtggccctgagagatggcaagctgtgcctgatgtggagggtgggcaacctgaggaagagccacatcgtggaggcccacgtgcgggcccagctgatcaagccccgggtgacagaggagggggagtacatccccctggaccagattgatattgatgtgggctttgataaaggcctggaccgcatcttcctggtgagccccatcaccatcctgcacgagattgatgaggccagccccctgtttggcatcagccggcaggacctggagacagatgactttgaaattgtggtgatcctggagggcatggtggaggccacagccatgaccacccaggcccggagcagctacctggccaatgagatcctgtggggccacagatttgagcctgtgctgtttgaggagaagaaccagtacaagattgactacagccacttccacaagacctatgaggtgcccagcaccccccgctgcagcgccaaggacctggtggagaacaagttcctgctgcccagcgccaacagcttctgctatgaaaatgagctggccttcctgagcagagatgaagaagatgaagcagatggagaccaggacggccgcagcagagatggcctgagcccccaggcccggcatgactttgaccggctgcaggccggcggcggcgtgctggagcagaggccctaccgccgggagagcgagatctag

SEQ ID NO: 164830 - DNA, 1257 bp, Artificial Sequence
  Description of Artificial Sequence: Synthetic coding sequence
atgagctactacggcagcagctaccacatcatcaatgctgatgccaagtacccaggctacccacctgagcacatcatcgccgagaagaggcgggcccggcggcggctgctgcacaaggatggcagctgcaatgtgtacttcaagcacatctttggagagtggggcagctatgtggtggacatcttcaccaccctggtggacaccaagtggaggcacatgtttgtgatcttcagcctgagctacatcctgtcctggctgatcttcggcagcgtcttctggctgattgccttccaccacggggacctgctgaatgaccctgacatcaccccctgtgtggacaacgtgcacagcttcaccggggccttcctgttcagcctggagacccagaccaccatcggctacggctaccgctgtgtgacagaggagtgcagcgtggccgtgctgatggtgatcctgcagagcatcctgagctgcatcatcaacaccttcatcattggagctgccctggccaagatggccacagccaggaagagggcccagaccatccgcttctcctactttgccctgattggcatgagagatggcaagctgtgcctgatgtggagaattggagacttccggcccaaccacgtggtggagggcaccgtgcgggcccagctgctgcgctacacagaagattctgagggccgcatgaccatggccttcaaggacctgaagctggtgaatgaccagatcatcctggtgacccctgtgaccatcgtgcatgaaattgaccacgagagccccctgtatgccctggacaggaaggctgtggccaaggacaactttgagatcctggtgaccttcatctacacaggagacagcacaggcaccagccaccagagccgcagcagctatgtgccccgggagatcctgtggggccaccgcttcaatgatgtgctggaggtgaagaggaagtactacaaggtgaactgcctgcagtttgagggctctgtggaggtgtatgcccccttctgcagcgccaagcagctggactggaaggaccagcagctgcacatcgagaaggcccctcctgtgcgggagagctgcaccagtgacaccaaggccaggagaagaagcttctctgctgtggccatcgtgagcagctgtgagaaccctgaggagaccaccaccagcgccacccatgagtaccgggagaccccctaccagaaggccctgctgaccctgaaccgcatctctgtggagagccagatgtag

SEQ ID NO: 164831 - DNA, 1119 bp, Artificial Sequence; identical to SEQ ID NO: 164826
  Description of Artificial Sequence: Synthetic coding sequence

SEQ ID NO: 164832 - DNA, 1176 bp, Artificial Sequence
  Description of Artificial Sequence: Synthetic coding sequence
atgaatgccagcagcagaaatgtgtttgacaccctcatccgggtgctgacagagagcatgttcaagcacctgaggaagtgggtggtgacccgcttcttcggccacagccggcagagggcccggctggtgtccaaggatggccgctgcaacattgaatttggaaatgtggaggcccagagccgcttcatcttctttgtggacatctggaccaccgtgctggacctgaagtggagatacaagatgaccatcttcatcacagccttcctgggctcctggttcttcttcggcctgctgtggtatgctgtggcctacatccacaaggacctgcctgagttccaccccagcgccaaccacaccccctgtgtggagaacatcaatggcctgaccagcgccttcctgttcagcctggagacccaggtgaccatcggctacggcttccgctgtgtgacagagcagtgtgccacagccatcttcctgctgatcttccagagcatcctgggcgtcatcatcaacagcttcatgtgtggggccatcctggccaagatcagccggcccaagaagagggccaagaccatcaccttcagcaagaatgctgtgatcagcaagaggggcggcaagctgtgcctgctgatccgggtggccaacctgaggaagagcctgctgattggcagccacatctacggcaagctgctgaagaccaccgtgaccccagagggggagaccatcatcctggaccagatcaacatcaactttgtggtggatgctggaaatgaaaatctcttcttcatcagccccctgaccatctaccacgtgattgaccacaacagccccttcttccacatggctgctgagaccctgctgcagcaggactttgagctggtggtgttcctggatggcaccgtggagagcaccagcgccacctgccaggtgaggaccagctatgtgcctgaggaggtgctgtggggctacagatttgcccccatcgtgtccaagaccaaggagggcaagtacagagtggacttccacaacttcagcaagacagtggaggtggagaccccccactgtgccatgtgcctgtacaatgagaaggatgtgcgggccaggatgaagaggggctatgacaaccccaacttcatcctgtctgaggtgaatgaaacagatgacaccaagatgtag

SEQ ID NO: 164833 - DNA, 1119 bp, Artificial Sequence; identical to SEQ ID NO: 164826
  Description of Artificial Sequence: Synthetic coding sequence

SEQ ID NO: 164834 - DNA, 1140 bp, Artificial Sequence
  Description of Artificial Sequence: Synthetic coding sequence
atgacctctgtggccaaggtgtactacagccagaccacccagacagagagccggcccctgatgggccctggcatcagaagaagaagagtgctgaccaaggatggccgcagcaatgtgaggatggagcacatcgctgacaagcgcttcctgtacctgaaggacctgtggaccaccttcatcgacatgcagtggagatacaagctgctgctcttcagcgccacctttgctggcacctggttcctgtttggagtggtgtggtacctggtggccgtggcccatggagacctgctggagctggaccccccagccaaccacaccccctgtgtggtgcaggtgcacaccctgaccggggccttcctgttcagcctggagagccagaccaccatcggctacggcttccgctacatcagtgaagaatgtcccctggccatcgtgctgctgattgcccagctggtgctgaccaccatcctggagatcttcatcaccggcaccttcctggccaagatcgcccggcccaagaagagagctgagaccatccgcttcagccagcacgctgtggtggccagccacaacgggaagccctgcctgatgatccgggtggccaacatgaggaagagcctgctgattggctgccaggtgacaggcaagctgctgcagacccaccagaccaaggagggggagaacatccggctgaaccaggtgaatgtgaccttccaggtggacacagccagtgacagccccttcctgatcctgcccctgaccttctaccacgtggtggatgagaccagccccctgaaggacctgcccctgcggagcggggagggggactttgagctggtgctgatcctgagcggcaccgtggagagcaccagcgccacctgccaggtgaggaccagctacctgcctgaggagatcctgtggggctatgagttcaccccagccatcagcctgagcgccagcggcaagtacatcgctgacttcagcctgtttgaccaggtggtgaaggtggccagccccagcggcctgcgggacagcacagtgcgctatggagaccctgagaagctgaagctggaggagagcctgcgggagcaggccgagaaggagggcagcgccctgtctgtgcgcatcagcaatgtgtag

SEQ ID NO: 164835 - DNA, 1173 bp, Artificial Sequence
  Description of Artificial Sequence: Synthetic coding sequence
atgctgagcaggaagggcatcatccctgaggagtatgtgctgacccggctggctgaagatcctgccaagccccgctaccgggcccggcagaggcgggccaggtttgtgtccaagaagggcaactgcaatgtggcccacaagaacatccgggagcagggccgcttcctgcaggatgtgttcaccaccctggtggacctgaagtggccccacaccctgctgatcttcaccatgtccttcctgtgctcctggctgctgtttgccatggcctggtggctgattgcctttgcccatggagacctggcccccagcgagggcacagctgagccctgtgtgaccagcatccacagcttcagcagcgccttcctgttcagcattgaggtgcaggtgaccatcggctttggaggccgcatggtgacagaagaatgtcccctggccatcctgatcctgattgtgcagaacatcgtgggcctgatgatcaatgccatcatgctgggctgcatcttcatgaagacagcccaggcccaccggcgggcagagaccctcatcttcagcaagcatgctgtgattgccctgcggcacggccgcctgtgcttcatgctgcgggtgggggacctgaggaagtccatgatcatcagcgccaccatccacatgcaggtggtgaggaagaccaccagccctgagggggaggtggtgcccctgcaccaggtggacatccccatggagaatggagtgggcggcaacagcatcttcctggtggcccccctcatcatctaccacgtgattgatgccaacagccccctgtatgacctggcccccagcgacctgcaccaccaccaggacctggagatcatcgtcatcctggagggcgtggtggagaccaccggcatcaccacccaggcccggaccagctacctggctgatgagatcctgtggggccagagatttgtgcccatcgtggccgaggaggatggccgctacagcgtggactacagcaagtttggaaacacagtgaaggtgcccacccccctgtgcacagcccggcagctggatgaggaccacagcctgctggaggccctgaccctggccagcgcccggggccccctgaggaagaggtctgtgcccatggccaaggccaagcccaagttcagcatcagcccagacagcctgtcctag

SEQ ID NO: 164836 - DNA, 1302 bp, Artificial Sequence; identical to SEQ ID NO: 164829
  Description of Artificial Sequence: Synthetic coding sequence

SEQ ID NO: 164837 - DNA, 819 bp, Artificial Sequence
  Description of Artificial Sequence: Synthetic coding sequence
atggtgctgctgacagctgtgctgctgctgctggccgcctatgccggccctgcccagagcctgggcagctttgtgcactgtgagccctgtgatgagaaggccctgtccatgtgcccccccagccccctgggctgtgagctggtgaaggagcccggctgcggctgctgcatgacctgtgccctggccgagggccagagctgtggggtgtacacagagcgctgtgcccagggcctgcgctgcctgccccggcaggatgaggagaagcccctgcacgccctgctgcacggccggggcgtgtgcctgaatgagaagagctaccgggagcaggtgaagattgaaagagacagccgggagcacgaggagcccaccaccagcgagatggccgaggagacctacagccccaagatcttccggcccaagcacacccgcatcagcgagctgaaggccgaggccgtgaagaaggacaggaggaagaagctgacccagagcaagtttgtgggcggcgctgagaacacagcccacccccgcatcatcagcgcccctgagatgaggcaggagagcgagcagggcccctgcagaagacacatggaggccagcctgcaggagctgaaggccagccccaggatggtgcccagggctgtgtacctgcccaactgtgacaggaagggcttctacaagaggaagcagtgcaagcccagccggggcaggaagaggggcatctgctggtgtgtggacaagtatggcatgaagctgcccggcatggagtatgtggatggagacttccagtgccacacctttgacagcagcaatgtggagtag

SEQ ID NO: 164838 - DNA, 285 bp, Artificial Sequence
  Description of Artificial Sequence: Synthetic coding sequence
atggacagcagcaactgcaaggtgattgcccccctgctgagccagcgctacagaaggatggtgaccaaggatggccacagcaccctgcagatggatggagcccagaggggcctggcctacctgagagatgcctggggcatcctgatggacatgcgctggcgctggatgatgctggtgttttctgccagctttgtggtgcactggctggtgtttgctgtgctgtggtgcttctgtggggaggactgcccagccaagaagagcagcttcttcaacagcctgtactag

SEQ ID NO: 164839 - DNA, 1083 bp, Artificial Sequence; identical to SEQ ID NO: 153481
  Description of Artificial Sequence: Synthetic coding sequence

SEQ ID NO: 164840 - DNA, 1128 bp, Artificial Sequence
  Description of Artificial Sequence: Synthetic coding sequence
atggatgccatccacatcggcatgagcagcacccccctggtgaagcacacagctggggccggcctgaaggccaaccggccccgggtgatgagcaagagcggccacagcaatgtgagaattgacaaggtggatggcatctacctgctgtacctgcaggacctgtggaccaccgtgattgacatgaagtggagatacaagctgaccctgtttgctgccacctttgtgatgacctggttcctgtttggagtcatctactatgccatcgccttcatccacggggacctggagcctggagagcccatcagcaaccacaccccctgcatcatgaaggtggacagcctgactggagccttcctgttcagcctggagagccagaccaccatcggctacggcgtgcgcagcatcacagaggagtgcccccacgccatcttcctgctggtggcccagctggtgatcaccaccctcatcgagatcttcatcaccggcaccttcctggccaagatcgcccggcccaagaagagagctgagaccatcaagttcagccactgtgccgtcatcaccaagcagaatggcaagctgtgcctggtgatccaggtggccaacatgaggaagagcctgctgatccagtgccagctgagcggcaagctgctgcagacccacgtgaccaaggagggggagcgcatcctgctgaaccaggccaccgtgaagttccacgtggacagcagcagcgagagccccttcctgatcctgcccatgaccttctaccacgtgctggatgagaccagccccctgcgggacctgaccccccagaacctgaaggagaaggagtttgagctggtggtgctgctgaatgccaccgtggagagcaccagcgctgtgtgccagagcaggaccagctacatccctgaggagatctactggggctttgaatttgtgcctgtggtgtccctgagcaagaatggcaagtatgtggccgacttcagccagtttgagcagatcaggaagagcccagactgcaccttctactgtgccgacagcgagaagcagcagctggaggagaagtaccggcaggaggaccagcgggagcgggagctgcggaccctgctgctgcagcagagcaatgtgtag

SEQ ID NO: 164841 - DNA, 186 bp, Artificial Sequence
  Description of Artificial Sequence: Synthetic coding sequence
atggatgccatccacatcggcatgagcagcacccccctggtgaagcacacagctggggccggcctgaaggccaaccggccccgggtgatgagcaagagcggccacagcaatgtgagaattgacaaggtggatggcatctacctgctgtacctgcaggacctgtggaccaccgtgattgacatgtag

SEQ ID NO: 164842 - DNA, 471 bp, Artificial Sequence
  Description of Artificial Sequence: Synthetic coding sequence
atggatgccatccacatcggcatgagcagcacccccctggtgaagcacacagctggggccggcctgaaggccaaccggccccgggtgatgagcaagagcggccacagcaatgtgagaattgacaaggtggatggcatctacctgctgtacctgcaggacctgtggaccaccgtgattgacatgaagtggagatacaagctgaccctgtttgctgccacctttgtgatgacctggttcctgtttggagtcatctactatgccatcgccttcatccacggggacctggagcctggagagcccatcagcaaccacaccccctgcatcatgaaggtggacagcctgactggagccttcctgttcagcctggagagccagaccaccatcggctacggcgtgcgcagcatcacagaggagtgcccccacgccatcttcctgctggtggcccagctggtgatcaccaccctcatctag

SEQ ID NO: 164843 - DNA, 471 bp, Artificial Sequence; identical to SEQ ID NO: 164842
  Description of Artificial Sequence: Synthetic coding sequence

SEQ ID NO: 164844 - DNA, 1128 bp, Artificial Sequence; identical to SEQ ID NO: 164840
  Description of Artificial Sequence: Synthetic coding sequence

SEQ ID NO: 164845 - DNA, 1128 bp, Artificial Sequence; identical to SEQ ID NO: 164840
  Description of Artificial Sequence: Synthetic coding sequence

SEQ ID NO: 164846 - DNA, 1128 bp, Artificial Sequence; identical to SEQ ID NO: 164840
  Description of Artificial Sequence: Synthetic coding sequence

SEQ ID NO: 164847 - DNA, 1128 bp, Artificial Sequence; identical to SEQ ID NO: 164840
  Description of Artificial Sequence: Synthetic coding sequence

SEQ ID NO: 164848 - DNA, 60 bp, Artificial Sequence
  Description of Artificial Sequence: Synthetic coding sequence
atggatgccatccacatcggcatgagcagcacccccctggtgaagcacacagctggatag

SEQ ID NO: 164849 - DNA, 420 bp, Artificial Sequence
  Description of Artificial Sequence: Synthetic coding sequence
atggatgccatccacatcggcatgagcagcacccccctggtgaagcacacagctggggccggcctgaaggccaaccggccccgggtgatgagcaagagcggccacagcaatgtgagaattgacaaggtggatggcatctacctgctgtacctgcaggacctgtggaccaccgtgattgacatgaagtggagatacaagctgaccctgtttgctgccacctttgtgatgacctggttcctgtttggagtcatctactatgccatcgccttcatccacggggacctggagcctggagagcccatcagcaaccacaccccctgcatcatgaaggtggacagcctgactggagccttcctgttcagcctggagagccagaccaccatcggctacggcgtgcgcagcatcacagaggagtgctag

SEQ ID NO: 164850 - DNA, 738 bp, Artificial Sequence
  Description of Artificial Sequence: Synthetic coding sequence
atggatgccatccacatcggcatgagcagcacccccctggtgaagcacacagctggggccggcctgaaggccaaccggccccgggtgatgagcaagagcggccacagcaatgtgagaattgacaaggtggatggcatctacctgctgtacctgcaggacctgtggaccaccgtgattgacatgaagtggagatacaagctgaccctgtttgctgccacctttgtgatgacctggttcctgtttggagtcatctactatgccatcgccttcatccacggggacctggagcctggagagcccatcagcaaccacaccccctgcatcatgaaggtggacagcctgactggagccttcctgttcagcctggagagccagaccaccatcggctacggcgtgcgcagcatcacagaggagtgcccccacgccatcttcctgctggtggcccagctggtgatcaccaccctcatcgagatcttcatcaccggcaccttcctggccaagatcgcccggcccaagaagagagctgagaccatcaagttcagccactgtgccgtcatcaccaagcagaatggcaagctgtgcctggtgatccaggtggccaacatgaggaagagcctgctgatccagtgccagctgagcggcaagctgctgcagacccacgtgaccaaggagggggagcgcatcctgctgaaccaggccaccgtgaagttccacgtggacagcagcagcgagagctag

SEQ ID NO: 164851 - DNA, 120 bp, Artificial Sequence
  Description of Artificial Sequence: Synthetic coding sequence
atggatgccatccacatcggcatgagcagcacccccctggtgaagcacacagctggggccggcctgaaggccaaccggccccgggtgatgagcaagagcggccacagcaatgtgaggtag

SEQ ID NO: 164852 - DNA, 147 bp, Artificial Sequence
  Description of Artificial Sequence: Synthetic coding sequence
atggatgccatccacatcggcatgagcagcacccccctggtgaagcacacagctggggccggcctgaaggccaaccggccccgggtgatgagcaagagcggccacagcaatgtgagaattgacaaggtggatggcatctacctgtag

SEQ ID NO: 164853 - DNA, 147 bp, Artificial Sequence; identical to SEQ ID NO: 164852
  Description of Artificial Sequence: Synthetic coding sequence

SEQ ID NO: 164854 - DNA, 147 bp, Artificial Sequence; identical to SEQ ID NO: 164852
  Description of Artificial Sequence: Synthetic coding sequence

SEQ ID NO: 164855 - DNA, 78 bp, Artificial Sequence
  Description of Artificial Sequence: Synthetic coding sequence
atggatgccatccacatcggcatgagcagcacccccctggtgaagcacacagctggggccggcctgaaggccaactag

SEQ ID NO: 164856 - DNA, 147 bp, Artificial Sequence; identical to SEQ ID NO: 164852
  Description of Artificial Sequence: Synthetic coding sequence

SEQ ID NO: 164857 - DNA, 147 bp, Artificial Sequence; identical to SEQ ID NO: 164852
  Description of Artificial Sequence: Synthetic coding sequence

SEQ ID NO: 164858 - DNA, 147 bp, Artificial Sequence; identical to SEQ ID NO: 164852
  Description of Artificial Sequence: Synthetic coding sequence

SEQ ID NO: 164859 - DNA, 1257 bp, Artificial Sequence; identical to SEQ ID NO: 164830
  Description of Artificial Sequence: Synthetic coding sequence

SEQ ID NO: 164860 - DNA, 1257 bp, Artificial Sequence; identical to SEQ ID NO: 164830
  Description of Artificial Sequence: Synthetic coding sequence

SEQ ID NO: 164861 - DNA, 1257 bp, Artificial Sequence; identical to SEQ ID NO: 164830
  Description of Artificial Sequence: Synthetic coding sequence

SEQ ID NO: 164862 - DNA, 1284 bp, Artificial Sequence
  Description of Artificial Sequence: Synthetic coding sequence
atgggctctgtgaggaccaaccgctacagcatcgtgagcagcgaggaggatggcatgaagctggccaccatggctgtggccaacggctttggaaatggcaagagcaaggtgcacacccggcagcagtgccgcagcagatttgtgaagaaggatggccactgcaatgtgcagttcatcaacgtgggggagaagggccagcgctacctggccgacatcttcaccacctgtgtggacatccgctggcgctggatgctggtgatcttctgcctggcctttgtgctgtcctggctgttcttcggctgtgtgttctggctgattgccctgctgcacggggacctggatgccagcaaggagggcaaggcctgtgtgtctgaggtgaacagcttcaccgctgccttcctgttcagcattgagacccagaccaccatcggctacggcttccgctgtgtgacagatgaatgtcccatcgctgtgttcatggtggtgttccagagcatcgtgggctgcatcattgatgccttcatcatcggggctgtgatggccaagatggccaagcccaagaagagaaatgagaccctggtgttcagccacaatgctgtgattgccatgagagatggcaagctgtgcctgatgtggagggtgggcaacctgaggaagagccacctggtggaggcccacgtgcgggcccagctgctgaagagccgcatcaccagcgagggggagtacatccccctggaccagattgacatcaacgtgggctttgacagcggcatcgaccgcatcttcctggtgagccccatcaccatcgtgcatgaaattgatgaggacagccccctgtatgacctgagcaagcaggacatcgacaatgctgactttgagatcgtggtgatcctggagggcatggtggaggccacagccatgaccacccagtgccgcagcagctacctggccaatgagatcctgtggggccacagatatgagcctgtgctgtttgaggagaagcactactacaaggtggactacagccgcttccacaagacctatgaggtgcccaacacccccctgtgcagcgcccgggacctggccgagaagaagtacatcctgagcaatgccaacagcttctgctatgaaaatgaggtggccctgaccagcaaggaggaggatgacagtgaaaatggagtgcctgagagcaccagcacagacaccccaccagacatcgacctgcacaaccaggcctctgtgcccctggagccccggcccctgcggcgggagagcgagatctag

SEQ ID NO: 164863 - DNA, 1284 bp, Artificial Sequence; identical to SEQ ID NO: 164862
  Description of Artificial Sequence: Synthetic coding sequence

SEQ ID NO: 164864 - DNA, 1506 bp, Artificial Sequence
  Description of Artificial Sequence: Synthetic coding sequence
atgtctgccctgcggaggaagtttggagatgactaccaggtggtgaccaccagcagcagcggcagcggcctgcagccccagggccctggccaggacccccagcagcagctggtgcccaagaagaagaggcagagatttgtggacaagaatggccgctgcaatgtgcagcacggcaacctgggcagcgagaccagccgctacctgagtgacctcttcaccaccctggtggacctgaagtggcgctggaacctcttcatcttcatcctgacctacacagtggcctggctgttcatggcctccatgtggtgggtgattgcctacaccaggggggacctgaacaaggcccacgtgggcaactacaccccctgtgtggccaacgtgtacaacttccccagcgccttcctgttcttcatcgagacagaggccaccatcggctacggctaccgctacatcacagacaagtgcccagagggcatcatcctcttcctgttccagagcatcctgggcagcatcgtggatgccttcctgattggctgcatgttcatcaagatgagccagcccaagaagagagctgagaccctgatgttttctgaacatgctgtgatctccatgagagatggcaagctgaccctgatgttccgggtgggcaacctgaggaacagccacatggtgtctgcccagatccgctgcaagctgctgaagagccggcagaccccagagggggagttcctgcccctggaccagctggagctggatgtgggcttcagcactggagctgaccagctgttcctggtgagccccctgaccatctgccacgtgattgatgccaagagccccttctatgacctgagccagaggtccatgcagacagagcagtttgaaattgtggtgatcctggagggcatcgtggagaccaccggcatgacctgccaggcccggaccagctacacagaagatgaggtgctgtggggccaccgcttcttccctgtgatcagcctggaggagggcttcttcaaggtggactacagccagttccacgccacctttgaggtgcccaccccaccctacagcgtgaaggagcaggaggagatgctgctgatgagcagccccctcatcgccccagccatcaccaacagcaaggagcggcacaacagcgtggagtgcctggatggcctggatgacatcaccaccaagctgcccagcaagctgcagaagatcaccggccgggaggacttccccaagaagctgctgaggatgagcagcaccaccagcgagaaggcctacagcctgggggacctgcccatgaagctgcagaggatcagctctgtgcccggcaacagcgaggagaagctggtgtccaagaccaccaagatgctgagtgaccccatgagccagagcgtggccgacctgccccccaagctgcagaagatggccggcggggccgccaggatggagggcaacctgcctgccaagctgaggaagatgaacagcgaccgcttcacctag

SEQ ID NO: 164865 - DNA, 708 bp, Artificial Sequence
  Description of Artificial Sequence: Synthetic coding sequence
atgtctgccctgcggaggaagtttggagatgactaccaggtggtgaccaccagcagcagcggcagcggcctgcagccccagggccctggccaggacccccagcagcagctggtgcccaagaagaagaggcagagatttgtggacaagaatggccgctgcaatgtgcagcacggcaacctgggcagcgagaccagccgctacctgagtgacctcttcaccaccctggtggacctgaagtggcgctggaacctcttcatcttcatcctgacctacacagtggcctggctgttcatggcctccatgtggtgggtgattgcctacaccaggggggacctgaacaaggcccacgtgggcaactacaccccctgtgtggccaacgtgtacaacttccccagcgccttcctgttcttcatcgagacagaggccaccatcggctacggctaccgctacatcacagacaagtgcccagagggcatcatcctcttcctgttccagagcatcctgggcagcatcgtggatgccttcctgattggctgcatgttcatcaagatgagccagcccaagaagagagctgagaccctgatgttttctgaacatgctgtgatctccatgagagatggcaagctgaccctgatgttccgggtgggcaacctgaggaacagccacatggtgtctgcccagatccgctgcaagctgctgaagggctag

SEQ ID NO: 164866 - DNA, 1338 bp, Artificial Sequence
  Description of Artificial Sequence: Synthetic coding sequence
atgcacggccacagcagaaatggccaggcccacgtgcccaggaggaagagaagaaacagatttgtgaagaagaatggccagtgcaatgtgtactttgccaacctgagcaacaagagccagcgctacatggctgacatcttcaccacctgtgtggacacccgctggagatacatgctgatgatcttctctgctgccttcctggtgtcctggctgttcttcggcctgctcttctggtgcatcgccttcttccacggggacctggaggccagccctggggtgcctgctgctgggggccctgctgctgggggcggcggggccgcccctgtggcccccaagccctgcatcatgcacgtgaatggcttcctgggcgccttcctgttctctgtggagacccagaccaccatcggctacggcttccgctgtgtgacagaagaatgtcccctggccgtgattgctgtggtggtgcagagcatcgtgggctgtgtgattgacagcttcatgattggcaccatcatggccaagatggcccggcccaagaagagggcccagaccctgctcttcagccaccacgctgtgatctctgtgagagatggcaagctgtgcctgatgtggagggtgggcaacctgaggaagagccacatcgtggaggcccacgtgcgggcccagctgatcaagccctacatgacccaggagggggagtacctgcccctggaccagagggacctgaatgtgggctatgacatcggcctggaccgcatcttcctggtgagccccatcatcatcgtgcatgaaattgatgaggacagccccctgtatggcatgggcaaggaggagctggagagcgaggactttgagatcgtggtgatcctggagggcatggtggaggccacagccatgaccacccaggcccggagcagctacctggccagcgagatcctgtggggccacagatttgagcctgtggtgtttgaggagaagagccactacaaggtggactacagccgcttccacaagacctatgaggtggccggcaccccctgctgcagcgcccgggagctgcaggagagcaagatcaccgtgctgcctgcccctcctcctcctccttctgccttctgctatgaaaatgagctggccctgatgagccaggaggaggaggagatggaggaggaggccgctgctgctgctgctgtggccgccggcctgggcctggaggccggcagcaaggaggaggccggcatcatccgcatgctggagtttggcagccacctggacctggagaggatgcaggccagcctgcccctggacaacatctcctaccgccgggagagcgccatctag

SEQ ID NO: 164867 - DNA, 1260 bp, Artificial Sequence
  Description of Artificial Sequence: Synthetic coding sequence
atggccggggacagcagaaatgccatgaaccaggacatggagattggagtgaccccctgggaccccaagaagatccccaagcaggcccgggactatgtgcccatcgccacagacaggacccggctgctggccgagggcaagaagccccggcagcgctacatggagaagtctggaaaatgtaatgtgcaccacggcaatgtgcaggagacctaccgctacctgagtgacctcttcaccaccctggtggacctgaagtggaggttcaacctgctggtgttcaccatggtgtacacagtgacctggctgttcttcggcttcatctggtggctgattgcctacatccggggggacctggaccacgtgggggaccaggagtggatcccctgtgtggagaacctgagcggctttgtgtctgccttcctgttcagcattgaaacagagaccaccatcggctacggcttccgggtcatcacagagaagtgcccagagggcatcatcctgctgctggtgcaggccatcctgggcagcatcgtgaatgccttcatggtgggctgcatgtttgtgaagatcagccagcccaagaagagagctgagaccctgatgttcagcaacaatgctgtgatctccatgagagatgagaagctgtgcctgatgttccgggtgggggacctgaggaacagccacatcgtggaggccagcatccgggccaagctgatcaagagccggcagaccaaggagggggagttcatccccctgaaccagacagacatcaacgtgggctttgacacaggagatgacaggctcttcctggtgagccccctcatcatcagccatgagatcaaccagaagagccccttctgggagatgagccaggcccagctgcaccaggaggagtttgaggtggtggtgatcctggagggcatggtggaggccaccggcatgacctgccaggcccggagcagctacatggacacagaggtgctgtggggccaccgcttcacccctgtgctgaccctggagaagggcttctatgaggtggactacaacaccttccatgacacctatgagaccaacacccccagctgctgtgccaaggagctggccgagatgaagcgggagggccgcctgctgcagtacctgcccagcccccccctgctgggcggctgtgccgaggccggcctggatgctgaggccgagcagaatgaagaagatgagcccaagggcctgggcggcagccgggaggcccggggctctgtgtag

SEQ ID NO: 164868 - DNA, 1260 bp, Artificial Sequence; identical to SEQ ID NO: 164867
  Description of Artificial Sequence: Synthetic coding sequence

SEQ ID NO: 164869 - DNA, 1260 bp, Artificial Sequence; identical to SEQ ID NO: 164867
  Description of Artificial Sequence: Synthetic coding sequence

SEQ ID NO: 164870 - DNA, 1272 bp, Artificial Sequence
  Description of Artificial Sequence: Synthetic coding sequence
atggccaagctgacagagagcatgaccaacgtgctggagggggacagcatggaccaggatgtggagagccctgtggccatccaccagcccaagctgcccaagcaggccagagatgacctgcccaggcacatcagccgggacaggaccaagaggaagatccagcgctacgtgaggaaggatggcaagtgcaatgtgcaccacggcaatgtgcgggagacctaccgctacctgacagacatcttcaccaccctggtggacctgaagtggaggttcaacctgctgatctttgtgatggtgtacacagtgacctggctgttcttcggcatgatctggtggctgattgcctacatccggggggacatggaccacatcgaggaccccagctggaccccctgtgtgaccaacctgaatggatttgtgtctgccttcctgttcagcattgaaacagagaccaccatcggctacggctacagagtcatcacagacaagtgcccagagggcatcatcctgctgctgatccagagcgtgctgggcagcatcgtgaatgccttcatggtgggctgcatgtttgtgaagatcagccagcccaagaagagagctgagaccctggtgttcagcacccatgctgtgatctccatgagagatggcaagctgtgcctgatgttccgggtgggggacctgaggaacagccacatcgtggaggccagcatccgggccaagctgatcaagagcaagcagaccagcgagggggagttcatccccctgaaccagacagacatcaacgtgggctactacacaggagatgacaggctcttcctggtgagccccctcatcatcagccatgagatcaaccagcagagccccttctgggagatcagcaaggcccagctgcccaaggaggagctggagatcgtggtgatcctggagggcatggtggaggccaccggcatgacctgccaggcccggagcagctacatcaccagcgagatcctgtggggctaccgcttcacccctgtgctgaccctggaggatggcttctatgaggtggactacaacagcttccacgagacctatgagaccagcacccccagcctgagcgccaaggagctggccgagctggccagcagagctgagctgcccctgtcctggagcgtgagcagcaagctgaaccagcacgccgagctggagacagaggaggaggagaagaacctggaggagcagacagaaagaaatggagatgtggccaacctggagaatgaaagcaaggtgtag

SEQ ID NO: 164871 - DNA, 1272 bp, Artificial Sequence; identical to SEQ ID NO: 164870
  Description of Artificial Sequence: Synthetic coding sequence

SEQ ID NO: 164872 - DNA, 1275 bp, Artificial Sequence
  Description of Artificial Sequence: Synthetic coding sequence
atgctggccaggaagagcatcatccctgaggagtatgtgctggccagaattgctgctgagaacctgaggaagccccgcatccgggaccggctgcccaaggcccgcttcatcgccaagagcggggcctgcaacctggcccacaagaacatccgggagcagggccgcttcctgcaggacatcttcaccaccctggtggacctgaagtggaggcacaccctggtgatcttcaccatgtccttcctgtgctcctggctgctgtttgccatcatgtggtggctggtggcctttgcccacggggacatctatgcctacatggagaagagcggcatggagaagagcggcctggagagcacagtgtgtgtgaccaacgtgcgctccttcaccagcgccttcctgttcagcattgaggtgcaggtgaccatcggctttggaggccgcatgatgacagaagaatgtcccctggccatcaccgtgctgatcctgcagaacatcgtgggcctcatcatcaatgctgtgatgctgggctgcatcttcatgaagacagcccaggcccaccggcgggcagagaccctcatcttcagcagacatgctgtgattgctgtgagaaatggcaagctgtgcttcatgttccgggtgggggacctgaggaagtccatgatcatcagcgcctctgtgcgcatccaggtggtgaagaagaccaccaccccagagggggaggtggtgcccatccaccagctggacatccctgtggacaaccccatcgagagcaacaacatcttcctggtggcccccctcatcatctgccacgtgattgacaagaggagccccctgtatgacatcagcgccacagacctggccaaccaggacctggaggtgattgtcatcctggagggcgtggtggagaccaccggcatcaccacccaggcccggaccagctacatcgccgaggagatccagtggggccacagatttgtgtccatcgtgacagaggaggagggcgtgtacagcgtggactacagcaagtttggaaacacagtgaaggtggccgccccccgctgcagcgcccgggagctggatgagaagcccagcatcctgatccagaccctgcagaagtctgagctgagccaccagaacagcctgaggaagagaaattccatgagaagaaacaacagcatgagaagaaacaacagcatcagaagaaacaacagcagcctgatggtgcccaaggtgcagttcatgaccccagagggcaaccagaacaccagcgagagctag

SEQ ID NO: 164873 - DNA, 345 bp, Artificial Sequence
  Description of Artificial Sequence: Synthetic coding sequence
atgctggccaggaagagcatcatccctgaggagtatgtgctggccagaattgctgctgagaacctgaggaagccccgcatccgggaccggctgcccaaggcccgcttcatcgccaagagcggggcctgcaacctggcccacaagaacatccgggagcagggccgcttcctgcaggacatcttcaccaccctggtggacctgaagtggaggcacaccctggtgatcttcaccatgtccttcctgtgctcctggctgctgtttgccatcatgtggtggctggtggcctttgcccacggggacatctatgcctacatggagaagagcggcatggagaagtctggatag

SEQ ID NO: 164874 - DNA, 1275 bp, Artificial Sequence; identical to SEQ ID NO: 164872
  Description of Artificial Sequence: Synthetic coding sequence

SEQ ID NO: 164875 - DNA, 774 bp, Artificial Sequence
  Description of Artificial Sequence: Synthetic coding sequence
atgacagccttccctgccagcggcaagaagcgggagacagactacagtgatggagaccccctggatgtgcacaagaggctgcccagcagcgctggagaagatagagctgtgatgctgggctttgccatgatgggcttctctgtgctgatgttcttcctgctgggcaccaccatcctgaagcccttcatgctgagcatccagcgggaggagagcacctgcacagccatccacacagacatcatggatgactggctggactgtgccttcacctgtggggtgcactgccacggccagggcaagtacccctgcctgcaggtgtttgtgaacctgagccaccctggccagaaggccctgctgcactacaatgaggaggccgtgcagatcaaccccaagtgcttctacacccccaagtgccaccaggacagaaatgacctgctgaacagcgccctggacatcaaggagttctttgaccacaagaatggcacccccttcagctgcttctacagccctgccagccagagtgaagatgtgatcctgatcaagaagtatgaccagatggccatcttccactgcctcttctggcccagcctgaccctgctgggcggggccctgattgtgggcatggtgcggctgacccagcacctgagcctgctgtgtgagaagtacagcacagtggtgagagatgaggtgggcggcaaggtgccctacatcgagcagcaccagttcaagctgtgcatcatgaggaggagcaagggccgggcagagaagagctag

SEQ ID NO: 164876 - DNA, 522 bp, Artificial Sequence
  Description of Artificial Sequence: Synthetic coding sequence
atgcagcccttcagcatccctgtgcagatcaccctgcagggcagcagaagacggcagggccgcacagccttccctgccagcggcaagaagcgggagacagactacagtgatggagaccccctggatgtgcacaagaggctgcccagcagcgctggagaagatagagctgtgatgctgggctttgccatgatgggcttctctgtgctgatgttcttcctgctgggcaccaccatcctgaagcccttcatgctgagcatccagcgggaggagagcacctgcacagccatccacacagacatcatggatgactggctggactgtgccttcacctgtggggtgcactgccacggccagggcaagtacccctgcctgcaggtgtttgtgaacctgagccaccctggccagaaggccctgctgcactacaatgaggaggccgtgcagatcaaccccaagagagatgtgacagactgccgggtgaaggagaagcagaccctgactgtgtctgatgagcacaagcagtag

SEQ ID NO: 164877 - DNA, 840 bp, Artificial Sequence
  Description of Artificial Sequence: Synthetic coding sequence
atggacttcagccccagcagcgagctgggcttccactttgtggccttcatcctgctgaccaggcacaggacagccttccctgccagcggcaagaagcgggagacagactacagtgatggagaccccctggatgtgcacaagaggctgcccagcagcgctggagaagatagagctgtgatgctgggctttgccatgatgggcttctctgtgctgatgttcttcctgctgggcaccaccatcctgaagcccttcatgctgagcatccagcgggaggagagcacctgcacagccatccacacagacatcatggatgactggctggactgtgccttcacctgtggggtgcactgccacggccagggcaagtacccctgcctgcaggtgtttgtgaacctgagccaccctggccagaaggccctgctgcactacaatgaggaggccgtgcagatcaaccccaagtgcttctacacccccaagtgccaccaggacagaaatgacctgctgaacagcgccctggacatcaaggagttctttgaccacaagaatggcacccccttcagctgcttctacagccctgccagccagagtgaagatgtgatcctgatcaagaagtatgaccagatggccatcttccactgcctcttctggcccagcctgaccctgctgggcggggccctgattgtgggcatggtgcggctgacccagcacctgagcctgctgtgtgagaagtacagcacagtggtgagagatgaggtgggcggcaaggtgccctacatcgagcagcaccagttcaagctgtgcatcatgaggaggagcaagggccgggcagagaagagctag

SEQ ID NO: 164878 - DNA, 834 bp, Artificial Sequence
  Description of Artificial Sequence: Synthetic coding sequence
atgcagcccttcagcatccctgtgcagatcaccctgcagggcagcagaagacggcagggccgcacagccttccctgccagcggcaagaagcgggagacagactacagtgatggagaccccctggatgtgcacaagaggctgcccagcagcgctggagaagatagagctgtgatgctgggctttgccatgatgggcttctctgtgctgatgttcttcctgctgggcaccaccatcctgaagcccttcatgctgagcatccagcgggaggagagcacctgcacagccatccacacagacatcatggatgactggctggactgtgccttcacctgtggggtgcactgccacggccagggcaagtacccctgcctgcaggtgtttgtgaacctgagccaccctggccagaaggccctgctgcactacaatgaggaggccgtgcagatcaaccccaagtgcttctacacccccaagtgccaccaggacagaaatgacctgctgaacagcgccctggacatcaaggagttctttgaccacaagaatggcacccccttcagctgcttctacagccctgccagccagagtgaagatgtgatcctgatcaagaagtatgaccagatggccatcttccactgcctcttctggcccagcctgaccctgctgggcggggccctgattgtgggcatggtgcggctgacccagcacctgagcctgctgtgtgagaagtacagcacagtggtgagagatgaggtgggcggcaaggtgccctacatcgagcagcaccagttcaagctgtgcatcatgaggaggagcaagggccgggcagagaagagctag

SEQ ID NO: 164879 - DNA, 828 bp, Artificial Sequence
  Description of Artificial Sequence: Synthetic coding sequence
atgttccccctgctgtatgagctgacagctgtgagccccagccccttcccccagaggacagccttccctgccagcggcaagaagcgggagacagactacagtgatggagaccccctggatgtgcacaagaggctgcccagcagcgctggagaagatagagctgtgatgctgggctttgccatgatgggcttctctgtgctgatgttcttcctgctgggcaccaccatcctgaagcccttcatgctgagcatccagcgggaggagagcacctgcacagccatccacacagacatcatggatgactggctggactgtgccttcacctgtggggtgcactgccacggccagggcaagtacccctgcctgcaggtgtttgtgaacctgagccaccctggccagaaggccctgctgcactacaatgaggaggccgtgcagatcaaccccaagtgcttctacacccccaagtgccaccaggacagaaatgacctgctgaacagcgccctggacatcaaggagttctttgaccacaagaatggcacccccttcagctgcttctacagccctgccagccagagtgaagatgtgatcctgatcaagaagtatgaccagatggccatcttccactgcctcttctggcccagcctgaccctgctgggcggggccctgattgtgggcatggtgcggctgacccagcacctgagcctgctgtgtgagaagtacagcacagtggtgagagatgaggtgggcggcaaggtgccctacatcgagcagcaccagttcaagctgtgcatcatgaggaggagcaagggccgggcagagaagagctag

SEQ ID NO: 164880 - DNA, 774 bp, Artificial Sequence; identical to SEQ ID NO: 164875
  Description of Artificial Sequence: Synthetic coding sequence

SEQ ID NO: 164881 - DNA, 3537 bp, Artificial Sequence
  Description of Artificial Sequence: Synthetic coding sequence
atggccaatggaggcggcggcggcggcggcagcagcggcggcggcggcggcggcggcggcagcagcctgaggatgagcagcaacatccacgccaaccacctgagcctggatgccagcagcagcagcagcagcagcagcagcagcagcagcagcagcagcagcagcagcagcagcagctctgtgcatgagcccaagatggatgccctgatcatccctgtgaccatggaggtgccctgtgacagccggggccagaggatgtggtgggccttcctggccagctccatggtgaccttctttggaggcctcttcatcatcctgctgtggaggaccctgaagtacctgtggacagtgtgctgccactgcggcggcaagaccaaggaggcccagaagatcaacaacggcagcagccaggctgatggcaccctgaagcctgtggatgagaaggaggaggccgtggccgctgaggtgggctggatgacctctgtgaaggactgggccggcgtgatgatcagcgcccagaccctgaccggccgggtgctggtggtgctggtgtttgccctgagcattggagccctggtgatctacttcatcgacagcagcaaccccatcgagagctgccagaacttctacaaggacttcaccctgcagattgacatggccttcaacgtgttcttcctgctgtacttcggcctgcgcttcatcgccgccaatgacaagctgtggttctggctggaggtgaacagcgtggtggacttcttcaccgtgccccctgtgtttgtgtctgtgtacctgaacagatcctggctgggcctgcgcttcctgcgggccctgcggctcatccagttcagcgagatcctgcagttcctgaacatcctgaagaccagcaacagcatcaagctggtgaacctgctgagcatcttcatcagcacctggctgacagctgctggcttcatccacctggtggagaacagcggggacccctgggagaacttccagaacaaccaggccctgacctactgggagtgtgtgtacctgctgatggtgaccatgagcacagtgggctatggagatgtgtatgccaagaccaccctgggccgcctcttcatggtgttcttcatcctgggcggcctggccatgtttgccagctatgtgcctgagatcatcgagctgattggcaacaggaagaagtatggaggcagctacagcgctgtgtctggcaggaagcacatcgtggtgtgtggccacatcaccctggagagcgtgagcaacttcctgaaggacttcctgcacaaggacagagatgatgtgaatgtggagatcgtgttcctgcacaacatcagccccaacctggagctggaggccctcttcaagaggcacttcacccaggtggagttctaccagggctctgtgctgaacccccatgacctggcccgggtgaagattgaatctgcagatgcctgcctgatcctggccaacaagtactgtgccgaccctgatgctgaagatgccagcaacatcatgagggtcatcagcatcaagaactaccaccccaagatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccgcatcctgatcaaccctggcaaccacctgaagatccaggagggcaccctgggcttcttcatcgccagtgatgccaaggaggtgaagagggccttcttctactgcaaggcctgccatgatgacatcacagaccccaagaggatcaagaagtgtggctgcaagaggctggaggatgagcagcccagcaccctgagccccaagaagaagcagagaaatggaggcatgaggaacagccccaacaccagccccaagctgatgagacatgaccccctgctgatccctggaaatgaccagattgacaacatggacagcaatgtgaagaagtatgacagcacaggcatgttccactggtgtgcccccaaggagattgagaaggtgatcctgaccaggtctgaggccgccatgacagtgctgagcggccacgtggtggtgtgcatctttggagatgtgagcagcgccctgattggcctgaggaacctggtgatgcccctgcgggccagcaacttccactaccacgagctgaagcacatcgtgtttgtgggcagcattgagtacctgaagcgggagtgggagaccctgcacaacttccccaaggtgtccatcctgcccggcacccccctgagcagagctgacctgcgggctgtgaacatcaacctgtgtgacatgtgtgtgatcctgagcgccaaccagaacaacattgatgacaccagcctgcaggacaaggagtgcatcctggccagcctgaacatcaagtccatgcagtttgatgacagcattggagtgctgcaggccaacagccagggcttcaccccacctggcatggacaggagcagcccagacaacagccctgtgcacggcatgctgcggcagcccagcatcaccactggagtgaacatccccatcatcacagagctggtgaatgacaccaacgtgcagttcctggaccaggatgatgatgatgatcctgacacagagctgtacctgacccagccctttgcctgtggcacagcctttgctgtgtctgtgctggacagcctgatgtctgccacctacttcaatgacaacatcctgaccctcatccgcaccctggtgactggaggagccaccccagagctggaggccctgattgctgaagaaaatgccctgcggggcggctacagcaccccccagaccctggccaacagagaccgctgccgggtggcccagctggccctgctggatggcccctttgctgacctgggagatggcggctgctatggagacctcttctgcaaggccctgaagacctacaacatgctgtgcttcggcatctaccgcctgagagatgcccacctgagcacccccagccagtgcaccaagagatatgtgatcaccaaccccccctatgaatttgagctggtgcccacagacctgatcttctgcctgatgcagtttgaccacaatgccggccagagccgggccagcctgagccacagcagccacagcagccagagcagcagcaagaagagcagctctgtgcacagcatccccagcacagccaaccggcagaaccggcccaagagccgggagagccgggacaagcagaagtatgtgcaggaggagcggctgtag

SEQ ID NO: 164882 - DNA, 3633 bp, Artificial Sequence
  Description of Artificial Sequence: Synthetic coding sequence
agcaacatccacgccaaccacctgagcctggatgccagcagcagcagcagcagcagcagcagcagcagcagcagcagcagcagcagcagcagcagcagctctgtgcatgagcccaagatggatgccctgatcatccctgtgaccatggaggtgccctgtgacagccggggccagaggatgtggtgggccttcctggccagctccatggtgaccttctttggaggcctcttcatcatcctgctgtggaggaccctgaagtacctgtggacagtgtgctgccactgcggcggcaagaccaaggaggcccagaagatcaacaacggcagcagccaggctgatggcaccctgaagcctgtggatgagaaggaggaggccgtggccgctgaggtgggctggatgacctctgtgaaggactgggccggcgtgatgatcagcgcccagaccctgaccggccgggtgctggtggtgctggtgtttgccctgagcattggagccctggtgatctacttcatcgacagcagcaaccccatcgagagctgccagaacttctacaaggacttcaccctgcagattgacatggccttcaacgtgttcttcctgctgtacttcggcctgcgcttcatcgccgccaatgacaagctgtggttctggctggaggtgaacagcgtggtggacttcttcaccgtgccccctgtgtttgtgtctgtgtacctgaacagatcctggctgggcctgcgcttcctgcgggccctgcggctcatccagttcagcgagatcctgcagttcctgaacatcctgaagaccagcaacagcatcaagctggtgaacctgctgagcatcttcatcagcacctggctgacagctgctggcttcatccacctggtggagaacagcggggacccctgggagaacttccagaacaaccaggccctgacctactgggagtgtgtgtacctgctgatggtgaccatgagcacagtgggctatggagatgtgtatgccaagaccaccctgggccgcctcttcatggtgttcttcatcctgggcggcctggccatgtttgccagctatgtgcctgagatcatcgagctgattggcaacaggaagaagtatggaggcagctacagcgctgtgtctggcaggaagcacatcgtggtgtgtggccacatcaccctggagagcgtgagcaacttcctgaaggacttcctgcacaaggacagagatgatgtgaatgtggagatcgtgttcctgcacaacatcagccccaacctggagctggaggccctcttcaagaggcacttcacccaggtggagttctaccagggctctgtgctgaacccccatgacctggcccgggtgaagattgaatctgcagatgcctgcctgatcctggccaacaagtactgtgccgaccctgatgctgaagatgccagcaacatcatgagggtcatcagcatcaagaactaccaccccaagatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccgcatcctgatcaaccctggcaaccacctgaagatccaggagggcaccctgggcttcttcatcgccagtgatgccaaggaggtgaagagggccttcttctactgcaaggcctgccatgatgacatcacagaccccaagaggatcaagaagtgtggctgcaagaggcccaagatgagcatctacaagaggatgagaagagcctgctgctttgactgtggccgctctgagcgggactgcagctgcatgagcggccgggtgagaggaaatgtggacaccctggagcgggccttccccctgagctctgtgtctgtgaatgactgcagcaccagcttccgggcctttgaagatgagcagcccagcaccctgagccccaagaagaagcagagaaatggaggcatgaggaacagccccaacaccagccccaagctgatgagacatgaccccctgctgatccctggaaatgaccagattgacaacatggacagcaatgtgaagaagtatgacagcacaggcatgttccactggtgtgcccccaaggagattgagaaggtgatcctgaccaggtctgaggccgccatgacagtgctgagcggccacgtggtggtgtgcatctttggagatgtgagcagcgccctgattggcctgaggaacctggtgatgcccctgcgggccagcaacttccactaccacgagctgaagcacatcgtgtttgtgggcagcattgagtacctgaagcgggagtgggagaccctgcacaacttccccaaggtgtccatcctgcccggcacccccctgagcagagctgacctgcgggctgtgaacatcaacctgtgtgacatgtgtgtgatcctgagcgccaaccagaacaacattgatgacaccagcctgcaggacaaggagtgcatcctggccagcctgaacatcaagtccatgcagtttgatgacagcattggagtgctgcaggccaacagccagggcttcaccccacctggcatggacaggagcagcccagacaacagccctgtgcacggcatgctgcggcagcccagcatcaccactggagtgaacatccccatcatcacagagctggtgaatgacaccaacgtgcagttcctggaccaggatgatgatgatgatcctgacacagagctgtacctgacccagccctttgcctgtggcacagcctttgctgtgtctgtgctggacagcctgatgtctgccacctacttcaatgacaacatcctgaccctcatccgcaccctggtgactggaggagccaccccagagctggaggccctgattgctgaagaaaatgccctgcggggcggctacagcaccccccagaccctggccaacagagaccgctgccgggtggcccagctggccctgctggatggcccctttgctgacctgggagatggcggctgctatggagacctcttctgcaaggccctgaagacctacaacatgctgtgcttcggcatctaccgcctgagagatgcccacctgagcacccccagccagtgcaccaagagatatgtgatcaccaaccccccctatgaatttgagctggtgcccacagacctgatcttctgcctgatgcagtttgaccacaatgccggccagagccgggccagcctgagccacagcagccacagcagccagagcagcagcaagaagagcagctctgtgcacagcatccccagcacagccaaccggcagaaccggcccaagagccgggagagccgggacaagcagaagtatgtgcaggaggagcggctgtag

SEQ ID NO: 164883 - DNA, 3720 bp, Artificial Sequence
  Description of Artificial Sequence: Synthetic coding sequence
atggccaatggaggcggcggcggcggcggcagcagcggcggcggcggcggcggcggcggcagcagcctgaggatgagcagcaacatccacgccaaccacctgagcctggatgccagcagcagcagcagcagcagcagcagcagcagcagcagcagcagcagcagcagcagcagcagctctgtgcatgagcccaagatggatgccctgatcatccctgtgaccatggaggtgccctgtgacagccggggccagaggatgtggtgggccttcctggccagctccatggtgaccttctttggaggcctcttcatcatcctgctgtggaggaccctgaagtacctgtggacagtgtgctgccactgcggcggcaagaccaaggaggcccagaagatcaacaacggcagcagccaggctgatggcaccctgaagcctgtggatgagaaggaggaggccgtggccgctgaggtgggctggatgacctctgtgaaggactgggccggcgtgatgatcagcgcccagaccctgaccggccgggtgctggtggtgctggtgtttgccctgagcattggagccctggtgatctacttcatcgacagcagcaaccccatcgagagctgccagaacttctacaaggacttcaccctgcagattgacatggccttcaacgtgttcttcctgctgtacttcggcctgcgcttcatcgccgccaatgacaagctgtggttctggctggaggtgaacagcgtggtggacttcttcaccgtgccccctgtgtttgtgtctgtgtacctgaacagatcctggctgggcctgcgcttcctgcgggccctgcggctcatccagttcagcgagatcctgcagttcctgaacatcctgaagaccagcaacagcatcaagctggtgaacctgctgagcatcttcatcagcacctggctgacagctgctggcttcatccacctggtggagaacagcggggacccctgggagaacttccagaacaaccaggccctgacctactgggagtgtgtgtacctgctgatggtgaccatgagcacagtgggctatggagatgtgtatgccaagaccaccctgggccgcctcttcatggtgttcttcatcctgggcggcctggccatgtttgccagctatgtgcctgagatcatcgagctgattggcaacaggaagaagtatggaggcagctacagcgctgtgtctggcaggaagcacatcgtggtgtgtggccacatcaccctggagagcgtgagcaacttcctgaaggacttcctgcacaaggacagagatgatgtgaatgtggagatcgtgttcctgcacaacatcagccccaacctggagctggaggccctcttcaagaggcacttcacccaggtggagttctaccagggctctgtgctgaacccccatgacctggcccgggtgaagattgaatctgcagatgcctgcctgatcctggccaacaagtactgtgccgaccctgatgctgaagatgccagcaacatcatgagggtcatcagcatcaagaactaccaccccaagatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccgcatcctgatcaaccctggcaaccacctgaagatccaggagggcaccctgggcttcttcatcgccagtgatgccaaggaggtgaagagggccttcttctactgcaaggcctgccatgatgacatcacagaccccaagaggatcaagaagtgtggctgcaagaggcgctgggaggagcactgcagcctgtggaggctggagagcaaaggaaatgtgcggcggctgaactactgccggggccagcagaccttctctgtgaaggtgaaggtggccgcccggagccgctacagcaaggacccctttgagttcaagaaggagacccccaacagccggctggtgacagagcctgtggaggatgagcagcccagcaccctgagccccaagaagaagcagagaaatggaggcatgaggaacagccccaacaccagccccaagctgatgagacatgaccccctgctgatccctggaaatgaccagattgacaacatggacagcaatgtgaagaagtatgacagcacaggcatgttccactggtgtgcccccaaggagattgagaaggtgatcctgaccaggtctgaggccgccatgacagtgctgagcggccacgtggtggtgtgcatctttggagatgtgtcctctgccctgattggcctgaggaacctggtgatgcccctgcgggccagcaacttccactaccacgagctgaagcacatcgtgtttgtgggcagcattgagtacctgaagcgggagtgggagaccctgcacaacttccccaaggtgtccatcctgcccggcacccccctgagcagagctgacctgcgggctgtgaacatcaacctgtgtgacatgtgtgtgatcctgagcgccaaccagaacaacattgatgacaccagcctgcaggacaaggagtgcatcctggccagcctgaacatcaagtccatgcagtttgatgacagcattggagtgctgcaggccaacagccagggcttcaccccacctggcatggacaggagcagcccagacaacagccctgtgcacggcatgctgcggcagcccagcatcaccaccggggtgaacatccccatcatcacagagctggtgaatgacaccaacgtgcagttcctggaccaggatgatgatgatgatcctgacacagagctgtacctgacccagccctttgcctgtggcacagcctttgctgtgtctgtgctggacagcctgatgtctgccacctacttcaatgacaacatcctgaccctcatccgcaccctggtgactggaggagccaccccagagctggaggccctgattgctgaggagaatgccctgcggggcggctacagcaccccccagaccctggccaacagagaccgctgccgggtggcccagctggccctgctggatggcccctttgctgacctgggagatggcggctgctacggggacctcttctgcaaggccctgaagacctacaacatgctgtgcttcggcatctaccgcctgagagatgcccacctgagcacccccagccagtgcaccaagcgctacgtgatcaccaaccccccctatgaatttgagctggtgcccacagacctgatcttctgcctgatgcagtttgaccacaatgccggccagagccgggccagcctgagccacagcagccacagcagccagagcagcagcaagaagagcagctctgtgcacagcatccccagcacagccaaccggcagaaccggcccaagagccgggagagccgggacaagcagaagtatgtgcaggaggagcggctgtag

SEQ ID NO: 164884 - DNA, 3549 bp, Artificial Sequence
  Description of Artificial Sequence: Synthetic coding sequence
tgaagcagcagcagcagcagcagcagcagctctgtgcatgagcccaagatggatgccctgatcatccctgtgaccatggaggtgccctgtgacagccggggccagaggatgtggtgggccttcctggccagctccatggtgaccttcttcggcggcctcttcatcatcctgctgtggaggaccctgaagtacctgtggacagtgtgctgccactgcggcggcaagaccaaggaggcccagaagatcaacaacggcagcagccaggctgatggcaccctgaagcctgtggatgagaaggaggaggccgtggccgctgaggtgggctggatgacctctgtgaaggactgggccggcgtgatgatcagcgcccagaccctgaccggccgggtgctggtggtgctggtgtttgccctgagcatcggggccctggtgatctacttcatcgacagcagcaaccccatcgagagctgccagaacttctacaaggacttcaccctgcagattgacatggccttcaacgtgttcttcctgctgtacttcggcctgcgcttcatcgccgccaatgacaagctgtggttctggctggaggtgaacagcgtggtggacttcttcaccgtgccccctgtgtttgtgtctgtgtacctgaacagatcctggctgggcctgcgcttcctgcgggccctgcggctcatccagttcagcgagatcctgcagttcctgaacatcctgaagaccagcaacagcatcaagctggtgaacctgctgagcatcttcatcagcacctggctgacagctgctggcttcatccacctggtggagaacagcggggacccctgggagaacttccagaacaaccaggccctgacctactgggagtgtgtgtacctgctgatggtgaccatgagcacagtgggctatggagatgtgtatgccaagaccaccctgggccgcctcttcatggtgttcttcatcctgggcggcctggccatgtttgccagctatgtgcctgagatcatcgagctgattggcaacaggaagaagtatggaggcagctacagcgctgtgtctggcaggaagcacatcgtggtgtgtggccacatcaccctggagagcgtgagcaacttcctgaaggacttcctgcacaaggacagagatgatgtgaatgtggagatcgtgttcctgcacaacatcagccccaacctggagctggaggccctcttcaagaggcacttcacccaggtggagttctaccagggctctgtgctgaacccccatgacctggcccgggtgaagattgagagcgcagatgcctgcctgatcctggccaacaagtactgtgccgaccctgatgctgaagatgccagcaacatcatgagggtcatcagcatcaagaactaccaccccaagatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccgcatcctgatcaaccctggcaaccacctgaagatccaggagggcaccctgggcttcttcatcgccagtgatgccaaggaggtgaagagggccttcttctactgcaaggcctgccatgatgacatcacagaccccaagaggatcaagaagtgtggctgcaagaggctggaggatgagcagcccagcaccctgagccccaagaagaagcagagaaatggaggcatgaggaacagccccaacaccagccccaagctgatgagacatgaccccctgctgatccctggaaatgaccagattgacaacatggacagcaatgtgaagaagtatgacagcacaggcatgttccactggtgtgcccccaaggagattgagaaggtgatcctgaccaggtctgaggccgccatgacagtgctgagcggccacgtggtggtgtgcatctttggagatgtgtcctctgccctgattggcctgaggaacctggtgatgcccctgcgggccagcaacttccactaccacgagctgaagcacatcgtgtttgtgggcagcattgagtacctgaagcgggagtgggagaccctgcacaacttccccaaggtgtccatcctgcccggcacccccctgagcagagctgacctgcgggctgtgaacatcaacctgtgtgacatgtgtgtgatcctgagcgccaaccagaacaacattgatgacaccagcctgcaggacaaggagtgcatcctggccagcctgaacatcaagtccatgcagtttgatgacagcattggagtgctgcaggccaacagccagggcttcaccccacctggcatggacaggagcagcccagacaacagccctgtgcacggcatgctgcggcagcccagcatcaccaccggggtgaacatccccatcatcacagagctggtgaatgacaccaacgtgcagttcctggaccaggatgatgatgatgatcctgacacagagctgtacctgacccagccctttgcctgtggcacagcctttgctgtgtctgtgctggacagcctgatgtctgccacctacttcaatgacaacatcctgaccctcatccgcaccctggtgactggaggagccaccccagagctggaggccctgattgctgaggagaatgccctgcggggcggctacagcaccccccagaccctggccaacagagaccgctgccgggtggcccagctggccctgctggatggcccctttgctgacctgggagatggcggctgctacggggacctcttctgcaaggccctgaagacctacaacatgctgtgcttcggcatctaccgcctgagagatgcccacctgagcacccccagccagtgcaccaagcgctacgtgatcaccaaccccccctatgaatttgagctggtgcccacagacctgatcttctgcctgatgcagtttgaccacaatgccggccagagccgggccagcctgagccacagcagccacagcagccagagcagcagcaagaagagcagctctgtgcacagcatccccagcacagccaaccggcagaaccggcccaagagccgggagagccgggacaagcagaatgccaccaggatgaacaggatgggccaggccgagaagaagtggttcacagatgagccagacaatgcctaccccaggaacatccagatcaagcccatgagcacccacatggccaaccagatcaaccagtacaagagcaccagcagcctcatcccccccatccgggaggtggaggatgaatgttag

SEQ ID NO: 164885 - DNA, 3504 bp, Artificial Sequence
  Description of Artificial Sequence: Synthetic coding sequence
cccaagatggatgccctgatcatccctgtgaccatggaggtgccctgtgacagccggggccagaggatgtggtgggccttcctggccagctccatggtgaccttcttcggcggcctcttcatcatcctgctgtggaggaccctgaagtacctgtggacagtgtgctgccactgcggcggcaagaccaaggaggcccagaagatcaacaacggcagcagccaggctgatggcaccctgaagcctgtggatgagaaggaggaggccgtggccgctgaggtgggctggatgacctctgtgaaggactgggccggcgtgatgatcagcgcccagaccctgaccggccgggtgctggtggtgctggtgtttgccctgagcatcggggccctggtgatctacttcatcgacagcagcaaccccatcgagagctgccagaacttctacaaggacttcaccctgcagattgacatggccttcaacgtgttcttcctgctgtacttcggcctgcgcttcatcgccgccaatgacaagctgtggttctggctggaggtgaacagcgtggtggacttcttcaccgtgccccctgtgtttgtgtctgtgtacctgaacagatcctggctgggcctgcgcttcctgcgggccctgcggctcatccagttcagcgagatcctgcagttcctgaacatcctgaagaccagcaacagcatcaagctggtgaacctgctgagcatcttcatcagcacctggctgacagctgctggcttcatccacctggtggagaacagcggggacccctgggagaacttccagaacaaccaggccctgacctactgggagtgtgtgtacctgctgatggtgaccatgagcacagtgggctatggagatgtgtatgccaagaccaccctgggccgcctcttcatggtgttcttcatcctgggcggcctggccatgtttgccagctatgtgcctgagatcatcgagctgattggcaacaggaagaagtatggaggcagctacagcgctgtgtctggcaggaagcacatcgtggtgtgtggccacatcaccctggagagcgtgagcaacttcctgaaggacttcctgcacaaggacagagatgatgtgaatgtggagatcgtgttcctgcacaacatcagccccaacctggagctggaggccctcttcaagaggcacttcacccaggtggagttctaccagggctctgtgctgaacccccatgacctggcccgggtgaagattgagagcgcagatgcctgcctgatcctggccaacaagtactgtgccgaccctgatgctgaagatgccagcaacatcatgagggtcatcagcatcaagaactaccaccccaagatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccgcatcctgatcaaccctggcaaccacctgaagatccaggagggcaccctgggcttcttcatcgccagtgatgccaaggaggtgaagagggccttcttctactgcaaggcctgccatgatgacatcacagaccccaagaggatcaagaagtgtggctgcaagaggctggaggatgagcagcccagcaccctgagccccaagaagaagcagagaaatggaggcatgaggaacagccccaacaccagccccaagctgatgagacatgaccccctgctgatccctggaaatgaccagattgacaacatggacagcaatgtgaagaagtatgacagcacaggcatgttccactggtgtgcccccaaggagattgagaaggtgatcctgaccaggtctgaggccgccatgacagtgctgagcggccacgtggtggtgtgcatctttggagatgtgtcctctgccctgattggcctgaggaacctggtgatgcccctgcgggccagcaacttccactaccacgagctgaagcacatcgtgtttgtgggcagcattgagtacctgaagcgggagtgggagaccctgcacaacttccccaaggtgtccatcctgcccggcacccccctgagcagagctgacctgcgggctgtgaacatcaacctgtgtgacatgtgtgtgatcctgagcgccaaccagaacaacattgatgacaccagcctgcaggacaaggagtgcatcctggccagcctgaacatcaagtccatgcagtttgatgacagcattggagtgctgcaggccaacagccagggcttcaccccacctggcatggacaggagcagcccagacaacagccctgtgcacggcatgctgcggcagcccagcatcaccaccggggtgaacatccccatcatcacagagctggtgaatgacaccaacgtgcagttcctggaccaggatgatgatgatgatcctgacacagagctgtacctgacccagccctttgcctgtggcacagcctttgctgtgtctgtgctggacagcctgatgtctgccacctacttcaatgacaacatcctgaccctcatccgcaccctggtgactggaggagccaccccagagctggaggccctgattgctgaggagaatgccctgcggggcggctacagcaccccccagaccctggccaacagagaccgctgccgggtggcccagctggccctgctggatggcccctttgctgacctgggagatggcggctgctacggggacctcttctgcaaggccctgaagacctacaacatgctgtgcttcggcatctaccgcctgagagatgcccacctgagcacccccagccagtgcaccaagcgctacgtgatcaccaaccccccctatgaatttgagctggtgcccacagacctgatcttctgcctgatgcagtttgaccacaatgccggccagagccgggccagcctgagccacagcagccacagcagccagagcagcagcaagaagagcagctctgtgcacagcatccccagcacagccaaccggcagaaccggcccaagagccgggagagccgggacaagcagaatgccaccaggatgaacaggatgggccaggagaagaagtggttcacagatgagccagacaatgcctaccccaggaacatccagatcaagcccatgagcacccacatggccaaccagatcaaccagtacaagagcaccagcagcctcatcccccccatccgggaggtggaggatgagtgctag

SEQ ID NO: 164886 - DNA, 3504 bp, Artificial Sequence
  Description of Artificial Sequence: Synthetic coding sequence
tgaggaggcggcggcggcggcggcggcagcagcctgaggatgagcagcaacatccacgccaaccacctgagcctggatgccagcagcagcagcagcagcagcagcagcagcagcagcagcagcagcagcagcagcagcagcagctctgtgcatgagcccaagatggatgccctgatcatccctgtgaccatggaggtgccctgtgacagccggggccagaggatgtggtgggccttcctggccagctccatggtgaccttcttcggcggcctcttcatcatcctgctgtggaggaccctgaagtacctgtggacagtgtgctgccactgcggcggcaagaccaaggaggcccagaagatcaacaacggcagcagccaggctgatggcaccctgaagcctgtggatgagaaggaggaggccgtggccgctgaggtgggctggatgacctctgtgaaggactgggccggcgtgatgatcagcgcccagaccctgaccggccgggtgctggtggtgctggtgtttgccctgagcatcggggccctggtgatctacttcatcgacagcagcaaccccatcgagagctgccagaacttctacaaggacttcaccctgcagattgacatggccttcaacgtgttcttcctgctgtacttcggcctgcgcttcatcgccgccaatgacaagctgtggttctggctggaggtgaacagcgtggtggacttcttcaccgtgccccctgtgtttgtgtctgtgtacctgaacagatcctggctgggcctgcgcttcctgcgggccctgcggctcatccagttcagcgagatcctgcagttcctgaacatcctgaagaccagcaacagcatcaagctggtgaacctgctgagcatcttcatcagcacctggctgacagctgctggcttcatccacctggtggagaacagcggggacccctgggagaacttccagaacaaccaggccctgacctactgggagtgtgtgtacctgctgatggtgaccatgagcacagtgggctatggagatgtgtatgccaagaccaccctgggccgcctcttcatggtgttcttcatcctgggcggcctggccatgtttgccagctatgtgcctgagatcatcgagctgattggcaacaggaagaagtatggaggcagctacagcgctgtgtctggcaggaagcacatcgtggtgtgtggccacatcaccctggagagcgtgagcaacttcctgaaggacttcctgcacaaggacagagatgatgtgaatgtggagatcgtgttcctgcacaacatcagccccaacctggagctggaggccctcttcaagaggcacttcacccaggtggagttctaccagggctctgtgctgaacccccatgacctggcccgggtgaagattgagagcgcagatgcctgcctgatcctggccaacaagtactgtgccgaccctgatgctgaagatgccagcaacatcatgagggtcatcagcatcaagaactaccaccccaagatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccgcatcctgatcaaccctggcaaccacctgaagatccaggagggcaccctgggcttcttcatcgccagtgatgccaaggaggtgaagagggccttcttctactgcaaggcctgccatgatgacatcacagaccccaagaggatcaagaagtgtggctgcaagaggctggaggatgagcagcccagcaccctgagccccaagaagaagcagagaaatggaggcatgaggaacagccccaacaccagccccaagctgatgagacatgaccccctgctgatccctggaaatgaccagattgacaacatggacagcaatgtgaagaagtatgacagcacaggcatgttccactggtgtgcccccaaggagattgagaaggtgatcctgaccaggtctgaggccgccatgacagtgctgagcggccacgtggtggtgtgcatctttggagatgtgtcctctgccctgattggcctgaggaacctggtgatgcccctgcgggccagcaacttccactaccacgagctgaagcacatcgtgtttgtgggcagcattgagtacctgaagcgggagtgggagaccctgcacaacttccccaaggtgtccatcctgcccggcacccccctgagcagagctgacctgcgggctgtgaacatcaacctgtgtgacatgtgtgtgatcctgagcgccaaccagaacaacattgatgacaccagcctgcaggacaaggagtgcatcctggccagcctgaacatcaagtccatgcagtttgatgacagcattggagtgctgcaggccaacagccagggcttcaccccacctggcatggacaggagcagcccagacaacagccctgtgcacggcatgctgcggcagcccagcatcaccaccggggtgaacatccccatcatcacagagctggtgaatgacaccaacgtgcagttcctggaccaggatgatgatgatgatcctgacacagagctgtacctgacccagccctttgcctgtggcacagcctttgctgtgtctgtgctggacagcctgatgtctgccacctacttcaatgacaacatcctgaccctcatccgcaccctggtgactggaggagccaccccagagctggaggccctgattgctgaggagaatgccctgcggggcggctacagcaccccccagaccctggccaacagagaccgctgccgggtggcccagctggccctgctggatggcccctttgctgacctgggagatggcggctgctacggggacctcttctgcaaggccctgaagacctacaacatgctgtgcttcggcatctaccgcctgagagatgcccacctgagcacccccagccagtgcaccaagcgctacgtgatcaccaaccccccctatgaatttgagctggtgcccacagacctgatcttctgcctgatgcagtttgaccacaatgccggccagagccgggccagcctgagccacagcagccacagcagccagagcagcagcaagaagagcagctctgtgcacagcatccccagcacagccaaccggcagaaccggcccaagagccgggagagccgggacaagcagaacaggaaggagatggtgtacagatag

SEQ ID NO: 164887 - DNA, 3516 bp, Artificial Sequence
  Description of Artificial Sequence: Synthetic coding sequence
atggatgccctgatcatccctgtgaccatggaggtgccctgtgacagccggggccagaggatgtggtgggccttcctggccagctccatggtgaccttcttcggcggcctcttcatcatcctgctgtggaggaccctgaagtacctgtggacagtgtgctgccactgcggcggcaagaccaaggaggcccagaagatcaacaacggcagcagccaggctgatggcaccctgaagcctgtggatgagaaggaggaggccgtggccgctgaggtgggctggatgacctctgtgaaggactgggccggcgtgatgatcagcgcccagaccctgaccggccgggtgctggtggtgctggtgtttgccctgagcatcggggccctggtgatctacttcatcgacagcagcaaccccatcgagagctgccagaacttctacaaggacttcaccctgcagattgacatggccttcaacgtgttcttcctgctgtacttcggcctgcgcttcatcgccgccaatgacaagctgtggttctggctggaggtgaacagcgtggtggacttcttcaccgtgccccctgtgtttgtgtctgtgtacctgaacagatcctggctgggcctgcgcttcctgcgggccctgcggctcatccagttcagcgagatcctgcagttcctgaacatcctgaagaccagcaacagcatcaagctggtgaacctgctgagcatcttcatcagcacctggctgacagctgctggcttcatccacctggtggagaacagcggggacccctgggagaacttccagaacaaccaggccctgacctactgggagtgtgtgtacctgctgatggtgaccatgagcacagtgggctatggagatgtgtatgccaagaccaccctgggccgcctcttcatggtgttcttcatcctgggcggcctggccatgtttgccagctatgtgcctgagatcatcgagctgattggcaacaggaagaagtatggaggcagctacagcgctgtgtctggcaggaagcacatcgtggtgtgtggccacatcaccctggagagcgtgagcaacttcctgaaggacttcctgcacaaggacagagatgatgtgaatgtggagatcgtgttcctgcacaacatcagccccaacctggagctggaggccctcttcaagaggcacttcacccaggtggagttctaccagggctctgtgctgaacccccatgacctggcccgggtgaagattgagagcgcagatgcctgcctgatcctggccaacaagtactgtgccgaccctgatgctgaagatgccagcaacatcatgagggtcatcagcatcaagaactaccaccccaagatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccgcatcctgatcaaccctggcaaccacctgaagatccaggagggcaccctgggcttcttcatcgccagtgatgccaaggaggtgaagagggccttcttctactgcaaggcctgccatgatgacatcacagaccccaagaggatcaagaagtgtggctgcaagaggcccaagatgagcatctacaagaggatgaggcgggcctgctgctttgactgtggccgctctgagcgggactgcagctgcatgagcggccgggtgagaggaaatgtggacaccctggagcgggccttccccctgagctctgtgtctgtgaatgactgcagcaccagcttccgggcctttgaagatgagcagcccagcaccctgagccccaagaagaagcagagaaatggaggcatgaggaacagccccaacaccagccccaagctgatgagacatgaccccctgctgatccctggaaatgaccagattgacaacatggacagcaatgtgaagaagtatgacagcacaggcatgttccactggtgtgcccccaaggagattgagaaggtgatcctgaccaggtctgaggccgccatgacagtgctgagcggccacgtggtggtgtgcatctttggagatgtgtcctctgccctgattggcctgaggaacctggtgatgcccctgcgggccagcaacttccactaccacgagctgaagcacatcgtgtttgtgggcagcattgagtacctgaagcgggagtgggagaccctgcacaacttccccaaggtgtccatcctgcccggcacccccctgagcagagctgacctgcgggctgtgaacatcaacctgtgtgacatgtgtgtgatcctgagcgccaaccagaacaacattgatgacaccagcctgcaggacaaggagtgcatcctggccagcctgaacatcaagtccatgcagtttgatgacagcattggagtgctgcaggccaacagccagggcttcaccccacctggcatggacaggagcagcccagacaacagccctgtgcacggcatgctgcggcagcccagcatcaccaccggggtgaacatccccatcatcacagagctggtgaatgacaccaacgtgcagttcctggaccaggatgatgatgatgatcctgacacagagctgtacctgacccagccctttgcctgtggcacagcctttgctgtgtctgtgctggacagcctgatgtctgccacctacttcaatgacaacatcctgaccctcatccgcaccctggtgactggaggagccaccccagagctggaggccctgattgctgaggagaatgccctgcggggcggctacagcaccccccagaccctggccaacagagaccgctgccgggtggcccagctggccctgctggatggcccctttgctgacctgggagatggcggctgctacggggacctcttctgcaaggccctgaagacctacaacatgctgtgcttcggcatctaccgcctgagagatgcccacctgagcacccccagccagtgcaccaagcgctacgtgatcaccaaccccccctatgaatttgagctggtgcccacagacctgatcttctgcctgatgcagtttgaccacaatgccggccagagccgggccagcctgagccacagcagccacagcagccagagcagcagcaagaagagcagctctgtgcacagcatccccagcacagccaaccggcagaaccggcccaagagccgggagagccgggacaagcagaacaggaaggagatggtgtacagatag

SEQ ID NO: 164888 - DNA, 3534 bp, Artificial Sequence
  Description of Artificial Sequence: Synthetic coding sequence
atggccaatggaggcggcggcggcggcggcagcagcggcggcggcggcggcggcggcggcagcagcctgaggatgagcagcaacatccacgccaaccacctgagcctggatgccagcagcagcagcagcagcagcagcagcagcagcagcagcagcagcagcagcagcagcagcagctctgtgcatgagcccaagatggatgccctgatcatccctgtgaccatggaggtgccctgtgacagccggggccagaggatgtggtgggccttcctggccagctccatggtgaccttctttggaggcctcttcatcatcctgctgtggaggaccctgaagtacctgtggacagtgtgctgccactgcggcggcaagaccaaggaggcccagaagatcaacaacggcagcagccaggctgatggcaccctgaagcctgtggatgagaaggaggaggccgtggccgctgaggtgggctggatgacctctgtgaaggactgggccggcgtgatgatcagcgcccagaccctgaccggccgggtgctggtggtgctggtgtttgccctgagcattggagccctggtgatctacttcatcgacagcagcaaccccatcgagagctgccagaacttctacaaggacttcaccctgcagattgacatggccttcaacgtgttcttcctgctgtacttcggcctgcgcttcatcgccgccaatgacaagctgtggttctggctggaggtgaacagcgtggtggacttcttcaccgtgccccctgtgtttgtgtctgtgtacctgaacagatcctggctgggcctgcgcttcctgcgggccctgcggctcatccagttcagcgagatcctgcagttcctgaacatcctgaagaccagcaacagcatcaagctggtgaacctgctgagcatcttcatcagcacctggctgacagctgctggcttcatccacctggtggagaacagcggggacccctgggagaacttccagaacaaccaggccctgacctactgggagtgtgtgtacctgctgatggtgaccatgagcacagtgggctatggagatgtgtatgccaagaccaccctgggccgcctcttcatggtgttcttcatcctgggcggcctggccatgtttgccagctatgtgcctgagatcatcgagctgattggcaacaggaagaagtatggaggcagctacagcgctgtgtctggcaggaagcacatcgtggtgtgtggccacatcaccctggagagcgtgagcaacttcctgaaggacttcctgcacaaggacagagatgatgtgaatgtggagatcgtgttcctgcacaacatcagccccaacctggagctggaggccctcttcaagaggcacttcacccaggtggagttctaccagggctctgtgctgaacccccatgacctggcccgggtgaagattgaatctgcagatgcctgcctgatcctggccaacaagtactgtgccgaccctgatgctgaagatgccagcaacatcatgagggtcatcagcatcaagaactaccaccccaagatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccgcatcctgatcaaccctggcaaccacctgaagatccaggagggcaccctgggcttcttcatcgccagtgatgccaaggaggtgaagagggccttcttctactgcaaggcctgccatgatgacatcacagaccccaagaggatcaagaagtgtggctgcaagaggctggaggatgagcagcccagcaccctgagccccaagaagaagcagagaaatggaggcatgaggaacagccccaacaccagccccaagctgatgagacatgaccccctgctgatccctggaaatgaccagattgacaacatggacagcaatgtgaagaagtatgacagcacaggcatgttccactggtgtgcccccaaggagattgagaaggtgatcctgaccaggtctgaggccgccatgacagtgctgagcggccacgtggtggtgtgcatctttggagatgtgagcagcgccctgattggcctgaggaacctggtgatgcccctgcgggccagcaacttccactaccacgagctgaagcacatcgtgtttgtgggcagcattgagtacctgaagcgggagtgggagaccctgcacaacttccccaaggtgtccatcctgcccggcacccccctgagcagagctgacctgcgggctgtgaacatcaacctgtgtgacatgtgtgtgatcctgagcgccaaccagaacaacattgatgacaccagcctgcaggacaaggagtgcatcctggccagcctgaacatcaagtccatgcagtttgatgacagcattggagtgctgcaggccaacagccagggcttcaccccacctggcatggacaggagcagcccagacaacagccctgtgcacggcatgctgcggcagcccagcatcaccactggagtgaacatccccatcatcacagagctggtgaatgacaccaacgtgcagttcctggaccaggatgatgatgatgatcctgacacagagctgtacctgacccagccctttgcctgtggcacagcctttgctgtgtctgtgctggacagcctgatgtctgccacctacttcaatgacaacatcctgaccctcatccgcaccctggtgactggaggagccaccccagagctggaggccctgattgctgaagaaaatgccctgcggggcggctacagcaccccccagaccctggccaacagagaccgctgccgggtggcccagctggccctgctggatggcccctttgctgacctgggagatggcggctgctatggagacctcttctgcaaggccctgaagacctacaacatgctgtgcttcggcatctaccgcctgagagatgcccacctgagcacccccagccagtgcaccaagagatatgtgatcaccaaccccccctatgaatttgagctggtgcccacagacctgatcttctgcctgatgcagtttgaccacaatgccggccagagccgggccagcctgagccacagcagccacagcagccagagcagcagcaagaagagcagctctgtgcacagcatccccagcacagccaaccggcagaaccggcccaagagccgggagagccgggacaagcagaagaaggagatggtgtacagatag

SEQ ID NO: 164889 - DNA, 3618 bp, Artificial Sequence
  Description of Artificial Sequence: Synthetic coding sequence
atggccaatggaggcggcggcggcggcggcagcagcggcggcggcggcggcggcggcggcagcagcctgaggatgagcagcaacatccacgccaaccacctgagcctggatgccagcagcagcagcagcagcagcagcagcagcagcagcagcagcagcagcagcagcagcagcagctctgtgcatgagcccaagatggatgccctgatcatccctgtgaccatggaggtgccctgtgacagccggggccagaggatgtggtgggccttcctggccagctccatggtgaccttctttggaggcctcttcatcatcctgctgtggaggaccctgaagtacctgtggacagtgtgctgccactgcggcggcaagaccaaggaggcccagaagatcaacaacggcagcagccaggctgatggcaccctgaagcctgtggatgagaaggaggaggccgtggccgctgaggtgggctggatgacctctgtgaaggactgggccggcgtgatgatcagcgcccagaccctgaccggccgggtgctggtggtgctggtgtttgccctgagcattggagccctggtgatctacttcatcgacagcagcaaccccatcgagagctgccagaacttctacaaggacttcaccctgcagattgacatggccttcaacgtgttcttcctgctgtacttcggcctgcgcttcatcgccgccaatgacaagctgtggttctggctggaggtgaacagcgtggtggacttcttcaccgtgccccctgtgtttgtgtctgtgtacctgaacagatcctggctgggcctgcgcttcctgcgggccctgcggctcatccagttcagcgagatcctgcagttcctgaacatcctgaagaccagcaacagcatcaagctggtgaacctgctgagcatcttcatcagcacctggctgacagctgctggcttcatccacctggtggagaacagcggggacccctgggagaacttccagaacaaccaggccctgacctactgggagtgtgtgtacctgctgatggtgaccatgagcacagtgggctatggagatgtgtatgccaagaccaccctgggccgcctcttcatggtgttcttcatcctgggcggcctggccatgtttgccagctatgtgcctgagatcatcgagctgattggcaacaggaagaagtatggaggcagctacagcgctgtgtctggcaggaagcacatcgtggtgtgtggccacatcaccctggagagcgtgagcaacttcctgaaggacttcctgcacaaggacagagatgatgtgaatgtggagatcgtgttcctgcacaacatcagccccaacctggagctggaggccctcttcaagaggcacttcacccaggtggagttctaccagggctctgtgctgaacccccatgacctggcccgggtgaagattgaatctgcagatgcctgcctgatcctggccaacaagtactgtgccgaccctgatgctgaagatgccagcaacatcatgagggtcatcagcatcaagaactaccaccccaagatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccgcatcctgatcaaccctggcaaccacctgaagatccaggagggcaccctgggcttcttcatcgccagtgatgccaaggaggtgaagagggccttcttctactgcaaggcctgccatgatgacatcacagaccccaagaggatcaagaagtgtggctgcaagaggctggaggatgagcagcccagcaccctgagccccaagaagaagcagagaaatggaggcatgaggaacagccccaacaccagccccaagctgatgagacatgaccccctgctgatccctggaaatgaccagattgacaacatggacagcaatgtgaagaagtatgacagcacaggcatgttccactggtgtgcccccaaggagattgagaaggtgatcctgaccaggtctgaggccgccatgacagtgctgagcggccacgtggtggtgtgcatctttggagatgtgagcagcgccctgattggcctgaggaacctggtgatgcccctgcgggccagcaacttccactaccacgagctgaagcacatcgtgtttgtgggcagcattgagtacctgaagcgggagtgggagaccctgcacaacttccccaaggtgtccatcctgcccggcacccccctgagcagagctgacctgcgggctgtgaacatcaacctgtgtgacatgtgtgtgatcctgagcgccaaccagaacaacattgatgacaccagcctgcaggacaaggagtgcatcctggccagcctgaacatcaagtccatgcagtttgatgacagcattggagtgctgcaggccaacagccagggcttcaccccacctggcatggacaggagcagcccagacaacagccctgtgcacggcatgctgcggcagcccagcatcaccactggagtgaacatccccatcatcacagagctggccaagccaggcaagctgcccctggtgtctgtgaaccaggagaagaacagcggcacccacatcctgatgatcacagagctggtgaatgacaccaacgtgcagttcctggaccaggatgatgatgatgatcctgacacagagctgtacctgacccagccctttgcctgtggcacagcctttgctgtgtctgtgctggacagcctgatgtctgccacctacttcaatgacaacatcctgaccctcatccgcaccctggtgactggaggagccaccccagagctggaggccctgattgctgaggagaatgccctgcggggcggctacagcaccccccagaccctggccaacagagaccgctgccgggtggcccagctggccctgctggatggcccctttgctgacctgggagatggcggctgctacggggacctcttctgcaaggccctgaagacctacaacatgctgtgcttcggcatctaccgcctgagagatgcccacctgagcacccccagccagtgcaccaagcgctacgtgatcaccaaccccccctatgaatttgagctggtgcccacagacctgatcttctgcctgatgcagtttgaccacaatgccggccagagccgggccagcctgagccacagcagccacagcagccagagcagcagcaagaagagcagctctgtgcacagcatccccagcacagccaaccggcagaaccggcccaagagccgggagagccgggacaagcagaacaggaaggagatggtgtacagatag

SEQ ID NO: 164890 - DNA, 3678 bp, Artificial Sequence
  Description of Artificial Sequence: Synthetic coding sequence
cccaagatggatgccctgatcatccctgtgaccatggaggtgccctgtgacagccggggccagaggatgtggtgggccttcctggccagctccatggtgaccttcttcggcggcctcttcatcatcctgctgtggaggaccctgaagtacctgtggacagtgtgctgccactgcggcggcaagaccaaggaggcccagaagatcaacaacggcagcagccaggctgatggcaccctgaagcctgtggatgagaaggaggaggccgtggccgctgaggtgggctggatgacctctgtgaaggactgggccggcgtgatgatcagcgcccagaccctgaccggccgggtgctggtggtgctggtgtttgccctgagcatcggggccctggtgatctacttcatcgacagcagcaaccccatcgagagctgccagaacttctacaaggacttcaccctgcagattgacatggccttcaacgtgttcttcctgctgtacttcggcctgcgcttcatcgccgccaatgacaagctgtggttctggctggaggtgaacagcgtggtggacttcttcaccgtgccccctgtgtttgtgtctgtgtacctgaacagatcctggctgggcctgcgcttcctgcgggccctgcggctcatccagttcagcgagatcctgcagttcctgaacatcctgaagaccagcaacagcatcaagctggtgaacctgctgagcatcttcatcagcacctggctgacagctgctggcttcatccacctggtggagaacagcggggacccctgggagaacttccagaacaaccaggccctgacctactgggagtgtgtgtacctgctgatggtgaccatgagcacagtgggctatggagatgtgtatgccaagaccaccctgggccgcctcttcatggtgttcttcatcctgggcggcctggccatgtttgccagctatgtgcctgagatcatcgagctgattggcaacaggaagaagtatggaggcagctacagcgctgtgtctggcaggaagcacatcgtggtgtgtggccacatcaccctggagagcgtgagcaacttcctgaaggacttcctgcacaaggacagagatgatgtgaatgtggagatcgtgttcctgcacaacatcagccccaacctggagctggaggccctcttcaagaggcacttcacccaggtggagttctaccagggctctgtgctgaacccccatgacctggcccgggtgaagattgagagcgcagatgcctgcctgatcctggccaacaagtactgtgccgaccctgatgctgaagatgccagcaacatcatgagggtcatcagcatcaagaactaccaccccaagatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccgcatcctgatcaaccctggcaaccacctgaagatccaggagggcaccctgggcttcttcatcgccagtgatgccaaggaggtgaagagggccttcttctactgcaaggcctgccatgatgacatcacagaccccaagaggatcaagaagtgtggctgcaagaggcccaagatgagcatctacaagaggatgaggcgggcctgctgctttgactgtggccgctctgagcgggactgcagctgcatgagcggccgggtgagaggaaatgtggacaccctggagcgggccttccccctgagctctgtgtctgtgaatgactgcagcaccagcttccgggcctttgaagatgagcagcccagcaccctgagccccaagaagaagcagagaaatggaggcatgaggaacagccccaacaccagccccaagctgatgagacatgaccccctgctgatccctggaaatgaccagattgacaacatggacagcaatgtgaagaagtatgacagcacaggcatgttccactggtgtgcccccaaggagattgagaaggtgatcctgaccaggtctgaggccgccatgacagtgctgagcggccacgtggtggtgtgcatctttggagatgtgtcctctgccctgattggcctgaggaacctggtgatgcccctgcgggccagcaacttccactaccacgagctgaagcacatcgtgtttgtgggcagcattgagtacctgaagcgggagtgggagaccctgcacaacttccccaaggtgtccatcctgcccggcacccccctgagcagagctgacctgcgggctgtgaacatcaacctgtgtgacatgtgtgtgatcctgagcgccaaccagaacaacattgatgacaccagcctgcaggacaaggagtgcatcctggccagcctgaacatcaagtccatgcagtttgatgacagcattggagtgctgcaggccaacagccagggcttcaccccacctggcatggacaggagcagcccagacaacagccctgtgcacggcatgctgcggcagcccagcatcaccaccggggtgaacatccccatcatcacagagctggtgaatgacaccaacgtgcagttcctggaccaggatgatgatgatgatcctgacacagagctgtacctgacccagccctttgcctgtggcacagcctttgctgtgtctgtgctggacagcctgatgtctgccacctacttcaatgacaacatcctgaccctcatccgcaccctggtgactggaggagccaccccagagctggaggccctgattgctgaggagaatgccctgcggggcggctacagcaccccccagaccctggccaacagagaccgctgccgggtggcccagctggccctgctggatggcccctttgctgacctgggagatggcggctgctacggggacctcttctgcaaggccctgaagacctacaacatgctgtgcttcggcatctaccgcctgagagatgcccacctgagcacccccagccagtgcaccaagcgctacgtgatcaccaaccccccctatgaatttgagctggtgcccacagacctgatcttctgcctgatgcagtttgaccacaatgccggccagagccgggccagcctgagccacagcagccacagcagccagagcagcagcaagaagagcagctctgtgcacagcatccccagcacagccaaccggcagaaccggcccaagagccgggagagccgggacaagcagaatgccaccaggatgaacaggatgggccaggagaagaagtggttcacagatgagccagacaatgcctaccccaggaacatccagatcaagcccatgagcacccacatggccaaccagatcaaccagtacaagagcaccagcagcctcatcccccccatccgggaggtggaggatgagtgctag

SEQ ID NO: 164891 - DNA, 3660 bp, Artificial Sequence
  Description of Artificial Sequence: Synthetic coding sequence
atggccaatggaggcggcggcggcggcggcagcagcggcggcggcggcggcggcggcggcagcagcctgaggatgagcagcaacatccacgccaaccacctgagcctggatgccagcagcagcagcagcagcagcagcagcagcagcagcagcagcagcagcagcagcagcagcagctctgtgcatgagcccaagatggatgccctgatcatccctgtgaccatggaggtgccctgtgacagccggggccagaggatgtggtgggccttcctggccagctccatggtgaccttctttggaggcctcttcatcatcctgctgtggaggaccctgaagtacctgtggacagtgtgctgccactgcggcggcaagaccaaggaggcccagaagatcaacaacggcagcagccaggctgatggcaccctgaagcctgtggatgagaaggaggaggccgtggccgctgaggtgggctggatgacctctgtgaaggactgggccggcgtgatgatcagcgcccagaccctgaccggccgggtgctggtggtgctggtgtttgccctgagcattggagccctggtgatctacttcatcgacagcagcaaccccatcgagagctgccagaacttctacaaggacttcaccctgcagattgacatggccttcaacgtgttcttcctgctgtacttcggcctgcgcttcatcgccgccaatgacaagctgtggttctggctggaggtgaacagcgtggtggacttcttcaccgtgccccctgtgtttgtgtctgtgtacctgaacagatcctggctgggcctgcgcttcctgcgggccctgcggctcatccagttcagcgagatcctgcagttcctgaacatcctgaagaccagcaacagcatcaagctggtgaacctgctgagcatcttcatcagcacctggctgacagctgctggcttcatccacctggtggagaacagcggggacccctgggagaacttccagaacaaccaggccctgacctactgggagtgtgtgtacctgctgatggtgaccatgagcacagtgggctatggagatgtgtatgccaagaccaccctgggccgcctcttcatggtgttcttcatcctgggcggcctggccatgtttgccagctatgtgcctgagatcatcgagctgattggcaacaggaagaagtatggaggcagctacagcgctgtgtctggcaggaagcacatcgtggtgtgtggccacatcaccctggagagcgtgagcaacttcctgaaggacttcctgcacaaggacagagatgatgtgaatgtggagatcgtgttcctgcacaacatcagccccaacctggagctggaggccctcttcaagaggcacttcacccaggtggagttctaccagggctctgtgctgaacccccatgacctggcccgggtgaagattgaatctgcagatgcctgcctgatcctggccaacaagtactgtgccgaccctgatgctgaagatgccagcaacatcatgagggtcatcagcatcaagaactaccaccccaagatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccgcatcctgatcaaccctggcaaccacctgaagatccaggagggcaccctgggcttcttcatcgccagtgatgccaaggaggtgaagagggccttcttctactgcaaggcctgccatgatgacatcacagaccccaagaggatcaagaagtgtggctgcaagaggctggaggatgagcagcccagcaccctgagccccaagaagaagcagagaaatggaggcatgaggaacagccccaacaccagccccaagctgatgagacatgaccccctgctgatccctggaaatgaccagattgacaacatggacagcaatgtgaagaagtatgacagcacaggcatgttccactggtgtgcccccaaggagattgagaaggtgatcctggtgacaggctggatgccctacctgggcccccgggtgctgatgacctgcctggacattggagtggtgtgcatgcccacagacatccagagcaccagccctgccagcatcaagaagttcaaggagaccaggtctgaggccgccatgacagtgctgagcggccacgtggtggtgtgcatctttggagatgtgtcctctgccctgattggcctgaggaacctggtgatgcccctgcgggccagcaacttccactaccacgagctgaagcacatcgtgtttgtgggcagcattgagtacctgaagcgggagtgggagaccctgcacaacttccccaaggtgtccatcctgcccggcacccccctgagcagagctgacctgcgggctgtgaacatcaacctgtgtgacatgtgtgtgatcctgagcgccaaccagaacaacattgatgacaccagcctgcaggacaaggagtgcatcctggccagcctgaacatcaagtccatgcagtttgatgacagcattggagtgctgcaggccaacagccagggcttcaccccacctggcatggacaggagcagcccagacaacagccctgtgcacggcatgctgcggcagcccagcatcaccaccggggtgaacatccccatcatcacagagctggtgaatgacaccaacgtgcagttcctggaccaggatgatgatgatgatcctgacacagagctgtacctgacccagccctttgcctgtggcacagcctttgctgtgtctgtgctggacagcctgatgtctgccacctacttcaatgacaacatcctgaccctcatccgcaccctggtgactggaggagccaccccagagctggaggccctgattgctgaggagaatgccctgcggggcggctacagcaccccccagaccctggccaacagagaccgctgccgggtggcccagctggccctgctggatggcccctttgctgacctgggagatggcggctgctacggggacctcttctgcaaggccctgaagacctacaacatgctgtgcttcggcatctaccgcctgagagatgcccacctgagcacccccagccagtgcaccaagcgctacgtgatcaccaaccccccctatgaatttgagctggtgcccacagacctgatcttctgcctgatgcagtttgaccacaatgccggccagagccgggccagcctgagccacagcagccacagcagccagagcagcagcaagaagagcagctctgtgcacagcatccccagcacagccaaccggcagaaccggcccaagagccgggagagccgggacaagcagaagtatgtgcaggaggagcggctgtag

SEQ ID NO: 164892 - DNA, 3723 bp, Artificial Sequence
  Description of Artificial Sequence: Synthetic coding sequence
atggccaatggaggcggcggcggcggcggcagcagcggcggcggcggcggcggcggcggcagcagcctgaggatgagcagcaacatccacgccaaccacctgagcctggatgccagcagcagcagcagcagcagcagcagcagcagcagcagcagcagcagcagcagcagcagcagctctgtgcatgagcccaagatggatgccctgatcatccctgtgaccatggaggtgccctgtgacagccggggccagaggatgtggtgggccttcctggccagctccatggtgaccttctttggaggcctcttcatcatcctgctgtggaggaccctgaagtacctgtggacagtgtgctgccactgcggcggcaagaccaaggaggcccagaagatcaacaacggcagcagccaggctgatggcaccctgaagcctgtggatgagaaggaggaggccgtggccgctgaggtgggctggatgacctctgtgaaggactgggccggcgtgatgatcagcgcccagaccctgaccggccgggtgctggtggtgctggtgtttgccctgagcattggagccctggtgatctacttcatcgacagcagcaaccccatcgagagctgccagaacttctacaaggacttcaccctgcagattgacatggccttcaacgtgttcttcctgctgtacttcggcctgcgcttcatcgccgccaatgacaagctgtggttctggctggaggtgaacagcgtggtggacttcttcaccgtgccccctgtgtttgtgtctgtgtacctgaacagatcctggctgggcctgcgcttcctgcgggccctgcggctcatccagttcagcgagatcctgcagttcctgaacatcctgaagaccagcaacagcatcaagctggtgaacctgctgagcatcttcatcagcacctggctgacagctgctggcttcatccacctggtggagaacagcggggacccctgggagaacttccagaacaaccaggccctgacctactgggagtgtgtgtacctgctgatggtgaccatgagcacagtgggctatggagatgtgtatgccaagaccaccctgggccgcctcttcatggtgttcttcatcctgggcggcctggccatgtttgccagctatgtgcctgagatcatcgagctgattggcaacaggaagaagtatggaggcagctacagcgctgtgtctggcaggaagcacatcgtggtgtgtggccacatcaccctggagagcgtgagcaacttcctgaaggacttcctgcacaaggacagagatgatgtgaatgtggagatcgtgttcctgcacaacatcagccccaacctggagctggaggccctcttcaagaggcacttcacccaggtggagttctaccagggctctgtgctgaacccccatgacctggcccgggtgaagattgaatctgcagatgcctgcctgatcctggccaacaagtactgtgccgaccctgatgctgaagatgccagcaacatcatgagggtcatcagcatcaagaactaccaccccaagatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccggggccgcctgagcatcctgatcaaccctggcaaccacctgaagatccaggagggcaccctgggcttcttcatcgccagtgatgccaaggaggtgaagagggccttcttctactgcaaggcctgccatgatgacatcacagaccccaagaggatcaagaagtgtggctgcaagaggcccaagatgagcatctacaagaggatgagaagagcctgctgctttgactgtggccgctctgagcgggactgcagctgcatgagcggccgggtgagaggaaatgtggacaccctggagcgggccttccccctgagctctgtgtctgtgaatgactgcagcaccagcttccgggcctttgaagatgagcagcccagcaccctgagccccaagaagaagcagagaaatggaggcatgaggaacagccccaacaccagccccaagctgatgagacatgaccccctgctgatccctggaaatgaccagattgacaacatggacagcaatgtgaagaagtatgacagcacaggcatgttccactggtgtgcccccaaggagattgagaaggtgatcctgaccaggtctgaggccgccatgacagtgctgagcggccacgtggtggtgtgcatctttggagatgtgagcagcgccctgattggcctgaggaacctggtgatgcccctgcgggccagcaacttccactaccacgagctgaagcacatcgtgtttgtgggcagcattgagtacctgaagcgggagtgggagaccctgcacaacttccccaaggtgtccatcctgcccggcacccccctgagcagagctgacctgcgggctgtgaacatcaacctgtgtgacatgtgtgtgatcctgagcgccaaccagaacaacattgatgacaccagcctgcaggacaaggagtgcatcctggccagcctgaacatcaagtccatgcagtttgatgacagcattggagtgctgcaggccaacagccagggcttcaccccacctggcatggacaggagcagcccagacaacagccctgtgcacggcatgctgcggcagcccagcatcaccactggagtgaacatccccatcatcacagagctggtgaatgacaccaacgtgcagttcctggaccaggatgatgatgatgatcctgacacagagctgtacctgacccagccctttgcctgtggcacagcctttgctgtgtctgtgctggacagcctgatgtctgccacctacttcaatgacaacatcctgaccctcatccgcaccctggtgactggaggagccaccccagagctggaggccctgattgctgaagaaaatgccctgcggggcggctacagcaccccccagaccctggccaacagagaccgctgccgggtggcccagctggccctgctggatggcccctttgctgacctgggagatggcggctgctatggagacctcttctgcaaggccctgaagacctacaacatgctgtgcttcggcatctaccgcctgagagatgcccacctgagcacccccagccagtgcaccaagagatatgtgatcaccaaccccccctatgaatttgagctggtgcccacagacctgatcttctgcctgatgcagtttgaccacaatgccggccagagccgggccagcctgagccacagcagccacagcagccagagcagcagcaagaagagcagctctgtgcacagcatccccagcacagccaaccggcagaaccggcccaagagccgggagagccgggacaagcagaagtatgtgcaggaggagcggctgtag

SEQ ID NO: 164893 - DNA, 2970 bp, Artificial Sequence
  Description of Artificial Sequence: Synthetic coding sequence
atggccttcaacgtgttcttcctgctgtacttcggcctgcgcttcatcgccgccaatgacaagctgtggttctggctggaggtgaacagcgtggtggacttcttcaccgtgccccctgtgtttgtgtctgtgtacctgaacagatcctggctgggcctgcgcttcctgcgggccctgcggctcatccagttcagcgagatcctgcagttcctgaacatcctgaagaccagcaacagcatcaagctggtgaacctgctgagcatcttcatcagcacctggctgacagctgctggcttcatccacctggtggagaacagcggggacccctgggagaacttccagaacaaccaggccctgacctactgggagtgtgtgtacctgctgatggtgaccatgagcacagtgggctatggagatgtgtatgccaagaccaccctgggccgcctcttcatggtgttcttcatcctgggcggcctggccatgtttgccagctatgtgcctgagatcatcgagctgattggcaacaggaagaagtatggaggcagctacagcgctgtgtctggcaggaagcacatcgtggtgtgtggccacatcaccctggagagcgtgagcaacttcctgaaggacttcctgcacaaggacagagatgatgtgaatgtggagatcgtgttcctgcacaacatcagccccaacctggagctggaggccctcttcaagaggcacttcacccaggtggagttctaccagggctctgtgctgaacccccatgacctggcccgggtgaagattgaatctgcagatgcctgcctgatcctggccaacaagtactgtgccgaccctgatgctgaagatgccagcaacatcatgagggtcatcagcatcaagaactaccaccccaagatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccgcatcctgatcaaccctggcaaccacctgaagatccaggagggcaccctgggcttcttcatcgccagtgatgccaaggaggtgaagagggccttcttctactgcaaggcctgccatgatgacatcacagaccccaagaggatcaagaagtgtggctgcaagaggctgaaggtggccgcccggagccgctacagcaaggacccctttgagttcaagaaggagacccccaacagccggctggtgacagagcctgtggaggatgagcagcccagcaccctgagccccaagaagaagcagagaaatggaggcatgaggaacagccccaacaccagccccaagctgatgagacatgaccccctgctgatccctggaaatgaccagattgacaacatggacagcaatgtgaagaagtatgacagcacaggcatgttccactggtgtgcccccaaggagattgagaaggtgatcctgaccaggtctgaggccgccatgacagtgctgagcggccacgtggtggtgtgcatctttggagatgtgtcctctgccctgattggcctgaggaacctggtgatgcccctgcgggccagcaacttccactaccacgagctgaagcacatcgtgtttgtgggcagcattgagtacctgaagcgggagtgggagaccctgcacaacttccccaaggtgtccatcctgcccggcacccccctgagcagagctgacctgcgggctgtgaacatcaacctgtgtgacatgtgtgtgatcctgagcgccaaccagaacaacattgatgacaccagcctgcaggacaaggagtgcatcctggccagcctgaacatcaagtccatgcagtttgatgacagcattggagtgctgcaggccaacagccagggcttcaccccacctggcatggacaggagcagcccagacaacagccctgtgcacggcatgctgcggcagcccagcatcaccaccggggtgaacatccccatcatcacagagctggtgaatgacaccaacgtgcagttcctggaccaggatgatgatgatgatcctgacacagagctgtacctgacccagccctttgcctgtggcacagcctttgctgtgtctgtgctggacagcctgatgtctgccacctacttcaatgacaacatcctgaccctcatccgcaccctggtgactggaggagccaccccagagctggaggccctgattgctgaggagaatgccctgcggggcggctacagcaccccccagaccctggccaacagagaccgctgccgggtggcccagctggccctgctggatggcccctttgctgacctgggagatggcggctgctacggggacctcttctgcaaggccctgaagacctacaacatgctgtgcttcggcatctaccgcctgagagatgcccacctgagcacccccagccagtgcaccaagcgctacgtgatcaccaaccccccctatgaatttgagctggtgcccacagacctgatcttctgcctgatgcagtttgaccacaatgccggccagagccgggccagcctgagccacagcagccacagcagccagagcagcagcaagaagagcagctctgtgcacagcatccccagcacagccaaccggcagaaccggcccaagagccgggagagccgggacaagcagaagtatgtgcaggaggagcggctgtag

SEQ ID NO: 164894 - DNA, 543 bp, Artificial Sequence
  Description of Artificial Sequence: Synthetic coding sequence
tgaaaaatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccgcatcctgatcaaccctggcaaccacctgaagatccaggagggcaccctgggcttcttcatcgccagtgatgccaaggaggtgaagaggcctccccagctgtgcctgcccctggccgcccagaagcgctgcttccagagcgacaagctggacatcttcatctag

SEQ ID NO: 164895 - DNA, 2661 bp, Artificial Sequence
  Description of Artificial Sequence: Synthetic coding sequence
tgaaattctggggacccctgggagaacttccagaacaaccaggccctgacctactgggagtgtgtgtacctgctgatggtgaccatgagcacagtgggctatggagatgtgtatgccaagaccaccctgggccgcctcttcatggtgttcttcatcctgggcggcctggccatgtttgccagctatgtgcctgagatcatcgagctgattggcaacaggaagaagtatggaggcagctacagcgctgtgtctggcaggaagcacatcgtggtgtgtggccacatcaccctggagagcgtgagcaacttcctgaaggacttcctgcacaaggacagagatgatgtgaatgtggagatcgtgttcctgcacaacatcagccccaacctggagctggaggccctcttcaagaggcacttcacccaggtggagttctaccagggctctgtgctgaacccccatgacctggcccgggtgaagattgagagcgcagatgcctgcctgatcctggccaacaagtactgtgccgaccctgatgctgaagatgccagcaacatcatgagggtcatcagcatcaagaactaccaccccaagatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccgcatcctgatcaaccctggcaaccacctgaagatccaggagggcaccctgggcttcttcatcgccagtgatgccaaggaggtgaagagggccttcttctactgcaaggcctgccatgatgacatcacagaccccaagaggatcaagaagtgtggctgcaagaggctgaaggtggccgcccggagccgctacagcaaggacccctttgagttcaagaaggagacccccaacagccggctggtgacagagcctgtggaggatgagcagcccagcaccctgagccccaagaagaagcagagaaatggaggcatgaggaacagccccaacaccagccccaagctgatgagacatgaccccctgctgatccctggaaatgaccagattgacaacatggacagcaatgtgaagaagtatgacagcacaggcatgttccactggtgtgcccccaaggagattgagaaggtgatcctgaccaggtctgaggccgccatgacagtgctgagcggccacgtggtggtgtgcatctttggagatgtgagcagcgccctgattggcctgaggaacctggtgatgcccctgcgggccagcaacttccactaccacgagctgaagcacatcgtgtttgtgggcagcattgagtacctgaagcgggagtgggagaccctgcacaacttccccaaggtgtccatcctgcccggcacccccctgagcagagctgacctgcgggctgtgaacatcaacctgtgtgacatgtgtgtgatcctgagcgccaaccagaacaacattgatgacaccagcctgcaggacaaggagtgcatcctggccagcctgaacatcaagtccatgcagtttgatgacagcattggagtgctgcaggccaacagccagggcttcaccccacctggcatggacaggagcagcccagacaacagccctgtgcacggcatgctgcggcagcccagcatcaccactggagtgaacatccccatcatcacagagctggtgaatgacaccaacgtgcagttcctggaccaggatgatgatgatgatcctgacacagagctgtacctgacccagccctttgcctgtggcacagcctttgctgtgtctgtgctggacagcctgatgtctgccacctacttcaatgacaacatcctgaccctcatccgcaccctggtgactggaggagccaccccagagctggaggccctgattgctgaagaaaatgccctgcggggcggctacagcaccccccagaccctggccaacagagaccgctgccgggtggcccagctggccctgctggatggcccctttgctgacctgggagatggcggctgctatggagacctcttctgcaaggccctgaagacctacaacatgctgtgcttcggcatctaccgcctgagagatgcccacctgagcacccccagccagtgcaccaagagatatgtgatcaccaaccccccctatgaatttgagctggtgcccacagacctgatcttctgcctgatgcagtttgaccacaatgccggccagagccgggccagcctgagccacagcagccacagcagccagagcagcagcaagaagagcagctctgtgcacagcatccccagcacagccaaccggcagaaccggcccaagagccgggagagccgggacaagcagaagtatgtgcaggaggagcggctgtag

SEQ ID NO: 164896 - DNA, 795 bp, Artificial Sequence
  Description of Artificial Sequence: Synthetic coding sequence
tgagtcatcagcatcaagaactaccaccccaagatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccgcatcctgatcaaccctggcaaccacctgaagatccaggagggcaccctgggcttcttcatcgccagtgatgccaaggaggtgaagagggccttcttctactgcaaggcctgccatgatgacatcacagaccccaagaggatcaagaagtgtggctgcaagaggctggccggcagccaggacacccacccagacagcttctaccaccaggccgtgaatgccagcagctacctgcacggcggcggccagatgtggcctgtgagcagcagcagcagcatcctgctgcactacctgcggcggcagatgcctggccctgcccggctgcccctggagctgagctgccagggcagcgccctgagccccaacccagacctgtactgcatgaagtag

SEQ ID NO: 164897 - DNA, 3630 bp, Artificial Sequence
  Description of Artificial Sequence: Synthetic coding sequence
agcaacatccacgccaaccacctgagcctggatgccagcagcagcagcagcagcagcagcagcagcagcagcagcagcagcagcagcagcagcagcagctctgtgcatgagcccaagatggatgccctgatcatccctgtgaccatggaggtgccctgtgacagccggggccagaggatgtggtgggccttcctggccagctccatggtgaccttctttggaggcctcttcatcatcctgctgtggaggaccctgaagtacctgtggacagtgtgctgccactgcggcggcaagaccaaggaggcccagaagatcaacaacggcagcagccaggctgatggcaccctgaagcctgtggatgagaaggaggaggccgtggccgctgaggtgggctggatgacctctgtgaaggactgggccggcgtgatgatcagcgcccagaccctgaccggccgggtgctggtggtgctggtgtttgccctgagcattggagccctggtgatctacttcatcgacagcagcaaccccatcgagagctgccagaacttctacaaggacttcaccctgcagattgacatggccttcaacgtgttcttcctgctgtacttcggcctgcgcttcatcgccgccaatgacaagctgtggttctggctggaggtgaacagcgtggtggacttcttcaccgtgccccctgtgtttgtgtctgtgtacctgaacagatcctggctgggcctgcgcttcctgcgggccctgcggctcatccagttcagcgagatcctgcagttcctgaacatcctgaagaccagcaacagcatcaagctggtgaacctgctgagcatcttcatcagcacctggctgacagctgctggcttcatccacctggtggagaacagcggggacccctgggagaacttccagaacaaccaggccctgacctactgggagtgtgtgtacctgctgatggtgaccatgagcacagtgggctatggagatgtgtatgccaagaccaccctgggccgcctcttcatggtgttcttcatcctgggcggcctggccatgtttgccagctatgtgcctgagatcatcgagctgattggcaacaggaagaagtatggaggcagctacagcgctgtgtctggcaggaagcacatcgtggtgtgtggccacatcaccctggagagcgtgagcaacttcctgaaggacttcctgcacaaggacagagatgatgtgaatgtggagatcgtgttcctgcacaacatcagccccaacctggagctggaggccctcttcaagaggcacttcacccaggtggagttctaccagggctctgtgctgaacccccatgacctggcccgggtgaagattgaatctgcagatgcctgcctgatcctggccaacaagtactgtgccgaccctgatgctgaagatgccagcaacatcatgagggtcatcagcatcaagaactaccaccccaagatccgcatcatcacccagatgctgcagtaccacaacaaggcccacctgctgaacatccccagctggaactggaaggagggagatgatgccatctgcctggccgagctgaagctgggcttcatcgcccagagctgcctggcccagggcctgagcaccatgctggccaacctcttctccatgaggagcttcatcaagattgaggaggacacctggcagaagtactacctggagggcgtgtccaatgagatgtacacagagtacctgagcagcgcctttgtgggcctgtccttccccaccgtgtgtgagctgtgctttgtgaagctgaagctgctgatgattgccatcgagtacaagagcgccaaccgggagagccgcatcctgatcaaccctggcaaccacctgaagatccaggagggcaccctgggcttcttcatcgccagtgatgccaaggaggtgaagagggccttcttctactgcaaggcctgccatgatgacatcacagaccccaagaggatcaagaagtgtggctgcaagaggcccaagatgagcatctacaagaggatgagaagagcctgctgctttgactgtggccgctctgagcgggactgcagctgcatgagcggccgggtgagaggaaatgtggacaccctggagcgggccttccccctgagctctgtgtctgtgaatgactgcagcaccagcttccgggcctttgaagatgagcagcccagcaccctgagccccaagaagaagcagagaaatggaggcatgaggaacagccccaacaccagccccaagctgatgagacatgaccccctgctgatccctggaaatgaccagattgacaacatggacagcaatgtgaagaagtatgacagcacaggcatgttccactggtgtgcccccaaggagattgagaaggtgatcctgaccaggtctgaggccgccatgacagtgctgagcggccacgtggtggtgtgcatctttggagatgtgagcagcgccctgattggcctgaggaacctggtgatgcccctgcgggccagcaacttccactaccacgagctgaagcacatcgtgtttgtgggcagcattgagtacctgaagcgggagtgggagaccctgcacaacttccccaaggtgtccatcctgcccggcacccccctgagcagagctgacctgcgggctgtgaacatcaacctgtgtgacatgtgtgtgatcctgagcgccaaccagaacaacattgatgacaccagcctgcaggacaaggagtgcatcctggccagcctgaacatcaagtccatgcagtttgatgacagcattggagtgctgcaggccaacagccagggcttcaccccacctggcatggacaggagcagcccagacaacagccctgtgcacggcatgctgcggcagcccagcatcaccactggagtgaacatccccatcatcacagagctggtgaatgacaccaacgtgcagttcctggaccaggatgatgatgatgatcctgacacagagctgtacctgacccagccctttgcctgtggcacagcctttgctgtgtctgtgctggacagcctgatgtctgccacctacttcaatgacaacatcctgaccctcatccgcaccctggtgactggaggagccaccccagagctggaggccctgattgctgaagaaaatgccctgcggggcggctacagcaccccccagaccctggccaacagagaccgctgccgggtggcccagctggccctgctggatggcccctttgctgacctgggagatggcggctgctatggagacctcttctgcaaggccctgaagacctacaacatgctgtgcttcggcatctaccgcctgagagatgcccacctgagcacccccagccagtgcaccaagagatatgtgatcaccaaccccccctatgaatttgagctggtgcccacagacctgatcttctgcctgatgcagtttgaccacaatgccggccagagccgggccagcctgagccacagcagccacagcagccagagcagcagcaagaagagcagctctgtgcacagcatccccagcacagccaaccggcagaaccggcccaagagccgggagagccgggacaagcagaagaaggagatggtgtacagatag

SEQ ID NO: 164898 - DNA, 576 bp, Artificial Sequence
  Description of Artificial Sequence: Synthetic coding sequence
atggtgaagaagctggtgatggcccagaagagaggagagacccgggccctgtgcctgggcgtgaccatggtggtgtgtgctgtgatcacctactacatcctggtgaccaccgtgctgcccctgtaccagaagtctgtgtggacccaggagagcaagtgccacctgattgagaccaacatccgggaccaggaggagctgaagggcaagaaggtgccccagtacccctgcctgtgggtgaatgtgtctgctgctggccgctgggccgtgctgtaccacacagaggacacccgggaccagaaccagcagtgcagctacatccctggctctgtggacaactaccagacagcccgggcagatgtggagaaggtgcgggccaagttccaggagcagcaggtgttctactgcttcagcgcccccagaggaaatgagacctctgtgctcttccagaggctgtatggcccccaggccctgctcttcagcctcttctggcccaccttcctgctgactggaggcctgctgatcatcgccatggtgaagagcaaccagtacctgagcatcctggccgcccagaagtag

SEQ ID NO: 164899 - DNA, 393 bp, Artificial Sequence
  Description of Artificial Sequence: Synthetic coding sequence
atggtgaagaagctggtgatggcccagaagagaggagagacccgggccctgtgcctgggcgtgaccatggtggtgtgtgctgtgatcacctactacatcctggtgaccaccgtgctgcccctgtaccagaagtctgtgtggacccaggagagcaagtgccacctgattgagaccaacatccgggaccaggaggagctgaagggcaagaaggtgccccagtacccctgcctgtgggtgaatgtgtctgctgctggccgctgggccgtgctgtaccacacagaggacacccgggaccagaaccagcaggtgctgaactggagagatggagacaccagcctgtacccctgccaggtgtgtgagcctgtgcccaactgcccctgcccccggggctag

SEQ ID NO: 164900 - DNA, 633 bp, Artificial Sequence
  Description of Artificial Sequence: Synthetic coding sequence
atggccaagctgcgggtggcctatgagtacacagaagctgaggacaagagcatccggctgggcctcttcctgatcatctctggagtggtgtccctcttcatcttcggcttctgctggctgagccctgccctgcaggacctgcaggccacagaggccaactgcaccgtgctgtctgtgcagcagatcggggaggtgtttgaatgtaccttcacctgtggggctgactgccggggcaccagccagtacccctgtgtgcaggtgtatgtgaacaacagcgagagcaacagccgggccctgctgcacagtgatgagcaccagctgctgaccaaccccaagtgcagctacatccccccctgcaagcgggagaaccagaagaacctggagagcgtgatgaactggcagcagtactggaaggatgaaattggcagccagcccttcacctgctacttcaaccagcaccagaggccagatgatgtgctgctgcacaggacccatgatgagatcgtgctgctgcactgcttcctgtggcccctggtgacctttgtggtgggcgtgctgattgtggtgctgaccatctgtgccaagagcctggccgtgaaggccgaggccatgaagaagaggaagttctcctag

SEQ ID NO: 164901 - DNA, 2259 bp, Artificial Sequence
  Description of Artificial Sequence: Synthetic coding sequence
atgaagccagctgagcacgccaccatgttcctgattgtgctgggctgcctgatcctggccgtgctgaccaccttcaaggagtatgagaccgtgtctggggactggctgctgctgctggagacctttgccatcttcatctttggagctgagtttgccctgcgcatctgggccgccggctgctgctgccgctacaagggctggaggggccgcctgaagtttgccaggaagcccctgtgcatgctggacatctttgtgctgattgcctctgtgcctgtggtggccgtgggcaaccagggcaatgtgctggccaccagcctgcggagcctgcgcttcctgcagatcctgaggatgctgaggatggaccggcggggcggcacctggaagctgctgggcagcgccatctgtgcccacagcaaggagctgatcacagcctggtacatcggcttcctgaccctcatcctgagcagcttcctggtgtacctggtggagaaggatgtgcctgaggtggatgcccagggcgaggagatgaaggaggagtttgagacctatgcagatgccctgtggtggggcctcatcaccctggccaccatcggctatggagacaagacccccaagacctgggagggccgcctgattgctgccaccttcagcctgattggagtgtccttctttgccctgcctgctggcatcctgggcagcggcctggccctgaaggtgcaggagcagcaccggcagaagcactttgagaagaggaggaagccagctgctgagctgatccaggccgcctggagatactatgccaccaaccccaacagaattgacctggtggccacctggaggttctatgagagcgtggtgtccttccccttcttcaggaaggagcagctggaggccgccagcagccagaagctgggcctgctggacagagtgcggctgagcaacccccggggcagcaacaccaagggcaagctgttcacccccctgaatgtggatgccatcgaggagagccccagcaaggagcccaagcctgtgggcctgaacaacaaggagcgcttcagaacagccttcaggatgaaggcctatgccttctggcagagcagtgaagatgctggcaccggggaccccatggccgaggaccggggctatggaaatgacttccccatcgaggacatgatccccaccctgaaggccgccatccgggctgtgcgcatcctgcagttccggctgtacaagaagaagttcaaggagaccctgcggccctatgatgtgaaggatgtgattgagcagtacagcgctggccacctggacatgctgagccgcatcaagtacctgcagaccagaattgacatgatcttcaccccaggcccccccagcacccccaagcacaagaagagccagaagggcagcgccttcaccttccccagccagcagagccccagaaatgagccctacgtggcccggcccagcaccagcgagattgaggaccagagcatgatgggcaagtttgtgaaggtggagcggcaggtgcaggacatgggcaagaagctggacttcctggtggacatgcacatgcagcacatggagcggctgcaggtgcaggtgacagagtactaccccaccaagggcaccagcagccctgctgaggccgagaagaaggaggacaaccgctacagcgacctgaagaccatcatctgcaactacagcgagaccggccccccagagcccccctacagcttccaccaggtgaccatcgacaaggtgagcccctacggcttctttgcccatgaccctgtgaacctgccccggggcggccccagcagcggcaaggtgcaggccaccccacccagcagcgccaccacctacgtggagcggcccaccgtgctgcccatcctgaccctgctggacagccgggtgtcctgccacagccaggccgacctgcagggcccctacagcgaccgcatcagcccccggcagaggaggagcatcacccgggacagcgacacccccctgagcctgatgtctgtgaaccacgaggagctggagaggagccccagcggcttcagcatcagccaggacagagatgattatgtgtttggccccaatggaggcagctcctggatgagggagaagcgctacctggccgagggggagacagacacagacacagaccccttcacccccagcggctccatgcccctgagcagcactggagatggcatcagtgacagcgtgtggacccccagcaacaagcccatctag

SEQ ID NO: 164902 - DNA, 1434 bp, Artificial Sequence
  Description of Artificial Sequence: Synthetic coding sequence
atgacaggccagagcctgtgggatgtgtctgaggccaacgtggaggatggagagatccgcatcaacgtgggcggcttcaagaggcggctgcggagccacaccctgctgcgcttccctgagacccggctgggccgcctgctgctgtgccacagccgggaggccatcctggagctgtgtgatgattatgatgatgtgcagcgggagttctactttgacagaaatcctgagctgttcccctacgtgctgcacttctaccacacaggcaagctgcacgtgatggccgagctgtgtgtgttctccttcagccaggagattgagtactggggcatcaatgagttcttcatcgacagctgctgcagctacagctaccacggcaggaaggtggagcctgagcaggagaagtgggatgagcagagcgaccaggagagcaccaccagcagctttgatgagatcctggccttctacaatgatgccagcaagtttgatggccagcccctgggcaacttccggcggcagctgtggctggccctggacaaccctggctacagcgtgctgagcagggtcttcagcatcctgagcatcctggtggtgatgggcagcatcatcaccatgtgcctgaacagcctgcctgacttccagatcccagacagccagggcaaccctggagaggaccccaggtttgaaattgtggagcactttggaattgcctggttcacctttgagctggtggccaggtttgctgtggccccagacttcctgaagttcttcaagaatgccctgaacctgattgacctgatgagcatcgtgcccttctacatcaccctggtggtgaacctggtggtggagagcacccccaccctggccaacctgggccgggtggcccaggtgctgcggctgatgaggatcttccgcatcctgaagctggcccggcacagcacaggcctgcggagcctgggcgccaccctgaagtacagctacaaggaggtgggcctgctgctgctgtacctgtctgtgggcatcagcatcttctctgtggtggcctacaccatcgagaaggaggagaatgaaggcctggccaccatcccagcctgctggtggtgggccaccgtgtccatgaccaccgtgggctatggagatgtggtgcccggcaccacagctgggaagctgacagccagcgcctgcatcctggccggcatcctggtggtggtgctgcccatcaccctcatcttcaacaagttcagccacttctaccgccggcagaagcagctggagagcgccatgaggagctgtgactttggagatggcatgaaggaggtgcccagcgtgaacctgcgggactactatgcccacaaggtgaagagcctgatggccagcctgaccaacatgagccgcagcagccccagcgagctgagcctgaatgacagcctgaggtag

SEQ ID NO: 164903 - DNA, 1434 bp, Artificial Sequence; identical to SEQ ID NO: 164902
  Description of Artificial Sequence: Synthetic coding sequence

SEQ ID NO: 164904 - DNA, 1476 bp, Artificial Sequence
  Description of Artificial Sequence: Synthetic coding sequence
atggtgtttggagagttcttccaccggcccggccaggatgaggagctggtgaacctgaatgtgggcggcttcaagcagagcgtggaccagagcaccctgctgcgcttcccccacacccggctgggcaagctgctgacctgccacagcgaggaggccatcctggagctgtgtgatgactacagcgtggccgacaaggagtactactttgacaggaaccccagcctcttccgctacgtgctgaacttctactacacaggcaagctgcacgtgatggaggagctgtgtgtgttctccttctgccaggagattgagtactggggcatcaatgaactcttcatcgacagctgctgcagcaaccgctaccaggagaggaaggaggagaaccacgagaaggactgggaccagaagagccatgatgtgtccacagacagcagctttgaggagagcagcctgtttgagaaggagctggagaagtttgacaccctgcgcttcggccagctgaggaagaagatctggatccgcatggagaacccagcctactgcctgagcgccaagctgattgccatcagcagcctgtctgtggtgctggccagcatcgtggccatgtgtgtgcacagcatgtctgagttccagaatgaagatggagaggtggatgatcctgtgctggagggcgtggagatcgcctgcatcgcctggttcaccggggagctggccgtgcggctggccgccgccccctgccagaagaagttctggaagaaccccctgaacatcatcgactttgtgtccatcatccccttctacgccaccctggccgtggacaccaaggaggaggagagcgaggacatcgagaacatgggcaaggtggtgcagatcctgcggctgatgaggatcttccgcatcctgaagctggcccggcacagcgtgggcctgcggagcctgggcgccaccctgcggcacagctaccacgaggtgggcctgctgctgctcttcctgtctgtgggcatcagcatcttctctgtgctgatctacagcgtggagaaggatgaccacaccagcagcctgaccagcatccccatctgctggtggtgggccaccatctccatgaccaccgtgggctatggagacacccaccctgtgaccctggccggcaagctgattgccagcacctgcatcatctgtggcatcctggtggtggccctgcccatcaccatcatcttcaacaagttcagcaagtactaccagaagcagaaggacattgatgtggaccagtgcagtgaagatgcccctgagaagtgccacgagctgccctacttcaacatccgggacatctatgcccagaggatgcacaccttcatcaccagcctgagctctgtgggcatcgtggtgtctgaccctgacagcacagatgccagcagcattgaggacaatgaagacatctgcaacaccaccagcctggagaactgcacagccaagtag

SEQ ID NO: 164905 - DNA, 1476 bp, Artificial Sequence; identical to SEQ ID NO: 164904
  Description of Artificial Sequence: Synthetic coding sequence

SEQ ID NO: 164906 - DNA, 225 bp, Artificial Sequence
  Description of Artificial Sequence: Synthetic coding sequence
atggtgtttggagagttcttccaccggcccggccaggatgaggagctggtgaacctgaatgtgggcggcttcaagcagagcgtggaccagagcaccctgctgcgcttcccccacacccggctgggcaagctgctgacctgccacagcgaggaggccatcctggagctgtgtgatgactacagcgtggccgacaaggagtactactttgacaggaaccccagctag

SEQ ID NO: 164907 - DNA, 390 bp, Artificial Sequence
  Description of Artificial Sequence: Synthetic coding sequence
atgatcctgagcaacaccacagctgtgacccccttcctgaccaagctgtggcaggagaccgtgcagcagggcggcaacatgagcggcctggcccggcgcagccccaggagcagtgatggcaagctggaggccctgtatgtgctgatggtgctgggcttcttcggcttcttcaccctgggcatcatgctgagctacatccgcagcaagaagctggagcacagcaatgaccccttcaacgtgtacatcgagagtgatgcctggcaggagaaggacaaggcctacgtgcaggcccgggtgctggagagctaccgcagctgctacgtggtggagaaccacctggccatcgagcagcccaacacccacctgcctgagaccaagcccagcccctag

SEQ ID NO: 164908 - DNA, 390 bp, Artificial Sequence; identical to SEQ ID NO: 164907
  Description of Artificial Sequence: Synthetic coding sequence

SEQ ID NO: 164909 - DNA, 390 bp, Artificial Sequence; identical to SEQ ID NO: 164907
  Description of Artificial Sequence: Synthetic coding sequence

SEQ ID NO: 164910 - DNA, 390 bp, Artificial Sequence; identical to SEQ ID NO: 164907
  Description of Artificial Sequence: Synthetic coding sequence

SEQ ID NO: 164911 - DNA, 390 bp, Artificial Sequence; identical to SEQ ID NO: 164907
  Description of Artificial Sequence: Synthetic coding sequence

SEQ ID NO: 164912 - DNA, 390 bp, Artificial Sequence; identical to SEQ ID NO: 164907
  Description of Artificial Sequence: Synthetic coding sequence

SEQ ID NO: 164913 - DNA, 372 bp, Artificial Sequence
  Description of Artificial Sequence: Synthetic coding sequence
atgagcaccctgagcaacttcacccagaccctggaggatgtgttccgccgcatcttcatcacctacatggacaactggaggcagaacaccacagctgagcaggaggccctgcaggccaaggtggatgctgagaacttctactacgtgatcctgtacctgatggtgatgattggcatgttctccttcatcatcgtggccatcctggtgtccacagtgaagagcaagaggcgggagcacagcaatgacccctaccaccagtacatcgtggaggactggcaggagaagtacaagagccagatcctgaacctggaggagagcaaggccaccatccacgagaacatcggggctgctggcttcaagatgagcccctag

SEQ ID NO: 164914 - DNA, 312 bp, Artificial Sequence
  Description of Artificial Sequence: Synthetic coding sequence
atggagaccaccaatggaacagagacctggtatgagagcctgcatgctgtgctgaaggccctgaatgccaccctgcacagcaacctgctgtgcaggcctggccctggcctgggccctgacaaccagacagaggagcggcgggccagcctgcccggcagagatgacaacagctacatgtacatcctgtttgtgatgttcctgtttgctgtgacagtgggcagcctcatcctgggctacaccaggagcaggaaggtggacaagagaagtgacccctaccacgtgtacatcaagaacagagtgtccatgatctag

SEQ ID NO: 164915 - DNA, 312 bp, Artificial Sequence; identical to SEQ ID NO: 164914
  Description of Artificial Sequence: Synthetic coding sequence

SEQ ID NO: 164916 - DNA, 39 bp, Artificial Sequence
  Description of Artificial Sequence: Synthetic coding sequence
atggagaccaccaatggaacagagacctggtatgaatag

SEQ ID NO: 164917 - DNA, 153 bp, Artificial Sequence
  Description of Artificial Sequence: Synthetic coding sequence
atggagaccaccaatggaacagagacctggtatgagagcctgcatgctgtgctgaaggccctgaatgccaccctgcacagcaacctgctgtgcaggcctggccctggcctgggccctgacaaccagacagaggagcggcgggccagcctgtag

SEQ ID NO: 164918 - DNA, 162 bp, Artificial Sequence
  Description of Artificial Sequence: Synthetic coding sequence
atggagaccaccaatggaacagagacctggtatgagagcctgcatgctgtgctgaaggccctgaatgccaccctgcacagcaacctgctgtgcaggcctggccctggcctgggccctgacaaccagacagaggagcggcgggccagcctgcctggaagatag

SEQ ID NO: 164919 - DNA, 300 bp, Artificial Sequence
  Description of Artificial Sequence: Synthetic coding sequence
atggagaccaccaatggaacagagacctggtatgagagcctgcatgctgtgctgaaggccctgaatgccaccctgcacagcaacctgctgtgcaggcctggccctggcctgggccctgacaaccagacagaggagcggcgggccagcctgcccggcagagatgacaacagctacatgtacatcctgtttgtgatgttcctgtttgctgtgacagtgggcagcctcatcctgggctacaccaggagcaggaaggtggacaagagaagtgacccctaccacgtgtacatcaagaacagatag

SEQ ID NO: 164920 - DNA, 513 bp, Artificial Sequence
  Description of Artificial Sequence: Synthetic coding sequence
atgctgaagatggagcccctgaacagcacccaccctggaacagctgccagcagcagccccctggagagcagagctgctgggggcggcagcggaaatggaaatgagtacttctacatcctggtggtgatgtccttctacggcatcttcctgattggcatcatgctgggctacatgaagagcaagaggcgggagaagaagagcagcctgctgctgctgtacaaggatgaggagcggctgtggggcgaggccatgaagcccctgcctgtggtgtctggcctgcggtctgtgcaggtgcccctgatgctgaacatgctgcaggagagcgtggccccagccctgagctgcaccctgtgcagcatggagggggacagcgtgtcctctgagagcagcagcccagatgtgcacctgaccatccaggaggagggcgcagatgatgagctggaggagaccagcgagacccccctgaatgaatcttctgagggcagcagcgagaacatccaccagaacagctag

SEQ ID NO: 164921 - DNA, 2031 bp, Artificial Sequence
  Description of Artificial Sequence: Synthetic coding sequence
atggctgctgccagcagcccccccagggctgagaggaagcgctggggctggggccgcctgcccggggcccggcggggcagcgctggcctggccaagaagtgccccttcagcctggagctggccgagggcggccctgctgggggcgccctgtatgcccccatcgcccctggggcccctggccctgcccccccagccagccctgctgccccagctgcccctcctgtggccagtgacctgggccccaggcctcctgtgtccctggacccccgggtgtccatctacagcaccaggaggcctgtgctggcccggacccacgtgcagggccgggtgtacaacttcctggagcggcccaccggctggaagtgctttgtgtaccactttgctgtgttcctgattgtgctggtgtgcctgatcttctctgtgctgagcaccatcgagcagtatgctgccctggccaccggcaccctcttctggatggagatcgtgctggtggtgttctttggaacagaatatgtggtgcggctgtggagcgctggctgccgcagcaaatatgtgggcctgtggggccgcctgcgctttgccaggaagcccatcagcatcatcgacctgattgtggtggtggcctccatggtggtgctgtgtgtgggcagcaagggccaggtgtttgccaccagcgccatccggggcatccgcttcctgcagatcctgaggatgctgcacgtggaccggcagggcggcacctggaggctgctgggctctgtggtgttcatccaccggcaggagctgatcaccaccctgtacatcggcttcctgggcctcatcttcagcagctactttgtgtacctggccgagaaggatgctgtgaatgaaagtggccgggtggagtttggcagctatgcagatgccctgtggtggggcgtggtgacagtgaccaccatcggctatggagacaaggtgccccagacctgggtgggcaagaccatcgccagctgcttctctgtgtttgccatctccttctttgccctgcctgctggcatcctgggcagcggctttgccctgaaggtgcagcagaagcagaggcagaagcacttcaaccggcagatcccagctgctgccagcctcatccagacagcctggcgctgctatgctgctgaaaatccagacagcagcacctggaagatctacatcaggaaggcccccaggagccacaccctgctgagccccagccccaagcccaagaagtctgtggtggtgaagaagaagaagttcaagctggacaaggacaatggagtgaccccaggagagaagatgctgactgtgccccacatcacctgtgaccccccagaggagcggcggctggaccacttctctgtggatggctatgacagctctgtgaggaagagccccaccctgctggaggtgtccatgccccacttcatgaggaccaacagctttgctgaggacctggacctggagggggagaccctgctgacccccatcacccacatcagccagctgcgggagcaccaccgggccaccatcaaggtgatccggaggatgcagtactttgtggccaagaagaagttccagcaggccaggaagccctatgatgtgagagatgtgattgagcagtacagccagggccacctgaacctgatggtgcgcatcaaggagctgcagaggcggctggaccagagcatcggcaagcccagcctcttcatctctgtgtctgagaagagcaaggaccggggcagcaacaccatcggggcccggctgaacagagtggaggacaaggtgacccagctggaccagaggctggccctgatcacagacatgctgcaccagctgctgagcctgcacggcggcagcaccccaggcagcggcggccccccccgggagggcggggcccacatcacccagccctgtggcagcggcggctctgtggaccctgagctgttcctgcccagcaacaccctgcccacctatgagcagctgactgtgccccggcggggcccagatgagggcagctag

SEQ ID NO: 164922 - DNA, 1650 bp, Artificial Sequence
  Description of Artificial Sequence: Synthetic coding sequence
atggacttcctgattgtgctggtgtgcctgatcttctctgtgctgagcaccatcgagcagtatgctgccctggccaccggcaccctcttctggatggagatcgtgctggtggtgttcttcggcacagaatatgtggtgcggctgtggagcgctggctgccgcagcaaatatgtgggcctgtggggccgcctgcgctttgccaggaagcccatcagcatcatcgacctgattgtggtggtggcctccatggtggtgctgtgtgtgggcagcaagggccaggtgtttgccaccagcgccatccggggcatccgcttcctgcagatcctgaggatgctgcacgtggaccggcagggcggcacctggaggctgctgggctctgtggtgttcatccaccggcaggagctgatcaccaccctgtacatcggcttcctgggcctcatcttcagcagctactttgtgtacctggccgagaaggatgctgtgaatgaaagtggccgggtggagtttggcagctatgcagatgccctgtggtggggcgtggtgacagtgaccaccatcggctacggggacaaggtgccccagacctgggtgggcaagaccatcgccagctgcttctctgtgtttgccatctccttctttgccctgcctgctggcatcctgggcagcggctttgccctgaaggtgcagcagaagcagaggcagaagcacttcaaccggcagatcccagctgctgccagcctcatccagacagcctggcgctgctacgccgctgagaacccagacagcagcacctggaagatctacatcaggaaggcccccaggagccacaccctgctgagccccagccccaagcccaagaagtctgtggtggtgaagaagaagaagttcaagctggacaaggacaacggggtgaccccaggagagaagatgctgactgtgccccacatcacctgtgaccccccagaggagcggcggctggaccacttctctgtggatggctatgacagctctgtgaggaagagccccaccctgctggaggtgtccatgccccacttcatgaggaccaacagctttgctgaggacctggacctggagggggagaccctgctgacccccatcacccacatcagccagctgcgggagcaccaccgggccaccatcaaggtgatccggaggatgcagtactttgtggccaagaagaagttccagcaggccaggaagccctatgatgtgagagatgtgattgagcagtacagccagggccacctgaacctgatggtgcgcatcaaggagctgcagaggcggctggaccagagcatcggcaagcccagcctcttcatctctgtgtctgagaagagcaaggaccggggcagcaacaccatcggggcccggctgaacagagtggaggacaaggtgacccagctggaccagaggctggccctgatcacagacatgctgcaccagctgctgagcctgcatggaggcagcaccccaggcagcggcggccccccccgggagggcggggcccacatcacccagccctgtggcagcggcggctctgtggaccctgagctgttcctgcccagcaacaccctgcccacctatgagcagctgactgtgccccggcggggcccagatgagggcagctag

SEQ ID NO: 164923 - DNA, 1182 bp, Artificial Sequence
  Description of Artificial Sequence: Synthetic coding sequence
atggtgcagaagagcagaaatggaggagtgtacccaggccccagcggggagaagaagctgaaggtgggctttgtgggcctggaccccggggccccagacagcaccagagatggagccctgctgattgctggcagcgaggcccccaagaggggcagcatcctgagcaagcccagggctggaggagctggggccggcaagccacccaagagaaatgccttctacaggaagctgcagaacttcctgtacaacgtgctggagcggccccggggctgggccttcatctaccacgcctacgtgttcctgctggtgttcagctgcctggtgctgagcgtcttcagcaccatcaaggagtatgagaagagcagcgagggcgccctgtacatcctggagatcgtgaccatcgtggtgtttggagtggagtactttgtgcgcatctgggccgccggctgctgctgccgctaccggggctggaggggccgcctgaagtttgccaggaagcccttctgtgtgattgacatcatggtgctgattgccagcattgctgtgctggccgccggcagccagggcaatgtgtttgccaccagcgccctgcggagcctgcgcttcctgcagatcctgaggatgatccgcatggacagaagaggaggcacctggaagctgctgggctctgtggtgtatgcccacagcaaggagctggtgacagcctggtacatcggcttcctgtgcctgatcctggccagcttcctggtgtacctggccgagaagggagaaaatgaccactttgacacctatgcagatgccctgtggtggggcctcatcaccctgaccaccatcggctacggggacaagtacccccagacctggaatggccgcctgctggccgccaccttcaccctcatcggcgtgtccttctttgccctgcctgctggcatcctgggcagcggctttgccctgaaggtgcaggagcagcaccggcagaagcactttgagaagagaagaaatcctgctgctggcctcatccagagcgcctggaggttctacgccaccaacctgagcaggacagacctgcacagcacctggcagtactatgaaagaacagtgacagtgcccatgtaccgctacagaagaagagccccagccaccaagcagctgttccacttcctgttcagcatctgcagctag

SEQ ID NO: 164924 - DNA, 2607 bp, Artificial Sequence
  Description of Artificial Sequence: Synthetic coding sequence
atggtgcagaagagcagaaatggaggagtgtacccaggccccagcggggagaagaagctgaaggtgggctttgtgggcctggaccccggggccccagacagcaccagagatggagccctgctgattgctggcagcgaggcccccaagaggggcagcatcctgagcaagcccagggctggaggagctggggccggcaagccacccaagagaaatgccttctacaggaagctgcagaacttcctgtacaacgtgctggagcggccccggggctgggccttcatctaccacgcctacgtgttcctgctggtgttcagctgcctggtgctgagcgtcttcagcaccatcaaggagtatgagaagagcagcgagggcgccctgtacatcctggagatcgtgaccatcgtggtgtttggagtggagtactttgtgcgcatctgggccgccggctgctgctgccgctaccggggctggaggggccgcctgaagtttgccaggaagcccttctgtgtgattgacatcatggtgctgattgccagcattgctgtgctggccgccggcagccagggcaatgtgtttgccaccagcgccctgcggagcctgcgcttcctgcagatcctgaggatgatccgcatggacagaagaggaggcacctggaagctgctgggctctgtggtgtatgcccacagcaaggagctggtgacagcctggtacatcggcttcctgtgcctgatcctggccagcttcctggtgtacctggccgagaagggagaaaatgaccactttgacacctatgcagatgccctgtggtggggcctcatcaccctgaccaccatcggctacggggacaagtacccccagacctggaatggccgcctgctggccgccaccttcaccctcatcggcgtgtccttctttgccctgcctgctggcatcctgggcagcggctttgccctgaaggtgcaggagcagcaccggcagaagcactttgagaagagaagaaatcctgctgctggcctcatccagagcgcctggaggttctacgccaccaacctgagcaggacagacctgcacagcacctggcagtactatgaaagaacagtgacagtgcccatgtaccgcctcatcccccccctgaaccagctggagctgctgaggaacctgaagagcaagagcggcctggccttcaggaaggaccccccacctgagcccagccccagcccccggggcgtggccgccaagggcaagggcagcccccaggcccagacagtgcggcgcagccccagcgctgaccagagcctggaggacagccccagcaaggtgcccaagtcctggagctttggagacaggagccgggcccggcaggccttccgcatcaagggagctgccagccggcagaacagcgaggaggccagcctgcctggagaagatattgtggatgacaagagctgcccctgtgaatttgtgacagaggacctgaccccaggcctgaaggtgtccatccgggctgtgtgtgtgatgaggttcctggtgtccaagaggaagttcaaggagagcctgcggccctatgatgtgatggatgtgattgagcagtacagcgctggccacctggacatgctgagccgcatcaagagcctgcagagcagaattgacatgattgtgggccccccaccacccagcacccccaggcacaagaagtaccccaccaagggccccacagccccaccccgggagagcccccagtacagcccccgggtggaccagatcgtgggccggggccctgccatcacagacaaggacaggaccaagggccctgctgaggccgagctgcctgaggaccccagcatgatgggccgcctgggcaaggtggagaagcaggtgctgtccatggagaagaagctggacttcctggtgaacatctacatgcagaggatgggcatccccccaacagaaacagaggcctactttggagccaaggagcctgagcccgccccaccctaccacagccctgaggacagccgggagcacgtggacagacatggctgcatcgtgaagatcgtgcgcagcagcagcagcacaggccagaagaacttcagcgcccccccagctgcccctcctgtgcagtgcccccccagcacctcctggcagccccagagccacccccggcagggccacggcaccagccctgtgggggaccacggcagcctggtgcgcatccccccacctccagcccacgagaggagcctgagcgcctatggaggcggcaacagagcctccatggagttcctgcggcaggaggacaccccaggctgccggcccccagagggcaacctgcgggacagcgacaccagcatcagcatccccagcgtggaccacgaggagctggagaggagcttcagcggcttcagcatcagccagagcaaggagaacctggatgccctgaacagctgctacgccgctgtggccccctgtgccaaggtgcggccctacatcgccgagggggagagtgacacagacagcgacctgtgcaccccctgtggccccccacccaggtctgccactggagagggcccctttggagatgtgggctgggccggccccaggaagtag

SEQ ID NO: 164925 - DNA, 2643 bp, Artificial Sequence
  Description of Artificial Sequence: Synthetic coding sequence
atggtgcagaagagcagaaatggaggagtgtacccaggccccagcggggagaagaagctgaaggtgggctttgtgggcctggaccccggggccccagacagcaccagagatggagccctgctgattgctggcagcgaggcccccaagaggggcagcatcctgagcaagcccagggctggaggagctggggccggcaagccacccaagagaaatgccttctacaggaagctgcagaacttcctgtacaacgtgctggagcggccccggggctgggccttcatctaccacgcctacgtgttcctgctggtgttcagctgcctggtgctgagcgtcttcagcaccatcaaggagtatgagaagagcagcgagggcgccctgtacatcctggagatcgtgaccatcgtggtgtttggagtggagtactttgtgcgcatctgggccgccggctgctgctgccgctaccggggctggaggggccgcctgaagtttgccaggaagcccttctgtgtgattgacatcatggtgctgattgccagcattgctgtgctggccgccggcagccagggcaatgtgtttgccaccagcgccctgcggagcctgcgcttcctgcagatcctgaggatgatccgcatggacagaagaggaggcacctggaagctgctgggctctgtggtgtatgcccacagcaaggagctggtgacagcctggtacatcggcttcctgtgcctgatcctggccagcttcctggtgtacctggccgagaagggagaaaatgaccactttgacacctatgcagatgccctgtggtggggcctcatcaccctgaccaccatcggctacggggacaagtacccccagacctggaatggccgcctgctggccgccaccttcaccctcatcggcgtgtccttctttgccctgcctgctggcatcctgggcagcggctttgccctgaaggtgcaggagcagcaccggcagaagcactttgagaagagaagaaatcctgctgctggcctcatccagagcgcctggaggttctacgccaccaacctgagcaggacagacctgcacagcacctggcagtactatgaaagaacagtgacagtgcccatgtaccgcctcatcccccccctgaaccagctggagctgctgaggaacctgaagagcaagagcggcctggccttcaggaaggaccccccacctgagcccagccccagccagaaggtgtccctgaaggacagagtcttcagcagcccccggggcgtggccgccaagggcaagggcagcccccaggcccagacagtgcggcgcagccccagcgctgaccagagcctggaggacagccccagcaaggtgcccaagtcctggagctttggagacaggagccgggcccggcaggccttccgcatcaagggagctgccagccggcagaacagcgaggaggccagcctgcctggagaagatattgtggatgacaagagctgcccctgtgaatttgtgacagaggacctgaccccaggcctgaaggtgtccatccgggctgtgtgtgtgatgaggttcctggtgtccaagaggaagttcaaggagagcctgcggccctatgatgtgatggatgtgattgagcagtacagcgctggccacctggacatgctgagccgcatcaagagcctgcagacaggaattgacatgattgtgggccccccaccacccagcacccccaggcacaagaagtaccccaccaagggccccacagccccaccccgggagagcccccagtacagcccccgggtggaccagatcgtgggccggggccctgccatcacagacaaggacaggaccaagggccctgctgaggccgagctgcctgaggaccccagcatgatgggccgcctgggcaaggtggagaagcaggtgctgtccatggagaagaagctggacttcctggtgaacatctacatgcagaggatgggcatccccccaacagaaacagaggcctactttggagccaaggagcctgagcccgccccaccctaccacagccctgaggacagccgggagcacgtggacagacatggctgcatcgtgaagatcgtgcgcagcagcagcagcacaggccagaagaacttcagcgcccccccagctgcccctcctgtgcagtgcccccccagcacctcctggcagccccagagccacccccggcagggccacggcaccagccctgtgggggaccacggcagcctggtgcgcatccccccacctccagcccacgagaggagcctgagcgcctatggaggcggcaacagagcctccatggagttcctgcggcaggaggacaccccaggctgccggcccccagagggcaacctgcgggacagcgacaccagcatcagcatccccagcgtggaccacgaggagctggagaggagcttcagcggcttcagcatcagccagagcaaggagaacctggatgccctgaacagctgctacgccgctgtggccccctgtgccaaggtgcggccctacatcgccgagggggagagtgacacagacagcgacctgtgcaccccctgtggccccccacccaggtctgccactggagagggcccctttggagatgtgggctgggccggccccaggaagtag

SEQ ID NO: 164926 - DNA, 2565 bp, Artificial Sequence
  Description of Artificial Sequence: Synthetic coding sequence
atggtgcagaagagcagaaatggaggagtgtacccaggccccagcggggagaagaagctgaaggtgggctttgtgggcctggaccccggggccccagacagcaccagagatggagccctgctgattgctggcagcgaggcccccaagaggggcagcatcctgagcaagcccagggctggaggagctggggccggcaagccacccaagagaaatgccttctacaggaagctgcagaacttcctgtacaacgtgctggagcggccccggggctgggccttcatctaccacgcctacgtgttcctgctggtgttcagctgcctggtgctgagcgtcttcagcaccatcaaggagtatgagaagagcagcgagggcgccctgtacatcctggagatcgtgaccatcgtggtgtttggagtggagtactttgtgcgcatctgggccgccggctgctgctgccgctaccggggctggaggggccgcctgaagtttgccaggaagcccttctgtgtgattgacatcatggtgctgattgccagcattgctgtgctggccgccggcagccagggcaatgtgtttgccaccagcgccctgcggagcctgcgcttcctgcagatcctgaggatgatccgcatggacagaagaggaggcacctggaagctgctgggctctgtggtgtatgcccacagcaaggagctggtgacagcctggtacatcggcttcctgtgcctgatcctggccagcttcctggtgtacctggccgagaagggagaaaatgaccactttgacacctatgcagatgccctgtggtggggcctcatcaccctgaccaccatcggctacggggacaagtacccccagacctggaatggccgcctgctggccgccaccttcaccctcatcggcgtgtccttctttgccctgcctgctggcatcctgggcagcggctttgccctgaaggtgcaggagcagcaccggcagaagcactttgagaagagaagaaatcctgctgctggcctcatccagagcgcctggaggttctacgccaccaacctgagcaggacagacctgcacagcacctggcagtactatgaaagaacagtgacagtgcccatgtacagcagccagacccagacctatggagccagccgcctcatcccccccctgaaccagctggagctgctgaggaacctgaagagcaagagcggcctggccttcaggaaggaccccccacctgagcccagccccagccagaaggtgtccctgaaggacagagtcttcagcagcccccggggcgtggccgccaagggcaagggcagcccccaggcccagacagtgcggcgcagccccagcgctgaccagagcctggaggacagccccagcaaggtgcccaagtcctggagctttggagacaggagccgggcccggcaggccttccgcatcaagggagctgccagccggcagaacagcgaggaggccagcctgcctggagaagatattgtggatgacaagagctgcccctgtgaatttgtgacagaggacctgaccccaggcctgaaggtgtccatccgggctgtgtgtgtgatgaggttcctggtgtccaagaggaagttcaaggagagcctgcggccctatgatgtgatggatgtgattgagcagtacagcgctggccacctggacatgctgagccgcatcaagagcctgcagagccgggtggaccagatcgtgggccggggccctgccatcacagacaaggacaggaccaagggccctgctgaggccgagctgcctgaggaccccagcatgatgggccgcctgggcaaggtggagaagcaggtgctgtccatggagaagaagctggacttcctggtgaacatctacatgcagaggatgggcatccccccaacagaaacagaggcctactttggagccaaggagcctgagcccgccccaccctaccacagccctgaggacagccgggagcacgtggacagacatggctgcatcgtgaagatcgtgcgcagcagcagcagcacaggccagaagaacttcagcgcccccccagctgcccctcctgtgcagtgcccccccagcacctcctggcagccccagagccacccccggcagggccacggcaccagccctgtgggggaccacggcagcctggtgcgcatccccccacctccagcccacgagaggagcctgagcgcctatggaggcggcaacagagcctccatggagttcctgcggcaggaggacaccccaggctgccggcccccagagggcaacctgcgggacagcgacaccagcatcagcatccccagcgtggaccacgaggagctggagaggagcttcagcggcttcagcatcagccagagcaaggagaacctggatgccctgaacagctgctacgccgctgtggccccctgtgccaaggtgcggccctacatcgccgagggggagagtgacacagacagcgacctgtgcaccccctgtggccccccacccaggtctgccactggagagggcccctttggagatgtgggctgggccggccccaggaagtag

SEQ ID NO: 164927 - DNA, 2619 bp, Artificial Sequence
  Description of Artificial Sequence: Synthetic coding sequence
atggtgcagaagagcagaaatggaggagtgtacccaggccccagcggggagaagaagctgaaggtgggctttgtgggcctggaccccggggccccagacagcaccagagatggagccctgctgattgctggcagcgaggcccccaagaggggcagcatcctgagcaagcccagggctggaggagctggggccggcaagccacccaagagaaatgccttctacaggaagctgcagaacttcctgtacaacgtgctggagcggccccggggctgggccttcatctaccacgcctacgtgttcctgctggtgttcagctgcctggtgctgagcgtcttcagcaccatcaaggagtatgagaagagcagcgagggcgccctgtacatcctggagatcgtgaccatcgtggtgtttggagtggagtactttgtgcgcatctgggccgccggctgctgctgccgctaccggggctggaggggccgcctgaagtttgccaggaagcccttctgtgtgattgacatcatggtgctgattgccagcattgctgtgctggccgccggcagccagggcaatgtgtttgccaccagcgccctgcggagcctgcgcttcctgcagatcctgaggatgatccgcatggacagaagaggaggcacctggaagctgctgggctctgtggtgtatgcccacagcaaggagctggtgacagcctggtacatcggcttcctgtgcctgatcctggccagcttcctggtgtacctggccgagaagggagaaaatgaccactttgacacctatgcagatgccctgtggtggggcctcatcaccctgaccaccatcggctacggggacaagtacccccagacctggaatggccgcctgctggccgccaccttcaccctcatcggcgtgtccttctttgccctgcctgctggcatcctgggcagcggctttgccctgaaggtgcaggagcagcaccggcagaagcactttgagaagagaagaaatcctgctgctggcctcatccagagcgcctggaggttctacgccaccaacctgagcaggacagacctgcacagcacctggcagtactatgaaagaacagtgacagtgcccatgtacagcagccagacccagacctatggagccagccgcctcatcccccccctgaaccagctggagctgctgaggaacctgaagagcaagagcggcctggccttcaggaaggaccccccacctgagcccagccccagcaagggcagcccctgccggggccccctgtgtggctgctgccccggccgcagcagccagaaggtgtccctgaaggacagagtcttcagcagcccccggggcgtggccgccaagggcaagggcagcccccaggcccagacagtgcggcgcagccccagcgctgaccagagcctggaggacagccccagcaaggtgcccaagtcctggagctttggagacaggagccgggcccggcaggccttccgcatcaagggagctgccagccggcagaacagcgaggaggccagcctgcctggagaagatattgtggatgacaagagctgcccctgtgaatttgtgacagaggacctgaccccaggcctgaaggtgtccatccgggctgtgtgtgtgatgaggttcctggtgtccaagaggaagttcaaggagagcctgcggccctatgatgtgatggatgtgattgagcagtacagcgctggccacctggacatgctgagccgcatcaagagcctgcagagccgggtggaccagatcgtgggccggggccctgccatcacagacaaggacaggaccaagggccctgctgaggccgagctgcctgaggaccccagcatgatgggccgcctgggcaaggtggagaagcaggtgctgtccatggagaagaagctggacttcctggtgaacatctacatgcagaggatgggcatccccccaacagaaacagaggcctactttggagccaaggagcctgagcccgccccaccctaccacagccctgaggacagccgggagcacgtggacagacatggctgcatcgtgaagatcgtgcgcagcagcagcagcacaggccagaagaacttcagcgcccccccagctgcccctcctgtgcagtgcccccccagcacctcctggcagccccagagccacccccggcagggccacggcaccagccctgtgggggaccacggcagcctggtgcgcatccccccacctccagcccacgagaggagcctgagcgcctatggaggcggcaacagagcctccatggagttcctgcggcaggaggacaccccaggctgccggcccccagagggcaacctgcgggacagcgacaccagcatcagcatccccagcgtggaccacgaggagctggagaggagcttcagcggcttcagcatcagccagagcaaggagaacctggatgccctgaacagctgctacgccgctgtggccccctgtgccaaggtgcggccctacatcgccgagggggagagtgacacagacagcgacctgtgcaccccctgtggccccccacccaggtctgccactggagagggcccctttggagatgtgggctgggccggccccaggaagtag

SEQ ID NO: 164928 - DNA, 2619 bp, Artificial Sequence
  Description of Artificial Sequence: Synthetic coding sequence
atggtgcagaagagcagaaatggaggagtgtacccaggccccagcggggagaagaagctgaaggtgggctttgtgggcctggaccccggggccccagacagcaccagagatggagccctgctgattgctggcagcgaggcccccaagaggggcagcatcctgagcaagcccagggctggaggagctggggccggcaagccacccaagagaaatgccttctacaggaagctgcagaacttcctgtacaacgtgctggagcggccccggggctgggccttcatctaccacgcctacgtgttcctgctggtgttcagctgcctggtgctgagcgtcttcagcaccatcaaggagtatgagaagagcagcgagggcgccctgtacatcctggagatcgtgaccatcgtggtgtttggagtggagtactttgtgcgcatctgggccgccggctgctgctgccgctaccggggctggaggggccgcctgaagtttgccaggaagcccttctgtgtgattgacatcatggtgctgattgccagcattgctgtgctggccgccggcagccagggcaatgtgtttgccaccagcgccctgcggagcctgcgcttcctgcagatcctgaggatgatccgcatggacagaagaggaggcacctggaagctgctgggctctgtggtgtatgcccacagcaaggagctggtgacagcctggtacatcggcttcctgtgcctgatcctggccagcttcctggtgtacctggccgagaagggagaaaatgaccactttgacacctatgcagatgccctgtggtggggcctcatcaccctgaccaccatcggctacggggacaagtacccccagacctggaatggccgcctgctggccgccaccttcaccctcatcggcgtgtccttctttgccctgcctgctggcatcctgggcagcggctttgccctgaaggtgcaggagcagcaccggcagaagcactttgagaagagaagaaatcctgctgctggcctcatccagagcgcctggaggttctacgccaccaacctgagcaggacagacctgcacagcacctggcagtactatgaaagaacagtgacagtgcccatgtacagcagccagacccagacctatggagccagccgcctcatcccccccctgaaccagctggagctgctgaggaacctgaagagcaagagcggcctggccttcaggaaggaccccccacctgagcccagccccagcaagggcagcccctgccggggccccctgtgtggctgctgccccggccgcagcagccagaaggtgtccctgaaggacagagtcttcagcagcccccggggcgtggccgccaagggcaagggcagcccccaggcccagacagtgcggcgcagccccagcgctgaccagagcctggaggacagccccagcaaggtgcccaagtcctggagctttggagacaggagccgggcccggcaggccttccgcatcaagggagctgccagccggcagaacagcgaggaggccagcctgcctggagaagatattgtggatgacaagagctgcccctgtgaatttgtgacagaggacctgaccccaggcctgaaggtgtccatccgggctgtgtgtgtgatgaggttcctggtgtccaagaggaagttcaaggagagcctgcggccctatgatgtgatggatgtgattgagcagtacagcgctggccacctggacatgctgagccgcatcaagagcctgcagagccaggtggaccagatcgtgggccggggccctgccatcacagacaaggacaggaccaagggccctgctgaggccgagctgcctgaggaccccagcatgatgggccgcctgggcaaggtggagaagcaggtgctgtccatggagaagaagctggacttcctggtgaacatctacatgcagaggatgggcatccccccaacagaaacagaggcctactttggagccaaggagcctgagcccgccccaccctaccacagccctgaggacagccgggagcacgtggacagacatggctgcatcgtgaagatcgtgcgcagcagcagcagcacaggccagaagaacttcagcgcccccccagctgcccctcctgtgcagtgcccccccagcacctcctggcagccccagagccacccccggcagggccacggcaccagccctgtgggggaccacggcagcctggtgcgcatccccccacctccagcccacgagaggagcctgagcgcctatggaggcggcaacagagcctccatggagttcctgcggcaggaggacaccccaggctgccggcccccagagggcaacctgcgggacagcgacaccagcatcagcatccccagcgtggaccacgaggagctggagaggagcttcagcggcttcagcatcagccagagcaaggagaacctggatgccctgaacagctgctacgccgctgtggccccctgtgccaaggtgcggccctacatcgccgagggggagagtgacacagacagcgacctgtgcaccccctgtggccccccacccaggtctgccactggagagggcccctttggagatgtgggctgggccggccccaggaagtag

SEQ ID NO: 164929 - DNA, 2535 bp, Artificial Sequence
  Description of Artificial Sequence: Synthetic coding sequence
atggtgcagaagagcagaaatggaggagtgtacccaggccccagcggggagaagaagctgaaggtgggctttgtgggcctggaccccggggccccagacagcaccagagatggagccctgctgattgctggcagcgaggcccccaagaggggcagcatcctgagcaagcccagggctggaggagctggggccggcaagccacccaagagaaatgccttctacaggaagctgcagaacttcctgtacaacgtgctggagcggccccggggctgggccttcatctaccacgcctacgtgttcctgctggtgttcagctgcctggtgctgagcgtcttcagcaccatcaaggagtatgagaagagcagcgagggcgccctgtacatcctggagatcgtgaccatcgtggtgtttggagtggagtactttgtgcgcatctgggccgccggctgctgctgccgctaccggggctggaggggccgcctgaagtttgccaggaagcccttctgtgtgattgacatcatggtgctgattgccagcattgctgtgctggccgccggcagccagggcaatgtgtttgccaccagcgccctgcggagcctgcgcttcctgcagatcctgaggatgatccgcatggacagaagaggaggcacctggaagctgctgggctctgtggtgtatgcccacagcaaggagctggtgacagcctggtacatcggcttcctgtgcctgatcctggccagcttcctggtgtacctggccgagaagggagaaaatgaccactttgacacctatgcagatgccctgtggtggggcctcatcaccctgaccaccatcggctacggggacaagtacccccagacctggaatggccgcctgctggccgccaccttcaccctcatcggcgtgtccttctttgccctgcctgctggcatcctgggcagcggctttgccctgaaggtgcaggagcagcaccggcagaagcactttgagaagagaagaaatcctgctgctggcctcatccagagcgcctggaggttctacgccaccaacctgagcaggacagacctgcacagcacctggcagtactatgaaagaacagtgacagtgcccatgtaccgcctcatcccccccctgaaccagctggagctgctgaggaacctgaagagcaagagcggcctggccttcaggaaggaccccccacctgagcccagccccagccagaaggtgtccctgaaggacagagtcttcagcagcccccggggcgtggccgccaagggcaagggcagcccccaggcccagacagtgcggcgcagccccagcgctgaccagagcctggaggacagccccagcaaggtgcccaagtcctggagctttggagacaggagccgggcccggcaggccttccgcatcaagggagctgccagccggcagaacagcgaggaggccagcctgcctggagaagatattgtggatgacaagagctgcccctgtgaatttgtgacagaggacctgaccccaggcctgaaggtgtccatccgggctgtgtgtgtgatgaggttcctggtgtccaagaggaagttcaaggagagcctgcggccctatgatgtgatggatgtgattgagcagtacagcgctggccacctggacatgctgagccgcatcaagagcctgcagagccgggtggaccagatcgtgggccggggccctgccatcacagacaaggacaggaccaagggccctgctgaggccgagctgcctgaggaccccagcatgatgggccgcctgggcaaggtggagaagcaggtgctgtccatggagaagaagctggacttcctggtgaacatctacatgcagaggatgggcatccccccaacagaaacagaggcctactttggagccaaggagcctgagcccgccccaccctaccacagccctgaggacagccgggagcacgtggacagacatggctgcatcgtgaagatcgtgcgcagcagcagcagcacaggccagaagaacttcagcgcccccccagctgcccctcctgtgcagtgcccccccagcacctcctggcagccccagagccacccccggcagggccacggcaccagccctgtgggggaccacggcagcctggtgcgcatccccccacctccagcccacgagaggagcctgagcgcctatggaggcggcaacagagcctccatggagttcctgcggcaggaggacaccccaggctgccggcccccagagggcaacctgcgggacagcgacaccagcatcagcatccccagcgtggaccacgaggagctggagaggagcttcagcggcttcagcatcagccagagcaaggagaacctggatgccctgaacagctgctacgccgctgtggccccctgtgccaaggtgcggccctacatcgccgagggggagagtgacacagacagcgacctgtgcaccccctgtggccccccacccaggtctgccactggagagggcccctttggagatgtgggctgggccggccccaggaagtag

SEQ ID NO: 164930 - DNA, 1311 bp, Artificial Sequence
  Description of Artificial Sequence: Synthetic coding sequence
atggtgcagaagagcagaaatggaggagtgtacccaggccccagcggggagaagaagctgaaggtgggctttgtgggcctggaccccggggccccagacagcaccagagatggagccctgctgattgctggcagcgaggcccccaagaggggcagcatcctgagcaagcccagggctggaggagctggggccggcaagccacccaagagaaatgccttctacaggaagctgcagaacttcctgtacaacgtgctggagcggccccggggctgggccttcatctaccacgcctacgtgttcctgctggtgttcagctgcctggtgctgagcgtcttcagcaccatcaaggagtatgagaagagcagcgagggcgccctgtacatcctggagatcgtgaccatcgtggtgtttggagtggagtactttgtgcgcatctgggccgccggctgctgctgccgctaccggggctggaggggccgcctgaagtttgccaggaagcccttctgtgtgattgacatcatggtgctgattgccagcattgctgtgctggccgccggcagccagggcaatgtgtttgccaccagcgccctgcggagcctgcgcttcctgcagatcctgaggatgatccgcatggacagaagaggaggcacctggaagctgctgggctctgtggtgtatgcccacagcaaggagctggtgacagcctggtacatcggcttcctgtgcctgatcctggccagcttcctggtgtacctggccgagaagggagaaaatgaccactttgacacctatgcagatgccctgtggtggggcctcatcaccctgaccaccatcggctacggggacaagtacccccagacctggaatggccgcctgctggccgccaccttcaccctcatcggcgtgtccttctttgccctgcctgctggcatcctgggcagcggctttgccctgaaggtgcaggagcagcaccggcagaagcactttgagaagagaagaaatcctgctgctggcctcatccagagcgcctggaggttctacgccaccaacctgagcaggacagacctgcacagcacctggcagtactatgaaagaacagtgacagtgcccatgtaccgcctcatcccccccctgaaccagctggagctgctgaggaacctgaagagcaagagcggcctggccttcaggaaggaccccccacctgagcccagccccaggtctgtgcccccagctgccaccctggtgtctgctgtgtgcacagctgtgtggagcctgagccacacctgtgcccagcctgtgatggagatgtag

SEQ ID NO: 164931 - DNA, 1848 bp, Artificial Sequence
  Description of Artificial Sequence: Synthetic coding sequence
atggtgcagaagagcagaaatggaggagtgtacccaggccccagcggggagaagaagctgaaggtgggctttgtgggcctggaccccggggccccagacagcaccagagatggagccctgctgattgctggcagcgaggcccccaagaggggcagcatcctgagcaagcccagggctggaggagctggggccggcaagccacccaagagaaatgccttctacaggaagctgcagaacttcctgtacaacgtgctggagcggccccggggctgggccttcatctaccacgcctacgtgttcctgctggtgttcagctgcctggtgctgagcgtcttcagcaccatcaaggagtatgagaagagcagcgagggcgccctgtacatcctggagatcgtgaccatcgtggtgtttggagtggagtactttgtgcgcatctgggccgccggctgctgctgccgctaccggggctggaggggccgcctgaagtttgccaggaagcccttctgtgtgattgacatcatggtgctgattgccagcattgctgtgctggccgccggcagccagggcaatgtgtttgccaccagcgccctgcggagcctgcgcttcctgcagatcctgaggatgatccgcatggacagaagaggaggcacctggaagctgctgggctctgtggtgtatgcccacagcaaggagctggtgacagcctggtacatcggcttcctgtgcctgatcctggccagcttcctggtgtacctggccgagaagggagaaaatgaccactttgacacctatgcagatgccctgtggtggggcctcatcaccctgaccaccatcggctacggggacaagtacccccagacctggaatggccgcctgctggccgccaccttcaccctcatcggcgtgtccttctttgccctgcctgctggcatcctgggcagcggctttgccctgaaggtgcaggagcagcaccggcagaagcactttgagaagagaagaaatcctgctgctggcctcatccagagcgcctggaggttctacgccaccaacctgagcaggacagacctgcacagcacctggcagtactatgaaagaacagtgacagtgcccatgtaccgcctcatcccccccctgaaccagctggagctgctgaggaacctgaagagcaagagcggcctggccttcaggaaggaccccccacctgagcccagccccagccagaaggtgtccctgaaggacagagtcttcagcagcccccggggcgtggccgccaagggcaagggcagcccccaggcccagacagtgcggcgcagccccagcgctgaccagagcctggaggacagccccagcaaggtgcccaagtcctggagctttggagacaggagccgggcccggcaggccttccgcatcaagggagctgccagccggcagaacagcgaggaggccagcctgcctggagaagatattgtggatgacaagagctgcccctgtgaatttgtgacagaggacctgaccccaggcctgaaggtgtccatccgggctgtgtgtgtgatgaggttcctggtgtccaagaggaagttcaaggagagcctgcggccctatgatgtgatggatgtgattgagcagtacagcgctggccacctggacatgctgagccgcatcaagagcctgcagagccggcaggagccccggctgcctgtgcagcagggcaccaggacaggctgggccagcggcaccaagcccaccgtggcccatggaggcagcgctggaggagtgtgggccggccccccaccccacccccggcggcccctgagcgcctctgtggtgagcagccagagcctcttctag

SEQ ID NO: 164932 - DNA, 2643 bp, Artificial Sequence
  Description of Artificial Sequence: Synthetic coding sequence
atggtgcagaagagcagaaatggaggagtgtacccaggccccagcggggagaagaagctgaaggtgggctttgtgggcctggaccccggggccccagacagcaccagagatggagccctgctgattgctggcagcgaggcccccaagaggggcagcatcctgagcaagcccagggctggaggagctggggccggcaagccacccaagagaaatgccttctacaggaagctgcagaacttcctgtacaacgtgctggagcggccccggggctgggccttcatctaccacgcctacgtgttcctgctggtgttcagctgcctggtgctgagcgtcttcagcaccatcaaggagtatgagaagagcagcgagggcgccctgtacatcctggagatcgtgaccatcgtggtgtttggagtggagtactttgtgcgcatctgggccgccggctgctgctgccgctaccggggctggaggggccgcctgaagtttgccaggaagcccttctgtgtgattgacatcatggtgctgattgccagcattgctgtgctggccgccggcagccagggcaatgtgtttgccaccagcgccctgcggagcctgcgcttcctgcagatcctgaggatgatccgcatggacagaagaggaggcacctggaagctgctgggctctgtggtgtatgcccacagcaaggagctggtgacagcctggtacatcggcttcctgtgcctgatcctggccagcttcctggtgtacctggccgagaagggagaaaatgaccactttgacacctatgcagatgccctgtggtggggcctcatcaccctgaccaccatcggctacggggacaagtacccccagacctggaatggccgcctgctggccgccaccttcaccctcatcggcgtgtccttctttgccctgcctgctggcatcctgggcagcggctttgccctgaaggtgcaggagcagcaccggcagaagcactttgagaagagaagaaatcctgctgctggcctcatccagagcgcctggaggttctacgccaccaacctgagcaggacagacctgcacagcacctggcagtactatgaaagaacagtgacagtgcccatgtaccgcctcatcccccccctgaaccagctggagctgctgaggaacctgaagagcaagagcggcctggccttcaggaaggaccccccacctgagcccagccccagccagaaggtgtccctgaaggacagagtcttcagcagcccccggggcgtggccgccaagggcaagggcagcccccaggcccagacagtgcggcgcagccccagcgctgaccagagcctggaggacagccccagcaaggtgcccaagtcctggagctttggagacaggagccgggcccggcaggccttccgcatcaagggagctgccagccggcagaacagcgaggaggccagcctgcctggagaagatattgtggatgacaagagctgcccctgtgaatttgtgacagaggacctgaccccaggcctgaaggtgtccatccgggctgtgtgtgtgatgaggttcctggtgtccaagaggaagttcaaggagagcctgcggccctatgatgtgatggatgtgattgagcagtacagcgctggccacctggacatgctgagccgcatcaagagcctgcagagcagaattgacatgattgtgggccccccaccacccagcacccccaggcacaagaagtaccccaccaagggccccacagccccaccccgggagagcccccagtacagcccccgggtggaccagatcgtgggccggggccctgccatcacagacaaggacaggaccaagggccctgctgaggccgagctgcctgaggaccccagcatgatgggccgcctgggcaaggtggagaagcaggtgctgtccatggagaagaagctggacttcctggtgaacatctacatgcagaggatgggcatccccccaacagaaacagaggcctactttggagccaaggagcctgagcccgccccaccctaccacagccctgaggacagccgggagcacgtggacagacatggctgcatcgtgaagatcgtgcgcagcagcagcagcacaggccagaagaacttcagcgcccccccagctgcccctcctgtgcagtgcccccccagcacctcctggcagccccagagccacccccggcagggccacggcaccagccctgtgggggaccacggcagcctggtgcgcatccccccacctccagcccacgagaggagcctgagcgcctatggaggcggcaacagagcctccatggagttcctgcggcaggaggacaccccaggctgccggcccccagagggcaacctgcgggacagcgacaccagcatcagcatccccagcgtggaccacgaggagctggagaggagcttcagcggcttcagcatcagccagagcaaggagaacctggatgccctgaacagctgctacgccgctgtggccccctgtgccaaggtgcggccctacatcgccgagggggagagtgacacagacagcgacctgtgcaccccctgtggccccccacccaggtctgccactggagagggcccctttggagatgtgggctgggccggccccaggaagtag

SEQ ID NO: 164933 - DNA, 2529 bp, Artificial Sequence
  Description of Artificial Sequence: Synthetic coding sequence
atggtgcagaagagcagaaatggaggagtgtacccaggccccagcggggagaagaagctgaaggtgggctttgtgggcctggaccccggggccccagacagcaccagagatggagccctgctgattgctggcagcgaggcccccaagaggggcagcatcctgagcaagcccagggctggaggagctggggccggcaagccacccaagagaaatgccttctacaggaagctgcagaacttcctgtacaacgtgctggagcggccccggggctgggccttcatctaccacgcctacgtgttcctgctggtgttcagctgcctggtgctgagcgtcttcagcaccatcaaggagtatgagaagagcagcgagggcgccctgtacatcctggagatcgtgaccatcgtggtgtttggagtggagtactttgtgcgcatctgggccgccggctgctgctgccgctaccggggctggaggggccgcctgaagtttgccaggaagcccttctgtgtgattgacatcatggtgctgattgccagcattgctgtgctggccgccggcagccagggcaatgtgtttgccaccagcgccctgcggagcctgcgcttcctgcagatcctgaggatgatccgcatggacagaagaggaggcacctggaagctgctgggctctgtggtgtatgcccacagcaaggagctggtgacagcctggtacatcggcttcctgtgcctgatcctggccagcttcctggtgtacctggccgagaagggagaaaatgaccactttgacacctatgcagatgccctgtggtggggcctcatcaccctgaccaccatcggctacggggacaagtacccccagacctggaatggccgcctgctggccgccaccttcaccctcatcggcgtgtccttctttgccctgcctgctggcatcctgggcagcggctttgccctgaaggtgcaggagcagcaccggcagaagcactttgagaagagaagaaatcctgctgctggcctcatccagagcgcctggaggttctacgccaccaacctgagcaggacagacctgcacagcacctggcagtactatgaaagaacagtgacagtgcccatgtacagcagccagacccagacctatggagccagccgcctcatcccccccctgaaccagctggagctgctgaggaacctgaagagcaagagcggcctggccttcaggaaggaccccccacctgagcccagccccagcccccggggcgtggccgccaagggcaagggcagcccccaggcccagacagtgcggcgcagccccagcgctgaccagagcctggaggacagccccagcaaggtgcccaagtcctggagctttggagacaggagccgggcccggcaggccttccgcatcaagggagctgccagccggcagaacagcgaggaggccagcctgcctggagaagatattgtggatgacaagagctgcccctgtgaatttgtgacagaggacctgaccccaggcctgaaggtgtccatccgggctgtgtgtgtgatgaggttcctggtgtccaagaggaagttcaaggagagcctgcggccctatgatgtgatggatgtgattgagcagtacagcgctggccacctggacatgctgagccgcatcaagagcctgcagagccgggtggaccagatcgtgggccggggccctgccatcacagacaaggacaggaccaagggccctgctgaggccgagctgcctgaggaccccagcatgatgggccgcctgggcaaggtggagaagcaggtgctgtccatggagaagaagctggacttcctggtgaacatctacatgcagaggatgggcatccccccaacagaaacagaggcctactttggagccaaggagcctgagcccgccccaccctaccacagccctgaggacagccgggagcacgtggacagacatggctgcatcgtgaagatcgtgcgcagcagcagcagcacaggccagaagaacttcagcgcccccccagctgcccctcctgtgcagtgcccccccagcacctcctggcagccccagagccacccccggcagggccacggcaccagccctgtgggggaccacggcagcctggtgcgcatccccccacctccagcccacgagaggagcctgagcgcctatggaggcggcaacagagcctccatggagttcctgcggcaggaggacaccccaggctgccggcccccagagggcaacctgcgggacagcgacaccagcatcagcatccccagcgtggaccacgaggagctggagaggagcttcagcggcttcagcatcagccagagcaaggagaacctggatgccctgaacagctgctacgccgctgtggccccctgtgccaaggtgcggccctacatcgccgagggggagagtgacacagacagcgacctgtgcaccccctgtggccccccacccaggtctgccactggagagggcccctttggagatgtgggctgggccggccccaggaagtag

SEQ ID NO: 164934 - DNA, 2526 bp, Artificial Sequence
  Description of Artificial Sequence: Synthetic coding sequence
atggtgcagaagagcagaaatggaggagtgtacccaggccccagcggggagaagaagctgaaggtgggctttgtgggcctggaccccggggccccagacagcaccagagatggagccctgctgattgctggcagcgaggcccccaagaggggcagcatcctgagcaagcccagggctggaggagctggggccggcaagccacccaagagaaatgccttctacaggaagctgcagaacttcctgtacaacgtgctggagcggccccggggctgggccttcatctaccacgcctacgtgttcctgctggtgttcagctgcctggtgctgagcgtcttcagcaccatcaaggagtatgagaagagcagcgagggcgccctgtacatcctggagatcgtgaccatcgtggtgtttggagtggagtactttgtgcgcatctgggccgccggctgctgctgccgctaccggggctggaggggccgcctgaagtttgccaggaagcccttctgtgtgattgacatcatggtgctgattgccagcattgctgtgctggccgccggcagccagggcaatgtgtttgccaccagcgccctgcggagcctgcgcttcctgcagatcctgaggatgatccgcatggacagaagaggaggcacctggaagctgctgggctctgtggtgtatgcccacagcaaggagctggtgacagcctggtacatcggcttcctgtgcctgatcctggccagcttcctggtgtacctggccgagaagggagaaaatgaccactttgacacctatgcagatgccctgtggtggggcctcatcaccctgaccaccatcggctacggggacaagtacccccagacctggaatggccgcctgctggccgccaccttcaccctcatcggcgtgtccttctttgccctgcctgctggcatcctgggcagcggctttgccctgaaggtgcaggagcagcaccggcagaagcactttgagaagagaagaaatcctgctgctggcctcatccagagcgcctggaggttctacgccaccaacctgagcaggacagacctgcacagcacctggcagtactatgaaagaacagtgacagtgcccatgtacagcagccagacccagacctatggagccagccgcctcatcccccccctgaaccagctggagctgctgaggaacctgaagagcaagagcggcctggccttcaggaaggaccccccacctgagcccagccccagcccccggggcgtggccgccaagggcaagggcagcccccaggcccagacagtgcggcgcagccccagcgctgaccagagcctggaggacagccccagcaaggtgcccaagtcctggagctttggagacaggagccgggcccggcaggccttccgcatcaagggagctgccagccggcagaacagcgaggccagcctgcccggggaggacatcgtggatgacaagagctgcccctgtgaatttgtgacagaggacctgaccccaggcctgaaggtgtccatccgggctgtgtgtgtgatgaggttcctggtgtccaagaggaagttcaaggagagcctgcggccctatgatgtgatggatgtgattgagcagtacagcgctggccacctggacatgctgagccgcatcaagagcctgcagagccgggtggaccagatcgtgggccggggccctgccatcacagacaaggacaggaccaagggccctgctgaggccgagctgcctgaggaccccagcatgatgggccgcctgggcaaggtggagaagcaggtgctgtccatggagaagaagctggacttcctggtgaacatctacatgcagaggatgggcatccccccaacagaaacagaggcctactttggagccaaggagcctgagcccgccccaccctaccacagccctgaggacagccgggagcacgtggacagacatggctgcatcgtgaagatcgtgcgcagcagcagcagcacaggccagaagaacttcagcgcccctcctgctgcccctcctgtgcagtgcccccccagcacctcctggcagccccagagccacccccggcagggccacggcaccagccctgtgggggaccacggcagcctggtgcgcatccccccacctccagcccacgagaggagcctgagcgcctacggcggcggcaacagagcctccatggagttcctgcggcaggaggacaccccaggctgcaggcctcctgagggcaacctgcgggacagcgacaccagcatcagcatccccagcgtggaccacgaggagctggagaggagcttcagcggcttcagcatcagccagagcaaagaaaacctggatgccctgaacagctgctatgctgctgtggccccctgtgccaaggtgcggccctacatcgccgagggggagagtgacacagacagcgacctgtgcaccccctgtggccccccacccaggtctgccaccggggagggcccctttggagatgtgggctgggccggccccaggaagtag

SEQ ID NO: 164935 - DNA, 2619 bp, Artificial Sequence
  Description of Artificial Sequence: Synthetic coding sequence
atgggcctgaaggcccggcgggctgctggagctgctgggggcggcggagatggcggcggcggcggcggcggggccgccaacccagctggaggagatgctgctgctgctggagatgaggagaggaaggtgggcctggcccctggagatgtggagcaggtgaccctggccctgggcgctggagctgacaaggatggcaccctgctgctggagggcggcggcagagatgagggccagaggaggaccccccagggcatcggcctgctggccaagacccccctgagcaggcctgtgaagagaaataatgccaagtaccgccgcatccagaccctcatctatgatgccctggagcggccccggggctgggccctgctgtaccacgccctggtgttcctgattgtgctgggctgcctgatcctggccgtgctgaccaccttcaaggagtatgagaccgtgtctggggactggctgctgctgctggagacctttgccatcttcatctttggagctgagtttgccctgcgcatctgggccgccggctgctgctgccgctacaagggctggaggggccgcctgaagtttgccaggaagcccctgtgcatgctggacatctttgtgctgattgcctctgtgcctgtggtggccgtgggcaaccagggcaatgtgctggccaccagcctgcggagcctgcgcttcctgcagatcctgaggatgctgaggatggaccggcggggcggcacctggaagctgctgggcagcgccatctgtgcccacagcaaggagctgatcacagcctggtacatcggcttcctgaccctcatcctgagcagcttcctggtgtacctggtggagaaggatgtgcctgaggtggatgcccagggcgaggagatgaaggaggagtttgagacctatgcagatgccctgtggtggggcctcatcaccctggccaccatcggctatggagacaagacccccaagacctgggagggccgcctgattgctgccaccttcagcctgattggagtgtccttctttgccctgcctgctggcatcctgggcagcggcctggccctgaaggtgcaggagcagcaccggcagaagcactttgagaagaggaggaagccagctgctgagctgatccaggccgcctggagatactatgccaccaaccccaacagaattgacctggtggccacctggaggttctatgagagcgtggtgtccttccccttcttcaggaaggagcagctggaggccgccagcagccagaagctgggcctgctggacagagtgcggctgagcaacccccggggcagcaacaccaagggcaagctgttcacccccctgaatgtggatgccatcgaggagagccccagcaaggagcccaagcctgtgggcctgaacaacaaggagcgcttcagaacagccttcaggatgaaggcctatgccttctggcagagcagtgaagatgctggcaccggggaccccatggccgaggaccggggctatggaaatgacttccccatcgaggacatgatccccaccctgaaggccgccatccgggctgtgcgcatcctgcagttccggctgtacaagaagaagttcaaggagaccctgcggccctatgatgtgaaggatgtgattgagcagtacagcgctggccacctggacatgctgagccgcatcaagtacctgcagaccagaattgacatgatcttcaccccaggcccccccagcacccccaagcacaagaagagccagaagggcagcgccttcaccttccccagccagcagagccccagaaatgagccctacgtggcccggcccagcaccagcgagattgaggaccagagcatgatgggcaagtttgtgaaggtggagcggcaggtgcaggacatgggcaagaagctggacttcctggtggacatgcacatgcagcacatggagcggctgcaggtgcaggtgacagagtactaccccaccaagggcaccagcagccctgctgaggccgagaagaaggaggacaaccgctacagcgacctgaagaccatcatctgcaactacagcgagaccggccccccagagcccccctacagcttccaccaggtgaccatcgacaaggtgagcccctacggcttctttgcccatgaccctgtgaacctgccccggggcggccccagcagcggcaaggtgcaggccaccccacccagcagcgccaccacctacgtggagcggcccaccgtgctgcccatcctgaccctgctggacagccgggtgtcctgccacagccaggccgacctgcagggcccctacagcgaccgcatcagcccccggcagaggaggagcatcacccgggacagcgacacccccctgagcctgatgtctgtgaaccacgaggagctggagaggagccccagcggcttcagcatcagccaggacagagatgattatgtgtttggccccaatggaggcagctcctggatgagggagaagcgctacctggccgagggggagacagacacagacacagaccccttcacccccagcggctccatgcccctgagcagcactggagatggcatcagtgacagcgtgtggacccccagcaacaagcccatctag

SEQ ID NO: 164936 - DNA, 2256 bp, Artificial Sequence
  Description of Artificial Sequence: Synthetic coding sequence
aagcccaagaagcacggccccatgttcctgattgtgctgggctgcctgatcctggccgtgctgaccaccttcaaggagtatgaaacagtgtctggggactggctgctgctgctggagacctttgccatcttcatctttggagctgagtttgccctgcgcatctgggccgccggctgctgctgccgctacaagggctggaggggccgcctgaagtttgccaggaagcccctgtgcatgctggacatctttgtgctgattgcctctgtgcctgtggtggccgtgggcaaccagggcaatgtgctggccaccagcctgcggagcctgcgcttcctgcagatcctgaggatgctgaggatggacagaagaggaggcacctggaagctgctgggcagcgccatctgtgcccacagcaaggagctgatcacagcctggtacatcggcttcctgaccctcatcctgagcagcttcctggtgtacctggtggagaaggatgtgcctgaggtggatgcccagggcgaggagatgaaggaggagtttgagacctatgcagatgccctgtggtggggcctcatcaccctggccaccatcggctacggggacaagacccccaagacctgggagggccgcctgattgctgccaccttcagcctcatcggcgtgtccttctttgccctgcctgctggcatcctgggcagcggcctggccctgaaggtgcaggagcagcaccggcagaagcactttgagaagaggaggaagccagctgctgagctgatccaggccgcctggagatactatgccaccaaccccaacagaattgacctggtggccacctggaggttctatgaatctgtggtgtccttccccttcttcaggaaggagcagctggaggccgccagcagccagaagctgggcctgctggacagagtgcggctgagcaacccccggggcagcaacaccaagggcaagctgttcacccccctgaatgtggatgccatcgaggagagccccagcaaggagcccaagcctgtgggcctgaacaacaaggagcgcttcagaacagccttcaggatgaaggcctatgccttctggcagagcagtgaagatgctggcactggagaccccatggctgaagatcggggctatggaaatgacttccccatcgaggacatgatccccaccctgaaggccgccatccgggctgtgcgcatcctgcagttccggctgtacaagaagaagttcaaggagaccctgcggccctatgatgtgaaggatgtgattgagcagtacagcgctggccacctggacatgctgagccgcatcaagtacctgcagaccagaattgacatgatcttcaccccaggcccccccagcacccccaagcacaagaagagccagaagggcagcgccttcaccttccccagccagcagagccccagaaatgagccctacgtggcccggcccagcaccagcgagattgaggaccagagcatgatgggcaagtttgtgaaggtggagcggcaggtgcaggacatgggcaagaagctggacttcctggtggacatgcacatgcagcacatggagcggctgcaggtgcaggtgacagagtactaccccaccaagggcaccagcagccctgctgaggccgagaagaaggaggacaaccgctacagcgacctgaagaccatcatctgcaactacagcgagactggacctcctgagcccccctacagcttccaccaggtgaccatcgacaaggtgagcccctacggcttctttgcccatgaccctgtgaacctgccccggggcggccccagcagcggcaaggtgcaggccaccccacccagcagcgccaccacctacgtggagcggcccaccgtgctgcccatcctgaccctgctggacagccgggtgtcctgccacagccaggccgacctgcagggcccctacagcgaccgcatcagcccccggcagaggaggagcatcacccgggacagcgacacccccctgagcctgatgtctgtgaaccacgaggagctggagaggagccccagcggcttcagcatcagccaggacagagatgattatgtgtttggccccaacggcggcagctcctggatgagggagaagcgctacctggccgagggggagacagacacagacacagaccccttcaccccatctggctccatgcccctgagcagcactggagatggcatcagtgacagcgtgtggacccccagcaacaagcccatctag

SEQ ID NO: 164937 - DNA, 2550 bp, Artificial Sequence
  Description of Artificial Sequence: Synthetic coding sequence
cgggctgctgctgagaaggccaagaggcctgctggggcccggcagatgggcctgaaggccaggagagctgctgctggagatgaggagaggaaggtgggcctggcccctggagatgtggagcaggtgaccctggccctgggcgctggagctgacaaggatggcaccctgctgctggagggcggcggcagagatgagggccagaggaggaccccccagggcatcggcctgctggccaagacccccctgagcaggcctgtgaagaggaacaatgccaagtaccgccgcatccagaccctcatctatgatgccctggagcggccccggggctgggccctgctgtaccacgccctggtgttcctgattgtgctgggctgcctgatcctggccgtgctgaccaccttcaaggagtatgaaacagtgtctggggactggctgctgctgctggagacctttgccatcttcatctttggagctgagtttgccctgcgcatctgggccgccggctgctgctgccgctacaagggctggaggggccgcctgaagtttgccaggaagcccctgtgcatgctggacatctttgtgctgattgcctctgtgcctgtggtggccgtgggcaaccagggcaatgtgctggccaccagcctgcggagcctgcgcttcctgcagatcctgaggatgctgaggatggacagaagaggaggcacctggaagctgctgggcagcgccatctgtgcccacagcaaggagctgatcacagcctggtacatcggcttcctgaccctcatcctgagcagcttcctggtgtacctggtggagaaggatgtgcctgaggtggatgcccagggcgaggagatgaaggaggagtttgagacctatgcagatgccctgtggtggggcctcatcaccctggccaccatcggctacggggacaagacccccaagacctgggagggccgcctgattgctgccaccttcagcctcatcggcgtgtccttctttgccctgcctgctggcatcctgggcagcggcctggccctgaaggtgcaggagcagcaccggcagaagcactttgagaagaggaggaagccagctgctgagctgatccaggccgcctggagatactatgccaccaaccccaacagaattgacctggtggccacctggaggttctatgaatctgtggtgtccttccccttcttcaggaaggagcagctggaggccgccagcagccagaagctgggcctgctggacagagtgcggctgagcaacccccggggcagcaacaccaagggcaagctgttcacccccctgaatgtggatgccatcgaggagagccccagcaaggagcccaagcctgtgggcctgaacaacaaggagcgcttcagaacagccttcaggatgaaggcctatgccttctggcagagcagtgaagatgctggcactggagaccccatggctgaagatcggggctatggaaatgacttccccatcgaggacatgatccccaccctgaaggccgccatccgggctgtgcgcatcctgcagttccggctgtacaagaagaagttcaaggagaccctgcggccctatgatgtgaaggatgtgattgagcagtacagcgctggccacctggacatgctgagccgcatcaagtacctgcagaccagaattgacatgatcttcaccccaggcccccccagcacccccaagcacaagaagagccagaagggaaatgagccctacgtggcccggcccagcaccagcgagattgaggaccagagcatgatgggcaagtttgtgaaggtggagcggcaggtgcaggacatgggcaagaagctggacttcctggtggacatgcacatgcagcacatggagcggctgcaggtgcaggtgacagagtactaccccaccaagggcaccagcagccctgctgaggccgagaagaaggaggacaaccgctacagcgacctgaagaccatcatctgcaactacagcgagactggacctcctgagcccccctacagcttccaccaggtgaccatcgacaaggtgagcccctacggcttctttgcccatgaccctgtgaacctgccccggggcggccccagcagcggcaaggtgcaggccaccccacccagcagcgccaccacctacgtggagcggcccaccgtgctgcccatcctgaccctgctggacagccgggtgtcctgccacagccaggccgacctgcagggcccctacagcgaccgcatcagcccccggcagaggaggagcatcacccgggacagcgacacccccctgagcctgatgtctgtgaaccacgaggagctggagaggagccccagcggcttcagcatcagccaggacagagatgattatgtgtttggccccaacggcggcagctcctggatgagggagaagcgctacctggccgagggggagacagacacagacacagaccccttcaccccatctggctccatgcccctgagcagcactggagatggcatcagtgacagcgtgtggacccccagcaacaagcccatctag

SEQ ID NO: 164938 - DNA, 2088 bp, Artificial Sequence
  Description of Artificial Sequence: Synthetic coding sequence
atggccgaggccccaccccggcggctgggcctgggccccccacctggagatgcccccagggctgagctggtggccctgacagctgtgcagagcgagcagggcgaggccggcggcggcggcagcccccggcggctgggcctgctgggcagccccctgcccccaggggcccccctgcccggccctggcagcggcagcggcagcgcctgtggccagaggagcagcgctgcccacaagcgctacagaaggctgcagaactgggtgtacaacgtgctggagcggccccggggctgggcctttgtgtaccacgtgttcatcttcctgctggtgttcagctgcctggtgctgtctgtgctgagcaccatccaggagcaccaggagctggccaatgaatgtctgctgatcctggagtttgtgatgattgtggtgtttggcctggagtacatcgtgcgggtgtggagcgctggctgctgctgccgctaccggggctggcagggccgcttccgctttgccaggaagcccttctgtgtgattgacttcatcgtgtttgtggcctctgtggccgtgattgctgctggcacccagggcaacatctttgccaccagcgccctgcgctccatgaggttcctgcagatcctgaggatggtgaggatggacagaagaggaggcacctggaagctgctgggctctgtggtgtatgcccacagcaaggagctgatcacagcctggtacatcggcttcctggtgctgatctttgccagcttcctggtgtacctggccgagaaggatgccaacagcgacttcagcagctatgctgacagcctgtggtggggcaccatcaccctgaccaccatcggctacggggacaagaccccccacacctggctgggccgggtgctggccgccggctttgccctgctgggcatctccttctttgccctgcctgctggcatcctgggcagcggctttgccctgaaggtgcaggagcagcaccggcagaagcactttgagaagaggaggatgcctgctgccaacctgatccaggccgcctggaggctgtacagcacagacatgagccgggcctacctgacagccacctggtactactatgacagcatcctgcccagcttccgggagctggccctgctgtttgaacatgtgcagagggccagaaatggaggcctgcggcccctggaggtgcggcgggcccctgtgcctgatggagcccccagccgctacccacctgtggccacctgccacaggcctggcagcaccagcttctgccctggagagagcagcaggatgggcatcaaggaccgcatccgcatgggcagcagccagaggagaacaggccccagcaagcagcacctggccccacccaccatgcccaccagccccagcagcgagcaggtgggggaggccaccagccccaccaaggtgcagaagtcctggagcttcaatgacaggacccgcttccgggccagcctgcggctgaagcccaggaccagcgcagaagatgcccccagcgaggaggtggccgaggagaagagctaccagtgtgagctgactgtggatgacatcatgcctgctgtgaagacagtcatccgcagcatccgcatcctgaagttcctggtggccaagaggaagttcaaggagaccctgcggccctatgatgtgaaggatgtgattgagcagtacagcgctggccacctggacatgctgggccgcatcaagagcctgcagaccagggtggaccagatcgtgggccggggccctggggacaggaaggcccgggagaagggggacaagggccccagtgatgctgaggtggtggatgagatctccatgatgggccgggtggtgaaggtggagaagcaggtgcagagcattgagcacaagctggacctgctgctgggcttctacagccgctgcctgcggagcggcaccagcgccagcctgggcgctgtgcaggtgcccctgtttgatcctgacatcaccagtgactaccacagccctgtggaccacgaggacatctctgtgtctgcccagaccctgagcatcagccgctctgtgtccaccaacatggactag

SEQ ID NO: 164939 - DNA, 2856 bp, Artificial Sequence
  Description of Artificial Sequence: Synthetic coding sequence
atgcccaggcaccacgccggcggggaggagggcggggccgccggcctgtgggtgaagagcggggctgctgctgctgctgctgggggcggccgcctgggcagcggcatgaaggatgtggagagcggccggggccgggtgctgctgaacagcgctgctgcccggggagatggcctgctgctgctgggcaccagggctgccaccctgggcggcggcggcggcggcctgcgggagagcagaagaggcaagcagggcgccaggatgagcctgctgggcaagcccctgagctacaccagcagccagagctgcagaagaaatgtgaagtacagaagagtgcagaactacctgtacaacgtgctggagcggccccggggctgggccttcatctaccacgcctttgtgttcctgctggtgtttggctgcctgatcctgagcgtcttcagcaccatccctgagcacaccaagctggccagcagctgcctgctgatcctggagtttgtgatgattgtggtgtttggcctggagttcatcatccgcatctggagcgctggctgctgctgccgctaccggggctggcagggccgcctgcgctttgccaggaagcccttctgtgtgattgacaccatcgtgctgattgccagcattgctgtggtgtctgccaagacccagggcaacatctttgccaccagcgccctgcggagcctgcgcttcctgcagatcctgaggatggtgaggatggacagaagaggaggcacctggaagctgctgggctctgtggtgtatgcccacagcaaggagctgatcacagcctggtacatcggcttcctggtgctgatcttcagcagcttcctggtgtacctggtggagaaggatgccaacaaggagttcagcacctatgcagatgccctgtggtggggcaccatcaccctgaccaccatcggctacggggacaagacccccctgacctggctgggccgcctgctgtctgctggctttgccctgctgggcatctccttctttgccctgcctgctggcatcctgggcagcggctttgccctgaaggtgcaggagcagcaccggcagaagcactttgagaagagaagaaatcctgctgccaacctgatccagtgtgtgtggaggagctatgctgctgatgagaagtctgtgtccatcgccacctggaagccccacctgaaggccctgcacacctgcagccccaccaagaaggagcagggcgaggccagcagcagcaagttctgcagcaacaagcagaagctgttcaggatgtacaccagcaggaagcagagccagaagctgtccttcaaggagcgggtgaggatggccagcccccggggccagagcatcaagagccggcaggcctctgtgggggaccggcgcagccccagcacagacatcacagctgagggcagccccaccaaggtgcagaagtcctggagcttcaatgacaggacccgcttccggcccagcctgcggctgaagagcagccagcccaagcctgtgattgatgctgacacagccctgggcacagatgatgtgtatgatgagaagggctgccagtgtgatgtgtctgtggaggacctgaccccacccctgaagacagtcatccgggccatccgcatcatgaagttccacgtggccaagaggaagttcaaggagaccctgcggccctatgatgtgaaggatgtgattgagcagtacagcgctggccacctggacatgctgtgccgcatcaagagcctgcagaccagggtggaccagatcctgggcaagggccagatcaccagtgacaagaagagccgggagaagatcacagctgagcacgagaccacagatgacctgtccatgctgggccgggtggtgaaggtggagaagcaggtgcagagcattgagagcaagctggactgcctgctggacatctaccagcaggtgctgaggaagggcagcgccagcgccctggccctggccagcttccagatccccccatttgaatgtgagcagaccagtgactaccagagccctgtggacagcaaggacctgagcggcagcgcccagaacagcggctgcctgagccgcagcaccagcgccaacatcagccggggcctgcagttcatcctgaccccaaatgagttcagcgcccagaccttctacgccctgagccccaccatgcacagccaggccacccaggtgcccatcagccagagtgatggcagcgctgtggccgccaccaacaccatcgccaaccagatcaacacagcccccaagccagctgcccccaccaccctgcagatccccccacccctgcctgccatcaagcacctgcccaggcctgagaccctgcaccccaacccagctggcctgcaggagagcatcagtgatgtgaccacctgcctggtggccagcaaagaaaatgtgcaggtggcccagagcaacctgaccaaggaccgctccatgaggaagagctttgacatgggcggggagaccctgctgtctgtgtgccccatggtgcccaaggacctgggcaagagcctgtctgtgcagaacctgatccgcagcacagaggagctgaacatccagctgagcggcagcgagagcagcggcagccggggcagccaggacttctaccccaagtggagggagagcaagctgttcatcacagatgaggaggtgggccctgaggagacagaaacagacacctttgatgctgccccccagcctgcccgggaggccgcctttgccagtgacagcctgaggacaggccgcagccgcagcagccagagcatctgcaaggccggggagagcacagatgccctgagcctgccccacgtgaagctgaagtag

SEQ ID NO: 164940 - DNA, 2799 bp, Artificial Sequence
  Description of Artificial Sequence: Synthetic coding sequence
atgcccaggcaccacgccggcggggaggagggcggggccgccggcctgtgggtgaagagcggggctgctgctgctgctgctgggggcggccgcctgggcagcggcatgaaggatgtggagagcggccggggccgggtgctgctgaacagcgctgctgcccggggagatggcctgctgctgctgggcaccagggctgccaccctgggcggcggcggcggcggcctgcgggagagcagaagaggcaagcagggcgccaggatgagcctgctgggcaagcccctgagctacaccagcagccagagctgcagaagaaatgtgaagtacagaagagtgcagaactacctgtacaacgtgctggagcggccccggggctgggccttcatctaccacgcctttgtgttcctgcctgtgtttggctgcctgatcctgagcgtcttcagcaccatccctgagcacaccaagctggccagcagctgcctgctgatcctggagtttgtgatgattgtggtgtttggcctggagttcatcatccgcatctggagcgctggctgctgctgccgctaccggggctggcagggccgcctgcgctttgccaggaagcccttctgtgtgattgacaccatcgtgctgattgccagcattgctgtggtgtctgccaagacccagggcaacatctttgccaccagcgccctgcggagcctgcgcttcctgcagatcctgaggatggtgaggatggacagaagaggaggcacctggaagctgctgggctctgtggtgtatgcccacagcaaggagctgatcacagcctggtacatcggcttcctggtgctgatcttcagcagcttcctggtgtacctggtggagaaggatgccaacaaggagttcagcacctatgcagatgccctgtggtggggcaccatcaccctgaccaccatcggctacggggacaagacccccctgacctggctgggccgcctgctgtctgctggctttgccctgctgggcatctccttctttgccctgcctgctggcatcctgggcagcggctttgccctgaaggtgcaggagcagcaccggcagaagcactttgagaagagaagaaatcctgctgccaacctgatccagtgtgtgtggaggagctatgctgctgatgagaagtctgtgtccatcgccacctggaagccccacctgaaggccctgcacacctgcagccccaccaagaaggagcagggcgaggccagcagcagccagaagctgtccttcaaggagcgggtgaggatggccagcccccggggccagagcatcaagagccggcaggcctctgtgggggacagaagaagccccagcacagacatcacagctgagggcagccccaccaaggtgcagaagtcctggagcttcaatgacaggacccgcttccggcccagcctgcggctgaagagcagccagcccaagcctgtgattgatgctgacacagccctgggcacagatgatgtgtatgatgagaagggctgccagtgtgatgtgtctgtggaggacctgaccccacccctgaagacagtcatccgggccatccgcatcatgaagttccacgtggccaagaggaagttcaaggagaccctgcggccctatgatgtgaaggatgtgattgagcagtacagcgctggccacctggacatgctgtgccgcatcaagagcctgcagaccagggtggaccagatcctgggcaagggccagatcaccagtgacaagaagagccgggagaagatcacagctgagcacgagaccacagatgacctgtccatgctgggccgggtggtgaaggtggagaagcaggtgcagagcattgagagcaagctggactgcctgctggacatctaccagcaggtgctgaggaaaggaagtgccagcgccctggccctggccagcttccagatccccccatttgaatgtgagcagaccagtgactaccagagccctgtggacagcaaggacctgagcggcagcgcccagaacagcggctgcctgagccgcagcaccagcgccaacatcagccggggcctgcagttcatcctgaccccaaatgagttcagcgcccagaccttctacgccctgagccccaccatgcacagccaggccacccaggtgcccatcagccagagtgatggcagcgctgtggccgccaccaacaccatcgccaaccagatcaacacagcccccaagccagctgcccccaccaccctgcagatccccccacccctgcctgccatcaagcacctgcccaggcctgagaccctgcaccccaacccagctggcctgcaggagagcatcagtgatgtgaccacctgcctggtggccagcaaagaaaatgtgcaggtggcccagagcaacctgaccaaggaccgctccatgaggaagagctttgacatgggcggggagaccctgctgtctgtgtgccccatggtgcccaaggacctgggcaagagcctgtctgtgcagaacctgatccgcagcacagaggagctgaacatccagctgagcggcagcgagagcagcggcagccggggcagccaggacttctaccccaagtggagggagagcaagctgttcatcacagatgaggaggtgggccctgaggagacagaaacagacacctttgatgctgccccccagcctgcccgggaggccgcctttgccagtgacagcctgaggacaggccgcagccgcagcagccagagcatctgcaaggccggggagagcacagatgccctgagcctgccccacgtgaagctgaagtag

SEQ ID NO: 164941 - DNA, 2802 bp, Artificial Sequence
  Description of Artificial Sequence: Synthetic coding sequence
atgcccaggcaccacgccggcggggaggagggcggggccgccggcctgtgggtgaagagcggggctgctgctgctgctgctgggggcggccgcctgggcagcggcatgaaggatgtggagagcggccggggccgggtgctgctgaacagcgctgctgcccggggagatggcctgctgctgctgggcaccagggctgccaccctgggcggcggcggcggcggcctgcgggagagcagaagaggcaagcagggcgccaggatgagcctgctgggcaagcccctgagctacaccagcagccagagctgcagaagaaatgtgaagtacagaagagtgcagaactacctgtacaacgtgctggagcggccccggggctgggccttcatctaccacgcctttgtgttcctgctggtgtttggctgcctgatcctgagcgtcttcagcaccatccctgagcacaccaagctggccagcagctgcctgctgatcctggagtttgtgatgattgtggtgtttggcctggagttcatcatccgcatctggagcgctggctgctgctgccgctaccggggctggcagggccgcctgcgctttgccaggaagcccttctgtgtgattgacaccatcgtgctgattgccagcattgctgtggtgtctgccaagacccagggcaacatctttgccaccagcgccctgcggagcctgcgcttcctgcagatcctgaggatggtgaggatggacagaagaggaggcacctggaagctgctgggctctgtggtgtatgcccacagcaaggagctgatcacagcctggtacatcggcttcctggtgctgatcttcagcagcttcctggtgtacctggtggagaaggatgccaacaaggagttcagcacctatgcagatgccctgtggtggggcaccatcaccctgaccaccatcggctacggggacaagacccccctgacctggctgggccgcctgctgtctgctggctttgccctgctgggcatctccttctttgccctgcctgctggcatcctgggcagcggctttgccctgaaggtgcaggagcagcaccggcagaagcactttgagaagagaagaaatcctgctgccaacctgatccagtgtgtgtggaggagctatgctgctgatgagaagtctgtgtccatcgccacctggaagccccacctgaaggccctgcacacctgcagccccaccaagcagaaccagcagggcgagagccagagctgccagaagctgtccttcaaggagcgggtgaggatggccagcccccggggccagagcatcaagagccggcaggcctctgtgggggaccggcgcagccccagcacagacatcacagctgagggcagccccaccaaggtgcagaagtcctggagcttcaatgacaggacccgcttccggcccagcctgcggctgaagagcagccagcccaagcctgtgattgatgctgacacagccctgggcacagatgatgtgtatgatgagaagggctgccagtgtgatgtgtctgtggaggacctgaccccacccctgaagacagtcatccgggccatccgcatcatgaagttccacgtggccaagaggaagttcaaggagaccctgcggccctatgatgtgaaggatgtgattgagcagtacagcgctggccacctggacatgctgtgccgcatcaagagcctgcagaccagggtggaccagatcctgggcaagggccagatcaccagtgacaagaagagccgggagaagatcacagctgagcacgagaccacagatgacctgtccatgctgggccgggtggtgaaggtggagaagcaggtgcagagcattgagagcaagctggactgcctgctggacatctaccagcaggtgctgaggaagggcagcgccagcgccctggccctggccagcttccagatccccccatttgaatgtgagcagaccagtgactaccagagccctgtggacagcaaggacctgagcggcagcgcccagaacagcggctgcctgagccgcagcaccagcgccaacatcagccggggcctgcagttcatcctgaccccaaatgagttcagcgcccagaccttctacgccctgagccccaccatgcacagccaggccacccaggtgcccatcagccagagtgatggcagcgctgtggccgccaccaacaccatcgccaaccagatcaacacagcccccaagccagctgcccccaccaccctgcagatccccccacccctgcctgccatcaagcacctgcccaggcctgagaccctgcaccccaacccagctggcctgcaggagagcatcagtgatgtgaccacctgcctggtggccagcaaagaaaatgtgcaggtggcccagagcaacctgaccaaggaccgctccatgaggaagagctttgacatgggcggggagaccctgctgtctgtgtgccccatggtgcccaaggacctgggcaagagcctgtctgtgcagaacctgatccgcagcacagaggagctgaacatccagctgagcggcagcgagagcagcggcagccggggcagccaggacttctaccccaagtggagggagagcaagctgttcatcacagatgaggaggtgggccctgaggagacagaaacagacacctttgatgctgccccccagcctgcccgggaggccgcctttgccagtgacagcctgaggacaggccgcagccgcagcagccagagcatctgcaaggccggggagagcacagatgccctgagcctgccccacgtgaagctgaagtag

SEQ ID NO: 164942 - DNA, 1284 bp, Artificial Sequence
  Description of Artificial Sequence: Synthetic coding sequence
atgcccaggcaccacgccggcggggaggagggcggggccgccggcctgtgggtgaagagcggggctgctgctgctgctgctgggggcggccgcctgggcagcggcatgaaggatgtggagagcggccggggccgggtgctgctgaacagcgctgctgcccggggagatggcctgctgctgctgggcaccagggctgccaccctgggcggcggcggcggcggcctgcgggagagcagaagaggcaagcagggcgccaggatgagcctgctgggcaagcccctgagctacaccagcagccagagctgcagaagaaatgtgaagtacagaagagtgcagaactacctgtacaacgtgctggagcggccccggggctgggccttcatctaccacgcctttgtgttcctgctggtgtttggctgcctgatcctgagcgtcttcagcaccatccctgagcacaccaagctggccagcagctgcctgctgatcctggagtttgtgatgattgtggtgtttggcctggagttcatcatccgcatctggagcgctggctgctgctgccgctaccggggctggcagggccgcctgcgctttgccaggaagcccttctgtgtgattgacaccatcgtgctgattgccagcattgctgtggtgtctgccaagacccagggcaacatctttgccaccagcgccctgcggagcctgcgcttcctgcagatcctgaggatggtgaggatggacagaagaggaggcacctggaagctgctgggctctgtggtgtatgcccacagcaaggagctgatcacagcctggtacatcggcttcctggtgctgatcttcagcagcttcctggtgtacctggtggagaaggatgccaacaaggagttcagcacctatgcagatgccctgtggtggggcaccatcaccctgaccaccatcggctacggggacaagacccccctgacctggctgggccgcctgctgtctgctggctttgccctgctgggcatctccttctttgccctgcctgctggcatcctgggcagcggctttgccctgaaggtgcaggagcagcaccggcagaagcactttgagaagagaagaaatcctgctgccaacctgatccagtgtgtgtggaggagctatgctgctgatgagaagtctgtgtccatcgccacctggaagccccacctgaaggccctgcacacctgcagccccaccaagaaggagcagggcgaggccagcagcagatttgtgatcagcctgctgctgcacgtgtgcctgtag

SEQ ID NO: 164943 - DNA, 2799 bp, Artificial Sequence
  Description of Artificial Sequence: Synthetic coding sequence
atgcccaggcaccacgccggcggggaggagggcggggccgccggcctgtgggtgaagagcggggctgctgctgctgctgctgggggcggccgcctgggcagcggcatgaaggatgtggagagcggccggggccgggtgctgctgaacagcgctgctgcccggggagatggcctgctgctgctgggcaccagggctgccaccctgggcggcggcggcggcggcctgcgggagagcagaagaggcaagcagggcgccaggatgagcctgctgggcaagcccctgagctacaccagcagccagagctgcagaagaaatgtgaagtacagaagagtgcagaactacctgtacaacgtgctggagcggccccggggctgggccttcatctaccacgcctttgtgttcctgctggtgtttggctgcctgatcctgagcgtcttcagcaccatccctgagcacaccaagctggccagcagctgcctgctgatcctggagtttgtgatgattgtggtgtttggcctggagttcatcatccgcatctggagcgctggctgctgctgccgctaccggggctggcagggccgcctgcgctttgccaggaagcccttctgtgtgattgacaccatcgtgctgattgccagcattgctgtggtgtctgccaagacccagggcaacatctttgccaccagcgccctgcggagcctgcgcttcctgcagatcctgaggatggtgaggatggacagaagaggaggcacctggaagctgctgggctctgtggtgtatgcccacagcaaggagctgatcacagcctggtacatcggcttcctggtgctgatcttcagcagcttcctggtgtacctggtggagaaggatgccaacaaggagttcagcacctatgcagatgccctgtggtggggcaccatcaccctgaccaccatcggctacggggacaagacccccctgacctggctgggccgcctgctgtctgctggctttgccctgctgggcatctccttctttgccctgcctgctggcatcctgggcagcggctttgccctgaaggtgcaggagcagcaccggcagaagcactttgagaagagaagaaatcctgctgccaacctgatccagtgtgtgtggaggagctatgctgctgatgagaagtctgtgtccatcgccacctggaagccccacctgaaggccctgcacacctgcagccccaccaagaaggagcagggcgaggccagcagcagccagaagctgtccttcaaggagcgggtgaggatggccagcccccggggccagagcatcaagagccggcaggcctctgtgggggacagaagaagccccagcacagacatcacagctgagggcagccccaccaaggtgcagaagtcctggagcttcaatgacaggacccgcttccggcccagcctgcggctgaagagcagccagcccaagcctgtgattgatgctgacacagccctgggcacagatgatgtgtatgatgagaagggctgccagtgtgatgtgtctgtggaggacctgaccccacccctgaagacagtcatccgggccatccgcatcatgaagttccacgtggccaagaggaagttcaaggagaccctgcggccctatgatgtgaaggatgtgattgagcagtacagcgctggccacctggacatgctgtgccgcatcaagagcctgcagaccagggtggaccagatcctgggcaagggccagatcaccagtgacaagaagagccgggagaagatcacagctgagcacgagaccacagatgacctgtccatgctgggccgggtggtgaaggtggagaagcaggtgcagagcattgagagcaagctggactgcctgctggacatctaccagcaggtgctgaggaaaggaagtgccagcgccctggccctggccagcttccagatccccccatttgaatgtgagcagaccagtgactaccagagccctgtggacagcaaggacctgagcggcagcgcccagaacagcggctgcctgagccgcagcaccagcgccaacatcagccggggcctgcagttcatcctgaccccaaatgagttcagcgcccagaccttctacgccctgagccccaccatgcacagccaggccacccaggtgcccatcagccagagtgatggcagcgctgtggccgccaccaacaccatcgccaaccagatcaacacagcccccaagccagctgcccccaccaccctgcagatccccccacccctgcctgccatcaagcacctgcccaggcctgagaccctgcaccccaacccagctggcctgcaggagagcatcagtgatgtgaccacctgcctggtggccagcaaagaaaatgtgcaggtggcccagagcaacctgaccaaggaccgctccatgaggaagagctttgacatgggcggggagaccctgctgtctgtgtgccccatggtgcccaaggacctgggcaagagcctgtctgtgcagaacctgatccgcagcacagaggagctgaacatccagctgagcggcagcgagagcagcggcagccggggcagccaggacttctaccccaagtggagggagagcaagctgttcatcacagatgaggaggtgggccctgaggagacagaaacagacacctttgatgctgccccccagcctgcccgggaggccgcctttgccagtgacagcctgaggacaggccgcagccgcagcagccagagcatctgcaaggccggggagagcacagatgccctgagcctgccccacgtgaagctgaagtag

SEQ ID NO: 164944 - DNA, 2829 bp, Artificial Sequence
  Description of Artificial Sequence: Synthetic coding sequence
atgcccaggcaccacgccggcggggaggagggcggggccgccggcctgtgggtgaagagcggggctgctgctgctgctgctgggggcggccgcctgggcagcggcatgaaggatgtggagagcggccggggccgggtgctgctgaacagcgctgctgcccggggagatggcctgctgctgctgggcaccagggctgccaccctgggcggcggcggcggcggcctgcgggagagcagaagaggcaagcagggcgccaggatgagcctgctgggcaagcccctgagctacaccagcagccagagctgcagaagaaatgtgaagtacagaagagtgcagaactacctgtacaacgtgctggagcggccccggggctgggccttcatctaccacgcctttgtgttcctgctggtgtttggctgcctgatcctgagcgtcttcagcaccatccctgagcacaccaagctggccagcagctgcctgctgatcctggagtttgtgatgattgtggtgtttggcctggagttcatcatccgcatctggagcgctggctgctgctgccgctaccggggctggcagggccgcctgcgctttgccaggaagcccttctgtgtgattgacaccatcgtgctgattgccagcattgctgtggtgtctgccaagacccagggcaacatctttgccaccagcgccctgcggagcctgcgcttcctgcagatcctgaggatggtgaggatggacagaagaggaggcacctggaagctgctgggctctgtggtgtatgcccacagcaaggagctgatcacagcctggtacatcggcttcctggtgctgatcttcagcagcttcctggtgtacctggtggagaaggatgccaacaaggagttcagcacctatgcagatgccctgtggtggggcaccatcaccctgaccaccatcggctacggggacaagacccccctgacctggctgggccgcctgctgtctgctggctttgccctgctgggcatctccttctttgccctgcctgctggcatcctgggcagcggctttgccctgaaggtgcaggagcagcaccggcagaagcactttgagaagagaagaaatcctgctgccaacctgatccagtgtgtgtggaggagctatgctgctgatgagaagtctgtgtccatcgccacctggaagccccacctgaaggccctgcacacctgcagccccaccaacaagttctgcagcaacaagcagaagctgttcaggatgtacaccagcaggaagcagagccagaagctgtccttcaaggagcgggtgaggatggccagcccccggggccagagcatcaagagccggcaggcctctgtgggggacagaagaagccccagcacagacatcacagctgagggcagccccaccaaggtgcagaagtcctggagcttcaatgacaggacccgcttccggcccagcctgcggctgaagagcagccagcccaagcctgtgattgatgctgacacagccctgggcacagatgatgtgtatgatgagaagggctgccagtgtgatgtgtctgtggaggacctgaccccacccctgaagacagtcatccgggccatccgcatcatgaagttccacgtggccaagaggaagttcaaggagaccctgcggccctatgatgtgaaggatgtgattgagcagtacagcgctggccacctggacatgctgtgccgcatcaagagcctgcagaccagggtggaccagatcctgggcaagggccagatcaccagtgacaagaagagccgggagaagatcacagctgagcacgagaccacagatgacctgtccatgctgggccgggtggtgaaggtggagaagcaggtgcagagcattgagagcaagctggactgcctgctggacatctaccagcaggtgctgaggaaaggaagtgccagcgccctggccctggccagcttccagatccccccatttgaatgtgagcagaccagtgactaccagagccctgtggacagcaaggacctgagcggcagcgcccagaacagcggctgcctgagccgcagcaccagcgccaacatcagccggggcctgcagttcatcctgaccccaaatgagttcagcgcccagaccttctacgccctgagccccaccatgcacagccaggccacccaggtgcccatcagccagagtgatggcagcgctgtggccgccaccaacaccatcgccaaccagatcaacacagcccccaagccagctgcccccaccaccctgcagatccccccacccctgcctgccatcaagcacctgcccaggcctgagaccctgcaccccaacccagctggcctgcaggagagcatcagtgatgtgaccacctgcctggtggccagcaaagaaaatgtgcaggtggcccagagcaacctgaccaaggaccgctccatgaggaagagctttgacatgggcggggagaccctgctgtctgtgtgccccatggtgcccaaggacctgggcaagagcctgtctgtgcagaacctgatccgcagcacagaggagctgaacatccagctgagcggcagcgagagcagcggcagccggggcagccaggacttctaccccaagtggagggagagcaagctgttcatcacagatgaggaggtgggccctgaggagacagaaacagacacctttgatgctgccccccagcctgcccgggaggccgcctttgccagtgacagcctgaggacaggccgcagccgcagcagccagagcatctgcaaggccggggagagcacagatgccctgagcctgccccacgtgaagctgaagtag

SEQ ID NO: 164945 - DNA, 2772 bp, Artificial Sequence
  Description of Artificial Sequence: Synthetic coding sequence
atgcccaggcaccacgccggcggggaggagggcggggccgccggcctgtgggtgaagagcggggctgctgctgctgctgctgggggcggccgcctgggcagcggcatgaaggatgtggagagcggccggggccgggtgctgctgaacagcgctgctgcccggggagatggcctgctgctgctgggcaccagggctgccaccctgggcggcggcggcggcggcctgcgggagagcagaagaggcaagcagggcgccaggatgagcctgctgggcaagcccctgagctacaccagcagccagagctgcagaagaaatgtgaagtacagaagagtgcagaactacctgtacaacgtgctggagcggccccggggctgggccttcatctaccacgcctttgtgttcctgctggtgtttggctgcctgatcctgagcgtcttcagcaccatccctgagcacaccaagctggccagcagctgcctgctgatcctggagtttgtgatgattgtggtgtttggcctggagttcatcatccgcatctggagcgctggctgctgctgccgctaccggggctggcagggccgcctgcgctttgccaggaagcccttctgtgtgattgacaccatcgtgctgattgccagcattgctgtggtgtctgccaagacccagggcaacatctttgccaccagcgccctgcggagcctgcgcttcctgcagatcctgaggatggtgaggatggacagaagaggaggcacctggaagctgctgggctctgtggtgtatgcccacagcaaggagctgatcacagcctggtacatcggcttcctggtgctgatcttcagcagcttcctggtgtacctggtggagaaggatgccaacaaggagttcagcacctatgcagatgccctgtggtggggcaccatcaccctgaccaccatcggctacggggacaagacccccctgacctggctgggccgcctgctgtctgctggctttgccctgctgggcatctccttctttgccctgcctgctggcatcctgggcagcggctttgccctgaaggtgcaggagcagcaccggcagaagcactttgagaagagaagaaatcctgctgccaacctgatccagtgtgtgtggaggagctatgctgctgatgagaagtctgtgtccatcgccacctggaagccccacctgaaggccctgcacacctgcagccccaccaaccagaagctgtccttcaaggagcgggtgaggatggccagcccccggggccagagcatcaagagccggcaggcctctgtgggggaccggcgcagccccagcacagacatcacagctgagggcagccccaccaaggtgcagaagtcctggagcttcaatgacaggacccgcttccggcccagcctgcggctgaagagcagccagcccaagcctgtgattgatgctgacacagccctgggcacagatgatgtgtatgatgagaagggctgccagtgtgatgtgtctgtggaggacctgaccccacccctgaagacagtcatccgggccatccgcatcatgaagttccacgtggccaagaggaagttcaaggagaccctgcggccctatgatgtgaaggatgtgattgagcagtacagcgctggccacctggacatgctgtgccgcatcaagagcctgcagaccagggtggaccagatcctgggcaagggccagatcaccagtgacaagaagagccgggagaagatcacagctgagcacgagaccacagatgacctgtccatgctgggccgggtggtgaaggtggagaagcaggtgcagagcattgagagcaagctggactgcctgctggacatctaccagcaggtgctgaggaagggcagcgccagcgccctggccctggccagcttccagatccccccatttgaatgtgagcagaccagtgactaccagagccctgtggacagcaaggacctgagcggcagcgcccagaacagcggctgcctgagccgcagcaccagcgccaacatcagccggggcctgcagttcatcctgaccccaaatgagttcagcgcccagaccttctacgccctgagccccaccatgcacagccaggccacccaggtgcccatcagccagagtgatggcagcgctgtggccgccaccaacaccatcgccaaccagatcaacacagcccccaagccagctgcccccaccaccctgcagatccccccacccctgcctgccatcaagcacctgcccaggcctgagaccctgcaccccaacccagctggcctgcaggagagcatcagtgatgtgaccacctgcctggtggccagcaaagaaaatgtgcaggtggcccagagcaacctgaccaaggaccgctccatgaggaagagctttgacatgggcggggagaccctgctgtctgtgtgccccatggtgcccaaggacctgggcaagagcctgtctgtgcagaacctgatccgcagcacagaggagctgaacatccagctgagcggcagcgagagcagcggcagccggggcagccaggacttctaccccaagtggagggagagcaagctgttcatcacagatgaggaggtgggccctgaggagacagaaacagacacctttgatgctgccccccagcctgcccgggaggccgcctttgccagtgacagcctgaggacaggccgcagccgcagcagccagagcatctgcaaggccggggagagcacagatgccctgagcctgccccacgtgaagctgaagtag

SEQ ID NO: 164946 - DNA, 2469 bp, Artificial Sequence
  Description of Artificial Sequence: Synthetic coding sequence
atgcccaggcaccacgccggcggggaggagggcggggccgccggcctgtgggtgaagagcggggctgctgctgctgctgctgggggcggccgcctgggcagcggcatgaaggatgtggagagcggccggggccgggtgctgctgaacagcgctgctgcccggggagatggcctgctgctgctgggcaccagggctgccaccctgggcggcggcggcggcggcctgcgggagagcagaagaggcaagcagggcgccaggatgagcctgctgggcaagcccctgagctacaccagcagccagagctgcagaagaaatgtgaagtacagaagagtgcagaactacctgtacaacgtgctggagcggccccggggctgggccttcatctaccacgcctttgtgttcctgctggtgtttggctgcctgatcctgagcgtcttcagcaccatccctgagcacaccaagctggccagcagctgcctgctgatcctggagtttgtgatgattgtggtgtttggcctggagttcatcatccgcatctggagcgctggctgctgctgccgctaccggggctggcagggccgcctgcgctttgccaggaagcccttctgtgtgattgacaccatcgtgctgattgccagcattgctgtggtgtctgccaagacccagggcaacatctttgccaccagcgccctgcggagcctgcgcttcctgcagatcctgaggatggtgaggatggacagaagaggaggcacctggaagctgctgggctctgtggtgtatgcccacagcaaggagctgatcacagcctggtacatcggcttcctggtgctgatcttcagcagcttcctggtgtacctggtggagaaggatgccaacaaggagttcagcacctatgcagatgccctgtggtggggcaccatcaccctgaccaccatcggctacggggacaagacccccctgacctggctgggccgcctgctgtctgctggctttgccctgctgggcatctccttctttgccctgcctgctggcatcctgggcagcggctttgccctgaaggtgcaggagcagcaccggcagaagcactttgagaagagaagaaatcctgctgccaacctgatccagtgtgtgtggaggagctatgctgctgatgagaagtctgtgtccatcgccacctggaagccccacctgaaggccctgcacacctgcagccccaccaagaaggagcagggcgaggccagcagccgcatcatgaagttccacgtggccaagaggaagttcaaggagaccctgcggccctatgatgtgaaggatgtgattgagcagtacagcgctggccacctggacatgctgtgccgcatcaagagcctgcagaccagggtggaccagatcctgggcaagggccagatcaccagtgacaagaagagccgggagaagatcacagctgagcacgagaccacagatgacctgtccatgctgggccgggtggtgaaggtggagaagcaggtgcagagcattgagagcaagctggactgcctgctggacatctaccagcaggtgctgaggaaaggaagtgccagcgccctggccctggccagcttccagatccccccatttgaatgtgagcagaccagtgactaccagagccctgtggacagcaaggacctgagcggcagcgcccagaacagcggctgcctgagccgcagcaccagcgccaacatcagccggggcctgcagttcatcctgaccccaaatgagttcagcgcccagaccttctacgccctgagccccaccatgcacagccaggccacccaggtgcccatcagccagagtgatggcagcgctgtggccgccaccaacaccatcgccaaccagatcaacacagcccccaagccagctgcccccaccaccctgcagatccccccacccctgcctgccatcaagcacctgcccaggcctgagaccctgcaccccaacccagctggcctgcaggagagcatcagtgatgtgaccacctgcctggtggccagcaaagaaaatgtgcaggtggcccagagcaacctgaccaaggaccgctccatgaggaagagctttgacatgggcggggagaccctgctgtctgtgtgccccatggtgcccaaggacctgggcaagagcctgtctgtgcagaacctgatccgcagcacagaggagctgaacatccagctgagcggcagcgagagcagcggcagccggggcagccaggacttctaccccaagtggagggagagcaagctgttcatcacagatgaggaggtgggccctgaggagacagaaacagacacctttgatgctgccccccagcctgcccgggaggccgcctttgccagtgacagcctgaggacaggccgcagccgcagcagccagagcatctgcaaggccggggagagcacagatgccctgagcctgccccacgtgaagctgaagtag

SEQ ID NO: 164947 - DNA, 2856 bp, Artificial Sequence
  Description of Artificial Sequence: Synthetic coding sequence
atgcccaggcaccacgccggcggggaggagggcggggccgccggcctgtgggtgaagagcggggctgctgctgctgctgctgggggcggccgcctgggcagcggcatgaaggatgtggagagcggccggggccgggtgctgctgaacagcgctgctgcccggggagatggcctgctgctgctgggcaccagggctgccaccctgggcggcggcggcggcggcctgcgggagagcagaagaggcaagcagggcgccaggatgagcctgctgggcaagcccctgagctacaccagcagccagagctgcagaagaaatgtgaagtacagaagagtgcagaactacctgtacaacgtgctggagcggccccggggctgggccttcatctaccacgcctttgtgttcctgcctgtgtttggctgcctgatcctgagcgtcttcagcaccatccctgagcacaccaagctggccagcagctgcctgctgatcctggagtttgtgatgattgtggtgtttggcctggagttcatcatccgcatctggagcgctggctgctgctgccgctaccggggctggcagggccgcctgcgctttgccaggaagcccttctgtgtgattgacaccatcgtgctgattgccagcattgctgtggtgtctgccaagacccagggcaacatctttgccaccagcgccctgcggagcctgcgcttcctgcagatcctgaggatggtgaggatggacagaagaggaggcacctggaagctgctgggctctgtggtgtatgcccacagcaaggagctgatcacagcctggtacatcggcttcctggtgctgatcttcagcagcttcctggtgtacctggtggagaaggatgccaacaaggagttcagcacctatgcagatgccctgtggtggggcaccatcaccctgaccaccatcggctacggggacaagacccccctgacctggctgggccgcctgctgtctgctggctttgccctgctgggcatctccttctttgccctgcctgctggcatcctgggcagcggctttgccctgaaggtgcaggagcagcaccggcagaagcactttgagaagagaagaaatcctgctgccaacctgatccagtgtgtgtggaggagctatgctgctgatgagaagtctgtgtccatcgccacctggaagccccacctgaaggccctgcacacctgcagccccaccaagaaggagcagggcgaggccagcagcagcaagttctgcagcaacaagcagaagctgttcaggatgtacaccagcaggaagcagagccagaagctgtccttcaaggagcgggtgaggatggccagcccccggggccagagcatcaagagccggcaggcctctgtgggggaccggcgcagccccagcacagacatcacagctgagggcagccccaccaaggtgcagaagtcctggagcttcaatgacaggacccgcttccggcccagcctgcggctgaagagcagccagcccaagcctgtgattgatgctgacacagccctgggcacagatgatgtgtatgatgagaagggctgccagtgtgatgtgtctgtggaggacctgaccccacccctgaagacagtcatccgggccatccgcatcatgaagttccacgtggccaagaggaagttcaaggagaccctgcggccctatgatgtgaaggatgtgattgagcagtacagcgctggccacctggacatgctgtgccgcatcaagagcctgcagaccagggtggaccagatcctgggcaagggccagatcaccagtgacaagaagagccgggagaagatcacagctgagcacgagaccacagatgacctgtccatgctgggccgggtggtgaaggtggagaagcaggtgcagagcattgagagcaagctggactgcctgctggacatctaccagcaggtgctgaggaagggcagcgccagcgccctggccctggccagcttccagatccccccatttgaatgtgagcagaccagtgactaccagagccctgtggacagcaaggacctgagcggcagcgcccagaacagcggctgcctgagccgcagcaccagcgccaacatcagccggggcctgcagttcatcctgaccccaaatgagttcagcgcccagaccttctacgccctgagccccaccatgcacagccaggccacccaggtgcccatcagccagagtgatggcagcgctgtggccgccaccaacaccatcgccaaccagatcaacacagcccccaagccagctgcccccaccaccctgcagatccccccacccctgcctgccatcaagcacctgcccaggcctgagaccctgcaccccaacccagctggcctgcaggagagcatcagtgatgtgaccacctgcctggtggccagcaaagaaaatgtgcaggtggcccagagcaacctgaccaaggaccgctccatgaggaagagctttgacatgggcggggagaccctgctgtctgtgtgccccatggtgcccaaggacctgggcaagagcctgtctgtgcagaacctgatccgcagcacagaggagctgaacatccagctgagcggcagcgagagcagcggcagccggggcagccaggacttctaccccaagtggagggagagcaagctgttcatcacagatgaggaggtgggccctgaggagacagaaacagacacctttgatgctgccccccagcctgcccgggaggccgcctttgccagtgacagcctgaggacaggccgcagccgcagcagccagagcatctgcaaggccggggagagcacagatgccctgagcctgccccacgtgaagctgaagtag

SEQ ID NO: 164948 - DNA, 2577 bp, Artificial Sequence
  Description of Artificial Sequence: Synthetic coding sequence
atgcctgctggcatgaccaagcacggcagccgcagcaccagcagcctgcccccagagcccatggagatcgtgcgcagcaaggcctgcagcagaagagtgcggctgaatgtgggcggcctggcccacgaggtgctgtggaggaccctggaccggctgcccaggacccggctgggcaagctgcgggactgcaacacccatgacagcctgctggaggtgtgtgatgactacagcctggatgacaatgagtacttctttgacagacaccctggggccttcaccagcatcctgaacttctacagaacaggccgcctgcacatgatggaggagatgtgtgccctgtccttcagccaggagctggactactggggcattgatgagatctacctggagagctgctgccaggcccgctaccaccagaagaaggagcagatgaatgaggagctgaagcgggaggccgagaccctgcgggagcgggagggggaggagtttgacaacacctgctgtgccgagaagaggaagaagctgtgggacctgctggagaagcccaacagctctgtggccgccaagatcctggccatcatcagcatcatgtttattgtgctgagcaccatcgccctgagcctgaacaccctgcctgagctgcagagcctggatgaatttggccagagcacagacaacccccagctggcccacgtggaggccgtgtgcatcgcctggttcaccatggagtacctgctgcgcttcctgagcagccccaagaagtggaagttcttcaagggccccctgaatgccatcgacctgctggccatcctgccctactacgtgaccatcttcctgacagagagcaacaagtctgtgctgcagttccagaatgtgagaagagtggtgcagatcttccgcatcatgaggatcctgcgcatcctgaagctggcccggcacagcacaggcctgcagagcctgggcttcaccctgcggcgcagctacaatgagctgggcctgctgatcctcttcctggccatgggcatcatgatcttcagcagcctggtgttctttgctgagaaggatgaagatgacaccaagttcaagagcatcccagccagcttctggtgggccaccatcaccatgaccaccgtgggctacggggacatctaccccaagaccctgctgggcaagatcgtgggcggcctgtgctgcatcgccggcgtgctggtgattgccctgcccatccccatcatcgtgaacaacttcagcgagttctacaaggagcagaagaggcaggagaaggccatcaagaggcgggaggccctggagcgggccaagagaaatggcagcatcgtgtccatgaacatgaaggatgcctttgcccggagcattgagatgatggacatcgtggtggagaagaatggagagaacatgggcaagaaggacaaggtgcaggacaaccacctgagccccaacaagtggaagtggaccaagaggaccctgtctgagaccagcagcagcaagagctttgagaccaaggagcagggcagccctgagaaggcccggagcagcagcagcccccagcacctgaatgtgcagcagctggaggacatgtacaacaagatggccaagacccagagccagcccatcctgaacaccaaggagagcgctgcccagagcaagcccaaggaggagctggagatggagagcatccccagccctgtggcccccctgcccaccaggacagagggcgtcatcgacatgaggtccatgagcagcattgacagcttcatcagctgtgccacagacttccctgaggccacccgcttcagccacagccccctgaccagcctgcccagcaagacaggaggcagcacagcccctgaggtgggctggaggggggccctgggcgccagcggcggccgctttgtggaggccaaccccagcccagatgccagccagcacagcagcttcttcatcgagagccccaagagctccatgaagaccaacaaccccctgaagctgcgggccctgaaggtgaacttcatggagggggaccccagccccctgctgcctgtgctgggcatgtaccatgaccccctgaggaacagaggcagcgctgctgctgctgtggccggcctggagtgtgccaccctgctggacaaggctgtgctgagccctgagagcagcatctacaccacagccagcgccaagaccccacccaggagccctgagaagcacacagccatcgccttcaactttgaggccggcgtgcaccagtacattgatgctgacacagatgatgagggccagctgctgtacagcgtggacagcagcccccccaagagcctgcccggcagcaccagccccaagttcagcacaggcaccaggtctgagaagaaccactttgagagcagccccctgcccaccagccccaagttcctgcggcagaactgcatctacagcacagaggccctgaccgggaagggccccagcggccaggagaagtgcaagctggagaaccacatcagcccagatgtgcgggtgctgcccggcggcggggcccacggcagcacccgggaccagagcatctag

SEQ ID NO: 164949 - DNA, 2442 bp, Artificial Sequence
  Description of Artificial Sequence: Synthetic coding sequence
cgggatggaggagagaagacagctgtgacccggctgggcaagctgcgggactgcaacacccatgacagcctgctggaggtgtgtgatgactacagcctggatgacaatgagtacttctttgacagacaccctggggccttcaccagcatcctgaacttctacagaacaggccgcctgcacatgatggaggagatgtgtgccctgtccttcagccaggagctggactactggggcattgatgagatctacctggagagctgctgccaggcccgctaccaccagaagaaggagcagatgaatgaggagctgaagcgggaggccgagaccctgcgggagcgggagggggaggagtttgacaacacctgctgtgccgagaagaggaagaagctgtgggacctgctggagaagcccaacagctctgtggccgccaagatcctggccatcatcagcatcatgttcatcgtgctgagcaccatcgccctgagcctgaacaccctgcctgagctgcagagcctggatgaatttggccagagcacagacaacccccagctggcccacgtggaggccgtgtgcatcgcctggttcaccatggagtacctgctgcgcttcctgagcagccccaagaagtggaagttcttcaagggccccctgaatgccatcgacctgctggccatcctgccctactacgtgaccatcttcctgacagagagcaacaagtctgtgctgcagttccagaatgtgcggcgggtggtgcagatcttccgcatcatgaggatcctgcgcatcctgaagctggcccggcacagcacaggcctgcagagcctgggcttcaccctgcggcgcagctacaatgagctgggcctgctgatcctcttcctggccatgggcatcatgatcttcagcagcctggtgttctttgctgagaaggatgaagatgacaccaagttcaagagcatcccagccagcttctggtgggccaccatcaccatgaccaccgtgggctatggagacatctaccccaagaccctgctgggcaagatcgtgggcggcctgtgctgcatcgccggcgtgctggtgattgccctgcccatccccatcatcgtgaacaacttcagcgagttctacaaggagcagaagaggcaggagaaggccatcaagagaagagaggccctggagcgggccaagagaaatggcagcatcgtgtccatgaacatgaaggatgcctttgcccggagcattgagatgatggacatcgtggtggagaagaatggagagaacatgggcaagaaggacaaggtgcaggacaaccacctgagccccaacaagtggaagtggaccaagaggaccctgtctgagaccagcagcagcaagagctttgagaccaaggagcagggcagccctgagaaggcccggagcagcagcagcccccagcacctgaatgtgcagcagctggaggacatgtacaacaagatggccaagacccagagccagcccatcctgaacaccaaggagagcgctgcccagagcaagcccaaggaggagctggagatggagagcatccccagccctgtggcccccctgcccaccaggacagaaggagtgattgacatgaggtccatgagcagcattgacagcttcatcagctgtgccacagacttccctgaggccacccgcttcagccacagccccctgaccagcctgcccagcaagacaggaggcagcacagcccctgaggtgggctggaggggggccctgggcgccagcggcggccgctttgtggaggccaaccccagcccagatgccagccagcacagcagcttcttcatcgagagccccaagagctccatgaagaccaacaaccccctgaagctgcgggccctgaaggtgaacttcatggagggggaccccagccccctgctgcctgtgctgggcatgtaccatgaccccctgaggaacagaggcagcgctgctgctgctgtggccggcctggagtgtgccaccctgctggacaaggctgtgctgagccctgagagcagcatctacaccacagccagcgccaagaccccacccaggagccctgagaagcacacagccatcgccttcaactttgaagctggggtgcaccagtacattgatgctgacacagatgatgagggccagctgctgtacagcgtggacagcagcccccccaagagcctgcccggcagcaccagccccaagttcagcacaggcaccaggtctgagaagaaccactttgagagcagccccctgcccaccagccccaagttcctgcggcagaactgcatctacagcacagaggccctgaccgggaagggccccagcggccaggagaagtgcaagctggagaaccacatcagcccagatgtgcgggtgctgcccggcggcggggcccacggcagcacccgggaccagagcatctag

SEQ ID NO: 164950 - DNA, 2736 bp, Artificial Sequence
  Description of Artificial Sequence: Synthetic coding sequence
atggccgagaaggcccctcctggcctgaacaggaagaccagccgcagcaccctgagcctgcccccagagcctgtggacatcatccgcagcaagacctgcagcagaagagtgaagatcaacgtgggcggcctgaaccacgaggtgctgtggaggaccctggaccggctgcccaggacccggctgggcaagctgcgggactgcaacacccatgagagcctgctggaggtgtgtgatgactacaacctgaatgaaaatgagtacttctttgacagacaccctggggccttcaccagcatcctgaacttctacagaacaggcaagctgcacatgatggaggagatgtgtgccctgagctttggccaggagctggactactggggcattgatgagatctacctggagagctgctgccaggcccgctaccaccagaagaaggagcagatgaatgaggagctgcggcgggaggccgagaccatgagggagcgggagggggaggagtttgacaacacctgctgcccagacaagaggaagaagctgtgggacctgctggagaagcccaacagctctgtggccgccaagatcctggccatcgtgtccatcctcttcatcgtgctgagcaccatcgccctgagcctgaacaccctgcctgagctgcaggagacagatgaatttggccagctgaatgacaaccggcagctggcccacgtggaggccgtgtgcatcgcctggttcaccatggagtacctgctgcgcttcctgagcagccccaacaagtggaagttcttcaagggccccctgaatgtgattgacctgctggccatcctgccctactacgtgaccatcttcctgacagagagcaacaagtctgtgctgcagttccagaatgtgagaagagtggtgcagatcttccgcatcatgaggatcctgcgcatcctgaagctggcccggcacagcacaggcctgcagagcctgggcttcaccctgcggcgcagctacaatgagctgggcctgctgatcctcttcctggccatgggcatcatgatcttcagcagcctggtgttctttgctgagaaggatgaagatgccaccaagttcaccagcatcccagccagcttctggtgggccaccatcaccatgaccaccgtgggctacggggacatctaccccaagaccctgctgggcaagatcgtgggcggcctgtgctgcatcgccggcgtgctggtgattgccctgcccatccccatcatcgtgaacaacttcagcgagttctacaaggagcagaagaggcaggagaaggccatcaagaggcgggaggccctggagcgggccaagagaaatggcagcatcgtgtccatgaacctgaaggatgcctttgcccgctccatggagctgattgatgtggccgtggagaaggccggggagagcgccaacaccaaggacagcgcagatgacaaccacctgagccccagccgctggaagtgggccaggaaggccctgtctgagaccagcagcaacaagagctttgagaacaagtaccaggaggtgtcccagaaggacagccatgagcagctgaacaacaccagcagcagcagcccccagcacctgagcgcccagaagctggagatgctgtacaatgagatcaccaagacccagccccacagccaccccaacccagactgccaggagaagccagagcggcccagcgcctatgaggaggagattgagatggaggaggtggtgtgcccccaggagcagctggccgtggcccagacagaggtgattgtggacatgaagagcaccagcagcattgacagcttcaccagctgtgccacagacttcacagaaacagagaggagccccctgcccccaccttctgccagccacctgcagatgaagttccccacagacctgcccggcacagaggagcaccagagggcccggggcccccccttcctgaccctgagccgggagaagggccctgctgccagagatggcaccctggagtatgcccctgtggacatcaccgtgaacctggatgccagcggcagccagtgtggcctgcacagccccctgcagagcgacaatgccacagacagccccaagagcagcctgaagggcagcaaccccctgaagagccgcagcctgaaggtgaacttcaaggaaaatagaggcagcgccccccagaccccacccagcacagcccggcccctgcctgtgaccacagctgacttcagcctgaccaccccccagcacatcagcaccatcctgctggaggagacccccagccagggcgaccggcccctgctgggcacagaggtgtctgccccctgccagggccccagcaagggcctgagcccccgcttccccaagcagaagctgttccccttcagcagccgggagaggaggagcttcacagaaattgacacaggagatgatgaggacttcctggagctgcccggggcccgggaggagaagcaggtggacagcagccccaactgctttgctgacaagcccagtgatggccgggaccccctgcgggaggagggctctgtgggcagcagcagcccccaggacaccggccacaactgccggcaggacatctaccacgctgtgtctgaggtgaagaaggacagcagccaggagggctgcaagatggagaaccacctgtttgcccctgagatccacagcaaccctggggacaccggctactgccccacccgggagacctccatgtag

SEQ ID NO: 164951 - DNA, 1206 bp, Artificial Sequence
  Description of Artificial Sequence: Synthetic coding sequence
atgcaggtgtccatcgcctgcacagagcacaacctgaagagcagaaatggagaggaccggctgctgagcaagcagagcagcacagccccaaatgtggtgaatgctgcccgggccaagttcagaacagtggccatcatcgcccggagcctgggcaccttcaccccccagcaccacatcagcctgaaggagagcacagccaagcagacaggcatgaagtacagaaacctgggcaagagcggcctgcgggtgtcctgcctgggcctgggcacctgggtgaccttcggcggccagatcagtgatgaggtggccgagcggctgatgaccatcgcctatgaaagtggagtgaacctgtttgacacagctgaggtgtatgctgctgggaaggccgaggtgatcctgggcagcatcatcaagaagaagggctggaggaggagcagcctggtgatcaccaccaagctgtactggggcggcaaggccgagacagagcggggcctgagcaggaagcacatcatcgagggcctgaagggcagcctgcagaggctgcagctggagtatgtggatgtggtgtttgccaacagaccagacagcaacacccccatggaggagatcgtgcgggccatgacccacgtgatcaaccagggcatggccatgtactggggcaccagccgctggagcgccatggagatcatggaggcctacagcgtggcccggcagttcaacatgatcccccctgtgtgtgagcaggccgagtaccacctgttccagcgggagaaggtggaggtgcagctgcctgagctgtaccacaagattggagtgggcgccatgacctggagccccctggcctgtggcatcatcagcggcaagtatggaaatggagtgcctgagagcagccgggccagcctgaagtgctaccagtggctgaaggagagaattgtgtctgaggagggcaggaagcagcagaacaagctgaaggacctgagccccatcgccgagcggctgggctgcaccctgccccagctggccgtggcctggtgcctgagaaatgaaggagtgtcctctgtgctgctgggcagcagcaccccagagcagctgattgagaacctgggcgccatccaggtgctgcccaagatgaccagccacgtggtgaatgaaattgacaacatcctgaggaacaagccctacagcaagaaggactaccgctcctag

SEQ ID NO: 164952 - DNA, 1173 bp, Artificial Sequence
  Description of Artificial Sequence: Synthetic coding sequence
atgctggccgccaggactggagctgctggcagccagatcagcgaggagaacaccaagctgcggcggcagagcggcttctctgtggccggcaaggacaagagccccaagaaggcctctgaaaatgccaaggacagcagcctgagccccagcggggagagccagctgcgggcccggcagctggccctgctgcgggaggtggagatgaactggtacctgaagctgtgtgacctgagcagcgagcacaccaccgtgtgcaccaccggcatgccccacaggaacctgggcaagagcggcctgcgggtgtcctgcctgggcctgggcacctgggtgaccttcggcggccagatcagtgatgaggtggccgagcggctgatgaccatcgcctatgaaagtggagtgaacctgtttgacacagctgaggtgtatgctgctgggaaggccgaggtgatcctgggcagcatcatcaagaagaagggctggaggaggagcagcctggtgatcaccaccaagctgtactggggcggcaaggccgagacagagcggggcctgagcaggaagcacatcatcgaggagatcgtgcgggccatgacccacgtgatcaaccagggcatggccatgtactggggcaccagccgctggagcgccatggagatcatggaggcctacagcgtggcccggcagttcaacatgatcccccctgtgtgtgagcaggccgagtaccacctgttccagcgggagaaggtggaggtgcagctgcctgagctgtaccacaagattggagtgggcgccatgacctggagccccctggcctgtggcatcatcagcggcaagtatggaaatggagtgcctgagagcagccgggccagcctgaagtgctaccagtggctgaaggagcgcatcgtgtctgaggagggcaggaagcagcagaacaagctgaaggacctgagccccatcgccgagcggctgggctgcaccctgccccagctggccgtggcctggtgcctgagaaatgaaggagtgtcctctgtgctgctgggcagcagcaccccagagcagctgattgagaacctgggcgccatccaggtgctgcccaagatgaccagccacgtggtgaatgaaattgacaacatcctgaggaacaagccctacagcaagaaggactaccgctcctag

SEQ ID NO: 164953 - DNA, 1227 bp, Artificial Sequence
  Description of Artificial Sequence: Synthetic coding sequence
atgcacctgtacaagccagcctgtgccgacatccccagccccaagctgggcctgcccaagagcagcgagagcgccctgaagtgccgctggcacctggccgtgaccaagacccagccccaggccgcctgcaagcctgtgcggcccagcggggctgctgagcagaagtatgtggagaagttcctgcgggtgcacggcatcagcctgcaggagaccaccagggctgagaccggcatggcctacagaaacctgggcaagagcggcctgcgggtgtcctgcctgggcctgggcacctgggtgacctttggaggccagatcagtgatgaggtggccgagcggctgatgaccatcgcctatgagagcggcgtgaacctgtttgacacagctgaggtgtatgctgctgggaaggccgaggtgatcctgggcagcatcatcaagaagaagggctggaggaggagcagcctggtgatcaccaccaagctgtactggggcggcaaggccgagacagagcggggcctgagcaggaagcacatcatcgagggcctgaagggcagcctgcagaggctgcagctggagtatgtggatgtggtgtttgccaacagaccagacagcaacacccccatggaggagatcgtgcgggccatgacccacgtgatcaaccagggcatggccatgtactggggcaccagccgctggagcgccatggagatcatggaggcctacagcgtggcccggcagttcaacatgatcccccctgtgtgtgagcaggccgagtaccacctgttccagcgggagaaggtggaggtgcagctgcctgagctgtaccacaagattggagtgggcgccatgacctggagccccctggcctgtggcatcatcagcggcaagtatggaaatggagtgcctgagagcagccgggccagcctgaagtgctaccagtggctgaaggagcgcatcgtgtctgaggagggcaggaagcagcagaacaagctgaaggacctgagccccatcgccgagcggctgggctgcaccctgccccagctggccgtggcctggtgcctgagaaatgaaggagtgtcctctgtgctgctgggcagcagcaccccagagcagctgattgagaacctgggcgccatccaggtgctgcccaagatgaccagccacgtggtgaatgaaattgacaacatcctgaggaacaagccctacagcaagaaggactaccgctcctag

SEQ ID NO: 164954 - DNA, 1260 bp, Artificial Sequence
  Description of Artificial Sequence: Synthetic coding sequence
atgctggccgccaggactggagctgctggcagccagatcagcgaggagaacaccaagctgcggcggcagagcggcttctctgtggccggcaaggacaagagccccaagaaggcctctgaaaatgccaaggacagcagcctgagccccagcggggagagccagctgcgggcccggcagctggccctgctgcgggaggtggagatgaactggtacctgaagctgtgtgacctgagcagcgagcacaccaccgtgtgcaccaccggcatgccccacaggaacctgggcaagagcggcctgcgggtgtcctgcctgggcctgggcacctgggtgaccttcggcggccagatcagtgatgaggtggccgagcggctgatgaccatcgcctatgaaagtggagtgaacctgtttgacacagctgaggtgtatgctgctgggaaggccgaggtgatcctgggcagcatcatcaagaagaagggctggaggaggagcagcctggtgatcaccaccaagctgtactggggcggcaaggccgagacagagcggggcctgagcaggaagcacatcatcgagggcctgaagggcagcctgcagaggctgcagctggagtatgtggatgtggtgtttgccaacagaccagacagcaacacccccatggaggagatcgtgcgggccatgacccacgtgatcaaccagggcatggccatgtactggggcaccagccgctggagcgccatggagatcatggaggcctacagcgtggcccggcagttcaacatgatcccccctgtgtgtgagcaggccgagtaccacctgttccagcgggagaaggtggaggtgcagctgcctgagctgtaccacaagattggagtgggcgccatgacctggagccccctggcctgtggcatcatcagcggcaagtatggaaatggagtgcctgagagcagccgggccagcctgaagtgctaccagtggctgaaggagagaattgtgtctgaggagggcaggaagcagcagaacaagctgaaggacctgagccccatcgccgagcggctgggctgcaccctgccccagctggccgtggcctggtgcctgagaaatgaaggagtgtcctctgtgctgctgggcagcagcaccccagagcagctgattgagaacctgggcgccatccaggtgctgcccaagatgaccagccacgtggtgaatgaaattgacaacatcctgaggaacaagccctacagcaagaaggactaccgctcctag

SEQ ID NO: 164955 - DNA, 1104 bp, Artificial Sequence
  Description of Artificial Sequence: Synthetic coding sequence
atgtacccagagagcaccaccggcagccctgcccggctgagcctgcggcagacaggcagccctggcatgatctacagcaccaggtatggcagccccaagaggcagctgcagttctacagaaacctgggcaagagcggcctgcgggtgtcctgcctgggcctgggcacctgggtgaccttcggcggccagatcacagatgagatggccgagcagctgatgaccctggcctatgacaatggcatcaacctgtttgacacagctgaggtgtatgctgctgggaaggccgaggtggtgctgggcaacatcatcaagaagaagggctggaggaggagcagcctggtgatcaccaccaagatcttctggggcggcaaggccgagacagagcggggcctgagcaggaagcacatcatcgagggcctgaaggccagcctggagcggctgcagctggagtatgtggatgtggtgtttgccaacagaccagaccccaacacccccatggaggagaccgtgcgggccatgacccacgtgatcaaccagggcatggccatgtactggggcaccagccgctggagctccatggagatcatggaggcctacagcgtggcccggcagttcaacctgaccccacccatctgtgagcaggccgagtaccacatgttccagcgggagaaggtggaggtgcagctgcctgagctgttccacaagattggagtgggcgccatgacctggagccccctggcctgtggcatcgtgtctgggaagtatgattctggcatccccccctacagccgggccagcctgaagggctaccagtggctgaaggacaagatcctgtctgaggagggccggcggcagcaggccaagctgaaggagctgcaggccatcgccgagcggctgggctgcaccctgccccagctggccatcgcctggtgcctgagaaatgaaggagtgtcctctgtgctgctgggcgccagcaatgctgaccagctgatggagaacatcggggccatccaggtgctgcccaagctgagcagcagcatcatccatgaaattgacagcatcctgggcaacaagccctacagcaagaaggactaccgctcctag

SEQ ID NO: 164956 - DNA, 1104 bp, Artificial Sequence; identical to SEQ ID NO: 164955
  Description of Artificial Sequence: Synthetic coding sequence

SEQ ID NO: 164957 - DNA, 1062 bp, Artificial Sequence
  Description of Artificial Sequence: Synthetic coding sequence
atgtacccagagagcaccaccggcagccctgcccggctgagcctgcggcagacaggcagccctggcatgatctacagaaacctgggcaagagcggcctgcgggtgtcctgcctgggcctgggcacctgggtgaccttcggcggccagatcacagatgagatggccgagcagctgatgaccctggcctatgacaatggcatcaacctgtttgacacagctgaggtgtatgctgctgggaaggccgaggtggtgctgggcaacatcatcaagaagaagggctggaggaggagcagcctggtgatcaccaccaagatcttctggggcggcaaggccgagacagagcggggcctgagcaggaagcacatcatcgagggcctgaaggccagcctggagcggctgcagctggagtatgtggatgtggtgtttgccaacagaccagaccccaacacccccatggaggagaccgtgcgggccatgacccacgtgatcaaccagggcatggccatgtactggggcaccagccgctggagctccatggagatcatggaggcctacagcgtggcccggcagttcaacctgaccccacccatctgtgagcaggccgagtaccacatgttccagcgggagaaggtggaggtgcagctgcctgagctgttccacaagattggagtgggcgccatgacctggagccccctggcctgtggcatcgtgtctgggaagtatgattctggcatccccccctacagccgggccagcctgaagggctaccagtggctgaaggacaagatcctgtctgaggagggccggcggcagcaggccaagctgaaggagctgcaggccatcgccgagcggctgggctgcaccctgccccagctggccatcgcctggtgcctgagaaatgaaggagtgtcctctgtgctgctgggcgccagcaatgctgaccagctgatggagaacatcggggccatccaggtgctgcccaagctgagcagcagcatcatccatgaaattgacagcatcctgggcaacaagccctacagcaagaaggactaccgctcctag

SEQ ID NO: 164958 - DNA, 1248 bp, Artificial Sequence
  Description of Artificial Sequence: Synthetic coding sequence
atgctgtccatgacctacagcgagagcctgcggtctgtgagcagccgctgccacagcgagtgggccctgcaccctgtgcggcagacagacaccctggagctgcagaggctgcgggaggtgcgggctgctgcccaggccaggaacatggagagcttcctgaggatgcacggcctgagcctggatggctgcacagcccagaggacaggcatgaagtacagaaacctgggcaagagcggcctgcgggtgtcctgcctgggcctgggcacctgggtgacctttggaggccagatcacagatgagatggccgagcagctgatgaccctggcctatgacaatggcatcaacctgtttgacacagctgaggtgtatgctgctgggaaggccgaggtggtgctgggcaacatcatcaagaagaagggctggaggaggagcagcctggtgatcaccaccaagatcttctggggcggcaaggccgagacagagcggggcctgagcaggaagcacatcatcgagggcctgaaggccagcctggagcggctgcagctggagtatgtggatgtggtgtttgccaacagaccagaccccaacacccccatggagggggaccccttcagcagcagcaagagcaggaccttcatcatcgaggagaccgtgcgggccatgacccacgtgatcaaccagggcatggccatgtactggggcaccagccgctggagctccatggagatcatggaggcctacagcgtggcccggcagttcaacctgaccccacccatctgtgagcaggccgagtaccacatgttccagcgggagaaggtggaggtgcagctgcctgagctgttccacaagattggagtgggcgccatgacctggagccccctggcctgtggcatcgtgtctgggaagtatgattctggcatccccccctacagccgggccagcctgaagggctaccagtggctgaaggacaagatcctgtctgaggagggccggcggcagcaggccaagctgaaggagctgcaggccatcgccgagcggctgggctgcaccctgccccagctggccatcgcctggtgcctgagaaatgaaggagtgtcctctgtgctgctgggcgccagcaatgctgaccagctgatggagaacatcggggccatccaggtgctgcccaagctgagcagcagcatcatccatgaaattgacagcatcctgggcaacaagccctacagcaagaaggactaccgctcctag

SEQ ID NO: 164959 - DNA, 522 bp, Artificial Sequence
  Description of Artificial Sequence: Synthetic coding sequence
atgtacccagagagcaccaccggcagccctgcccggctgagcctgcggcagacaggcagccctggcatgatctacagcaccaggtatggcagccccaagaggcagctgcagttctacagaaacctgggcaagagcggcctgcgggtgtcctgcctgggcctgggcacctgggtgaccttcggcggccagatcacagatgagatggccgagcagctgatgaccctggcctatgacaatggcatcaacctgtttgacacagctgaggtgtatgctgctgggaaggccgaggtggtgctgggcaacatcatcaagaagaagggctggagccagcagggcgagagagctggccaggcccgggtgaccccaccctgcagcctgggccggcgggccagagatgccagcaagtctgctggagctggctgccacctgcaggcccaggcctgtgtgcccagcagcacccaggccctgcagaccacccggggccgggcccccctgaagcccccaccacccctggccagctag

SEQ ID NO: 164960 - DNA, 1062 bp, Artificial Sequence; identical to SEQ ID NO: 164957
  Description of Artificial Sequence: Synthetic coding sequence

SEQ ID NO: 164961 - DNA, 1104 bp, Artificial Sequence; identical to SEQ ID NO: 164955
  Description of Artificial Sequence: Synthetic coding sequence

SEQ ID NO: 164962 - DNA, 522 bp, Artificial Sequence
  Description of Artificial Sequence: Synthetic coding sequence
atgtacccagagagcaccaccggcagccctgcccggctgagcctgcggcagacaggcagccctggcatgatctacagcaccaggtatggcagccccaagaggcagctgcagttctacagaaacctgggcaagagcggcctgcgggtgtcctgcctgggcctgggcacctgggtgaccttcggcggccagatcacagatgagatggccgagcagctgatgaccctggcctatgacaatggcatcaacctgtttgacacagctgaggtgtatgctgctgggaaggccgaggtggtgctgggcaacatcatcaagaagaagggctggaggcagagaggagagagagctggccaggcccgggtgaccccaccctgcagcctgggccggcgggccagagatgccagcaagtctgctggagctggctgccacctgcaggcccaggcctgtgtgcccagcagcacccaggccctgcagaccacccggggccgggcccccctgaagcccccaccacccctggccagctag

SEQ ID NO: 164963 - DNA, 762 bp, Artificial Sequence
  Description of Artificial Sequence: Synthetic coding sequence
atgtacccagagagcaccaccggcagccctgcccggctgagcctgcggcagacaggcagccctggcatgatctacagcaccaggtatggcagccccaagaggcagctgcagttctacagaaacctgggcaagagcggcctgcgggtgtcctgcctgggcctgggcacctgggtgaccttcggcggccagatcacagatgagatggccgagcagctgatgaccctggcctatgacaatggcatcaacctgtttgacacagctgaggtgtatgctgctgggaaggccgaggtggtgctgggcaacatcatcaagaagaagggctggaggaggagcagcctggtgatcaccaccaagatcttctggggcggcaaggccgagacagagcggggcctgagcaggaagcacatcatcgagggcctgaaggccagcctggagcggctgcagctggagtatgtggatgtggtgtttgccaacagaccagaccccaacacccccatggaggagaccgtgcgggccatgacccacgtgatcaaccagggcatggccatgtactggggcaccagccgctggagctccatggagatcatggaggcctacagcgtggcccggcagttcaacctgaccccacccatctgtgagcaggccgagtaccacatgttccagcgggagaaggtggaggtgcagctgcctgagctgttccacaagattggagtgggcgccatgacctggagccccctggcctgtggcatcgtgtctggatag

SEQ ID NO: 164964 - DNA, 765 bp, Artificial Sequence
  Description of Artificial Sequence: Synthetic coding sequence
atgtacccagagagcaccaccggcagccctgcccggctgagcctgcggcagacaggcagccctggcatgatctacagaaacctgggcaagagcggcctgcgggtgtcctgcctgggcctgggcacctgggtgaccttcggcggccagatcacagatgagatggccgagcagctgatgaccctggcctatgacaatggcatcaacctgtttgacacagctgaggtgtatgctgctgggaaggccgaggtggtgctgggcaacatcatcaagaagaagggctggaggaggagcagcctggtgatcaccaccaagatcttctggggcggcaaggccgagacagagcggggcctgagcaggaagcacatcatcgagggcctgaaggccagcctggagcggctgcagctggagtatgtggatgtggtgtttgccaacagaccagaccccaacacccccatggaggagaccgtgcgggccatgacccacgtgatcaaccagggcatggccatgtactggggcaccagccgctggagctccatggagatcatggaggcctacagcgtggcccggcagttcaacctgaccccacccatctgtgagcaggccgagtaccacatgttccagcgggagaaggtggaggtgcagctgcctgagctgttccacaagattggagtgggcgccatgacctggagccccctggcctgtggcatcgtgtctgggaagtatgattctggcatccccccctacagccgggccagcctgaagtag

SEQ ID NO: 164965 - DNA, 288 bp, Artificial Sequence
  Description of Artificial Sequence: Synthetic coding sequence
atgtacccagagagcaccaccggcagccctgcccggctgagcctgcggcagacaggcagccctggcatgatctacagaaacctgggcaagagcggcctgcgggtgtcctgcctgggcctgggcacctgggtgaccttcggcggccagatcacagatgagatggccgagcagctgatgaccctggcctatgacaatggcatcaacctgtttgacacagctgaggtgtatgctgctgggaaggccgaggtggtgctgggcaacatcatcaagaagaagggctggaggtag

SEQ ID NO: 164966 - DNA, 159 bp, Artificial Sequence
  Description of Artificial Sequence: Synthetic coding sequence
atgtacccagagagcaccaccggcagccctgcccggctgagcctgcggcagacaggcagccctggcatgatctacagcaccaggtatggcagccccaagaggcagctgcagttctacagaaacctgggcaagagcggcctgcgggtgtcctgcctgtag

SEQ ID NO: 164967 - DNA, 903 bp, Artificial Sequence
  Description of Artificial Sequence: Synthetic coding sequence
atggccgagcagctgatgaccctggcctatgacaatggcatcaacctgtttgacacagctgaggtgtatgctgctgggaaggccgaggtggtgctgggcaacatcatcaagaagaagggctggaggaggagcagcctggtgatcaccaccaagatcttctggggcggcaaggccgagacagagcggggcctgagcaggaagcacatcatcgagggcctgaaggccagcctggagcggctgcagctggagtatgtggatgtggtgtttgccaacagaccagaccccaacacccccatggaggagaccgtgcgggccatgacccacgtgatcaaccagggcatggccatgtactggggcaccagccgctggagctccatggagatcatggaggcctacagcgtggcccggcagttcaacctgaccccacccatctgtgagcaggccgagtaccacatgttccagcgggagaaggtggaggtgcagctgcctgagctgttccacaagattggagtgggcgccatgacctggagccccctggcctgtggcatcgtgtctgggaagtatgacagcggcatccccccctacagccgggccagcctgaagggctaccagtggctgaaggacaagatcctgtctgaggagggccggcggcagcaggccaagctgaaggagctgcaggccatcgccgagcggctgggctgcaccctgccccagctggccatcgcctggtgcctgagaaatgaaggagtgtcctctgtgctgctgggcgccagcaatgctgaccagctgatggagaacattggagccatccaggtgctgcccaagctgagcagcagcatcatccacgagattgacagcatcctgggcaacaagccctacagcaagaaggactaccgctcctag

SEQ ID NO: 164968 - DNA, 1215 bp, Artificial Sequence
  Description of Artificial Sequence: Synthetic coding sequence
atgcaggtgtccatcgcctgcacagagcagaacctgcggagccgcagcagcgaggaccggctgtgtggcccccggcccggccctgggggcggcaatggaggccctgctgggggcggccacggcaaccccccaggcggcggcggcagcggccccaaggcccgggccgccctggtgccccggcccccagccccagctggggccctgcgggagagcacaggccggggcaccggcatgaagtacagaaacctgggcaagagcggcctgcgggtgtcctgcctgggcctgggcacctgggtgaccttcggcagccagatcagtgatgaaacagcagaagatgtgctgactgtggcctatgagcacggcgtgaacctgtttgacacagctgaggtgtatgctgctgggaaggccgagaggaccctgggcaacatcctgaagagcaagggctggaggaggagcagctatgtgatcaccaccaagatcttctggggcggccaggccgagacagagcggggcctgagcaggaagcacatcatcgagggcctgcggggcagcctggagcggctgcagctgggctacgtggacatcgtgtttgccaacagaagtgaccccaactgccccatggaggagatcgtgcgggccatgacctacgtgatcaaccagggcctggccctgtactggggcaccagccgctggggcgctgctgagatcatggaggcctacagcatggcccggcagttcaacctgatcccccctgtgtgtgagcaggccgagcaccacctgttccagcgggagaaggtggagatgcagctgcctgagctgtaccacaagattggagtgggctctgtgacctggtaccccctggcctgtggcctcatcaccagcaaatatgatggccgggtgcctgacacctgccgggccagcatcaagggctaccagtggctgaaggacaaggtgcagagtgaagatggcaagaagcagcaggccaaggtgatggacctgctgcctgtggcccaccagctgggctgcaccgtggcccagctggccatcgcctggtgcctgcggagtgaaggagtgtcctctgtgctgctgggcgtgtcctctgctgagcagctgattgagcacctgggcgccctgcaggtgctgagccagctgaccccccagacagtgatggagattgatggcctgctgggcaacaagccccacagcaagaagtag

SEQ ID NO: 164969 - DNA, 2562 bp, Artificial Sequence
  Description of Artificial Sequence: Synthetic coding sequence
atgtctgagaaggtggactggctgcagagccagaatggagtgtgcaaggtggatgtgtacagccctggggacaaccaggcccaggactggaagatggacaccagcacagatcctgtgcgggtgctgtcctggctgcggcgggacctggagaagagcacagctgagttccaggatgtgcgcttcaagccaggagagagctttggaggagagaccagcaacagcggggacccccacaagggcttctctgtggactactacaacaccaccaccaagggcaccccagagcggctgcactttgagatgacccacaaggagatcccctgccagggcccccgggcccagctgggcaatggcagctctgtggatgaggtgtccttctacgccaaccggctgaccaacctggtgattgccatggccaggaaggagatcaatgagaagattgatggctctgaaaataaatgtgtgtaccagagcctgtacatgggaaatgagcccacccccaccaagagcctgagcaagatcgccagcgagctggtgaatgagaccgtgtctgcctgcagcagaaatgctgccccagacaaggcccctggcagcggggacagagtgtctggcagcagccagagcccccccaacctgaagtacaagagcaccctgaagatcaaggagagcaccaaggagcggcagggcccagatgacaagccacccagcaagaagagcttcttctacaaggaggtgtttgagagcagaaatggagactatgcccgggagggcggccgcttcttcccccgggagaggaagcgcttccggggccaggagaggccagatgacttcaccgcctctgtgtctgagggcatcatgacctacgccaacagcgtggtgtctgacatgatggtgtccatcatgaagaccctgaagatccaggtgaaggacaccaccatcgccaccatcctgctgaagaaggtgctgctgaagcacgccaaggaggtggtgtctgacctgattgacagcttcctgaggaacctgcacagcgtgacaggcaccctgatgacagacacccagtttgtgtctgctgtgaagaggacagtgttcagccacggcagccagaaggccacagacatcatggatgccatgctgaggaagctgtacaacgtgatgtttgccaagaaggtgcctgagcacgtgaggaaggcccaggacaaggccgagagctacagcctcatctccatgaagggcatgggagaccccaagaacagaaatgtgaactttgccatgaagtctgagaccaagctgcgggagaagatgtacagcgagcccaagtctgaggaggagacctgtgccaagaccctgggggagcacatcatcaaggagggcctgaccctgtggcacaagacccagcagaaggagtgcaagagcctgggcttccagcacgccgcctttgaggcccccaacacccagaggaagccagccagtgacatcagctttgagtacccagaggacatcggcaacctgagcctgcccccctacccacctgagaagccagagaacttcatgtatgacagcgacagctgggccgaggacctgattgtgtctgccctgctgctgatccagtaccacctggcccagggcggcagaagagatgcccggagctttgtggaggccgccggcaccaccaacttccctgccaatgagccccctgtggccccagatgagagctgcctgaagagcgcccccatcgtgggggaccaggagcaggccgagaagaaggacctgcggagcgtcttcttcaacttcatccggaacctgctgtctgagaccatcttcaagagggaccagagccctgagcccaaggtgcctgagcagcctgtgaaggaggacaggaagctgtgtgagcggcccctggccagcagccccccccggctgtatgaagatgatgagacccctggggccctgagcggcctgaccaagatggctgtgtcccagattgatggccacatgagcggccagatggtggagcacctgatgaacagcgtgatgaagctgtgtgtgatcatcgccaagagctgtgatgccagcctggccgagctgggagatgacaagtctggagatgccagccggctgaccagcgccttcccagacagcctgtatgagtgcctgcctgccaagggcactggatctgctgaggccgtgctgcagaatgcctaccaggccatccacaatgagatgaggggcaccagcggccagcccccagagggctgtgccgcccccaccgtcatcgtgagcaaccacaacctgacagacacagtgcagaacaagcagctgcaggccgtgctgcagtgggtggccgccagcgagctgaatgtgcccatcctgtactttgctggagatgatgagggcatccaggagaagctgctgcagctgtctgctgctgctgtggacaagggctgcagcgtgggggaggtgctgcagagcgtgctgcgctatgagaaggagcggcagctgaatgaggccgtgggcaatgtgacccccctgcagctgctggactggctgatggtgaacctgtag

SEQ ID NO: 164970 - DNA, 1488 bp, Artificial Sequence
  Description of Artificial Sequence: Synthetic coding sequence
atgacagtgatgtctggagaaaatgtggatgaggccagcgctgcccctggccacccccaggacggcagctacccccggcaggccgaccatgatgaccacgagtgctgtgagcgggtggtgatcaacatcagcggcctgcgctttgagacccagctgaagaccctggcccagttccccaacaccctgctgggcaaccccaagaagaggatgagatactttgaccccctgagaaatgagtacttctttgacaggaaccggcccagctttgatgccatcctgtactactaccagagcggcggccgcctgcggcggcctgtgaatgtgcccctggacatgttcagcgaggagatcaagttctatgagctgggggaggaggccatggagaagttccgggaggatgagggcttcatcaaggaggaggagcggcccctgcctgagaaggagtaccagaggcaggtgtggctgctgtttgagtacccagagagcagcggccctgcccgggtgattgccatcgtgtctgtgatggtgatcctgatcagcatcgtcatcttctgcctggagaccctgcctgagctgaaggatgacaaggacttcaccggcaccgtgcacagaattgacaacaccaccgtcatctacaacagcaacatcttcacagaccccttcttcatcgtggagaccctgtgcatcatctggttctcctttgagctggtggtgcgcttctttgcctgccccagcaagacagacttcttcaagaacatcatgaacttcattgatattgtggccatcatcccctacttcatcaccctgggcacagaaattgctgagcaggagggcaaccagaagggggagcaggccaccagcctggccatcctgcgggtcatccggctggtgcgggtcttccgcatcttcaagctgagccgccacagcaagggcctgcagatcctgggccagaccctgaaggcctccatgagggagctgggcctgctgatcttcttcctgttcatcggggtcatcctcttcagcagcgctgtgtactttgctgaggccgaggaggccgagagccacttcagcagcatcccagatgccttctggtgggccgtggtgtccatgaccaccgtgggctatggagacatgtaccctgtgaccatcggcggcaagatcgtgggcagcctgtgtgccatcgccggcgtgctgaccatcgccctgcctgtgcctgtgattgtgagcaacttcaactacttctaccaccgggagacagaaggagaggagcaggcccagctgctgcacgtgagcagccccaacctggccagtgacagcgacctgagcagaagaagcagcagcaccatgagcaagtctgagtacatggagattgaggaggacatgaacaacagcatcgcccactaccggcaggtgaacatcagaacagccaactgcaccacagccaaccagaactgtgtgaacaagagcaagctgctgacagatgtgtag

SEQ ID NO: 164971 - DNA, 1536 bp, Artificial Sequence
  Description of Artificial Sequence: Synthetic coding sequence
atggatgtgtgtggctggaaggagatggaggtggccctggtgaactttgacaacagtgatgagatccaggaggagcccggctacgccacagactttgacagcaccagccccaagggccggcctgggggcagcagcttcagcaatggcaagatcctgatcagcgagagcaccaaccatgaaacagccttcagcaagctgcccggggactatgctgaccccccaggccctgagcctgtggtgctgaatgaaggcaaccagagggtcatcatcaacattgctggcctgcgctttgagacccagctgcggaccctgagccagtttcctgagaccctgctgggggaccgggagaagaggatgcagttctttgacagcatgagaaatgagtacttctttgacaggaaccggcccagctttgatggcatcctgtactactaccagagcggcggcaagatccggcggcctgccaacgtgcccatcgacatctttgctgatgagatctccttctatgagctgggcagcgaggccatggaccagttcagagaagatgagggcttcatcaaggaccctgagaccctgctgcccaccaatgacatccaccggcagttctggctgctgtttgagtacccagagagcagcagcgctgcccgggctgtggccgtggtgtctgtgctggtggtggtgatcagcatcaccatcttctgcctggagaccctgcctgagttcagagaagatcgggagctgaaggtggtgcgggaccccaacctgaacatgagcaagacagtgctgagccagaccatgttcacagaccccttcttcatggtggagagcacctgcatcgtgtggttcacctttgagctggtgctgcgctttgtggtgtgccccagcaagacagacttcttcaggaacatcatgaacatcatcgacatcatcagcatcatcccctactttgccaccctcatcacagagctggtgcaggagacagagcccagcgcccagcagaacatgagcctggccatcctgcgcatcatccggctggtgcgggtcttccgcatcttcaagctgagccgccacagcaagggcctgcagatcctgggccagaccctgaaggcctccatgagggagctgggcctgctgatcttcttcctgttcatcggggtcatcctcttcagcagcgctgtgtactttgctgaggtggatgagcctgagagccacttcagcagcatcccagatggcttctggtgggccgtggtgaccatgaccaccgtgggctacggggacatgtgccccaccacccctgggggcaagatcgtgggcaccctgtgtgccatcgccggcgtgctgaccatcgccctgcctgtgcctgtgattgtgagcaacttcaactacttctaccaccgggagacagaaaatgaggagaagcagaacatccctggagaaattgaaagaatcctgaacagcgtgggcagcaggatgggcagcacagacagcctgaacaagaccaatggaggctgcagcacagagaagagcaggaagtag

SEQ ID NO: 164972 - DNA, 1728 bp, Artificial Sequence
  Description of Artificial Sequence: Synthetic coding sequence
atggatgagcggctgagcctgctgcggagccccccacctccttctgcccggcaccgggcccaccccccccagaggcctgccagcagtggaggagcccacaccctggtgaaccacggctatgcagagcctgctgctggccgggagctgcccccagacatgacagtggtgcctggggaccacctgctggagcctgaggtggctgatggcggcggggccccaccccagggcggctgcggcggcggcggctgtgacagatatgagcccctgccccccagcctgcctgctgctggggagcaggactgctgcggggagcgggtggtgatcaacatcagcggcctgcgctttgagacccagctgaagaccctgtgccagtttcctgagaccctgctgggggaccccaagaggaggatgagatactttgaccccctgagaaatgagtacttctttgacaggaaccggcccagctttgatgccatcctgtactactaccagagcggcggccgcatccggcggcctgtgaatgtgcccatcgacatcttcagcgaggagatccgcttctaccagctgggggaggaggccatggagaagttcagagaagatgagggcttcctgcgggaggaggagcggcccctgccccggcgggacttccagaggcaggtgtggctgctgtttgagtacccagagagcagcggccctgcccggggcatcgccatcgtgtctgtgctggtgatcctgatcagcatcgtcatcttctgcctggagaccctgcctgagttcagagatgagaaggactacccagccagcaccagccaggacagctttgaggccgccggcaacagcaccagcggcagccgggccggggccagcagcttcagtgaccccttctttgtggtggagaccctgtgcatcatctggttctcctttgagctgctggtgcgcttctttgcctgccccagcaaggccaccttcagcaggaacatcatgaacctgattgatattgtggccatcatcccctacttcatcaccctgggcacagagctggccgagcggcagggcaatggccagcaggccatgagcctggccatcctgcgggtcatccggctggtgcgggtcttccgcatcttcaagctgagccgccacagcaagggcctgcagatcctgggccagaccctgaaggcctccatgagggagctgggcctgctgatcttcttcctgttcatcggggtcatcctcttcagcagcgctgtgtactttgctgaggctgatgaccccaccagcggcttcagcagcatcccagatgccttctggtgggccgtggtgaccatgaccaccgtgggctatggagacatgcaccctgtgaccatcggcggcaagatcgtgggcagcctgtgtgccatcgccggcgtgctgaccatcgccctgcctgtgcctgtgattgtgagcaacttcaactacttctaccaccgggagacagaaggagaggagcagagccagtacatgcacgtgggcagctgccagcacctgagcagcagcgctgaggagctgaggaaggcccggagcaacagcaccctgagcaagtctgagtacatggtgattgaggagggcggcatgaaccacagcgccttcccccagacccccttcaagacaggcaacagcacagccacctgcaccaccaacaacaaccccaacagctgtgtgaacatcaagaagatcttcacagatgtgtag

SEQ ID NO: 164973 - DNA, 1962 bp, Artificial Sequence
  Description of Artificial Sequence: Synthetic coding sequence
atggaggtggccatggtgtctgctgagagcagcggctgcaacagccacatgccctacggctacgccgcccaggcccgggcccgggagcgggagcggctggcccacagcagagctgctgctgctgctgctgtggccgccgccacagctgctgtggagggcagcggcggcagcggcggcggcagccaccaccaccaccagagcagaggagcctgcaccagccatgacccccagagcagccggggcagcagaagaagaagacggcagaggtctgagaagaagaaggcccactaccggcagagcagcttcccccactgcagcgacctgatgcccagcggcagcgaggagaagatcctgcgggagctgtctgaggaggaggaggatgaggaggaggaggaggaggaggaggaggagggccgcttctactacagtgaagatgaccatggagatgagtgcagctacacagacctgctgccccaggatgagggcggcggcggctacagctctgtgcgctacagcgactgctgtgagcgggtggtgatcaacgtgtctggcctgcgctttgagacccagatgaagaccctggcccagtttcctgagaccctgctgggggaccctgagaagaggacccagtactttgaccccctgagaaatgagtacttctttgacaggaaccggcccagctttgatgccatcctgtactactaccagagcggcggccgcctgaagaggcctgtgaatgtgccctttgacatcttcacagaggaggtgaagttctaccagctgggggaggaggccctgctgaagttcagagaagatgagggctttgtgcgggaggaggaggaccgggccctgcctgaaaatgagttcaagaagcagatctggctgctgtttgagtacccagagagcagcagccctgcccggggcatcgccatcgtgtctgtgctggtgatcctgatcagcatcgtcatcttctgcctggagaccctgcctgagttcagagatgaccgggacctggtgatggccctgtctgctgggggccatggaggcctgctgaatgacaccagcgccccccacctggagaacagcggccacaccatcttcaatgaccccttcttcatcgtggagaccgtgtgcatcgtgtggttctcctttgaatttgtggtgcgctgctttgcctgccccagccaggccctcttcttcaagaacatcatgaacatcattgatattgtgtccatcctgccctacttcatcaccctgggcacagacctggcccagcagcagggcggcggcaatggccagcagcagcaggccatgagctttgccatcctgcgcatcatccggctggtgcgggtcttccgcatcttcaagctgagccgccacagcaagggcctgcagatcctgggccacaccctgcgggcctccatgagggagctgggcctgctgatcttcttcctgttcatcggggtcatcctcttcagcagcgctgtgtactttgctgaggctgatgagcccaccacccacttccagagcatcccagatgccttctggtgggccgtggtgaccatgaccaccgtgggctatggagacatgaagcccatcaccgtgggcggcaagatcgtgggcagcctgtgtgccatcgccggcgtgctgaccatcgccctgcctgtgcctgtgattgtgagcaacttcaactacttctaccaccgggagacagaaaatgaggagcagacccagctgacccagaatgctgtgtcctgcccctacctgcccagcaacctgctgaagaagttccgcagcagcaccagcagcagcctgggggacaagtctgagtacctggagatggaggagggcgtgaaggagagcctgtgtgccaaggaggagaagtgccagggcaaaggagatgacagcgagacagacaagaacaactgcagcaatgccaaggctgtggagacagatgtgtag

SEQ ID NO: 164974 - DNA, 1842 bp, Artificial Sequence
  Description of Artificial Sequence: Synthetic coding sequence
atggagatcgccctggtgcccctggagaatggaggagccatgacagtgagaggaggagatgaggcccgggccggctgcggccaggccaccggcggggagctgcagtgccccccaacagctggcctgagtgatggccccaaggagcccgcccccaagggccgcggggcccagagagatgctgacagcggcgtgcggcccctgccccccctgcctgaccccggggtgcggcccctgccccccctgcctgaggagctgccccggcccaggaggcctcctccagaagatgaggaggaggagggggaccccggcctgggcaccgtggaggaccaggccctgggcacagccagcctgcaccaccagagggtgcacatcaacatcagcggcctgcgctttgagacccagctgggcaccctggcccagttccccaacaccctgctgggggaccctgccaagaggctgcgctactttgaccccctgagaaatgagtacttctttgacaggaaccggcccagctttgatggcatcctgtactactaccagagcggcggccgcctgcggcggcctgtgaatgtgtccctggatgtgtttgctgatgagatccgcttctaccagctgggagatgaggccatggagcgcttcagagaagatgagggcttcatcaaggaggaggagaagcccctgcccagaaatgagttccagaggcaggtgtggctgatctttgagtacccagagagcagcggcagcgcccgggccatcgccatcgtgtctgtgctggtgatcctgatcagcatcatcaccttctgcctggagaccctgcctgagttcagagatgagcgggagctgctgcggcaccccccagccccccaccagcccccagccccagcccctggggccaatggaagtggagtgatggccccacccagcggccccaccgtggcccccctgctgcccaggaccctggccgaccccttcttcatcgtggagaccacctgtgtgatctggttcacctttgagctgctggtgcgcttctttgcctgccccagcaaggccggcttcagcaggaacatcatgaacatcattgatgtggtggccatcttcccctacttcatcaccctgggcacagagctggccgagcagcagcccggcggcggcggcggcggccagaatggccagcaggccatgagcctggccatcctgcgggtcatccggctggtgcgggtcttccgcatcttcaagctgagccgccacagcaagggcctgcagatcctgggcaagaccctgcaggcctccatgagggagctgggcctgctgatcttcttcctgttcatcggggtcatcctcttcagcagcgctgtgtactttgctgaggccgacaaccagggcacccacttcagcagcatcccagatgccttctggtgggccgtggtgaccatgaccaccgtgggctatggagacatgaggcccatcaccgtgggcggcaagatcgtgggcagcctgtgtgccatcgccggcgtgctgaccatcgccctgcctgtgcctgtgattgtgagcaacttcaactacttctaccaccgggagacagaccacgaggagcctgctgtgctgaaggaggagcagggcacccagagccagggccctggcctggacagaggagtgcagaggaaggtgtctggcagccggggcagcttctgcaaggccggcggcaccctggagaatgctgacagcgcccggcggggcagctgccccctggagaagtgcaatgtgaaggccaagagcaatgtggacctgcggcgcagcctgtatgccctgtgcctggacaccagccgggagacagacctgtag

SEQ ID NO: 164975 - DNA, 1557 bp, Artificial Sequence
  Description of Artificial Sequence: Synthetic coding sequence
atggccgcctccatggcccggcggctgtggcccctgctgacccggcggggcttccggccccggggcggctgcatcagcaatgacagccccaggaggagcttcaccacagagaagaggaacagaaacctgctgtatgaatatgcccgggagggctacagcgccctgccccagctggacatcgagcgcttctgtgcctgcccagaggaggccgcccacgccctggagctgaggaagggggagctgcggtctgctgacctgcctgccatcatcagcacctggcaggagctgcggcagctgcaggagcagatccgcagcctggaggaggagaaggctgctgtgacagaggccgtgcgggccctgctggccaaccaggacagcggggaggtgcagcaggaccccaagtaccagggcctgcgggcccggggccgggagatcaggaaggagctggtgcacctgtacccccgggaggcccagctggaggagcagttctacctgcaggccctgaagctgcccaaccagacccacccagatgtgcctgtgggagatgagagccaggcccgggtgctgcacatggtgggggacaagcctgtgttctccttccagccccggggccacctggagatcggggagaagctggacatcatccggcagaagaggctgagccacgtgtctggccacaggagctactacctgcggggggccggggccctgctgcagcacggcctggtgaacttcaccttcaacaagctgctgcggcggggcttcacccccatgacagtgcctgacctgctgcggggagctgtgtttgagggctgcggcatgaccccaaatgccaaccccagccagatctacaacatcgaccctgcccgcttcaaggacctgaacctggccggcacagctgaggtgggcctggccggctacttcatggaccacacagtggccttccgggacctgcctgtgaggatggtgtgcagcagcacctgctacagagctgagaccaacacaggccaggagccccggggcctgtacagagtgcaccacttcaccaaggtggagatgtttggagtgactggacctggcctggagcagagcagccagctgctggaggagttcctgagcctgcagatggagatcctgacagagctgggcctgcacttccgggtgctggacatgcccacccaggagctgggcctgcctgcctacaggaagtttgacatcgaggcctggatgcctggccggggccgctttggagaggtgaccagcgccagcaactgcacagacttccagagccggcggctgcacatcatgttccagacagaagctggggagctgcagtttgcccacacagtgaatgccacagcctgtgctgtgccccggctgctgattgccctgctggagagcaaccagcagaaggatggctctgtgctggtgcccccagccctgcagagctacctgggcacagaccgcatcacagcccccacccacgtgcccctgcagtacatcggccccaaccagcccaggaagccaggcctgcccggccagcctgctgtgtcctag

SEQ ID NO: 164976 - DNA, 1893 bp, Artificial Sequence
  Description of Artificial Sequence: Synthetic coding sequence
atggctgctggggtggccgcctggctgccctttgcccgggctgctgccatcggctggatgcctgtggccagcggccccatgcctgccccaccccggcaggagaggaagaggacccaggatgccctgattgtgctgaatgtgtctggcacccgcttccagacctggcaggacaccctggagcgctacccagacaccctgctgggcagcagcgagcgggacttcttctaccaccctgagacccagcagtacttctttgaccgggaccctgacatcttccgccacatcctgaacttctacagaacaggcaagctgcactaccccaggcatgagtgcatcagcgcctatgatgaggagctggccttcttcggcctcatccctgagatcattggagactgctgctatgaggagtacaaggacagaagaagagaaaatgctgagcggctgcaggatgatgctgacacagacacagctggggagagcgccctgcccaccatgacagcccggcagagggtgtggagggcctttgagaacccccacaccagcaccatggccctggtgttctactacgtgacaggcttcttcatcgctgtgtctgtcatcgccaacgtggtggagaccgtgccctgtggcagcagccctggccacatcaaggagctgccctgtggggagagatatgctgtggccttcttctgcctggacacagcctgtgtgatgatcttcaccgtggagtacctgctgcggctggccgccgcccccagccgctacagatttgtgcgctctgtgatgagcatcattgatgtggtggccatcctgccctactacatcggcctggtgatgacagacaatgaagatgtgtctggggcctttgtgaccctgcgggtcttccgggtcttccgcatcttcaagttcagccgccacagccagggcctgcgcatcctgggctacaccctgaagagctgtgccagcgagctgggcttcctgctcttcagcctgaccatggccatcatcatctttgccaccgtgatgttttatgcagagaagggcagcagcgccagcaagttcaccagcatcccagctgccttctggtacaccatcgtgaccatgaccaccctgggctatggagacatggtgcccaagaccatcgccggcaagatcttcggcagcatctgcagcctgtctggagtgctggtgattgccctgcctgtgcctgtgattgtgagcaacttcagccgcatctaccaccagaaccagagagctgacaagaggcgggcccagaagaaggcccggctggcccgcatccgggccgccaagagcggcagcgccaatgcctacatgcagagcaagagaaatggcctgctgagcaaccagctgcagagcagtgaagatgagcaggcctttgtgtccaagagcggcagcagctttgagacccagcaccaccacctgctgcactgcctggagaagaccaccaaccatgaatttgtggatgagcaggtgtttgaggagagctgcatggaggtggccaccgtgaaccggcccagcagccacagccccagcctgagcagccagcagggcgtgaccagcacctgctgcagccgccgccacaagaagaccttccgcatccccaatgccaacgtgtctggcagccaccagggcagcatccaggagctgagcaccatccagatccgctgtgtggagaggacccccctgagcaacagccgcagcagcctgaatgccaagatggaggagtgtgtgaagctgaactgtgagcagccctacgtgaccacagccatcatcagcatccccaccccacctgtgaccaccccagaaggagatgacaggcctgagagccctgagtacagcggcggcaacatcgtgcgggtgtctgccctgtag

SEQ ID NO: 164977 - DNA, 1911 bp, Artificial Sequence
  Description of Artificial Sequence: Synthetic coding sequence
atggctgctggggtggccgcctggctgccctttgcccgggctgctgccatcggctggatgcctgtggccaactgccccatgcccctggccccagctgacaagaacaagaggcaggatgagctgattgtgctgaatgtgtctggaagacgcttccagacctggaggaccaccctggagcgctacccagacaccctgctgggcagcacagagaaggagttcttcttcaatgaagacaccaaggagtacttctttgaccgggaccctgaggtgttccgctgtgtgctgaacttctacagaacaggcaagctgcactaccccaggtatgagtgcatcagcgcctatgatgatgagctggccttctacggcatcctgcctgagatcatcggggactgctgctatgaggagtacaaggacaggaagcgggagaatgctgagcggctgatggatgacaatgattctgagaacaaccaggagagcatgcccagcctgtccttccggcagaccatgtggagggcctttgagaacccccacaccagcaccctggccctggtgttctactacgtgacaggcttcttcatcgctgtgtctgtcatcaccaacgtggtggagaccgtgccctgtggcaccgtgcccggcagcaaggagctgccctgtggggagcgctacagcgtggccttcttctgcctggacacagcctgtgtgatgatcttcaccgtggagtacctgctgcggctgtttgctgcccccagccgctaccgcttcatccgctctgtgatgagcatcattgatgtggtggccatcatgccctactacatcggcctggtgatgaccaacaatgaagatgtgtctggggcctttgtgaccctgcgggtcttccgggtcttccgcatcttcaagttcagccgccacagccagggcctgcgcatcctgggctacaccctgaagagctgtgccagcgagctgggcttcctgctcttcagcctgaccatggccatcatcatctttgccaccgtgatgttttatgcagagaagggcagcagcgccagcaagttcaccagcatcccagccagcttctggtacaccatcgtgaccatgaccaccctgggctacggggacatggtgcccaagaccatcgccggcaagatcttcggcagcatctgcagcctgagcggcgtgctggtgattgccctgcctgtgcctgtgattgtgagcaacttcagccgcatctaccaccagaaccagagagctgacaagagaagagcccagaagaaggcccggctggcccgcatccgggtggccaagacaggcagcagcaatgcctacctgcacagcaagagaaatggcctgctgaatgaggccctggagctgaccggcaccccagaggaggagcacatgggcaagaccaccagcctcatcgagagccagcaccaccacctgctgcactgcctggagaagaccaccaaccacgagttcattgatgagcagatgtttgagcagaactgcatggagagctccatgcagaactaccccagcaccaggagccccagcctgagcagccaccctggcctgaccaccacctgctgcagccgccgcagcaagaagaccacccacctgcccaacagcaacctgcctgccacccggctgcgctccatgcaggagctgagcaccatccacatccagggcagcgagcagcccagcctgaccaccagccgcagcagcctgaacctgaaggcagatgatggcctgcggcccaactgcaagaccagccagatcaccacagccatcatcagcatccccaccccaccagccctgaccccagagggggagagccggcccccaccagccagccctggccccaacaccaacatccccagcatcgccagcaatgtggtgaaggtgtctgccctgtag

SEQ ID NO: 164978 - DNA, 1968 bp, Artificial Sequence
  Description of Artificial Sequence: Synthetic coding sequence
atggctgctggggtggccgcctggctgccctttgcccgggctgctgccatcggctggatgcctgtggccaactgccccatgcccctggccccagctgacaagaacaagaggcaggatgagctgattgtgctgaatgtgtctggaagacgcttccagacctggaggaccaccctggagcgctacccagacaccctgctgggcagcacagagaaggagttcttcttcaatgaagacaccaaggagtacttctttgaccgggaccctgaggtgttccgctgtgtgctgaacttctacagaacaggcaagctgcactaccccaggtatgagtgcatcagcgcctatgatgatgagctggccttctacggcatcctgcctgagatcatcggggactgctgctatgaggagtacaaggacaggaagcgggagaatgctgagcggctgatggatgacaatgattctgagaacaaccaggagagcatgcccagcctgtccttccggcagaccatgtggagggcctttgagaacccccacaccagcaccctggccctggtgttctactacgtgacaggcttcttcatcgctgtgtctgtcatcaccaacgtggtggagaccgtgccctgtggcaccgtgcccggcagcaaggagctgccctgtggggagcgctacagcgtggccttcttctgcctggacacagcctgtgtgatgatcttcaccgtggagtacctgctgcggctgtttgctgcccccagccgctaccgcttcatccgctctgtgatgagcatcattgatgtggtggccatcatgccctactacatcggcctggtgatgaccaacaatgaagatgtgtctggggcctttgtgaccctgcgggtcttccgggtcttccgcatcttcaagttcagccgccacagccagggcctgcgcatcctgggctacaccctgaagagctgtgccagcgagctgggcttcctgctcttcagcctgaccatggccatcatcatctttgccaccgtgatgttttatgcagagaagggcagcagcgccagcaagttcaccagcatcccagccagcttctggtacaccatcgtgaccatgaccaccctgggctacggggacatggtgcccaagaccatcgccggcaagatcttcggcagcatctgcagcctgagcggcgtgctggtgattgccctgcctgtgcctgtgattgtgagcaacttcagccgcatctaccaccagaaccagagagctgacaagagaagagcccagaagaaggcccggctggcccgcatccgggtggccaagacaggcagcagcaatgcctacctgcacagcaagagaaatggcctgctgaatgaggccctggagctgaccggcaccccagaggaggagcacatgggcaagaccaccagcctcatcgagagccagcaccaccacctgctgcactgcctggagaagaccaccggcctgagctacctggtggatgaccccctgctgtctgtgaggaccagcaccatcaagaaccacgagttcattgatgagcagatgtttgagcagaactgcatggagagctccatgcagaactaccccagcaccaggagccccagcctgagcagccaccctggcctgaccaccacctgctgcagcagaagaagcaagaagaccacccacctgcccaacagcaacctgcctgccacccggctgcgctccatgcaggagctgagcaccatccacatccagggcagcgagcagcccagcctgaccaccagccgcagcagcctgaacctgaaggcagatgatggcctgcggcccaactgcaagaccagccagatcaccacagccatcatcagcatccccaccccaccagccctgaccccagagggggagagcaggcctcctccagccagccctggccccaacaccaacatccccagcatcgccagcaatgtggtgaaggtgtctgccctgtag

SEQ ID NO: 164979 - DNA, 1911 bp, Artificial Sequence; identical to SEQ ID NO: 164977
  Description of Artificial Sequence: Synthetic coding sequence

SEQ ID NO: 164980 - DNA, 1758 bp, Artificial Sequence
  Description of Artificial Sequence: Synthetic coding sequence
atgggccagggagatgaaagtgagcgcatcgtcatcaacgtgggcggcaccaggcaccagacctaccgcagcaccctgcggaccctgcccggcacccggctggcctggctggccgagccagatgcccacagccactttgattatgaccccagggcagatgagttcttctttgacagacaccctggggtgtttgcccacatcctgaactactacagaacaggcaagctgcactgcccagcagatgtgtgtggccccctgtatgaggaggagctggccttctggggcattgatgaaacagatgtggagccctgctgctggatgacctaccggcagcacagagatgctgaggaggccctggacagctttggaggagcccccctggacaacagcgcagatgatgctgatgctgatggccctggggacagcggagatggagaagatgagctggagatgaccaagaggctggccctgagtgacagcccagatggccggcctgggggcttctggaggcgctggcagccccgcatctgggccctgtttgaggacccctacagcagccgctatgcccgctacgtggcctttgccagcctcttcttcatcctggtgtccatcaccaccttctgcctggagacccatgagcgcttcaaccccatcgtgaacaagacagaaattgaaaatgtgagaaatggcacccaggtgcgctactaccgggaggccgagacagaggccttcctgacctacatcgagggcgtgtgtgtggtgtggttcacctttgagttcctgatgagggtcatcttctgccccaacaaggtggagttcatcaagaacagcctgaacatcatcgactttgtggccatcctgcccttctacctggaggtgggcctgagcggcctgagcagcaaggccgccaaggatgtgctgggcttcctgcgggtggtgcgctttgtgcgcatcctgcgcatcttcaagctgaccaggcactttgtgggcctgcgggtgctgggccacaccctgcgggccagcaccaatgagttcctgctgctgatcatcttcctggccctgggcgtgctgatctttgccaccatgatctactatgcagagagaattggagcccagcccaatgaccccagcgccagcgagcacacccacttcaagaacatccccatcggcttctggtgggccgtggtgaccatgaccaccctgggctatggagacatgtacccccagacctggagcggcatgctggtgggcgccctgtgtgccctggccggcgtgctgaccatcgccatgcctgtgcctgtgattgtgaacaactttggcatgtactacagcctggccatggccaagcagaagctgcccaagaagaagaagaagcacatccccaggcctccccagctgggcagccccaactactgcaagtctgtggtgaacagcccccaccacagcacccagagcgacacctgccccctggcccaggaggagatcctggagatcaacagagctgacagcaagctgaatggagaggtggccaaggccgccctggccaatgaagactgcccccacatcgaccaggccctgaccccagatgagggcctgcccttcaccaggagcggcacccgggagagatatggcccctgcttcctgctgagcactggagaatatgcctgccccccaggcggcggcatgaggaaggacctgtgcaaggagagccctgtgattgccaagtacatgcccacagaagctgtgcgggtgacctag

SEQ ID NO: 164981 - DNA, 1536 bp, Artificial Sequence
  Description of Artificial Sequence: Synthetic coding sequence
atgggccagggagatgaaagtgagcgcatcgtcatcaacgtgggcggcaccaggcaccagacctaccgcagcaccctgcggaccctgcccggcacccggctggcctggctggccgagccagatgcccacagccactttgattatgaccccagggcagatgagttcttctttgacagacaccctggggtgtttgcccacatcctgaactactacagaacaggcaagctgcactgcccagcagatgtgtgtggccccctgtatgaggaggagctggccttctggggcattgatgaaacagatgtggagccctgctgctggatgacctaccggcagcacagagatgctgaggaggccctggacagctttggaggagcccccctggacaacagcgcagatgatgctgatgctgatggccctggggacagcggagatggagaagatgagctggagatgaccaagaggctggccctgagtgacagcccagatggccggcctgggggcttctggaggcgctggcagccccgcatctgggccctgtttgaggacccctacagcagccgctatgcccgctacgtggcctttgccagcctcttcttcatcctggtgtccatcaccaccttctgcctggagacccatgagcgcttcaaccccatcgtgaacaagacagaaattgaaaatgtgagaaatggcacccaggtgcgctactaccgggaggccgagacagaggccttcctgacctacatcgagggcgtgtgtgtggtgtggttcacctttgagttcctgatgagggtcatcttctgccccaacaaggtggagttcatcaagaacagcctgaacatcatcgactttgtggccatcctgcccttctacctggaggtgggcctgagcggcctgagcagcaaggccgccaaggatgtgctgggcttcctgcgggtggtgcgctttgtgcgcatcctgcgcatcttcaagctgaccaggcactttgtgggcctgcgggtgctgggccacaccctgcgggccagcaccaatgagttcctgctgctgatcatcttcctggccctgggcgtgctgatctttgccaccatgatctactatgcagagagaattggagcccagcccaatgaccccagcgccagcgagcacacccacttcaagaacatccccatcggcttctggtgggccgtggtgaccatgaccaccctgggctatggagacatgtacccccagacctggagcggcatgctggtgggcgccctgtgtgccctggccggcgtgctgaccatcgccatgcctgtgcctgtgattgtgaacaactttggcatgtactacagcctggccatggccaagcagaagctgcccaagaagaagaagaagcacatccccaggcctccccagctgggcagccccaactactgcaagtctgtggtgaacagcccccaccacagcacccagagcgacacctgccccctggcccaggaggagatcctggagatcaacagagctggcaggaagcccctgcggggcatgagcatctag

SEQ ID NO: 164982 - DNA, 1842 bp, Artificial Sequence
  Description of Artificial Sequence: Synthetic coding sequence
atgggcaagattgaaaataatgaaagagtcatcctgaatgtgggcggcaccaggcatgagacctaccgcagcaccctgaagaccctgcccggcacccggctggccctgctggccagcagcgagcccccaggggactgcctgaccacagctggggacaagctgcagcccagccccccacccctgagccccccaccccgggccccacccctgagccctggccctgggggctgctttgagggcggggccggcaactgcagcagcagaggaggccgggccagtgaccaccctgggggcggccgggagttcttctttgacagacaccctggggtgtttgcctacgtgctgaactactacagaacaggcaagctgcactgcccagcagatgtgtgtggccccctgtttgaggaggagctggccttctggggcattgatgaaacagatgtggagccctgctgctggatgacctaccggcagcacagagatgctgaggaggccctggacatctttgagaccccagacctgattggaggagaccctggagatgatgaggacctggccgccaagaggctgggcattgaagatgctgctggcctgggcggcccagatggcaagagcggccgctggaggcggctgcagcccaggatgtgggccctgtttgaggacccctacagcagcagagctgcccgcttcatcgcctttgccagcctcttcttcatcctggtgtccatcaccaccttctgcctggagacccatgaggccttcaacatcgtgaagaacaagacagagcctgtgatcaatggcacctctgtggtgctgcagtatgaaattgaaacagatcctgccctgacctacgtggagggcgtgtgtgtggtgtggttcacctttgagttcctggtgagaattgtgttcagccccaacaagctggagttcatcaagaacctgctgaacatcatcgactttgtggccatcctgcccttctacctggaggtgggcctgagcggcctgagcagcaaggccgccaaggatgtgctgggcttcctgcgggtggtgcgctttgtgcgcatcctgcgcatcttcaagctgaccaggcactttgtgggcctgcgggtgctgggccacaccctgcgggccagcaccaatgagttcctgctgctgatcatcttcctggccctgggcgtgctgatctttgccaccatgatctactatgcagagcgggtgggcgcccagcccaatgaccccagcgccagcgagcacacccagttcaagaacatccccatcggcttctggtgggccgtggtgaccatgaccaccctgggctacggggacatgtacccccagacctggagcggcatgctggtgggcgccctgtgtgccctggccggcgtgctgaccatcgccatgcctgtgcctgtgattgtgaacaactttggcatgtactacagcctggccatggccaagcagaagctgcccaggaagaggaagaagcacatccccccagccccccaggccagcagccccaccttctgcaagacagagctgaacatggcctgcaacagcacccagagcgacacctgcctgggcaaggacaaccggctgctggagcacaacagatctgtgctgtctggagatgacagcacaggcagcgagccccccctgagccccccagagcggctgcccatcagaagaagcagcacccgggacaagaacagaagaggagagacctgcttcctgctgaccaccggggactacacctgtgccagtgatggcggcatcaggaaggacaactgcaaggaggtggtgatcaccggctacacccaggccgaggcccggagcctgacctag

SEQ ID NO: 164983 - DNA, 1890 bp, Artificial Sequence
  Description of Artificial Sequence: Synthetic coding sequence
atgggcaagattgaaaataatgaaagagtcatcctgaatgtgggcggcaccaggcatgagacctaccgcagcaccctgaagaccctgcccggcacccggctggccctgctggccagcagcgagcccccaggggactgcctgaccacagctggggacaagctgcagcccagccccccacccctgagccccccaccccgggccccacccctgagccctggccctgggggctgctttgagggcggggccggcaactgcagcagcagaggaggccgggccagtgaccaccctgggggcggccgggagttcttctttgacagacaccctggggtgtttgcctacgtgctgaactactacagaacaggcaagctgcactgcccagcagatgtgtgtggccccctgtttgaggaggagctggccttctggggcattgatgaaacagatgtggagccctgctgctggatgacctaccggcagcacagagatgctgaggaggccctggacatctttgagaccccagacctgattggaggagaccctggagatgatgaggacctggccgccaagaggctgggcattgaagatgctgctggcctgggcggcccagatggcaagagcggccgctggaggcggctgcagcccaggatgtgggccctgtttgaggacccctacagcagcagagctgcccgcttcatcgcctttgccagcctcttcttcatcctggtgtccatcaccaccttctgcctggagacccatgaggccttcaacatcgtgaagaacaagacagagcctgtgatcaatggcacctctgtggtgctgcagtatgaaattgaaacagatcctgccctgacctacgtggagggcgtgtgtgtggtgtggttcacctttgagttcctggtgagaattgtgttcagccccaacaagctggagttcatcaagaacctgctgaacatcatcgactttgtggccatcctgcccttctacctggaggtgggcctgagcggcctgagcagcaaggccgccaaggatgtgctgggcttcctgcgggtggtgcgctttgtgcgcatcctgcgcatcttcaagctgaccaggcactttgtgggcctgcgggtgctgggccacaccctgcgggccagcaccaatgagttcctgctgctgatcatcttcctggccctgggcgtgctgatctttgccaccatgatctactatgcagagcgggtgggcgcccagcccaatgaccccagcgccagcgagcacacccagttcaagaacatccccatcggcttctggtgggccgtggtgaccatgaccaccctgggctacggggacatgtacccccagacctggagcggcatgctggtgggcgccctgtgtgccctggccggcgtgctgaccatcgccatgcctgtgcctgtgattgtgaacaactttggcatgtactacagcctggccatggccaagcagaagctgcccaggaagaggaagaagcacatccccccagccccccaggccagcagccccaccttctgcaagacagagctgaacatggcctgcaacagcacccagagcgacacctgcctgggcaaggacaaccggctgctggagcacaacagatctgtgctgtctggagatgacagcacaggcagcgagccccccctgagccccccagagcggctgcccatcagaagaagcagcacccgggacaagaacagaagaggagagacctgcttcctgctgaccaccggggactacacctgtgccagtgatggcggcatcaggaaggtgctgtaccgcatctaccacggcctgctgacagctgagaagggcaccgtggagttcagccacaccaaggactacacaggcaaccggctgctgctgctgaatgtgccctag

SEQ ID NO: 164984 - DNA, 1677 bp, Artificial Sequence
  Description of Artificial Sequence: Synthetic coding sequence
atgggcaagattgaaaataatgaaagagtcatcctgaatgtgggcggcaccaggcatgagacctaccgcagcaccctgaagaccctgcccggcacccggctggccctgctggccagcagcgagcccccaggggactgcctgaccacagctggggacaagctgcagcccagccccccacccctgagccccccaccccgggccccacccctgagccctggccctgggggctgctttgagggcggggccggcaactgcagcagcagaggaggccgggccagtgaccaccctgggggcggccgggagttcttctttgacagacaccctggggtgtttgcctacgtgctgaactactacagaacaggcaagctgcactgcccagcagatgtgtgtggccccctgtttgaggaggagctggccttctggggcattgatgaaacagatgtggagccctgctgctggatgacctaccggcagcacagagatgctgaggaggccctggacatctttgagaccccagacctgattggaggagaccctggagatgatgaggacctggccgccaagaggctgggcattgaagatgctgctggcctgggcggcccagatggcaagagcggccgctggaggcggctgcagcccaggatgtgggccctgtttgaggacccctacagcagcagagctgcccgcttcatcgcctttgccagcctcttcttcatcctggtgtccatcaccaccttctgcctggagacccatgaggccttcaacatcgtgaagaacaagacagagcctgtgatcaatggcacctctgtggtgctgcagtatgaaattgaaacagatcctgccctgacctacgtggagggcgtgtgtgtggtgtggttcacctttgagttcctggtgagaattgtgttcagccccaacaagctggagttcatcaagaacctgctgaacatcatcgactttgtggccatcctgcccttctacctggaggtgggcctgagcggcctgagcagcaaggccgccaaggatgtgctgggcttcctgcgggtggtgcgctttgtgcgcatcctgcgcatcttcaagctgaccaggcactttgtgggcctgcgggtgctgggccacaccctgcgggccagcaccaatgagttcctgctgctgatcatcttcctggccctgggcgtgctgatctttgccaccatgatctactatgcagagcgggtgggcgcccagcccaatgaccccagcgccagcgagcacacccagttcaagaacatccccatcggcttctggtgggccgtggtgaccatgaccaccctgggctacggggacatgtacccccagacctggagcggcatgctggtgggcgccctgtgtgccctggccggcgtgctgaccatcgccatgcctgtgcctgtgattgtgaacaactttggcatgtactacagcctggccatggccaagcagaagctgcccaggaagaggaagaagcacatccccccagccccccaggccagcagccccaccttctgcaagacagagctgaacatggcctgcaacagcacccagagcgacacctgcctgggcaaggacaaccggctgctggagcacaacagaagtgacaactgcaaggaggtggtgatcaccggctacacccaggccgaggcccggagcctgacctag

SEQ ID NO: 164985 - DNA, 1842 bp, Artificial Sequence; identical to SEQ ID NO: 164982
  Description of Artificial Sequence: Synthetic coding sequence

SEQ ID NO: 164986 - DNA, 1917 bp, Artificial Sequence
  Description of Artificial Sequence: Synthetic coding sequence
atgggcaagattgaaaataatgaaagagtcatcctgaatgtgggcggcaccaggcatgagacctaccgcagcaccctgaagaccctgcccggcacccggctggccctgctggccagcagcgagcccccaggggactgcctgaccacagctggggacaagctgcagcccagccccccacccctgagccccccaccccgggccccacccctgagccctggccctgggggctgctttgagggcggggccggcaactgcagcagcagaggaggccgggccagtgaccaccctgggggcggccgggagttcttctttgacagacaccctggggtgtttgcctacgtgctgaactactacagaacaggcaagctgcactgcccagcagatgtgtgtggccccctgtttgaggaggagctggccttctggggcattgatgaaacagatgtggagccctgctgctggatgacctaccggcagcacagagatgctgaggaggccctggacatctttgagaccccagacctgattggaggagaccctggagatgatgaggacctggccgccaagaggctgggcattgaagatgctgctggcctgggcggcccagatggcaagagcggccgctggaggcggctgcagcccaggatgtgggccctgtttgaggacccctacagcagcagagctgcccgcttcatcgcctttgccagcctcttcttcatcctggtgtccatcaccaccttctgcctggagacccatgaggccttcaacatcgtgaagaacaagacagagcctgtgatcaatggcacctctgtggtgctgcagtatgaaattgaaacagatcctgccctgacctacgtggagggcgtgtgtgtggtgtggttcacctttgagttcctggtgagaattgtgttcagccccaacaagctggagttcatcaagaacctgctgaacatcatcgactttgtggccatcctgcccttctacctggaggtgggcctgagcggcctgagcagcaaggccgccaaggatgtgctgggcttcctgcgggtggtgcgctttgtgcgcatcctgcgcatcttcaagctgaccaggcactttgtgggcctgcgggtgctgggccacaccctgcgggccagcaccaatgagttcctgctgctgatcatcttcctggccctgggcgtgctgatctttgccaccatgatctactatgcagagcgggtgggcgcccagcccaatgaccccagcgccagcgagcacacccagttcaagaacatccccatcggcttctggtgggccgtggtgaccatgaccaccctgggctacggggacatgtacccccagacctggagcggcatgctggtgggcgccctgtgtgccctggccggcgtgctgaccatcgccatgcctgtgcctgtgattgtgaacaactttggcatgtactacagcctggccatggccaagcagaagctgcccaggaagaggaagaagcacatccccccagccccccaggccagcagccccaccttctgcaagacagagctgaacatggcctgcaacagcacccagagcgacacctgcctgggcaaggacaaccggctgctggagcacaacagatctgtgctgtctggagatgacagcacaggcagcgagccccccctgagccccccagagcggctgcccatcagaagaagcagcacccgggacaagaacagaagaggagagacctgcttcctgctgaccaccggggactacacctgtgccagtgatggcggcatcaggaagggctatgagaagagccgcagcctgaacaacattgctggcctggccggaaatgccctgcggctgagccctgtgaccagcccctacaacagcccctgccccctgcggcgcagccgcagccccatccccagcatcctgtag

SEQ ID NO: 164987 - DNA, 1890 bp, Artificial Sequence; identical to SEQ ID NO: 164983
  Description of Artificial Sequence: Synthetic coding sequence

SEQ ID NO: 164988 - DNA, 2187 bp, Artificial Sequence
  Description of Artificial Sequence: Synthetic coding sequence
atgctgagctctgtgtgtgtgtcctccttccggggccggcagggcgccagcaagcagcagcctgcccccccaccccagcccccagagagccccccacctccacccctgcccccccagcagcagcagcctgcccagcccggccctgctgccagccctgctggccccccagccccccggggccctggggaccggcgggcagagccctgccccggcctgcctgctgctgccatgggccgccacggcggcggcggcggggacagcggcaagatcgtcatcaacgtgggcggcgtgagacatgagacctaccgcagcaccctgcggaccctgcccggcacccggctggccggcctgacagagcctgaggccgccgccaggtttgattatgaccccggggctgatgagttcttctttgacagacaccctggggtgtttgcctacgtgctgaactactacagaacaggcaagctgcactgcccagcagatgtgtgtggccccctgtttgaggaggagctgggcttctggggcattgatgaaacagatgtggaggcctgctgctggatgacctaccggcagcacagagatgctgaggaggccctggacagctttgaggccccagaccctgctggggccgccaatgctgccaatgctgctggggcccatgatggcggcctggatgatgaggccggggccggcggcggcggcctggatggagctggaggagagctgaagaggctgtgcttccaggatgctgggggcggggccggcggccccccaggaggagctggaggagctgggggcacctggtggaggcgctggcagccccgggtgtgggccctgtttgaggacccctacagcagccgggccgcccgctacgtggcctttgccagcctcttcttcatcctgatcagcatcaccaccttctgcctggagacccatgagggcttcatccacatcagcaacaagacagtgacccaggccagccccatccctggggcccccccagagaacatcaccaacgtggaggtggagacagagcccttcctgacctacgtggagggcgtgtgtgtggtgtggttcacctttgagttcctgatgaggatcaccttctgcccagacaaggtggagttcctgaagagcagcctgaacatcatcgactgtgtggccatcctgcccttctacctggaggtgggcctgagcggcctgagcagcaaggccgccaaggatgtgctgggcttcctgcgggtggtgcgctttgtgcgcatcctgcgcatcttcaagctgaccaggcactttgtgggcctgcgggtgctgggccacaccctgcgggccagcaccaatgagttcctgctgctgatcatcttcctggccctgggcgtgctgatctttgccaccatgatctactatgcagagcgcatcggggctgaccctgatgacatcctgggcagcaaccacacctacttcaagaacatccccatcggcttctggtgggccgtggtgaccatgaccaccctgggctacggggacatgtaccccaagacctggagcggcatgctggtgggcgccctgtgtgccctggccggcgtgctgaccatcgccatgcctgtgcctgtgattgtgaacaactttggcatgtactacagcctggccatggccaagcagaagctgcccaagaagaagaacaagcacatcccccggcccccccagcccggcagccccaactactgcaagccagaccccccacctcctcctccaccccacccccaccacggcagcggcggcatcagccccccaccacccatcaccccacccagcatgggcgtgacagtggccggggcctacccagctggcccccacacccaccctggcctgctgcggggcggggccggcggcctgggcatcatgggcctgccccccctgcctgcccctggagagccctgccccctggcccaggaggaggtgattgagatcaacagagctgacccccggcccaacggggaccctgctgctgctgccctggcccacgaggactgcccagccatcgaccagcctgccatgagccctgaggacaagagccccatcaccccaggcagccggggccgctacagccgggaccgggcctgcttcctgctgacagattatgcccccagcccagatggcagcatcaggaaggccctggtgacagcctag

SEQ ID NO: 164989 - DNA, 468 bp, Artificial Sequence
  Description of Artificial Sequence: Synthetic coding sequence
atgggcatccggcagcagctgcggctgcccaccaggacagcccagcccctgaccagcctgccctgccccaggaagacccgggcccccagccggctggaggccgtggccgccatcgccggcacagagcccgccagcagcagccccaccatgcccctgcccctgatggcccccagcgagaagctgctgagccccccagagaccagccgggacttccgcagccccccacccctgcccccccggctgcgggagatcccccagccccagcagcaccggggccctgagcggggcgtgcctgccccccgggccccctgccaccccccctggctgagccctggccggccccccaggagcccagaccctgccctgcaccccctggccctgcccagccccctgtggggagacagcggcgtgacaggcaagaaggtgaagggagctgggggcggcggctggggcaagggcttcttctag

SEQ ID NO: 164990 - DNA, 1629 bp, Artificial Sequence
  Description of Artificial Sequence: Synthetic coding sequence
atgacctaccggcagcacagagatgctgaggaggccctggacagctttgaggccccagaccctgctggggccgccaatgctgccaatgctgctggggcccatgatggcggcctggatgatgaggccggggccggcggcggcggcctggatggagctggaggagagctgaagaggctgtgcttccaggatgctgggggcggggccggcggccccccaggaggagctggaggagctgggggcacctggtggaggcgctggcagccccgggtgtgggccctgtttgaggacccctacagcagccgggccgcccgctacgtggcctttgccagcctcttcttcatcctgatcagcatcaccaccttctgcctggagacccatgagggcttcatccacatcagcaacaagacagtgacccaggccagccccatccctggggcccccccagagaacatcaccaacgtggaggtggagacagagcccttcctgacctacgtggagggcgtgtgtgtggtgtggttcacctttgagttcctgatgaggatcaccttctgcccagacaaggtggagttcctgaagagcagcctgaacatcatcgactgtgtggccatcctgcccttctacctggaggtgggcctgagcggcctgagcagcaaggccgccaaggatgtgctgggcttcctgcgggtggtgcgctttgtgcgcatcctgcgcatcttcaagctgaccaggcactttgtgggcctgcgggtgctgggccacaccctgcgggccagcaccaatgagttcctgctgctgatcatcttcctggccctgggcgtgctgatctttgccaccatgatctactatgcagagcgcatcggggctgaccctgatgacatcctgggcagcaaccacacctacttcaagaacatccccatcggcttctggtgggccgtggtgaccatgaccaccctgggctacggggacatgtaccccaagacctggagcggcatgctggtgggcgccctgtgtgccctggccggcgtgctgaccatcgccatgcctgtgcctgtgattgtgaacaactttggcatgtactacagcctggccatggccaagcagaagctgcccaagaagaagaacaagcacatcccccggcccccccagcccggcagccccaactactgcaagccagaccccccacctcctcctccaccccacccccaccacggcagcggcggcatcagccccccaccacccatcaccccacccagcatgggcgtgacagtggccggggcctacccagctggcccccacacccaccctggcctgctgcggggcggggccggcggcctgggcatcatgggcctgccccccctgcctgcccctggagagccctgccccctggcccaggaggaggtgattgagatcaacagagctgacccccggcccaacggggaccctgctgctgctgccctggcccacgaggactgcccagccatcgaccagcctgccatgagccctgaggacaagagccccatcaccccaggcagccggggccgctacagccgggaccgggcctgcttcctgctgacagattatgcccccagcccagatggcagcatcaggaaggccctggtgacagcctag

SEQ ID NO: 164991 - DNA, 2274 bp, Artificial Sequence
  Description of Artificial Sequence: Synthetic coding sequence
atgctgagctctgtgtgtgtgtcctccttccggggccggcagggcgccagcaagcagcagcctgcccccccaccccagcccccagagagccccccacctccacccctgcccccccagcagcagcagcctgcccagcccggccctgctgccagccctgctggccccccagccccccggggccctggggaccggcgggcagagccctgccccggcctgcctgctgctgccatgggccgccacggcggcggcggcggggacagcggcaagatcgtcatcaacgtgggcggcgtgagacatgagacctaccgcagcaccctgcggaccctgcccggcacccggctggccggcctgacagagcctgaggccgccgccaggtttgattatgaccccggggctgatgagttcttctttgacagacaccctggggtgtttgcctacgtgctgaactactacagaacaggcaagctgcactgcccagcagatgtgtgtggccccctgtttgaggaggagctgggcttctggggcattgatgaaacagatgtggaggcctgctgctggatgacctaccggcagcacagagatgctgaggaggccctggacagctttgaggccccagaccctgctggggccgccaatgctgccaatgctgctggggcccatgatggcggcctggatgatgaggccggggccggcggcggcggcctggatggagctggaggagagctgaagaggctgtgcttccaggatgctgggggcggggccggcggccccccaggaggagctggaggagctgggggcacctggtggaggcgctggcagccccgggtgtgggccctgtttgaggacccctacagcagccgggccgcccgctacgtggcctttgccagcctcttcttcatcctgatcagcatcaccaccttctgcctggagacccatgagggcttcatccacatcagcaacaagacagtgacccaggccagccccatccctggggcccccccagagaacatcaccaacgtggaggtggagacagagcccttcctgacctacgtggagggcgtgtgtgtggtgtggttcacctttgagttcctgatgaggatcaccttctgcccagacaaggtggagttcctgaagagcagcctgaacatcatcgactgtgtggccatcctgcccttctacctggaggtgggcctgagcggcctgagcagcaaggccgccaaggatgtgctgggcttcctgcgggtggtgcgctttgtgcgcatcctgcgcatcttcaagctgaccaggcactttgtgggcctgcgggtgctgggccacaccctgcgggccagcaccaatgagttcctgctgctgatcatcttcctggccctgggcgtgctgatctttgccaccatgatctactatgcagagcgcatcggggctgaccctgatgacatcctgggcagcaaccacacctacttcaagaacatccccatcggcttctggtgggccgtggtgaccatgaccaccctgggctacggggacatgtaccccaagacctggagcggcatgctggtgggcgccctgtgtgccctggccggcgtgctgaccatcgccatgcctgtgcctgtgattgtgaacaactttggcatgtactacagcctggccatggccaagcagaagctgcccaagaagaagaacaagcacatcccccggcccccccagcccggcagccccaactactgcaagccagaccccccacctcctcctccaccccacccccaccacggcagcggcggcatcagccccccaccacccatcaccccacccagcatgggcgtgacagtggccggggcctacccagctggcccccacacccaccctggcctgctgcggggcggggccggcggcctgggcatcatgggcctgccccccctgcctgcccctggagagccctgccccctggcccaggaggaggtgattgagatcaacagagctgacccccggcccaacggggaccctgctgctgctgccctggcccacgaggactgcccagccatcgaccagcctgccatgagccctgaggacaagagccccatcaccccaggcagccggggccgctacagccgggaccgggcctgcttcctgctgacagattatgcccccagcccagatggcagcatcaggaaggccactggagccccacccctgcccccccaggactggaggaagccaggcccccccagcttcctgcctgacctgaatgccaatgctgctgcctggatcagcccctag

SEQ ID NO: 164992 - DNA, 1908 bp, Artificial Sequence
  Description of Artificial Sequence: Synthetic coding sequence
atgatcagctctgtgtgtgtgtcctcctaccggggcaggaagagcggcaacaagccacccagcaagacctgcctgaaggaggagatggccaagggggaggccagcgagaagatcatcatcaacgtgggcggcaccaggcatgagacctaccgcagcaccctgcggaccctgcccggcacccggctggcctggctggccgaccctgatggcggcggccggcctgagacagatggcggcggcgtgggcagcagcggcagcagcggcggcggcggctgtgagttcttctttgacagacaccctggggtgtttgcctacgtgctgaactactacagaacaggcaagctgcactgcccagcagatgtgtgtggccccctgtttgaggaggagctgaccttctggggcattgatgaaacagatgtggagccctgctgctggatgacctaccggcagcacagagatgctgaggaggccctggacatctttgagagcccagatggcggcggcagcggggccggccccagtgatgaagctggagatgatgagcgggagctggccctgcagaggctgggcccccatgagggcggggccggccacggggccggcagcggcggctgccggggctggcagcccaggatgtgggccctgtttgaggacccctacagcagccgggccgcccgggtggtggcctttgccagcctcttcttcatcctggtgtccatcaccaccttctgcctggagacccatgaggccttcaacatcgacagaaatgtgacagagatcctgcgggtgggcaacatcacctctgtgcacttccggcgggaggtggagacagagcccatcctgacctacatcgagggcgtgtgtgtgctgtggttcaccctggagttcctggtgcgcatcgtgtgctgcccagacaccctggactttgtgaagaacctgctgaacatcatcgactttgtggccatcctgcccttctacctggaggtgggcctgagcggcctgagcagcaaggccgccagagatgtgctgggcttcctgcgggtggtgcgctttgtgcgcatcctgcgcatcttcaagctgaccaggcactttgtgggcctgcgggtgctgggccacaccctgcgggccagcaccaatgagttcctgctgctgatcatcttcctggccctgggcgtgctgatctttgccaccatgatctactatgcagagagaattggagcccggcccagcgaccccagaggaaatgaccacacagacttcaagaacatccccatcggcttctggtgggccgtggtgaccatgaccaccctgggctatggagacatgtaccccaagacctggagcggcatgctggtgggcgccctgtgtgccctggccggcgtgctgaccatcgccatgcctgtgcctgtgattgtgaacaactttggcatgtactacagcctggccatggccaagcagaagctgcccaagaagaggaagaagcacgtgcccaggcctgcccagctggagagccccatgtactgcaagtctgaggagaccagcccccgggacagcacctgcagcgacaccagccccccagcccgggaggagggcatgattgaaaggaagagagctgacagcaagcagaatggagatgccaatgctgtgctgagtgatgaggagggcgccggcctgacccagcccctggccagcagccccaccccagaggagcggcgggccctgcggcgcagcaccacccgggacaggaacaagaaggctgctgcctgcttcctgctgagcactggagactatgcctgtgctgatggctctgtgaggaagggcacctttgtgctgcgggacctgcccctgcagcacagccctgaggccgcctgccccccaacagctggcaccctcttcctgccccactag

SEQ ID NO: 164993 - DNA, 1881 bp, Artificial Sequence
  Description of Artificial Sequence: Synthetic coding sequence
atgatcagctctgtgtgtgtgtcctcctaccggggcaggaagagcggcaacaagccacccagcaagacctgcctgaaggaggagatggccaagggggaggccagcgagaagatcatcatcaacgtgggcggcaccaggcatgagacctaccgcagcaccctgcggaccctgcccggcacccggctggcctggctggccgaccctgatggcggcggccggcctgagacagatggcggcggcgtgggcagcagcggcagcagcggcggcggcggctgtgagttcttctttgacagacaccctggggtgtttgcctacgtgctgaactactacagaacaggcaagctgcactgcccagcagatgtgtgtggccccctgtttgaggaggagctgaccttctggggcattgatgaaacagatgtggagccctgctgctggatgacctaccggcagcacagagatgctgaggaggccctggacatctttgagagcccagatggcggcggcagcggggccggccccagtgatgaagctggagatgatgagcgggagctggccctgcagaggctgggcccccatgagggcggggccggccacggggccggcagcggcggctgccggggctggcagcccaggatgtgggccctgtttgaggacccctacagcagccgggccgcccgggtggtggcctttgccagcctcttcttcatcctggtgtccatcaccaccttctgcctggagacccatgaggccttcaacatcgacagaaatgtgacagagatcctgcgggtgggcaacatcacctctgtgcacttccggcgggaggtggagacagagcccatcctgacctacatcgagggcgtgtgtgtgctgtggttcaccctggagttcctggtgcgcatcgtgtgctgcccagacaccctggactttgtgaagaacctgctgaacatcatcgactttgtggccatcctgcccttctacctggaggtgggcctgagcggcctgagcagcaaggccgccagagatgtgctgggcttcctgcgggtggtgcgctttgtgcgcatcctgcgcatcttcaagctgaccaggcactttgtgggcctgcgggtgctgggccacaccctgcgggccagcaccaatgagttcctgctgctgatcatcttcctggccctgggcgtgctgatctttgccaccatgatctactatgcagagagaattggagcccggcccagcgaccccagaggaaatgaccacacagacttcaagaacatccccatcggcttctggtgggccgtggtgaccatgaccaccctgggctatggagacatgtaccccaagacctggagcggcatgctggtgggcgccctgtgtgccctggccggcgtgctgaccatcgccatgcctgtgcctgtgattgtgaacaactttggcatgtactacagcctggccatggccaagcagaagctgcccaagaagaggaagaagcacgtgcccaggcctgcccagctggagagccccatgtactgcaagtctgaggagaccagcccccgggacagcacctgcagcgacaccagccccccagcccgggaggagggcatgattgaaaggaagagagctgacagcaagcagaatggagatgccaatgctgtgctgagtgatgaggagggcgccggcctgacccagcccctggccagcagccccaccccagaggagcggcgggccctgcggcgcagcaccacccgggacaggaacaagaaggctgctgcctgcttcctgctgagcactggagactatgcctgtgctgatggctctgtgaggaaggagacctgccaggatgccctgagcagcaactatgcccaggccgaggtgctgaccctgtcctag

SEQ ID NO: 164994 - DNA, 1908 bp, Artificial Sequence; identical to SEQ ID NO: 164992
  Description of Artificial Sequence: Synthetic coding sequence

SEQ ID NO: 164995 - DNA, 1485 bp, Artificial Sequence
  Description of Artificial Sequence: Synthetic coding sequence
atggatggcagcggggagaggagcctgcctgagcccggcagccagagcagcgctgccagtgatgacattgaaattgtggtgaatgtgggcggcgtgcggcaggtgctgtatggagacctgctgagccagtacccagagacccggctggccgagctgatcaactgcctggccggcggctatgacaccatcttcagcctgtgtgatgattatgaccccgggaagcgggagttctactttgaccgggaccctgatgccttcaagtgtgtgattgaggtgtactactttggagaggtgcacatgaagaagggcatctgccccatctgcttcaagaatgagatggacttctggaaggtggacctgaagttcctggatgactgctgcaagagccacctgtctgagaagcgggaggagctggaggagatcgccaggagagtgcagctgatcctggatgacctgggcgtggatgctgctgagggccgctggaggcgctgccagaagtgtgtgtggaagttcctggagaagccagagagcagctgcccagcccgggtggtggccgtgctgtccttcctgctgatcctggtgtcctctgtggtgatgtgcatgggcaccatccctgagctgcaggtgctggatgctgagggcaacagagtggagcaccccaccctggagaatgtggagacagcctgcatcggctggttcaccctggagtacctgctgcggctcttcagcagccccaacaagctgcactttgccctgtccttcatgaacatcgtggatgtgctggccatcctgcccttctacgtgtccctgaccctgacccacctgggcgccaggatgatggagctgaccaacgtgcagcaggccgtgcaggccctgcgcatcatgagaattgcccgcatcttcaagctggcccggcacagcagcggcctgcagaccctgacctacgccctgaagaggagcttcaaggagctgggcctgctgctgatgtacctggccgtgggcatctttgtgttttctgccctgggctacaccatggagcagagccaccctgagaccctcttcaagagcatcccccagagcttctggtgggccatcatcaccatgaccaccgtgggctatggagacatctaccccaagaccaccctgggcaagctgaatgctgccatctccttcctgtgtggggtcatcgccatcgccctgcccatccaccccatcatcaacaactttgtgcgctactacaacaagcagagggtgctggagacagctgccaagcatgagctggagctgatggagctgaacagcagcagcggcggggagggcaagacaggaggcagcagaagtgacctggacaacctgcccccagagcctgctgggaaggaggcccccagctgcagcagccggctgaagctgagccacagcgacaccttcatccccctgctgacagaggagaagcaccacaggacccggctgcagagctgcaagtag

SEQ ID NO: 164996 - DNA, 1542 bp, Artificial Sequence
  Description of Artificial Sequence: Synthetic coding sequence
atgaccctgctgcccggggacaacagcgactatgactacagcgccctgagctgcaccagtgatgccagcttccacccagccttcctgccccagaggcaggccatcaagggggccttctacagaagagcccagaggctgcggccccaggatgagccccggcagggctgccagccagaagatagaagaagacgcatcatcatcaacgtgggcggcatcaagtacagcctgccctggaccaccctggatgagttccccctgacccggctgggccagctgaaggcctgcaccaactttgatgacatcctgaatgtgtgtgatgattatgatgtgacctgcaatgagttcttctttgacagaaatcctggggccttcggcaccatcctgaccttcctgcgggccggcaagctgcggctgctgcgggagatgtgtgccctgtccttccaggaggagctgctgtactggggcattgctgaggaccacctggatggctgctgcaagaggcgctacctgcagaagattgaggagtttgctgagatggtggagcgggaggaggaggatgatgccctggacagcgagggccgggacagcgagggccctgctgagggggagggccgcctgggccgctgcatgaggcggctgcgggacatggtggagcggccccacagcggcctgcccgggaaggtgtttgcctgcctgtctgtgctgtttgtgacagtgacagctgtgaacctgtctgtgtccaccctgcccagcctgcgggaggaggaggagcagggccactgcagccagatgtgccacaacgtgttcatcgtggagagcgtgtgtgtgggctggttcagcctggagttcctgctgcggctcatccaggcccccagcaagtttgccttcctgcggagccccctgaccctgattgacctggtggccatcctgccctactacatcaccctgctggtggatggagctgctgctggaagaaggaagccaggggccggcaacagctacctggacaaggtgggcctggtgctgcgggtgctgcgggccctgcgcatcctgtatgtgatgaggctggcccggcacagcctgggcctgcagaccctgggcctgacagcccggcgctgcacccgggagtttggcctgctgctgctcttcctgtgtgtggccatcgccctgtttgcccccctgctgtatgtgattgaaaatgagatggctgacagccctgagttcaccagcatcccagcctgctactggtgggccgtcatcaccatgaccaccgtgggctatggagacatggtgcccaggagcaccccaggccaggtggtggccctgagcagcatcctgagcggcatcctgctgatggccttccctgtgaccagcatcttccacaccttcagccgcagctacctggagctgaagcaggagcaggagcgggtgatgttccggcgggcccagttcctgatcaagaccaagagccagctgtctgtgtcccaggacagcgacatcctgtttggcagcgccagcagtgacacccgggacaacaactag

SEQ ID NO: 164997 - DNA, 828 bp, Artificial Sequence
  Description of Artificial Sequence: Synthetic coding sequence
atgaccctgctgcccggggacaacagcgactatgactacagcgccctgagctgcaccagtgatgccagcttccacccagccttcctgccccagaggcaggccatcaagggggccttctacagaagagcccagaggctgcggccccaggatgagccccggcagggctgccagccagaagatagaagaagacgcatcatcatcaacgtgggcggcatcaagtacagcctgccctggaccaccctggatgagttccccctgacccggctgggccagctgaaggcctgcaccaactttgatgacatcctgaatgtgtgtgatgattatgatgtgacctgcaatgagttcttctttgacagaaatcctggggccttcggcaccatcctgaccttcctgcgggccggcaagctgcggctgctgcgggagatgtgtgccctgtccttccaggaggagctgctgtactggggcattgctgaggaccacctggatggctgctgcaagaggcgctacctgcagaagattgaggagtttgctgagatggtggagcgggaggaggaggatgatgccctggacagcgagggccgggacagcgagggccctgctgagggggagggccgcctgggccgctgcatgaggcggctgcgggacatggtggagcggccccacagcggcctgcccgggaaggtgtttgcctgcctgtctgtgctgtttgtgacagtgacagctgtgaacctgtctgtgtccaccctgcccagcctgcgggaggaggaggagcaggtgcgggcccacgcccccagaggaaatgccccaccccggggcaagggcctgtag

SEQ ID NO: 164998 - DNA, 543 bp, Artificial Sequence
  Description of Artificial Sequence: Synthetic coding sequence
atgaccctgctgcccggggacaacagcgactatgactacagcgccctgagctgcaccagtgatgccagcttccacccagccttcctgccccagaggcaggccatcaagggggccttctacagaagagcccagaggctgcggccccaggatgagccccggcagggctgccagccagaagatagaagaagacgcatcatcatcaacgtgggcggcatcaagtacagcctgccctggaccaccctggatgagttccccctgacccggctgggccagctgaaggcctgcaccaactttgatgacatcctgaatgtgtgtgatgattatgatgtgacctgcaatgagttcttctttgacagaaatcctggggccttcggcaccatcctgaccttcctgcgggccggcaagctgcggctgctgcgggagatgtgtgccctgtccttccaggaggagctgctgtactggggcattgctgaggaccacctggatggctgctgcaagaggcgctacctgcagaagattgaggagtttgctgagatggtgtag

SEQ ID NO: 164999 - DNA, 291 bp, Artificial Sequence
  Description of Artificial Sequence: Synthetic coding sequence
atgaccctgctgcccggggacaacagcgactatgactacagcgccctgagctgcaccagtgatgccagcttccacccagccttcctgccccagaggcaggccatcaagggggccttctacagaagagcccagaggctgcggccccaggatgagccccggcagggctgccagccagaagatagaagaagacgcatcatcatcaacgtgggcggcatcaagtacagcctgccctggaccaccctggatgagttccccctgacccggctgggccagctgaaggcctgcacctag

SEQ ID NO: 165000 - DNA, 777 bp, Artificial Sequence
  Description of Artificial Sequence: Synthetic coding sequence
atgaccctgctgcccggggacaacagcgactatgactacagcgccctgagctgcaccagtgatgccagcttccacccagccttcctgccccagaggcaggccatcaagggggccttctacagaagagcccagaggctgcggccccaggatgagccccggcagggctgccagccagaagatagaagaagacgcatcatcatcaacgtgggcggcatcaagtacagcctgccctggaccaccctggatgagttccccctgacccggctgggccagctgaaggcctgcaccaactttgatgacatcctgaatgtgtgtgatgattatgatgtgacctgcaatgagttcttctttgacagaaatcctggggccttcggcaccatcctgaccttcctgcgggccggcaagctgcggctgctgcgggagatgtgtgccctgtccttccaggaggagctgctgtactggggcattgctgaggaccacctggatggctgctgcaagaggcgctacctgcagaagattgaggagtttgctgagatggtggagcgggaggaggaggatgatgccctggacagcgagggccgggacagcgagggccctgctgagggggagggccgcctgggccgctgcatgaggcggctgcgggacatggtggagcggccccacagcggcctgcccgggaaggtgtttgcctgcctgtctgtgctgtttgtgacagtgacagctgtgaacctgtctgtgtccaccctgcccagcctgcgggaggaggaggagcagtag

SEQ ID NO: 165001 - DNA, 147 bp, Artificial Sequence
  Description of Artificial Sequence: Synthetic coding sequence
atgaccctgctgcccggggacaacagcgactatgactacagcgccctgagctgcaccagtgatgccagcttccacccagccttcctgccccagaggcaggccatcaagggggccttctacagaagagcccagaggctgcggccctag

SEQ ID NO: 165002 - DNA, 1311 bp, Artificial Sequence
  Description of Artificial Sequence: Synthetic coding sequence
atgaccttcggccgcagcggggccgcctctgtggtgctgaatgtgggcggggcccgctacagcctgagccgggagctgctgaaggacttccccctgcggcgggtgtcccggctgcacggctgccgctcagaaagagatgtgctggaggtgtgtgatgattatgaccgggagagaaatgagtacttctttgacagacattctgaggccttcggcttcatcctgctgtatgtgcggggccacggcaagctgcgctttgcccccaggatgtgtgagctgtccttctacaatgagatgatctactggggcctggagggcgcccacctggagtactgctgccagaggcggctggatgacaggatgtctgacacctacaccttctacagcgcagatgagcccggggtgctgggcagagatgaggcccggcctgggggcgctgaggccgcccccagccgccgctggctggagaggatgaggaggacctttgaggagcccaccagcagcctggccgcccagatcctggcctctgtgtctgtggtgtttgtgattgtgtccatggtggtgctgtgtgccagcaccctgcctgactggagaaatgctgctgctgacaacagaagcctggatgacaggagccgctacagcgctggccctggccgggagcccagcggcatcatcgaggccatctgcatcggctggttcaccgcagaatgtattgtgcgcttcatcgtgtccaagaacaagtgtgaatttgtgaagaggcccctgaacatcatcgacctgctggccatcaccccctactacatctctgtgctgatgaccgtcttcaccggggagaacagccagctgcagagagctggggtgaccctgcgggtgctgaggatgatgaggatcttctgggtgatcaagctggcccggcacttcatcggcctgcagaccctgggcctgaccctgaagcgctgctaccgggagatggtgatgctgctggtgttcatctgtgtggccatggccatcttcagcgccctgagccagctgctggagcacggcctggacctggagaccagcaacaaggacttcaccagcatcccagctgcctgctggtgggtgatcatctccatgaccaccgtgggctacggggacatgtaccccatcaccgtgcccggccgcatcctgggcggcgtgtgtgtggtgtctggcatcgtgctgctggccctgcccatcaccttcatctaccacagctttgtgcagtgctaccacgagctgaagttccgcagcgcccgctacagccgcagcctgagcacagagttcctgaactag

SEQ ID NO: 165003 - DNA, 1278 bp, Artificial Sequence
  Description of Artificial Sequence: Synthetic coding sequence
atgaccttcggccgcagcggggccgcctctgtggtgctgaatgtgggcggggcccgctacagcctgagccgggagctgctgaaggacttccccctgcggcgggtgtcccggctgcacggctgccgctcagaaagagatgtgctggaggtgtgtgatgattatgaccgggagagaaatgagtacttctttgacagacattctgaggccttcggcttcatcctgctgtatgtgcggggccacggcaagctgcgctttgcccccaggatgtgtgagctgtccttctacaatgagatgatctactggggcctggagggcgcccacctggagtactgctgccagaggcggctggatgacaggatgtctgacacctacaccttctacagcgcagatgagcccggggtgctgggcagagatgaggcccggcctgggggcgctgaggccgcccccagccgccgctggctggagaggatgaggaggacctttgaggagcccaccagcagcctggccgcccagatcctggcctctgtgtctgtggtgtttgtgattgtgtccatggtggtgctgtgtgccagcaccctgcctgactggagaaatgctgctgctgacaacagaagcctggatgacaggagccgcatcatcgaggccatctgcatcggctggttcaccgctgagtgcatcgtgcgcttcatcgtgtccaagaacaagtgtgaatttgtgaagaggcccctgaacatcatcgacctgctggccatcaccccctactacatctctgtgctgatgacagtgttcaccggggagaacagccagctgcagagagctggggtgaccctgcgggtgctgaggatgatgaggatcttctgggtgatcaagctggcccggcacttcatcggcctgcagaccctgggcctgaccctgaagcgctgctaccgggagatggtgatgctgctggtgttcatctgtgtggccatggccatcttcagcgccctgagccagctgctggagcacggcctggacctggagaccagcaacaaggacttcaccagcatcccagctgcctgctggtgggtgatcatctccatgaccaccgtgggctatggagacatgtaccccatcaccgtgcccggccgcatcctgggcggcgtgtgtgtggtgtctggaattgtgctgctggccctgcccatcaccttcatctaccacagctttgtgcagtgctaccacgagctgaagttccgcagcgcccgctacagccgcagcctgagcacagagttcctgaactag

SEQ ID NO: 165004 - DNA, 1560 bp, Artificial Sequence
  Description of Artificial Sequence: Synthetic coding sequence
atgcccatgcccagcagagatggcggcctgcaccccaggcaccaccactacggcagccacagcccctggagccagctgctgagcagccccatggagacccccagcatcaagggcctgtactaccgccgggtgaggaaggtgggcgccctggatgccagccctgtggacctgaagaaggagatcctgatcaacgtgggcggccgccgctacctgctgccctggagcaccctggaccgcttccccctgagccggctgagcaagctgcggctgtgccgctcctatgaggagatcgtgcagctgtgtgatgattatgatgaggacagccaggagttcttctttgacaggagccccagcgccttcggcgtgattgtgtccttcctggccgccggcaagctggtgctgctgcaggagatgtgtgccctgtccttccaggaggagctggcctactggggcatcgaggaggcccacctggagcgctgctgcctgaggaagctgctgaggaagctggaggagctggaggagctggccaagctgcacagagaagatgtgctgcggcagcagcgggagaccaggaggcctgccagccacagcagccgctggggcctgtgcatgaaccggctgcgggagatggtggagaacccccagagcggcctgcccgggaaggtgtttgcctgcctgagcatcctgtttgtggccaccacagctgtgtccctgtgtgtgtccaccatgccagacctgcgggcagaggaggaccagggcgagtgcagcaggaagtgctactacatcttcatcgtggagaccatctgtgtggcctggttcagcctggagttctgcctgcgctttgtgcaggcccaggacaagtgccagttcttccagggccccctgaacatcatcgacatcctggccatcagcccctactacgtgtccctggccgtgtctgaggagcccccagaagatggagagcggcccagcggcagcagctacctggagaaggtgggcctggtgctgcgggtgctgcgggccctgcgcatcctgtatgtgatgaggctggcccggcacagcctgggcctgcagaccctgggcctgactgtgcggcgctgcacccgggagtttggcctgctgctgctcttcctggccgtggccatcaccctcttcagccccctggtgtatgtggccgagaaggagagcggccgggtgctggagttcaccagcatcccagccagctactggtgggccatcatctccatgaccaccgtgggctatggagacatggtgcccaggtctgtgcccggccagatggtggccctgagcagcatcctgagcggcatcctgatcatggccttccctgccaccagcatcttccacaccttcagccacagctacctggagctgaagaaggagcaggagcagctgcaggcccggctgcggcacctgcagaacacaggccctgcctctgaatgtgagctgctggacccccacgtggccagcgagcacgagctgatgaatgatgtgaatgacctgatcctggagggccctgccctgcccatcatgcacatgtag

SEQ ID NO: 165005 - DNA, 2970 bp, Artificial Sequence
  Description of Artificial Sequence: Synthetic coding sequence
atgaccatggccggcggcagaagaggcctggtggccccccagaacaccttcctggagaacatcgtgagaagaagcaatgacaccaactttgtgctgggcaatgcccagatcgtggactggcccatcgtgtacagcaatgatggcttctgcaagctgagcggctaccacagagctgaggtgatgcagaagagcagcacctgcagcttcatgtatggagagctgacagacaaggacaccatcgagaaggtgcggcagacctttgagaactatgagatgaacagctttgagatcctgatgtacaagaagaacagaacacctgtgtggttctttgtgaagatcgcccccatcagaaatgagcaggacaaggtggtgctcttcctgtgcaccttcagtgacatcacagccttcaagcagcccattgaagatgacagctgcaagggctggggcaagtttgcccggctgacccgggccctgaccagcagcagaggagtgctgcagcagctggcccccagcgtgcagaagggggagaatgtgcacaagcacagccggctggccgaggtgctgcagctgggcagtgacatcctgccccagtacaagcaggaggcccccaagaccccaccccacatcatcctgcactactgtgtgttcaagaccacctgggactggatcatcctgatcctgaccttctacacagccatcctggtgccctacaacgtgtccttcaagacccggcagaacaacgtggcctggctggtggtggacagcatcgtggatgtgatcttcctggtggacatcgtgctgaacttccacaccacctttgtgggccctgctggggaggtgatcagtgaccccaagctgatccgcatgaactacctgaagacctggtttgtgattgacctgctgagctgcctgccctatgatgtgatcaatgcctttgaaaatgtggatgaggtgtctgccttcatgggagaccccgggaagattggatttgctgaccagatccccccacccctggagggccgggagagccagggcatcagcagcctcttcagcagcctgaaggtggtgcggctgctgcggctgggccgggtggccaggaagctggaccactacatcgagtatggagctgctgtgctggtgctgctggtgtgtgtgtttggcctggccgcccactggatggcctgcatctggtacagcatcggggactatgagatctttgatgaggacaccaagaccatccggaacaacagctggctgtaccagctggccatggacatcggcaccccctaccagttcaatggaagtggcagcggcaagtgggagggcggccccagcaagaacagcgtgtacatcagcagcctgtacttcaccatgaccagcctgacctctgtgggcttcggcaacatcgcccccagcacagacatcgagaagatctttgctgtggccatcatgatgattggcagcctgctgtatgccaccatctttggaaatgtgaccaccatcttccagcagatgtatgccaacaccaaccgctaccacgagatgctgaacagcgtgcgggacttcctgaagctgtaccaggtgcccaagggcctgtctgagcgggtgatggactacatcgtgtccacctggagcatgagccggggcatcgacacagagaaggtgctgcagatctgccccaaggacatgagagctgacatctgtgtgcacctgaacaggaaggtgttcaaggagcacccagccttccggctggccagtgatggctgcctgcgggccctggccatggagttccagacagtgcactgtgcccctggggacctgatctaccacgccggggagagcgtggacagcctgtgctttgtggtgtctggcagcctggaggtgatccaggatgatgaggtggtggccatcctgggcaaaggagatgtgtttggagatgtgttctggaaggaggccaccctggcccagagctgtgccaacgtgcgggccctgacctactgtgacctgcacgtgatcaagagagatgccctgcagaaggtgctggagttctacacagccttcagccacagcttcagcaggaacctgatcctgacctacaacctgaggaagagaattgtgttcaggaagatcagtgatgtgaagcgggaggaggaggagaggatgaagaggaagaatgaggcccccctcatcctgcccccagaccaccctgtgcggcggctcttccagcgcttccggcagcagaaggaggcccggctggccgctgagcggggcggccgggacctggatgacctggatgtggagaagggaaatgtgctgacagaacatgccagcgccaaccacagcctggtgaaggcctctgtggtgacagtgcgggagagccctgccacccctgtgtccttccaggccgccagcaccagcggcgtgcctgaccacgccaagctgcaggcccctggcagcgagtgcctgggccccaagggcggcggcggggactgtgccaagaggaagtcctgggcccgcttcaaggatgcctgtgggaagtctgaggactggaacaaggtgtccaaggccgagagcatggagaccctgcctgagaggaccaaggccagcggggaggccaccctgaagaagacagacagctgtgacagcggcatcaccaagagtgacctgcggctggacaacgtgggggaggcccggagcccccaggacaggagccccatcctggccgaggtgaagcacagcttctaccccatccctgagcagaccctgcaggccaccgtgctggaggtgagacatgagctgaaggaggacatcaaggccctgaatgccaagatgaccaacatcgagaagcagctgtctgagatcctgcgcatcctgaccagcagaagaagcagccagagcccccaggagctgtttgagatcagccggccccagagccctgagagcgagcgggacatctttggagccagctag

SEQ ID NO: 165006 - DNA, 2889 bp, Artificial Sequence
  Description of Artificial Sequence: Synthetic coding sequence
atgaccatggccggcggcagaagaggcctggtggccccccagaacaccttcctggagaacatcgtgagaagaagcaatgacaccaactttgtgctgggcaatgcccagatcgtggactggcccatcgtgtacagcaatgatggcttctgcaagctgagcggctaccacagagctgaggtgatgcagaagagcagcacctgcagcttcatgtatggagagctgacagacaaggacaccatcgagaaggtgcggcagacctttgagaactatgagatgaacagctttgagatcctgatgtacaagaagaacagaacacctgtgtggttctttgtgaagatcgcccccatcagaaatgagcaggacaaggtggtgctcttcctgtgcaccttcagtgacatcacagccttcaagcagcccattgaagatgacagctgcaagggctggggcaagtttgcccggctgacccgggccctgaccagcagcagaggagtgctgcagcagctggcccccagcgtgcagaagggggagaatgtgcacaagcacagccggctggccgaggtgctgcagctgggcagtgacatcctgccccagtacaagcaggaggcccccaagaccccaccccacatcatcctgcactactgtgtgttcaagaccacctgggactggatcatcctgatcctgaccttctacacagccatcctggtgccctacaacgtgtccttcaagacccggcagaacaacgtggcctggctggtggtggacagcatcgtggatgtgatcttcctggtggacatcgtgctgaacttccacaccacctttgtgggccctgctggggaggtgatcagtgaccccaagctgatccgcatgaactacctgaagacctggtttgtgattgacctgctgagctgcctgccctatgatgtgatcaatgcctttgaaaatgtggatgagggcatcagcagcctcttcagcagcctgaaggtggtgcggctgctgcggctgggccgggtggccaggaagctggaccactacattgaatatggagctgctgtgctggtgctgctggtgtgtgtgtttggcctggccgcccactggatggcctgcatctggtacagcattggagactatgagatctttgatgaggacaccaagaccatccggaacaacagctggctgtaccagctggccatggacatcggcaccccctaccagttcaacggcagcggcagcggcaagtgggagggcggccccagcaagaacagcgtgtacatcagcagcctgtacttcaccatgaccagcctgacctctgtgggctttggaaacatcgcccccagcacagacatcgagaagatctttgctgtggccatcatgatgattggcagcctgctgtatgccaccatctttggaaatgtgaccaccatcttccagcagatgtatgccaacaccaaccgctaccacgagatgctgaacagcgtgcgggacttcctgaagctgtaccaggtgcccaagggcctgtctgagcgggtgatggactacatcgtgtccacctggagcatgagccggggcatcgacacagagaaggtgctgcagatctgccccaaggacatgagagctgacatctgtgtgcacctgaacaggaaggtgttcaaggagcacccagccttccggctggccagtgatggctgcctgcgggccctggccatggagttccagacagtgcactgtgcccctggggacctgatctaccacgccggggagagcgtggacagcctgtgctttgtggtgtctggcagcctggaggtgatccaggatgatgaggtggtggccatcctgggcaaaggagatgtgtttggagatgtgttctggaaggaggccaccctggcccagagctgtgccaacgtgcgggccctgacctactgtgacctgcacgtgatcaagagagatgccctgcagaaggtgctggagttctacacagccttcagccacagcttcagcaggaacctgatcctgacctacaacctgaggaagagaattgtgttcaggaagatcagtgatgtgaagcgggaggaggaggagaggatgaagaggaagaatgaggcccccctcatcctgcccccagaccaccctgtgagaagactcttccagcgcttccggcagcagaaggaggcccggctggccgctgagcggggcggccgggacctggatgacctggatgtggagaagggaaatgtgctgacagagcacgccagcgccaaccacagcctggtgaaggcctctgtggtgacagtgcgggagagccctgccacccctgtgtccttccaggccgccagcaccagcggcgtgcctgaccacgccaagctgcaggcccctggctctgaatgtctgggccccaagggcggcggcggggactgtgccaagaggaagtcctgggcccgcttcaaggatgcctgtgggaagtctgaggactggaacaaggtgtccaaggccgagagcatggagaccctgcctgagaggaccaaggccagcggggaggccaccctgaagaagacagacagctgtgacagcggcatcaccaagagtgacctgcggctggacaacgtgggggaggcccggagcccccaggacaggagccccatcctggccgaggtgaagcacagcttctaccccatccctgagcagaccctgcaggccaccgtgctggaggtgagacatgagctgaaggaggacatcaaggccctgaatgccaagatgaccaacatcgagaagcagctgtctgagatcctgcgcatcctgaccagccgccgcagcagccagagcccccaggagctgtttgagatcagccggccccagagccctgagagcgagcgggacatctttggagccagctag

SEQ ID NO: 165007 - DNA, 3480 bp, Artificial Sequence
  Description of Artificial Sequence: Synthetic coding sequence
atgcctgtgcggcggggccacgtggccccccagaacaccttcctggacaccatcatcaggaagtttgagggccagagcaggaagttcatcatcgccaatgcccgggtggagaactgtgccgtcatctactgcaatgatggcttctgtgagctgtgtggctacagcagagctgaggtgatgcagaggccctgcacctgtgacttcctgcacggccccaggacccagaggagagctgctgcccagatcgcccaggccctgctgggcgctgaggagaggaaggtggagatcgccttctacaggaaggatggcagctgcttcctgtgcctggtggatgtggtgcctgtgaagaatgaagatggagctgtgatcatgttcatcctgaactttgaggtggtgatggagaaggacatggtgggcagccctgcccatgacaccaaccaccggggcccccccacctcctggctggcccctggccgggccaagaccttccggctgaagctgcctgccctgctggccctgacagcccgggagagctctgtgcgcagcggcggggccggcggggccggggcccctggagctgtggtggtggatgtggacctgaccccagctgcccccagcagcgagagcctggccctggatgaggtgacagccatggacaaccacgtggccggcctgggccctgctgaggagcggcgggccctggtgggccctggcagcccccccaggtctgcccctggccagctgcccagcccccgggcccacagcctgaacccagatgccagcggcagcagctgcagcctggcccggaccaggagccgggagagctgtgcctctgtgcggcgggccagcagcgcagatgacatcgaggccatgagagctggggtgctgcccccaccacccaggcatgccagcactggagccatgcaccccctgcggagcggcctgctgaacagcaccagtgacagcgacctggtgcgctaccgcaccatcagcaagatcccccagatcaccctgaactttgtggacctgaagggggaccccttcctggccagccccaccagtgaccgggagatcatcgcccccaagatcaaggagaggacccacaacgtgacagagaaggtgacccaggtgctgagcctgggcgcagatgtgctgcctgagtacaagctgcaggccccccgcatccaccgctggaccatcctgcactacagccccttcaaggctgtgtgggactggctgatcctgctgctggtgatctacacagctgtgttcaccccctacagcgctgccttcctgctgaaggagacagaggagggccccccagccacagaatgtggctacgcctgccagcccctggccgtggtggacctgattgtggacatcatgttcatcgtggacatcctgatcaacttccgcaccacctacgtgaatgccaatgaggaggtggtgagccaccctggaagaattgctgtgcactacttcaagggctggttcctgattgacatggtggccgccatcccctttgacctgctgatctttggaagtggcagcgaggagctgattggcctgctgaagacagcccggctgctgcggctggtgcgggtggccaggaagctggaccgctacagtgaatatggagctgctgtgctcttcctgctgatgtgcacctttgccctgattgcccactggctggcctgcatctggtacgccatcggcaacatggagcagccccacatggacagcagaattggctggctgcacaacctgggggaccagatcggcaagccctacaacagcagcggcctgggcggccccagcatcaaggacaagtatgtgacagccctgtacttcaccttcagcagcctgacctctgtgggctttggaaatgtgagccccaacaccaacagcgagaagatcttcagcatctgtgtgatgctgattggcagcctgatgtatgccagcatctttggaaatgtgtctgccatcatccagaggctgtacagcggcacagcccgctaccacacccagatgctgcgggtgcgggagttcatccgcttccaccagatccccaaccccctgcggcagaggctggaggagtacttccagcacgcctggagctacaccaatggaattgacatgaatgctgtgctgaagggcttccctgagtgcctgcaggccgacatctgcctgcacctgaacagaagcctgctgcagcactgcaagcccttccggggggccaccaagggctgcctgcgggccctggccatgaagttcaagaccacccacgcccctcctggggacaccctggtgcacgccggggacctgctgacagccctgtacttcatcagccggggcagcattgagatcctgcggggagatgtggtggtggccatcctgggcaagaatgacatctttggagagcccctgaacctgtatgcccggcctgggaagagcaatggagatgtgcgggccctgacctactgtgacctgcacaagatccacagagatgacctgctggaggtgctggacatgtacccagagttcagtgaccacttctggagcagcctggagatcaccttcaacctgcgggacaccaacatgatccctggcagccctggcagcacagagctggagggcggcttcagccggcagaggaagaggaagctgtccttcagaagaagaacagacaaggacacagagcagcccggggaggtgtctgccctgggccctggccgggccggggccggccccagcagccggggccggcctgggggcccctggggcgagagccccagcagcggccccagcagccctgagagcagtgaagatgagggccctggccgcagcagcagccccctgcggctggtgcccttcagcagccccaggcctcctggagagcccccaggaggagagcccctgatggaggactgtgagaagagcagtgacacctgcaaccccctgagcggggccttcagcggcgtgagcaacatcttctccttctggggagacagccggggccggcagtaccaggagctgccccgctgcccagcccccacccccagcctgctgaacatccccctgagcagccctggccggcggcccagaggagatgtggagagccggctggatgccctgcagaggcagctgaaccggctggagacccggctgtctgctgacatggccaccgtgctgcagctgctgcagaggcagatgaccctggtgcccccagcctacagcgctgtgaccaccccaggccctggccccaccagcaccagccccctgctgcctgtgagccccctgcccaccctgaccctggacagcctgagccaggtgtcccagttcatggcctgtgaggagctgcccccaggggcccctgagctgccccaggagggccccacccggcggctgagcctgcccggccagctgggcgccctgaccagccagcccctgcacagacatggcagtgaccccggcagctag

SEQ ID NO: 165008 - DNA, 2460 bp, Artificial Sequence
  Description of Artificial Sequence: Synthetic coding sequence
atggccgccccagctgggaaggccagcaggactggagccctgcggccccgggcccagaagggccgggtgcggcgggctgtgcgcatcagcagcctggtggcccaggaggtgctgagcctgggcgcagatgtgctgcctgagtacaagctgcaggccccccgcatccaccgctggaccatcctgcactacagccccttcaaggctgtgtgggactggctgatcctgctgctggtgatctacacagctgtgttcaccccctacagcgctgccttcctgctgaaggagacagaggagggccccccagccacagaatgtggctacgcctgccagcccctggccgtggtggacctgattgtggacatcatgttcatcgtggacatcctgatcaacttccgcaccacctacgtgaatgccaatgaggaggtggtgagccaccctggaagaattgctgtgcactacttcaagggctggttcctgattgacatggtggccgccatcccctttgacctgctgatctttggaagtggcagcgaggagctgattggcctgctgaagacagcccggctgctgcggctggtgcgggtggccaggaagctggaccgctacagtgaatatggagctgctgtgctcttcctgctgatgtgcacctttgccctgattgcccactggctggcctgcatctggtacgccatcggcaacatggagcagccccacatggacagcagaattggctggctgcacaacctgggggaccagatcggcaagccctacaacagcagcggcctgggcggccccagcatcaaggacaagtatgtgacagccctgtacttcaccttcagcagcctgacctctgtgggctttggaaatgtgagccccaacaccaacagcgagaagatcttcagcatctgtgtgatgctgattggcagcctgatgtatgccagcatctttggaaatgtgtctgccatcatccagaggctgtacagcggcacagcccgctaccacacccagatgctgcgggtgcgggagttcatccgcttccaccagatccccaaccccctgcggcagaggctggaggagtacttccagcacgcctggagctacaccaatggaattgacatgaatgctgtgctgaagggcttccctgagtgcctgcaggccgacatctgcctgcacctgaacagaagcctgctgcagcactgcaagcccttccggggggccaccaagggctgcctgcgggccctggccatgaagttcaagaccacccacgcccctcctggggacaccctggtgcacgccggggacctgctgacagccctgtacttcatcagccggggcagcattgagatcctgcggggagatgtggtggtggccatcctgggcaagaatgacatctttggagagcccctgaacctgtatgcccggcctgggaagagcaatggagatgtgcgggccctgacctactgtgacctgcacaagatccacagagatgacctgctggaggtgctggacatgtacccagagttcagtgaccacttctggagcagcctggagatcaccttcaacctgcgggacaccaacatgatccctggcagccctggcagcacagagctggagggcggcttcagccggcagaggaagaggaagctgtccttcagaagaagaacagacaaggacacagagcagcccggggaggtgtctgccctgggccctggccgggccggggccggccccagcagccggggccggcctgggggcccctggggcgagagccccagcagcggccccagcagccctgagagcagtgaagatgagggccctggccgcagcagcagccccctgcggctggtgcccttcagcagccccaggcctcctggagagcccccaggaggagagcccctgatggaggactgtgagaagagcagtgacacctgcaaccccctgagcggggccttcagcggcgtgagcaacatcttctccttctggggagacagccggggccggcagtaccaggagctgccccgctgcccagcccccacccccagcctgctgaacatccccctgagcagccctggccggcggcccagaggagatgtggagagccggctggatgccctgcagaggcagctgaaccggctggagacccggctgtctgctgacatggccaccgtgctgcagctgctgcagaggcagatgaccctggtgcccccagcctacagcgctgtgaccaccccaggccctggccccaccagcaccagccccctgctgcctgtgagccccctgcccaccctgaccctggacagcctgagccaggtgtcccagttcatggcctgtgaggagctgcccccaggggcccctgagctgccccaggagggccccacccggcggctgagcctgcccggccagctgggcgccctgaccagccagcccctgcacagacatggcagtgaccccggcagctag

SEQ ID NO: 165009 - DNA, 1182 bp, Artificial Sequence
  Description of Artificial Sequence: Synthetic coding sequence
atggccgccccagctgggaaggccagcaggactggagccctgcggccccgggcccagaagggccgggtgcggcgggctgtgcgcatcagcagcctggtggcccaggaggtgctgagcctgggcgcagatgtgctgcctgagtacaagctgcaggccccccgcatccaccgctggaccatcctgcactacagccccttcaaggctgtgtgggactggctgatcctgctgctggtgatctacacagctgtgttcaccccctacagcgctgccttcctgctgaaggagacagaggagggccccccagccacagaatgtggctacgcctgccagcccctggccgtggtggacctgattgtggacatcatgttcatcgtggacatcctgatcaacttccgcaccacctacgtgaatgccaatgaggaggtggtgagccaccctggaagaattgctgtgcactacttcaagggctggttcctgattgacatggtggccgccatcccctttgacctgctgatctttggaagtggcagcgaggagctgattggcctgctgaagacagcccggctgctgcggctggtgcgggtggccaggaagctggaccgctacagtgaatatggagctgctgtgctcttcctgctgatgtgcacctttgccctgattgcccactggctggcctgcatctggtacgccatcggcaacatggagcagccccacatggacagcagaattggctggctgcacaacctgggggaccagatcggcaagccctacaacagcagcggcctgggcggccccagcatcaaggacaagtatgtgacagccctgtacttcaccttcagcagcctgacctctgtgggctttggaaatgtgagccccaacaccaacagcgagaagatcttcagcatctgtgtgatgctgattggcagcctgatgtatgccagcatctttggaaatgtgtctgccatcatccagaggctgtacagcggcacagcccgctaccacacccagatgctgcgggtgcgggagttcatccgcttccaccagatccccaaccccctgcggcagtgctgtgaccaccctggggcctggccccacttccacatcccagctgtggcccggcagcccccaccccacccccacctgggcctggccttcagcggcttccctgtgcatggagtgtag

SEQ ID NO: 165010 - DNA, 3192 bp, Artificial Sequence
  Description of Artificial Sequence: Synthetic coding sequence
atgagcagccacagcgctggcagctgcttcctgtgcctggtggatgtggtgcctgtgaagaatgaagatggagctgtgatcatgttcatcctgaactttgaggtggtgatggagaaggacatggtgggcagccctgcccatgacaccaaccaccggggcccccccacctcctggctggcccctggccgggccaagaccttccggctgaagctgcctgccctgctggccctgacagcccgggagagctctgtgcgcagcggcggggccggcggggccggggcccctggagctgtggtggtggatgtggacctgaccccagctgcccccagcagcgagagcctggccctggatgaggtgacagccatggacaaccacgtggccggcctgggccctgctgaggagcggcgggccctggtgggccctggcagcccccccaggtctgcccctggccagctgcccagcccccgggcccacagcctgaacccagatgccagcggcagcagctgcagcctggcccggaccaggagccgggagagctgtgcctctgtgcggcgggccagcagcgcagatgacatcgaggccatgagagctggggtgctgcccccaccacccaggcatgccagcactggagccatgcaccccctgcggagcggcctgctgaacagcaccagtgacagcgacctggtgcgctaccgcaccatcagcaagatcccccagatcaccctgaactttgtggacctgaagggggaccccttcctggccagccccaccagtgaccgggagatcatcgcccccaagatcaaggagaggacccacaacgtgacagagaaggtgacccaggtgctgagcctgggcgcagatgtgctgcctgagtacaagctgcaggccccccgcatccaccgctggaccatcctgcactacagccccttcaaggctgtgtgggactggctgatcctgctgctggtgatctacacagctgtgttcaccccctacagcgctgccttcctgctgaaggagacagaggagggccccccagccacagaatgtggctacgcctgccagcccctggccgtggtggacctgattgtggacatcatgttcatcgtggacatcctgatcaacttccgcaccacctacgtgaatgccaatgaggaggtggtgagccaccctggaagaattgctgtgcactacttcaagggctggttcctgattgacatggtggccgccatcccctttgacctgctgatctttggaagtggcagcgaggagctgattggcctgctgaagacagcccggctgctgcggctggtgcgggtggccaggaagctggaccgctacagtgaatatggagctgctgtgctcttcctgctgatgtgcacctttgccctgattgcccactggctggcctgcatctggtacgccatcggcaacatggagcagccccacatggacagcagaattggctggctgcacaacctgggggaccagatcggcaagccctacaacagcagcggcctgggcggccccagcatcaaggacaagtatgtgacagccctgtacttcaccttcagcagcctgacctctgtgggctttggaaatgtgagccccaacaccaacagcgagaagatcttcagcatctgtgtgatgctgattggcagcctgatgtatgccagcatctttggaaatgtgtctgccatcatccagaggctgtacagcggcacagcccgctaccacacccagatgctgcgggtgcgggagttcatccgcttccaccagatccccaaccccctgcggcagaggctggaggagtacttccagcacgcctggagctacaccaatggaattgacatgaatgctgtgctgaagggcttccctgagtgcctgcaggccgacatctgcctgcacctgaacagaagcctgctgcagcactgcaagcccttccggggggccaccaagggctgcctgcgggccctggccatgaagttcaagaccacccacgcccctcctggggacaccctggtgcacgccggggacctgctgacagccctgtacttcatcagccggggcagcattgagatcctgcggggagatgtggtggtggccatcctgggcaagaatgacatctttggagagcccctgaacctgtatgcccggcctgggaagagcaatggagatgtgcgggccctgacctactgtgacctgcacaagatccacagagatgacctgctggaggtgctggacatgtacccagagttcagtgaccacttctggagcagcctggagatcaccttcaacctgcgggacaccaacatgatccctggcagccctggcagcacagagctggagggcggcttcagccggcagaggaagaggaagctgtccttcagaagaagaacagacaaggacacagagcagcccggggaggtgtctgccctgggccctggccgggccggggccggccccagcagccggggccggcctgggggcccctggggcgagagccccagcagcggccccagcagccctgagagcagtgaagatgagggccctggccgcagcagcagccccctgcggctggtgcccttcagcagccccaggcctcctggagagcccccaggaggagagcccctgatggaggactgtgagaagagcagtgacacctgcaaccccctgagcggggccttcagcggcgtgagcaacatcttctccttctggggagacagccggggccggcagtaccaggagctgccccgctgcccagcccccacccccagcctgctgaacatccccctgagcagccctggccggcggcccagaggagatgtggagagccggctggatgccctgcagaggcagctgaaccggctggagacccggctgtctgctgacatggccaccgtgctgcagctgctgcagaggcagatgaccctggtgcccccagcctacagcgctgtgaccaccccaggccctggccccaccagcaccagccccctgctgcctgtgagccccctgcccaccctgaccctggacagcctgagccaggtgtcccagttcatggcctgtgaggagctgcccccaggggcccctgagctgccccaggagggccccacccggcggctgagcctgcccggccagctgggcgccctgaccagccagcccctgcacagacatggcagtgaccccggcagctag

SEQ ID NO: 165011 - DNA, 2667 bp, Artificial Sequence
  Description of Artificial Sequence: Synthetic coding sequence
atgcctgtgcggcggggccacgtggccccccagaacaccttcctggacaccatcatcaggaagtttgagggccagagcaggaagttcatcatcgccaatgcccgggtggagaactgtgccgtcatctactgcaatgatggcttctgtgagctgtgtggctacagcagagctgaggtgatgcagaggccctgcacctgtgacttcctgcacggccccaggacccagaggagagctgctgcccagatcgcccaggccctgctgggcgctgaggagaggaaggtggagatcgccttctacaggaaggatggcagctgcttcctgtgcctggtggatgtggtgcctgtgaagaatgaagatggagctgtgatcatgttcatcctgaactttgaggtggtgatggagaaggacatggtgggcagccctgcccatgacaccaaccaccggggcccccccacctcctggctggcccctggccgggccaagaccttccggctgaagctgcctgccctgctggccctgacagcccgggagagctctgtgcgcagcggcggggccggcggggccggggcccctggagctgtggtggtggatgtggacctgaccccagctgcccccagcagcgagagcctggccctggatgaggtgacagccatggacaaccacgtggccggcctgggccctgctgaggagcggcgggccctggtgggccctggcagcccccccaggtctgcccctggccagctgcccagcccccgggcccacagcctgaacccagatgccagcggcagcagctgcagcctggcccggaccaggagccgggagagctgtgcctctgtgcggcgggccagcagcgcagatgacatcgaggccatgagagctggggtgctgcccccaccacccaggcatgccagcactggagccatgcaccccctgcggagcggcctgctgaacagcaccagtgacagcgacctggtgcgctaccgcaccatcagcaagatcccccagatcaccctgaactttgtggacctgaagggggaccccttcctggccagccccaccagtgaccgggagatcatcgcccccaagatcaaggagaggacccacaacgtgacagagaaggtgacccaggtgctgagcctgggcgcagatgtgctgcctgagtacaagctgcaggccccccgcatccaccgctggaccatcctgcactacagccccttcaaggctgtgtgggactggctgatcctgctgctggtgatctacacagctgtgttcaccccctacagcgctgccttcctgctgaaggagacagaggagggccccccagccacagaatgtggctacgcctgccagcccctggccgtggtggacctgattgtggacatcatgttcatcgtggacatcctgatcaacttccgcaccacctacgtgaatgccaatgaggaggtggtgagccaccctggaagaattgctgtgcactacttcaagggctggttcctgattgacatggtggccgccatcccctttgacctgctgatctttggaagtggcagcgaggagctgattggcctgctgaagacagcccggctgctgcggctggtgcgggtggccaggaagctggaccgctacagtgaatatggagctgctgtgctcttcctgctgatgtgcacctttgccctgattgcccactggctggcctgcatctggtacgccatcggcaacatggagcagccccacatggacagcagaattggctggctgcacaacctgggggaccagatcggcaagccctacaacagcagcggcctgggcggccccagcatcaaggacaagtatgtgacagccctgtacttcaccttcagcagcctgacctctgtgggctttggaaatgtgagccccaacaccaacagcgagaagatcttcagcatctgtgtgatgctgattggcagcctgatgtatgccagcatctttggaaatgtgtctgccatcatccagaggctgtacagcggcacagcccgctaccacacccagatgctgcgggtgcgggagttcatccgcttccaccagatccccaaccccctgcggcagaggctggaggagtacttccagcacgcctggagctacaccaatggaattgacatgaatgctgtgctgaagggcttccctgagtgcctgcaggccgacatctgcctgcacctgaacagaagcctgctgcagcactgcaagcccttccggggggccaccaagggctgcctgcgggccctggccatgaagttcaagaccacccacgcccctcctggggacaccctggtgcacgccggggacctgctgacagccctgtacttcatcagccggggcagcattgagatcctgcggggagatgtggtggtggccatcctgggcatgggctggggcgccggcaccggcctggagatgcccagcgctgccagcagaggagccagcctgctgaacatgcagagcctgggcctgtggacctgggactgcctgcagggccactgggcccccctcatccacctgaacagcggccccccatctggggccatggagaggagccccacctggggcgaggccgctgagctgtggggcagccacatcctgctgcccttccgcatccgccacaagcagaccctgtttgccagcctgaagtag

SEQ ID NO: 165012 - DNA, 3252 bp, Artificial Sequence
  Description of Artificial Sequence: Synthetic coding sequence
atgcctgccatgaggggcctgctggccccccagaacaccttcctggacaccatcgccaccaggtttgatggcacccacagcaactttgtgctgggcaatgcccaggtggccggcctcttccctgtggtgtactgcagtgatggcttctgtgacctgaccggcttcagcagagctgaggtgatgcagaggggctgtgcctgcagcttcctgtatggccctgacaccagcgagctggtgcggcagcagatcaggaaggccctggatgagcacaaggagttcaaggccgagctgatcctgtacaggaagagcggcctgcccttctggtgcctgctggatgtgatccccatcaagaatgagaagggggaggtggccctcttcctggtgagccacaaggacatcagcgagaccaagaacagaggaggccctgaccgctggaaggagaccggcggcggcagaagaagatatggccgggcccggagcaagggcttcaatgccaacagaagaagaagcagagctgtgctgtaccacctgagcggccacctgcagaagcagcccaagggcaagcacaagctgaacaagggcgtgtttggagagaagcccaacctgcctgagtacaaggtggccgccatcaggaagagccccttcatcctgctgcactgtggggccctgcgggccacctgggatggcttcatcctgctggccaccctgtatgtggccgtgacagtgccctacagcgtgtgtgtgtccacagcccgggagcccagcgctgcccggggcccccccagcgtgtgtgacctggccgtggaggtgctcttcatcctggacatcgtgctgaacttccgcaccacctttgtgtccaagagcggccaggtggtgtttgcccccaagagcatctgcctgcactacgtgaccacctggttcctgctggatgtgattgctgccctgccctttgacctgctgcacgccttcaaggtgaatgtgtactttggagcccacctgctgaagacagtgcggctgctgcggctgctgcggctgctgccccggctggaccgctacagccagtacagcgctgtggtgctgaccctgctgatggctgtgtttgccctgctggcccactgggtggcctgtgtgtggttctacatcggccagcgggagattgagagcagcgagagcgagctgcctgagatcggctggctgcaggagctggcccggcggctggagaccccctactacctggtgggcagaagacctgctgggggcaacagcagcggccagagcgacaactgcagcagcagcagcgaggccaacggcaccggcctggagctgctgggcggccccagcctgcggagcgcctacatcaccagcctgtactttgccctgagcagcctgacctctgtgggctttggaaatgtgtctgccaacacagacacagagaagatcttcagcatctgcaccatgctgattggagccctgatgcatgctgtggtgtttggaaatgtgacagccatcatccagaggatgtatgcccggcgcttcctgtaccacagcaggacccgggacctgcgggactacatccgcatccaccgcatccccaagcccctgaagcagaggatgctggagtacttccaggccacctgggccgtgaacaacggcatcgacaccacagagctgctgcagagcctgcctgatgagctgcgggctgacatcgccatgcacctgcacaaggaggtgctgcagctgcccctgtttgaagctgccagccggggctgcctgcgggccctgagcctggccctgcggcctgccttctgcaccccaggagagtacctgatccaccagggagatgccctgcaggccctgtactttgtgtgcagcggctccatggaggtgctgaagggcggcaccgtgctggccatcctgggcaaaggagacctgattggctgtgagctgccccggcgggagcaggtggtgaaggccaatgctgatgtgaagggcctgacctactgtgtgctgcagtgcctgcagctggccggcctgcatgacagcctggccctgtacccagagtttgccccccgcttcagccggggcctgcggggggagctgagctacaacctgggcgctgggggcggcagcgctgaggtggacaccagcagcctgagcggggacaacaccctgatgagcaccctggaggagaaggagacagatggagagcagggccccaccgtgtccccagccccagcagatgagcccagcagccccctgctgagccctggctgcaccagcagcagcagcgctgccaagctgctgagccccaggagaacagccccccggccccggctgggcggccggggccggcccggccgggccggggccctgaaggccgaggccggccccagcgccccaccccgggccctggagggcctgcggctgccccccatgccctggaatgtgcccccagacctgagcccccgggtggtggatggcattgaagatggctgcggcagtgaccagcccaagttctccttccgggtgggccagagcggcccagaatgtagcagcagccccagccctggccctgagagcggcctgctgactgtgccccacggccccagcgaggccaggaacacagacaccctggacaagctgcggcaggccgtgacagagctgtctgagcaggtgctgcagatgagggagggcctgcagagcctgcggcaggccgtgcagctggtgctggccccccaccgggagggcccctgcccccgggccagcggggagggcccctgcccagccagcaccagcggcctgctgcagcccctgtgtgtggacaccggggccagcagctactgcctgcagcccccagctggctctgtgctgagcggcacctggccccacccccggcccggccccccacccctgatggccccctggccctggggccccccagccagccagagcagcccctggccccgggccacagccttctggaccagcaccagtgacagcgagcccccagccagcggggacctgtgcagcgagcccagcaccccagccagccccccaccttctgaggagggcgccaggactggacctgctgagcctgtgtcccaggccgaggccaccagcactggagagcccccacctggcagcggcggcctggccctgccctgggacccccacagcctggagatggtgctgattggctgccacggcagcggcaccgtgcagtggacccaggaggagggcactggagtgtag

SEQ ID NO: 165013 - DNA, 2967 bp, Artificial Sequence
  Description of Artificial Sequence: Synthetic coding sequence
atgcctgggggcaagaggggcctggtggccccccagaacaccttcctggagaacatcgtgagaagaagcagcgagagcagcttcctgctgggcaatgcccagatcgtggactggcctgtggtgtacagcaatgatggcttctgcaagctgagcggctaccacagagcagatgtgatgcagaagagcagcacctgcagcttcatgtatggagagctgacagacaagaagaccatcgagaaggtgcggcagacctttgacaactatgagagcaactgctttgaggtgctgctgtacaagaagaacagaacacctgtgtggttctacatgcagatcgcccccatcagaaatgagcacgagaaggtggtgctcttcctgtgcaccttcaaggacatcaccctcttcaagcagcccattgaagatgacagcaccaagggctggaccaagtttgcccggctgacccgggccctgaccaacagccgctctgtgctgcagcagctgacccccatgaacaagacagaggtggtgcacaagcacagccggctggccgaggtgctgcagctgggcagtgacatcctgccccagtacaagcaggaggcccccaagaccccaccccacatcatcctgcactactgtgccttcaagaccacctgggactgggtgatcctgatcctgaccttctacacagccatcatggtgccctacaacgtgtccttcaagaccaagcagaacaacatcgcctggctggtgctggacagcgtggtggatgtgatcttcctggtggacatcgtgctgaacttccacaccacctttgtgggccctggaggagaggtgatcagtgaccccaagctgatccgcatgaactacctgaagacctggtttgtgattgacctgctgagctgcctgccctatgacatcatcaatgcctttgaaaatgtggatgagggcatcagcagcctcttcagcagcctgaaggtggtgcggctgctgcggctgggccgggtggccaggaagctggaccactacctggagtatggagctgctgtgctggtgctgctggtgtgtgtgtttggcctggtggcccactggctggcctgcatctggtacagcatcggggactatgaggtgattgatgaggtgaccaacaccatccagattgacagctggctgtaccagctggccctgagcatcggcaccccctaccgctacaacaccagcgctggcatctgggagggcggccccagcaaggacagcctgtatgtgagcagcctgtacttcaccatgaccagcctgaccaccatcggctttggaaacatcgcccccaccacagatgtggagaagatgttttctgtggccatgatgatggtgggcagcctgctgtatgccaccatctttggaaatgtgaccaccatcttccagcagatgtatgccaacaccaaccgctaccacgagatgctgaacaacgtgcgggacttcctgaagctgtaccaggtgcccaagggcctgtctgagcgggtgatggactacatcgtgtccacctggagcatgagcaaaggaattgacacagagaaggtgctgagcatctgccccaaggacatgagagctgacatctgtgtgcacctgaacaggaaggtgttcaatgagcacccagccttccggctggccagtgatggctgcctgcgggccctggccgtggagttccagaccatccactgtgcccctggggacctgatctaccacgccggggagagcgtggatgccctgtgctttgtggtgtctggcagcctggaggtgatccaggatgatgaggtggtggccatcctgggcaaaggagatgtgtttggagacatcttctggaaggagaccaccctggcccacgcctgtgccaacgtgcgggccctgacctactgtgacctgcacatcatcaagcgggaggccctgctgaaggtgctggacttctacacagcctttgccaacagcttcagcaggaacctgaccctgacctgcaacctgaggaagaggatcatcttcaggaagatcagtgatgtgaagaaggaggaggaggagcggctgcggcagaagaatgaggtgaccctgagcatccctgtggaccaccctgtgaggaagctgttccagaagttcaagcagcagaaggagctgaggaaccagggcagcacccagggcgaccctgagaggaaccagctgcaggtggagagccgcagcctgcagaatggagccagcatcaccggcacctctgtggtgacagtgtcccagatcacccccatccagaccagcctggcctacgtgaagaccagcgagagcctgaagcagaacaacagagatgccatggagctgaagcccaatggaggagctgaccagaagtgcctgaaggtgaacagccccatccgcatgaagaatggaaatggcaagggctggctgcggctgaagaacaacatgggcgcccacgaggagaagaaggaggactggaacaacgtgaccaaggccgagagcatgggcctgctgtctgaggaccccaagagcagtgacagcgagaacagcgtgaccaagaaccccctgaggaagacagacagctgtgacagcggcatcaccaagagtgacctgcggctggacaaggccggggaggcccggagccccctggagcacagccccatccaggctgatgccaagcaccccttctaccccatccctgagcaggccctgcagaccaccctgcaggaggtgaagcatgagctgaaggaggacatccagctgctgagctgcaggatgacagccctggagaagcaggtggccgagatcctgaagatcctgtctgagaagtctgtgccccaggccagcagccccaagagccagatgcccctgcaggtgcccccccagatcccctgccaggacatcttctctgtgtccaggcctgagagccctgagagtgacaaggatgagatccacttctag

SEQ ID NO: 165014 - DNA, 1269 bp, Artificial Sequence
  Description of Artificial Sequence: Synthetic coding sequence
atgcagaagagcagcacctgcagcttcatgtatggagagctgacagacaagaagaccatcgagaaggtgcggcagacctttgacaactatgagagcaactgctttgaggtgctgctgtacaagaagaacagaacacctgtgtggttctacatgcagatcgcccccatcagaaatgagcacgagaaggtggtgctcttcctgtgcaccttcaaggacatcaccctcttcaagcagcccattgaagatgacagcaccaagggctggaccaagtttgcccggctgacccgggccctgaccaacagccgctctgtgctgcagcagctgacccccatgaacaagacagaggtggtgcacaagcacagccggctggccgaggtgctgcagctgggcagtgacatcctgccccagtacaagcaggaggcccccaagaccccaccccacatcatcctgcactactgtgccttcaagaccacctgggactgggtgatcctgatcctgaccttctacacagccatcatggtgccctacaacgtgtccttcaagaccaagcagaacaacatcgcctggctggtgctggacagcgtggtggatgtgatcttcctggtggacatcgtgctgaacttccacaccacctttgtgggccctggaggagaggtgatcagtgaccccaagctgatccgcatgaactacctgaagacctggtttgtgattgacctgctgagctgcctgccctatgacatcatcaatgcctttgaaaatgtggatgagggcatcagcagcctcttcagcagcctgaaggtggtgcggctgctgcggctgggccgggtggccaggaagctggaccactacctggagtatggagctgctgtgctggtgctgctggtgtgtgtgtttggcctggtggcccactggctggcctgcatctggtacagcatcggggactatgaggtgattgatgaggtgaccaacaccatccagattgacagctggctgtaccagctggccctgagcatcggcaccccctaccgctacaacaccagcgctggcatctgggagggcggccccagcaaggacagcctgtatgtgagcagcctgtacttcaccatgaccagcctgaccaccatcggctttggaaacatcgcccccaccacagatgtggagaagatgttttctgtggccatgatgatggtgggctgcaagtacttcaacttcttcatcgagaactactgctactggcagttctcctggctgcagagccagattggatag

SEQ ID NO: 165015 - DNA, 2199 bp, Artificial Sequence
  Description of Artificial Sequence: Synthetic coding sequence
atgcctgtgcggcggggccacgtggccccccagaacaccttcctgggcaccatcatcaggaagtttgagggccagaacaagaagttcatcatcgccaatgcccgggtgcagaactgtgccatcatctactgcaatgatggcttctgtgagatgacaggcttcagcaggccagatgtgatgcagaagccctgcacctgtgacttcctgcacggccctgagaccaagagacatgacatcgcccagatcgcccaggccctgctgggcagcgaggagaggaaggtggaggtgacctactaccacaagaatggcagcaccttcatctgcaacacccacatcatccctgtgaagaaccaggagggcgtggccatgatgttcatcatcaactttgaatatgtgacagacaatgaaaatgctgccaccccagagcgggtgaaccccatcctgcccatcaagacagtgaacaggaagttcttcggcttcaagtttcctggcctgcgggtgctgacctacaggaagcagagcctgccccaggaggaccctgatgtggtggtgattgacagcagcaagcacagtgatgacagcgtggccatgaagcacttcaagagccccaccaaggagagctgcagccccagcgaggctgatgacaccaaggccctgatccagcccagcaagtgcagccccctggtgaacatcagcggccccctggaccacagcagccccaagaggcagtgggaccggctgtacccagacatgctgcagagcagcagccagctgagccacagccgcagccgggagagcctgtgcagcatcagaagagccagctctgtgcatgacatcgagggcttcggcgtgcaccccaagaacatcttccgggacagacatgccagcgagggccccttcaaccacatcaagagcagcctgctgggcagcaccagtgacagcaacctgaacaagtacagcaccatcaacaagatcccccagctgaccctgaacttcagcgaggtgaagacagagaagaagaacagcagcccccccagcagtgacaagaccatcatcgcccccaaggtgaaggacaggacccacaacgtgacagagaaggtgacccaggtgctgagcctgggcgcagatgtgctgcctgagtacaagctgcagaccccccgcatcaacaagttcaccatcctgcactacagccccttcaaggctgtgtgggactggctgatcctgctgctggtgatctacacagccatcttcaccccctacagcgctgccttcctgctgaatgaccgggaggagcagaagaggcgggagtgtggctacagctgcagccccctgaatgtggtggacctgattgtggacatcatgttcatcatcgacatcctgatcaacttccgcaccacctacgtgaaccagaatgaggaggtggtgtctgaccctgccaagatcgccatccactacttcaagggctggttcctgattgacatggtggccgccatcccctttgacctgctgatctttggaagtggcagtgatgagaccaccaccctcatcggcctgctgaagacagcccggctgctgcggctggtgcgggtggccaggaagctggaccgctacagtgaatatggagctgctgtgctgatgctgctgatgtgcatctttgccctgattgcccactggctggcctgcatctggtacgccatcggaaatgtggagcggccctacctgacagacaagattggctggctggacagcctgggccagcagatcggcaagcgctacaatgacagcgacagcagcagcggccccagcatcaaggacaagtatgtgacagccctgtacttcaccttcagcagcctgacctctgtgggctttggaaatgtgagccccaacaccaacagcgagaagatcttcagcatctgtgtgatgctgattggcagcctgatgtatgccagcatctttggaaatgtgtctgccatcatccagaggctgtacagcggcacagcccgctaccacatgcagatgctgcgggtgaaggagttcatccgcttccaccagatccccaaccccctgcggcagaggctggaggagtacttccagcacgcctggacctacaccaatggaattgacatgaacatggtgtgcatgtctgtgttccagaatgaatctgctgctggcatcatcgtcatcgccaagatggagtag

SEQ ID NO: 165016 - DNA, 3591 bp, Artificial Sequence
  Description of Artificial Sequence: Synthetic coding sequence
atgcctgtgcggcggggccacgtggccccccagaacaccttcctgggcaccatcatcaggaagtttgagggccagaacaagaagttcatcatcgccaatgcccgggtgcagaactgtgccatcatctactgcaatgatggcttctgtgagatgacaggcttcagcaggccagatgtgatgcagaagccctgcacctgtgacttcctgcacggccctgagaccaagagacatgacatcgcccagatcgcccaggccctgctgggcagcgaggagaggaaggtggaggtgacctactaccacaagaatggcagcaccttcatctgcaacacccacatcatccctgtgaagaaccaggagggcgtggccatgatgttcatcatcaactttgaatatgtgacagacaatgaaaatgctgccaccccagagcgggtgaaccccatcctgcccatcaagacagtgaacaggaagttcttcggcttcaagtttcctggcctgcgggtgctgacctacaggaagcagagcctgccccaggaggaccctgatgtggtggtgattgacagcagcaagcacagtgatgacagcgtggccatgaagcacttcaagagccccaccaaggagagctgcagccccagcgaggctgatgacaccaaggccctgatccagcccagcaagtgcagccccctggtgaacatcagcggccccctggaccacagcagccccaagaggcagtgggaccggctgtacccagacatgctgcagagcagcagccagctgagccacagccgcagccgggagagcctgtgcagcatcagaagagccagctctgtgcatgacatcgagggcttcggcgtgcaccccaagaacatcttccgggacagacatgcctctgaagataatggaagaaatgtgaagggccccttcaaccacatcaagagcagcctgctgggcagcaccagtgacagcaacctgaacaagtacagcaccatcaacaagatcccccagctgaccctgaacttcagcgaggtgaagacagagaagaagaacagcagcccccccagcagtgacaagaccatcatcgcccccaaggtgaaggacaggacccacaacgtgacagagaaggtgacccaggtgctgagcctgggcgcagatgtgctgcctgagtacaagctgcagaccccccgcatcaacaagttcaccatcctgcactacagccccttcaaggctgtgtgggactggctgatcctgctgctggtgatctacacagccatcttcaccccctacagcgctgccttcctgctgaatgaccgggaggagcagaagagaagagaatgtggctacagctgcagccccctgaatgtggtggacctgattgtggacatcatgttcatcatcgacatcctgatcaacttccgcaccacctacgtgaaccagaatgaggaggtggtgtctgaccctgccaagatcgccatccactacttcaagggctggttcctgattgacatggtggccgccatcccctttgacctgctgatcttcggcagcggcagtgatgagaccaccaccctgattggcctgctgaagacagcccggctgctgcggctggtgcgggtggccaggaagctggaccgctacagtgaatatggagctgctgtgctgatgctgctgatgtgcatctttgccctgattgcccactggctggcctgcatctggtacgccatcggaaatgtggagcggccctacctgacagacaagattggctggctggacagcctgggccagcagatcggcaagcgctacaatgacagcgacagcagcagcggccccagcatcaaggacaagtatgtgacagccctgtacttcaccttcagcagcctgacctctgtgggctttggaaatgtgagccccaacaccaacagcgagaagatcttcagcatctgtgtgatgctgattggcagcctgatgtatgccagcatctttggaaatgtgtctgccatcatccagaggctgtacagcggcacagcccgctaccacatgcagatgctgcgggtgaaggagttcatccgcttccaccagatccccaaccccctgcggcagaggctggaggagtacttccagcacgcctggacctacaccaacggcatcgacatgaacatggtgctgaagggcttcccagaatgtctgcaggccgacatctgcctgcacctgaaccagaccctgctgcagaactgcaaggccttccggggggccagcaagggctgcctgcgggccctggccatgaagttcaagaccacccacgcccctcctggggacaccctggtgcactgtggagatgtgctgacagccctgtacttcctgagccggggcagcattgagatcctgaaggatgacatcgtggtggccatcctgggcaagaatgacatctttggagagatggtgcacctgtatgccaagccaggcaagagcaatgctgatgtgcgggccctgacctactgtgacctgcacaagatccagcgggaggacctgctggaggtgctggacatgtacccagagttcagtgaccacttcctgaccaacctggagctgaccttcaacctgcggcatgaaagtgccaaggctgacctgctgcggagccagagcatgaatgattctgagggggacaactgcaagctgcggcggaggaagctgagctttgaaagtgaaggagagaaggagaacagcaccaatgaccctgaagattctgctgacaccatccgccactaccagagcagcaagaggcactttgaggagaagaagagccgcagcagcagcttcatcagcagcattgatgatgagcagaagcccctcttcagcggcatcgtggacagcagccctggcatcggcaaggccagcggcctggactttgaggagaccgtgcccaccagcggccgcatgcacatcgacaagaggagccacagctgcaaggacatcacagacatgaggtcctgggagcgggagaatgcccacccccagcctgaggacagcagccccagcgccctgcagagagctgcctggggcatcagcgagacagaaagtgacctgacctacggggaggtggagcagaggctggacctgctgcaggagcagctgaaccggctggagagccagatgaccacagacatccagaccatcctgcagctgctgcagaagcagaccaccgtggtgcccccagcctacagcatggtgacagctggcagcgagtaccagaggcccatcatccagctgatgaggaccagccagcctgaggccagcatcaagacagacaggagcttcagccccagcagccagtgcccagagttcctggacctggagaagagcaagctgaagagcaaggagagcctgagcagcggcgtgcacctgaacacagccagcgaggacaacctgaccagcctgctgaagcaggacagcgacctgagcctggagctgcacctgcggcagaggaagacctacgtgcaccccatccgccaccccagcctgcctgacagcagcctgagcacagtgggcatcgtgggcctgcacagacatgtgtctgaccccggcctgcccgggaagtag

SEQ ID NO: 165017 - DNA, 1755 bp, Artificial Sequence
  Description of Artificial Sequence: Synthetic coding sequence
atggtggccgaggtgtgcagcatgcccacagccagcacagtgaagaagccctttgacctgcggagcaagatgggcaagtggtgccaccaccgcttcccctgctgccggggcagcggcaagagcaacatgggcaccagcggggaccatgatgacagcttcatgaagatgctgcggagcaagatgggcaagtgctgccgccactgcttcccctgctgccggggcagcggcaccagcaatgtgggcaccagcggggaccatgaaaattccttcatgaagatgctgcggagcaagatgggcaagtggtgctgccactgcttcccctgctgccggggcagcggcaagagcaatgtgggcgcctggggagactatgaccacagcgccttcatggagccccgctaccacatccggcgggaggacctggacaagctgcaccgggccgcctggtggggcaaggtgcccaggaaggacctgattgtgatgctgcgggacacagacatgaacaagagggacaaggagaagaggacagccctgcacctggccagcgccaatggaaacagcgaggtggtgcagctgctgctggaccggcgctgccagctgaatgtgctggacaacaagaagaggacagccctgatcaaggccatccagtgccaggaggatgaatgtgtgctgatgctgctggagcacggggctgacaggaacatcccagatgaatatggcaacacagccctgcactacgccatctacaatgaagacaagctgatggccaaggccctgctgctgtatggagctgacatcgagagcaagaacaagtgtggcctgacccccctgctgctgggcgtgcatgagcagaagcagcaggtggtgaagttcctgatcaagaagaaggccaacctgaatgtgctggacagatatggccgcacagccctgatcctggccgtgtgctgcggcagcgccagcatcgtgaacctgctgctggagcagaatgtggatgtgagcagccaggacctgagcggccagacagcccgggagtatgctgtgagcagccaccaccacgtgatctgtgagctgctgagtgactacaaggagaagcagatgctgaagatcagcagcgagaacagcaaccctgagcaggacctgaagctgaccagcgaggaggagagccagaggctgaaggtgtctgagaacagccagcctgagaagatgagccaggagcctgagatcaacaaggactgtgaccgggaggtggaggaggagatcaagaagcacggcagcaaccctgtgggcctgcctgagaacctgaccaatggagccagcgctggaaatggagatgatggcctcatcccccagaggaggagcaggaagccagagaaccagcagttcccagacacagaaaatgaggagtaccacagtgatgagcagaatgacaccaggaagcagctgtctgaggagcagaacacaggcatcagccaggatgagatcctgaccaacaagcagaagcagatcgaggtggccgagcagaagatgaacagcgagctgagcctgagccacaagaaggaggaggacctgctgagagaaaattctgtgctgcaggaggagatcgccatgctgcggctggagctggatgagaccaagcaccagaaccagctgcgggagaacaagatcctggaggagattgagagcgtgaaggagaagacagacaagctgctgcgggccatgcagctgaatgaggaggccctgaccaagaccaacatctag

SEQ ID NO: 165018 - DNA, 1638 bp, Artificial Sequence
  Description of Artificial Sequence: Synthetic coding sequence
atggtggccgaggccggctccatgcctgctgccagctctgtgaagaagcccttcggcctgcggagcaagatgggcaagtggtgccgccactgctttgcctggtgccggggcagcggcaagagcaatgtgggcaccagcggggaccatgatgacagcgccatgaagaccctgcggagcaagatgggcaagtggtgctgccactgcttcccctggtgccggggcagcggcaagagcaatgtgggcaccagcggggaccatgatgattctgccatgaagaccctgcggagcaagatgggcaagtggtgctgccactgcttcccctgctgccggggcagcggcaagagcaatgtgggcaccagcggggaccatgatgacagcgccatgaagaccctgcggagcaagatgggcaagtggtgctgccactgcttcccctgctgccggggcagcggcaagaacaaggtgggcccctggggagactatgatgattctgccttcatggagccccgctaccacgtgagaagagaggacctggacaagctgcacagagctgcctggtggggcaaggtgcccaggaaggacctgattgtgatgctgaaggacacagacatgaacaagaaggacaagcagaagaggacagccctgcacctggccagcgccaacggcaacagcgaggtggtgaagctgctgctggaccggcgctgccagctgaacatcctggacaacaagaagaggacagccctgaccaaggctgtgcagtgccaggaggatgaatgtgccctgatgctgctggagcacggcacagaccccaacatcccagatgaatatggcaacacagccctgcactacgccatctacaatgaagacaagctgatggccaaggccctgctgctgtatggagctgacatcgagagcaagaacaagcacggcctgacccccctgctgctgggcgtgcatgagcagaagcagcaggtggtgaagttcctgatcaagaagaaggccaacctgaatgccctggacagatatggccgcacagccctgatcctggccgtgtgctgcggcagcgccagcatcgtgtccctgctgctggagcagaacattgatgtgagcagccaggacctgagcggccagacagcccgggagtatgctgtgagcagccgccacaacgtcatctgccagctgctgagtgactacaaggagaagcagatcctgaaggtgtcctctgagaacagcaaccctgagcaggacctgaagctgaccagcgaggaggagagccagaggctgaagggcagcgagaacagccagcctgaggagatgagccaggagcctgagatcaacaagggcggggacaggaaggtggaggaggagatgaagaagcacggcagcacccacatgggcttccctgagaacctgaccaacggggccacagctgacaatggagatgatggcctcatcccccccaggaagagcaggaccccagagagccagcagttcccagacacagaaaatgagcagtaccacagtgatgagcagaatgacacccagaagcagctgtctgaggagcagaacacaggcatcctgcaggatgagatcctgattcatgaggagaagcagatcgaggtggccgagaatgagttctag

SEQ ID NO: 165019 - DNA, 867 bp, Artificial Sequence
  Description of Artificial Sequence: Synthetic coding sequence
atggtggccgaggccggctccatgcctgctgccagctctgtgaagaagcccttcggcctgcggagcaagatgggcaagtggtgccgccactgctttgcctggtgccggggcagcggcaagagcaatgtgggcaccagcggggaccatgatgacagcgccatgaagaccctgcggagcaagatgggcaagtggtgctgccactgcttcccctggtgccggggcagcggcaagagcaatgtgggcaccagcggggaccatgatgattctgccatgaagaccctgcggagcaagatgggcaagtggtgctgccactgcttcccctgctgccggggcagcggcaagagcaatgtgggcaccagcggggaccatgatgacagcgccatgaagaccctgcggagcaagatgggcaagtggtgctgccactgcttcccctgctgccggggcagcggcaagaacaaggtgggcccctggggagactatgatgattctgccttcatggagccccgctaccacgtgagaagagaggacctggacaagctgcacagagctgcctggtggggcaaggtgcccaggaaggacctgattgtgatgctgaaggacacagacatgaacaagaaggacaagcagaagaggacagccctgcacctggccagcgccaacggcaacagcgaggtggtgaagctgctgctggaccggcgctgccagctgaacatcctggacaacaagaagaggacagccctgaccaaggctgtgcagtgccaggaggatgaatgtgccctgatgctgctggagcacggcacagaccccaacatcccagatgaatatggcaacacagccctgcactacgccatctacaatgaagattag

SEQ ID NO: 165020 - DNA, 1527 bp, Artificial Sequence
  Description of Artificial Sequence: Synthetic coding sequence
atggtggccgaggccggctccatgcctgctgccagctctgtgaagaagcccttcggcctgcggagcaagatgggcaagtggtgccgccactgctttgcctggtgccggggcagcggcaagagcaatgtgggcaccagcggggaccatgatgacagcgccatgaagaccctgcggagcaagatgggcaagtggtgctgccactgcttcccctggtgccggggcagcggcaagagcaatgtgggcaccagcggggaccatgatgattctgccatgaagaccctgcggagcaagatgggcaagtggtgctgccactgcttcccctgctgccggggcagcggcaagaacaaggtgggcccctggggagactatgatgacagcgccttcatggagccccgctaccacgtgcggcgggaggacctggacaagctgcaccgggccgcctggtggggcaaggtgcccaggaaggacctgattgtgatgctgaaggacacagacatgaacaagaaggacaagcagaagaggacagccctgcacctggccagcgccaatggaaacagcgaggtggtgaagctgctgctggaccggcgctgccagctgaacatcctggacaacaagaagaggacagccctgaccaaggctgtgcagtgccaggaggatgaatgtgccctgatgctgctggagcacggcacagaccccaacatcccagatgaatatggcaacacagccctgcactacgccatctacaatgaagacaagctgatggccaaggccctgctgctgtatggagctgacatcgagagcaagaacaagcacggcctgacccccctgctgctgggcgtgcatgagcagaagcagcaggtggtgaagttcctgatcaagaagaaggccaacctgaatgccctggacagatatggccgcacagccctgatcctggccgtgtgctgcggcagcgccagcatcgtgtccctgctgctggagcagaacattgatgtgagcagccaggacctgagcggccagacagcccgggagtatgctgtgagcagccgccacaacgtcatctgccagctgctgagtgactacaaggagaagcagatcctgaaggtgtcctctgagaacagcaaccctgagcaggacctgaagctgaccagcgaggaggagagccagaggctgaagggcagcgagaacagccagcctgaggagatgagccaggagcctgagatcaacaagggcggggacaggaaggtggaggaggagatgaagaagcacggcagcacccacatgggcttccctgagaacctgaccaatggagccacagctgacaatggagatgatggcctcatcccccccaggaagagcaggaccccagagagccagcagttcccagacacagaaaatgagcagtaccacagtgatgagcagaatgacacccagaagcagctgtctgaggagcagaacacaggcatcctgcaggatgagatcctgatccacgaggagaagcagatcgaggtggctgaaaatgagttctag

SEQ ID NO: 165021 - DNA, 954 bp, Artificial Sequence
  Description of Artificial Sequence: Synthetic coding sequence
atgagctgccaggccttcaccagcgctgacaccttcatccccctgaacagtgatgccagcgccaccctgcccctcatcatgcaccacagcgctgctgaatgtctgcctgtgagcaaccacgccaccaacgtgatgagcacagtgcccagcatcctgagcctcatccagacccccaagtgcctgtgcacccacttctctgtgaccaccctgggcaacacagccaccggcctgcactacagcgtgcccagctgccactacggcaaccagcccagcacctatggagtgatggccggcagcctgaccccctgcctgtacaagttcccagaccacaccctgagccacggcttcccccccatccaccagcccctgctggccgaggaccccacagctgctgacttcaagcaggagctgcggaggaagagcaagctggtggaggagcccatcgacatggacagccctgagatccgggagctggagaagtttgccaatgagttcaaggtgcggcgcatcaagctgggctacacccagaccaacgtgggggaggccctggccgctgtgcacggcagcgagttcagccagaccaccatctgccgctttgagaacctgcagctgtccttcaagaatgcctgcaagctgaaggccatcctgagcaagtggctggaggaggccgagcaggtgggcgccctgtacaatgagaaggtgggcgccaatgaaaggaagaggaagaggaggaccaccatcagcattgctgccaaggatgccctggagcggcactttggagagcagaacaagcccagcagccaggagatcatgaggatggccgaggagctgaacctggagaaggaggtggtgcgggtgtggttctgcaacagacggcagcgggagaagagggtgaagaccagcctgaaccagagcctcttcagcatcagcaaggagcacctggagtgcaggtag

SEQ ID NO: 165022 - DNA, 876 bp, Artificial Sequence
  Description of Artificial Sequence: Synthetic coding sequence
atgagctgccaggccttcaccagcgctgacaccttcatccccctgaacagtgatgccagcgccaccctgcccctcatcatgcaccacagcgctgctgaatgtctgcctgtgagcaaccacgccaccaacgtgatgagcacagccaccggcctgcactacagcgtgcccagctgccactacggcaaccagcccagcacctatggagtgatggccggcagcctgaccccctgcctgtacaagttcccagaccacaccctgagccacggcttcccccccatccaccagcccctgctggccgaggaccccacagctgctgacttcaagcaggagctgcggaggaagagcaagctggtggaggagcccatcgacatggacagccctgagatccgggagctggagaagtttgccaatgagttcaaggtgcggcgcatcaagctgggctacacccagaccaacgtgggggaggccctggccgctgtgcacggcagcgagttcagccagaccaccatctgccgctttgagaacctgcagctgtccttcaagaatgcctgcaagctgaaggccatcctgagcaagtggctggaggaggccgagcaggtgggcgccctgtacaatgagaaggtgggcgccaatgaaaggaagaggaagaggaggaccaccatcagcattgctgccaaggatgccctggagcggcactttggagagcagaacaagcccagcagccaggagatcatgaggatggccgaggagctgaacctggagaaggaggtggtgcgggtgtggttctgcaacagacggcagcgggagaagagggtgaagaccagcctgaaccagagcctcttcagcatcagcaaggagcacctggagtgcaggtag

SEQ ID NO: 165023 - DNA, 771 bp, Artificial Sequence
  Description of Artificial Sequence: Synthetic coding sequence
atgctgtggcagaagcccacagcccctgagcaggccccagccccagcccggccctaccagggcgtgcgggtgaaggagcctgtgaaggagctgctgcggaggaagaggggccacgccagcagtggagctgccccagcccccacagctgtggtgctgccccaccagcccctggccacctacaccaccgtgggccccagctgcctggacatggagggctctgtgtctgctgtgacagaggaggccgccctgtgtgccggctggctgagccagcccaccccagccaccctgcagcccctggccccctggaccccctacacagaatatgtgccccatgaagctgtgtcctgcccctacagcgctgacatgtatgtgcagcctgtgtgccccagctacacagtggtgggccccagctctgtgctgacctacgccagccccccactcatcaccaacgtgaccaccaggagcagcgccaccccagctgtgggcccccccctggagggccctgagcaccaggcccccctgacctacttcccctggccccagcccctgagcaccctgcccaccagcaccctgcagtaccagcccccagccccagccctgcccggcccccagtttgtgcagctgcccatcagcatccctgagcctgtgctgcaggacatggaggacccccggcgggccgccagcagcctgaccatcgacaagctgctgctggaggaggaggacagtgatgcctatgccctgaaccacaccctgtctgtggagggcttctag

SEQ ID NO: 165024 - DNA, 1440 bp, Artificial Sequence
  Description of Artificial Sequence: Synthetic coding sequence
atggtgcacagctccatgggcgcccctgagatccgcatgagcaagcccctggaggccgagaagcagggcctggacagccccagcgagcacacagacacagaaagaaatggaccagacaccaaccaccagaacccccagaacaagaccagccccttctctgtgagccccaccggccccagcaccaagatcaaggccgaggaccccagcggggacagcgccccagctgcccccctgcccccccagcctgcccagccccacctgccccaggcccagctgatgctgaccggcagccagctggccggggacatccagcagctgctgcagctgcagcagctggtgctggtgcccggccaccacctgcagcccccagcccagttcctgctgccccaggcccagcagagccagcccggcctgctgcccacccccaacctcttccagctgccccagcagacccagggcgccctgctgaccagccagccccgggccggcctgcccacccaggccgtgacccggcccaccctgcctgacccccacctgagccacccccagccccccaagtgcctggagccccccagccaccctgaggagcccagcgacctggaggagctggagcagtttgcccggaccttcaagcagaggcgcatcaagctgggcttcacccagggagatgtgggcctggccatgggcaagctgtatggaaatgacttcagccagaccaccatcagcagatttgaggccctgaacctgtccttcaagaacatgtgcaagctgaagcccctgctggagaagtggctgaatgatgctgagaccatgtctgtggacagcagcctgcccagccccaaccagctgagcagccccagcctgggctttgatggcctgcccggcagaagaaggaagaagaggaccagcattgagaccaacgtgcgctttgccctggagaagagcttcctggccaaccagaagcccaccagcgaggagatcctgctgattgctgagcagctgcacatggagaaggaggtgatccgggtgtggttctgcaacagacggcagaaggagaagaggatcaacccctgcagcgctgcccccatgctgcccagccctgggaagccagccagctacagcccccacatggtgaccccccagggcggggccggcaccctgcccctgagccaggccagcagcagcctgagcaccaccgtgaccaccctgagcagcgctgtgggcaccctgcaccccagcaggacagctgggggcggcggcggcggcggcggggccgccccacccctgaacagcatccccagcgtgaccccacctcctccagccaccaccaacagcaccaaccccagcccccagggcagccacagcgccatcggcctgagcggcctgaaccccagcacaggccctggcctgtggtggaacccagccccctaccagccctag

SEQ ID NO: 165025 - DNA, 1809 bp, Artificial Sequence
  Description of Artificial Sequence: Synthetic coding sequence
atggtgcacagctccatgggcgcccctgagatccgcatgagcaagcccctggaggccgagaagcagggcctggacagccccagcgagcacacagacacagaaagaaatggaccagacaccaaccaccagaacccccagaacaagaccagccccttctctgtgagccccaccggccccagcaccaagatcaaggccgaggaccccagcggggacagcgccccagctgcccccctgcccccccagcctgcccagccccacctgccccaggcccagctgatgctgaccggcagccagctggccggggacatccagcagctgctgcagctgcagcagctggtgctggtgcccggccaccacctgcagcccccagcccagttcctgctgccccaggcccagcagagccagcccggcctgctgcccacccccaacctcttccagctgccccagcagacccagggcgccctgctgaccagccagccccgggccggcctgcccacccaggccgtgacccggcccaccctgcctgacccccacctgagccacccccagccccccaagtgcctggagccccccagccaccctgaggagcccagcgacctggaggagctggagcagtttgcccggaccttcaagcagaggcgcatcaagctgggcttcacccagggagatgtgggcctggccatgggcaagctgtatggaaatgacttcagccagaccaccatcagcagatttgaggccctgaacctgtccttcaagaacatgtgcaagctgaagcccctgctggagaagtggctgaatgatgctgagaccatgtctgtggacagcagcctgcccagccccaaccagctgagcagccccagcctgggctttgatggcctgcccggcagaagaaggaagaagaggaccagcattgagaccaacgtgcgctttgccctggagaagagcttcctggccaaccagaagcccaccagcgaggagatcctgctgattgctgagcagctgcacatggagaaggaggtgatccgggtgtggttctgcaacagacggcagaaggagaagaggatcaacccctgcagcgctgcccccatgctgcccagccctgggaagccagccagctacagcccccacatggtgaccccccagggcggggccggcaccctgcccctgagccaggccagcagcagcctgagcaccaccgtgaccaccctgagcagcgctgtgggcaccctgcaccccagcaggacagctgggggcggcggcggcggcggcggggccgccccacccctgaacagcatccccagcgtgaccccacctcctccagccaccaccaacagcaccaaccccagcccccagggcagccacagcgccatcggcctgagcggcctgaaccccagcacaggcagcaccatggtgggcctgagcagcggcctgagccctgccctgatgagcaacaaccccctggccaccatccaggccctggccagcggcggcaccctgcccctgaccagcctggatggcagcggcaacctggtgctgggcgctgctggagctgcccctggcagccctggcctggtgaccagccccctcttcctgaaccacgccggcctgcccctgctgagcaccccacctggggtgggcctggtgtctgctgctgctgctgctgtggccgccagcatcagcagcaagagccctggcctgagcagcagcagcagcagcagcagcagcagcagcagcagcacctgcagcgagacagctgcccagaccccaggcggccctgggggccctgaggccggcagcaagccagagtag

SEQ ID NO: 165026 - DNA, 1392 bp, Artificial Sequence
  Description of Artificial Sequence: Synthetic coding sequence
atggtgcacagctccatgggcgcccctgagatccgcatgagcaagcccctggaggccgagaagcagggcctggacagccccagcgagcacacagacacagaaagaaatggaccagacaccaaccaccagaacccccagaacaagaccagccccttctctgtgagccccaccggccccagcaccaagatcaaggccgaggaccccagcggggacagcgccccagctgcccccctgcccccccagcctgcccagccccacctgccccaggcccagctgatgctgaccggcagccagctggccggggacatccagcagctgctgcagctgcagcagctggtgctggtgcccggccaccacctgcagcccccagcccagttcctgctgccccaggcccagcagagccagcccggcctgctgcccacccccaacctcttccagctgccccagcagacccagggcgccctgctgaccagccagccccgggccggcctgcccacccagccccccaagtgcctggagccccccagccaccctgaggagcccagcgacctggaggagctggagcagtttgcccggaccttcaagcagaggcgcatcaagctgggcttcacccagggagatgtgggcctggccatgggcaagctgtatggaaatgacttcagccagaccaccatcagcagatttgaggccctgaacctgtccttcaagaacatgtgcaagctgaagcccctgctggagaagtggctgaatgatgctgagaccatgtctgtggacagcagcctgcccagccccaaccagctgagcagccccagcctgggctttgatggcctgcccggcagaagaaggaagaagaggaccagcattgagaccaacgtgcgctttgccctggagaagagcttcctggccaaccagaagcccaccagcgaggagatcctgctgattgctgagcagctgcacatggagaaggaggtgatccgggtgtggttctgcaacagacggcagaaggagaagaggatcaacccctgcagcgctgcccccatgctgcccagccctgggaagccagccagctacagcccccacatggtgaccccccagggcggggccggcaccctgcccctgagccaggccagcagcagcctgagcaccaccgtgaccaccctgagcagcgctgtgggcaccctgcaccccagcaggacagctgggggcggcggcggcggcggcggggccgccccacccctgaacagcatccccagcgtgaccccacctcctccagccaccaccaacagcaccaaccccagcccccagggcagccacagcgccatcggcctgagcggcctgaaccccagcacaggccctggcctgtggtggaacccagccccctaccagccctag

SEQ ID NO: 165027 - DNA, 1425 bp, Artificial Sequence
  Description of Artificial Sequence: Synthetic coding sequence
atgggcgcccctgagatccgcatgagcaagcccctggaggccgagaagcagggcctggacagccccagcgagcacacagacacagaaagaaatggaccagacaccaaccaccagaacccccagaacaagaccagccccttctctgtgagccccaccggccccagcaccaagatcaaggccgaggaccccagcggggacagcgccccagctgcccccctgcccccccagcctgcccagccccacctgccccaggcccagctgatgctgaccggcagccagctggccggggacatccagcagctgctgcagctgcagcagctggtgctggtgcccggccaccacctgcagcccccagcccagttcctgctgccccaggcccagcagagccagcccggcctgctgcccacccccaacctcttccagctgccccagcagacccagggcgccctgctgaccagccagcccagggctggcctgcccacccaggccgtgacccggcccaccctgcctgacccccacctgagccacccccagccccccaagtgcctggagccccccagccaccctgaggagcccagcgacctggaggagctggagcagtttgcccggaccttcaagcagaggcgcatcaagctgggcttcacccagggagatgtgggcctggccatgggcaagctgtatggaaatgacttcagccagaccaccatcagcagatttgaggccctgaacctgtccttcaagaacatgtgcaagctgaagcccctgctggagaagtggctgaatgatgctgagaccatgtctgtggacagcagcctgcccagccccaaccagctgagcagccccagcctgggctttgatggcctgcctggaagaagaaggaagaagaggaccagcattgagaccaacgtgcgctttgccctggagaagagcttcctggccaaccagaagcccaccagcgaggagatcctgctgattgctgagcagctgcacatggagaaggaggtgatccgggtgtggttctgcaacagacggcagaaggagaagaggatcaacccctgcagcgctgcccccatgctgcccagccctgggaagccagccagctacagcccccacatggtgaccccccagggcggggccggcaccctgcccctgagccaggccagcagcagcctgagcaccaccgtgaccaccctgagcagcgctgtgggcaccctgcaccccagcaggacagctgggggcggcggcggcggcggcggggccgccccacccctgaacagcatccccagcgtgaccccacctcctccagccaccaccaacagcaccaaccccagcccccagggcagccacagcgccatcggcctgagcggcctgaaccccagcactggacctggcctgtggtggaacccagccccctaccagccctag

SEQ ID NO: 165028 - DNA, 1203 bp, Artificial Sequence
  Description of Artificial Sequence: Synthetic coding sequence
atggtgcacagctccatgggcgcccctgagatccgcatgagcaagcccctggaggccgagaagcagggcctggacagccccagcgagcacacagacacagaaagaaatggaccagacaccaaccaccagaacccccagaacaagaccagccccttctctgtgagccccaccggccccagcaccaagatcaaggccgaggaccccagcggggacagcgccccagctgcccccctgcccccccagcctgcccagccccacctgccccaggcccagctgatgctgaccggcagccagctggccggggacatccagcagctgctgcagctgcagcagctggtgctggtgcccggccaccacctgcagcccccagcccagttcctgctgccccaggcccagcagagccagcccggcctgctgcccacccccaacctcttccagctgccccagcagacccagggcgccctgctgaccagccagccccgggccggcctgcccacccagccccccaagtgcctggagccccccagccaccctgaggagcccagcgacctggaggagctggagcagtttgcccggaccttcaagcagaggcgcatcaagctgggcttcacccagggagatgtgggcctggccatgggcaagctgtatggaaatgacttcagccagaccaccatcagcagatttgaggccctgaacctgtccttcaagaacatgtgcaagctgaagcccctgctggagaagtggctgaatgatgctgagaccatgtctgtggacagcagcctgcccagccccaaccagctgagcagccccagcctgggctttgatggcctgcccggcagaagaaggaagaagaggaccagcattgagaccaacgtgcgctttgccctggagaagagcttcctggccaaccagaagcccaccagcgaggagatcctgctgattgctgagcagctgcacatggagaaggaggtgatccgggtgtggttctgcaacagacggcagaaggagaagaggatcaacccctgcagcgctgcccccatgctgcccagccctgggaagccagccagctacagcccccacatggtgaccccccagggcggggccggcaccctgcccctgagccaggccagcagcagcctgagcaccacagcccagaccccagccctgaaggccgccacccggctgagcgcctgccaggcctag

SEQ ID NO: 165029 - DNA, 1404 bp, Artificial Sequence
  Description of Artificial Sequence: Synthetic coding sequence
atggtgcacagctccatgggcgcccctgagatccgcatgagcaagcccctggaggccgagaagcagggcctggacagccccagcgagcacacagacacagaaagaaatggaccagacaccaaccaccagaacccccagaacaagaccagccccttctctgtgagccccaccggccccagcaccaagatcaaggccgaggaccccagcggggacagcgccccagctgcccccctgcccccccagcctgcccagccccacctgccccaggcccagctgatgctgaccggcagccagctggccggggacatccagcagctgctgcagctgcagcagctggtgctggtgcccggccaccacctgcagcccccagcccagttcctgctgccccaggcccagcagagccagcccggcctgctgcccacccccaacctcttccagctgccccagcagacccagggcgccctgctgaccagccagccccgggccggcctgcccacccaggccgtgacccggcccaccctgcctgacccccacctgagccacccccagccccccaagtgcctggagccccccagccaccctgaggagcccagcgacctggaggagctggagcagtttgcccggaccttcaagcagaggcgcatcaagctgggcttcacccagggagatgtgggcctggccatgggcaagctgtatggaaatgacttcagccagaccaccatcagcagatttgaggccctgaacctgtccttcaagaacatgtgcaagctgaagcccctgctggagaagtggctgaatgatgctgagaccatgtctgtggacagcagcctgcccagccccaaccagctgagcagccccagcctgggctttgatggcctgcccggcagaagaaggaagaagaggaccagcattgagaccaacgtgcgctttgccctggagaagagcttcctggccaaccagaagcccaccagcgaggagatcctgctgattgctgagcagctgcacatggagaaggaggtgatccgggtgtggttctgcaacagacggcagaaggagaagaggatcaacccctgcagcgctgcccccatgctgcccagccctgggaagccagccagctacagcccccacatggtgaccccccagggcggggccggcaccctgcccctgagccaggccagcagcagcctgagcaccaccgtgaccaccctgagcagcgctgtgggcaccctgcaccccagcaggacagctgggggcggcggcggcggcggcggggccgccccacccctgaacagcatccccagcgtgaccccacctcctccagccaccaccaacagcaccaaccccagcccccagggcagccacagcgccatcggcctgagcggcctgaaccccagcactggatag

SEQ ID NO: 165030 - DNA, 1761 bp, Artificial Sequence
  Description of Artificial Sequence: Synthetic coding sequence
atggtgcacagctccatgggcgcccctgagatccgcatgagcaagcccctggaggccgagaagcagggcctggacagccccagcgagcacacagacacagaaagaaatggaccagacaccaaccaccagaacccccagaacaagaccagccccttctctgtgagccccaccggccccagcaccaagatcaaggccgaggaccccagcggggacagcgccccagctgcccccctgcccccccagcctgcccagccccacctgccccaggcccagctgatgctgaccggcagccagctggccggggacatccagcagctgctgcagctgcagcagctggtgctggtgcccggccaccacctgcagcccccagcccagttcctgctgccccaggcccagcagagccagcccggcctgctgcccacccccaacctcttccagctgccccagcagacccagggcgccctgctgaccagccagccccgggccggcctgcccacccagccccccaagtgcctggagccccccagccaccctgaggagcccagcgacctggaggagctggagcagtttgcccggaccttcaagcagaggcgcatcaagctgggcttcacccagggagatgtgggcctggccatgggcaagctgtatggaaatgacttcagccagaccaccatcagcagatttgaggccctgaacctgtccttcaagaacatgtgcaagctgaagcccctgctggagaagtggctgaatgatgctgagaccatgtctgtggacagcagcctgcccagccccaaccagctgagcagccccagcctgggctttgatggcctgcccggcagaagaaggaagaagaggaccagcattgagaccaacgtgcgctttgccctggagaagagcttcctggccaaccagaagcccaccagcgaggagatcctgctgattgctgagcagctgcacatggagaaggaggtgatccgggtgtggttctgcaacagacggcagaaggagaagaggatcaacccctgcagcgctgcccccatgctgcccagccctgggaagccagccagctacagcccccacatggtgaccccccagggcggggccggcaccctgcccctgagccaggccagcagcagcctgagcaccaccgtgaccaccctgagcagcgctgtgggcaccctgcaccccagcaggacagctgggggcggcggcggcggcggcggggccgccccacccctgaacagcatccccagcgtgaccccacctcctccagccaccaccaacagcaccaaccccagcccccagggcagccacagcgccatcggcctgagcggcctgaaccccagcacaggcagcaccatggtgggcctgagcagcggcctgagccctgccctgatgagcaacaaccccctggccaccatccaggccctggccagcggcggcaccctgcccctgaccagcctggatggcagcggcaacctggtgctgggcgctgctggagctgcccctggcagccctggcctggtgaccagccccctcttcctgaaccacgccggcctgcccctgctgagcaccccacctggggtgggcctggtgtctgctgctgctgctgctgtggccgccagcatcagcagcaagagccctggcctgagcagcagcagcagcagcagcagcagcagcagcagcagcacctgcagcgagacagctgcccagaccccaggcggccctgggggccctgaggccggcagcaagccagagtag

SEQ ID NO: 165031 - DNA, 1311 bp, Artificial Sequence
  Description of Artificial Sequence: Synthetic coding sequence
atggtgaacctggagagcatgcacacagacatcaagatgtctggagatgtggccgacagcacagatgcccggagcaccctgagccaggtggagcctggaaatgacagaaatggcctggacttcaaccggcagatcaagacagaggacctgagtgacagcctgcagcagaccctgagccaccggccctgccacctgagccagggccctgccatgatgagcggcaaccagatgagcggcctgaatgccagcccctgccaggacatggccagcctgcaccccctgcagcagctggtgctggtgcccggccacctgcagagcgtgtcccagttcctgctgagccagacccagcccggccagcagggcctgcagcccaacctgctgcccttcccccagcagcagagcggcctgctgctgccccagacaggccctggcctggccagccaggccttcggccaccctggcctgcccggcagcagcctggagccccacctggaggccagccagcacctgcctgtgcccaagcacctgcccagcagtggaggagcagatgagcccagcgacctggaggagctggagaagtttgccaagaccttcaagcagaggcgcatcaagctgggcttcacccagggagatgtgggcctggccatgggcaagctgtatggaaatgacttcagccagaccaccatcagcagatttgaggccctgaacctgtccttcaagaacatgtgcaagctgaagcccctgctggagaagtggctgaatgatgctgagagcagccccagcgaccccagcgtgtccacccccagcagctaccccagcctgtctgaggtgtttggaaggaagaggaagaagaggaccagcattgagaccaacatccggctgaccctggagaagcgcttccaggacaaccccaagcccagcagcgaggagatctccatgattgctgagcagctgtccatggagaaggaggtggtgcgggtgtggttctgcaacagacggcagaaggagaagaggatcaactgccctgtggccacccccatcaagccccctgtgtacaacagccggctggtgagccccagcggcagcctgggccccctgtctgtgccccctgtgcacagcaccatgcctggcaccgtgaccagcagctgcagccctggcaacaacagccggcccagcagccctggcagcggcctgcacgccagcagccccacagccagccagaacaacagcaaggctgctgtgaacagcgccagcagcttcaacagcagcggctcctggtaccgctggaaccacagcacctacctgcactag

SEQ ID NO: 165032 - DNA, 1317 bp, Artificial Sequence
  Description of Artificial Sequence: Synthetic coding sequence
atggagagccccaggacagccaagggcggccgggacatcaagatgtctggagatgtggccgacagcacagatgcccggagcaccctgagccaggtggagcctggaaatgacagaaatggcctggacttcaaccggcagatcaagacagaggacctgagtgacagcctgcagcagaccctgagccaccggccctgccacctgagccagggccctgccatgatgagcggcaaccagatgagcggcctgaatgccagcccctgccaggacatggccagcctgcaccccctgcagcagctggtgctggtgcccggccacctgcagagcgtgtcccagttcctgctgagccagacccagcccggccagcagggcctgcagcccaacctgctgcccttcccccagcagcagagcggcctgctgctgccccagacaggccctggcctggccagccaggccttcggccaccctggcctgcccggcagcagcctggagccccacctggaggccagccagcacctgcctgtgcccaagcacctgcccagcagtggaggagcagatgagcccagcgacctggaggagctggagaagtttgccaagaccttcaagcagaggcgcatcaagctgggcttcacccagggagatgtgggcctggccatgggcaagctgtatggaaatgacttcagccagaccaccatcagcagatttgaggccctgaacctgtccttcaagaacatgtgcaagctgaagcccctgctggagaagtggctgaatgatgctgagagcagccccagcgaccccagcgtgtccacccccagcagctaccccagcctgtctgaggtgtttggaaggaagaggaagaagaggaccagcattgagaccaacatccggctgaccctggagaagcgcttccaggacaaccccaagcccagcagcgaggagatctccatgattgctgagcagctgtccatggagaaggaggtggtgcgggtgtggttctgcaacagacggcagaaggagaagaggatcaactgccctgtggccacccccatcaagccccctgtgtacaacagccggctggtgagccccagcggcagcctgggccccctgtctgtgccccctgtgcacagcaccatgcctggcaccgtgaccagcagctgcagccctggcaacaacagccggcccagcagccctggcagcggcctgcacgccagcagccccacagccagccagaacaacagcaaggctgctgtgaacagcgccagcagcttcaacagcagcggctcctggtaccgctggaaccacagcacctacctgcactag

SEQ ID NO: 165033 - DNA, 1356 bp, Artificial Sequence
  Description of Artificial Sequence: Synthetic coding sequence
atggccaccacagcccagtacctgccccggggccctgggggcggggccggcggcaccggccccctgatgcacccagatgctgctgctgctgctgctgctgctgctgctgctgagcggctgcacgccggggccgcctaccgggaggtgcagaagctgatgcaccacgagtggctgggcgctggggccggccaccctgtgggcctggcccacccccagtggctgcccaccggcggcggcggcggcggggactgggccggcggcccccacctggagcacggcaaggccggcggcggcggcaccggccgggcagatgatggcggcggcggcggcggcttccacgcccggctggtgcaccagggcgccgcccacgccggggccgcctgggcccagggcagcacagcccaccacctgggccctgccatgagccccagccctggggccagcggcggccaccagccccagcccctgggcctgtatgcccaggccgcctacccaggcggcggcggcggcggcctggccggcatgctggccgccggcggcggcggggccggccctggcctgcaccacgccctgcatgaagatggccacgaggcccagctggagcccagccccccaccccacctgggcgcccacggccacgcccacggccacgcccacgccggcggcctgcatgctgctgctgcccacctgcaccctggggccggcggcggcggcagctctgtgggggagcacagtgatgaagatgcccccagcagtgatgacctggagcagtttgccaagcagttcaagcagaggcgcatcaagctgggcttcacccaggctgatgtgggcctggccctgggcaccctgtatggaaatgtgttcagccagaccaccatctgccgctttgaggccctgcagctgtccttcaagaacatgtgcaagctgaagcccctgctgaacaagtggctggaggagacagacagcagcagcggcagccccaccaacctggacaagattgctgcccagggcaggaagaggaagaagaggaccagcattgaggtgggcgtgaagggggccctggagagccacttcctgaagtgccccaagcccagcgcccacgagatcaccggcctggccgacagcctgcagctggagaaggaggtggtgcgggtgtggttctgcaacagacggcagaaggagaagaggatgaccccagctgctggagctggccacccccccatggatgatgtgtatgcccctggagagctgggccctgggggcggcggggccagcccccccagcgcccctcctcctcctcctcctgctgccctgcaccaccaccaccaccacaccctgcccggctctgtgcagtag

SEQ ID NO: 165034 - DNA, 1332 bp, Artificial Sequence
  Description of Artificial Sequence: Synthetic coding sequence
atggccacagctgccagcaaccactacagcctgctgaccagcagcgccagcatcgtgcatgctgagcccccaggcggcatgcagcagggcgccggcggctaccgggaggcccagagcctggtgcagggcgactatggagccctgcagagcaatggccaccccctgagccacgcccaccagtggatcacagccctgagccatggaggcggcggcggcggcggcggcggcggcggcggcggcggcggcggcggcggcggcggcggagatggcagcccctggagcaccagccccctgggccagcctgacatcaagcccagcgtggtggtgcagcagggcggcagaggagatgagctgcacggccctggggccctgcagcagcagcaccagcagcagcagcagcagcagcagcagcagcagcagcagcagcagcagcagcagcagcagcagaggcctccccacctggtgcaccacgccgccaaccaccaccctggccctggggcctggaggtctgctgctgctgctgcccacctgccccccagcatgggcgccagcaatggaggcctgctgtacagccagcccagcttcaccgtgaatggcatgctgggcgccggcggccagcctgctggcctgcaccaccacggcctgagagatgcccatgatgagccccaccacgccgaccaccacccccacccccacagccacccccaccagcagcccccacctcctcctccaccccagggccccccaggccaccctggggcccaccacgacccccacagtgatgaggacacccccaccagtgatgacctggagcagtttgccaagcagttcaagcagaggcgcatcaagctgggcttcacccaggctgatgtgggcctggccctgggcaccctgtatggaaatgtgttcagccagaccaccatctgccgctttgaggccctgcagctgtccttcaagaacatgtgcaagctgaagcccctgctgaacaagtggctggaggaggccgacagcagcagcggcagccccaccagcattgacaagattgctgcccagggcaggaagaggaagaagaggaccagcattgaggtgtctgtgaagggggccctggagagccacttcctgaagtgccccaagcccagcgcccaggagatcaccagcctggccgacagcctgcagctggagaaggaggtggtgcgggtgtggttctgcaacagacggcagaaggagaagaggatgaccccacctgggggcaccctgcccggggctgaagatgtgtatggaggcagccgggacaccccaccccaccacggcgtgcagacccctgtgcagtag

SEQ ID NO: 165035 - DNA, 1131 bp, Artificial Sequence
  Description of Artificial Sequence: Synthetic coding sequence
atggccacagctgccagcaaccactacagcctgctgaccagcagcgccagcatcgtgcatgctgagcccccaggcggcatgcagcagggcgccggcggctaccgggaggcccagagcctggtgcagggcgactatggagccctgcagagcaatggccaccccctgagccacgcccaccagtggatcacagccctgagccatggaggagatggcagcccctggagcaccagccccctgggccagcctgacatcaagcccagcgtggtggtgcagcagggcggcagaggagatgagctgcacggccctggggccctgcagcagcagcaccagcagcagcagcagcagcagcagcagcagcagcagcagcagcagcagcagcagcagcagcagaggcctccccacctggtgcaccacgccgccaaccaccaccctggccctggggcctggaggtctgctgctgctgctgcccacctgcccccatccatgggcgccagcaatggaggcctgctgtacagccagcccccacctccaccccagggccccccaggccaccctggggcccaccacgacccccacagtgatgaggacacccccaccagtgatgacctggagcagtttgccaagcagttcaagcagaggcgcatcaagctgggcttcacccaggctgatgtgggcctggccctgggcaccctgtatggaaatgtgttcagccagaccaccatctgccgctttgaggccctgcagctgtccttcaagaacatgtgcaagctgaagcccctgctgaacaagtggctggaggaggccgacagcagcagcggcagccccaccagcattgacaagattgctgcccagggcaggaagaggaagaagaggaccagcattgaggtgtctgtgaagggggccctggagagccacttcctgaagtgccccaagcccagcgcccaggagatcaccagcctggccgacagcctgcagctggagaaggaggtggtgcgggtgtggttctgcaacagacggcagaaggagaagaggatgaccccacctgggggcaccctgcctggagcagaagatgtgtatggaggcagccgggacaccccaccccaccacggcgtgcagacccctgtgcagtag

SEQ ID NO: 165036 - DNA, 1503 bp, Artificial Sequence
  Description of Artificial Sequence: Synthetic coding sequence
atggccacagctgccagcaacccctacctgcccggcaacagcctgctggccgccggcagcatcgtgcacagtgatgctgctggagctgggggcggcggcggcggcggcggcggcggcggcggcggcggggccggcggcggcggcggcggcatgcagcccggcagcgctgctgtgaccagcggggcctacagaggagaccccagctctgtgaagatggtgcagagcgacttcatgcagggcgccatggccgccagcaatggaggccacatgctgagccacgcccaccagtgggtgacagccctgccccacgccgctgctgctgctgctgctgctgctgctgctgctgtggaggccagcagcccctggagcggcagcgctgtgggcatggccggcagcccccagcagcccccccagcccccacctcctccaccccagggcccagatgtgaagggcggggccggcagagatgacctgcacgccggcacagccctgcaccaccggggccccccccacctgggccccccacctcctccaccccaccagggccaccctgggggctggggcgctgctgctgctgctgctgctgctgctgctgctgctgctgctgctgcccacctgcccagcatggccggcggccagcagcccccaccccagagcctgctgtacagccagcccggcggcttcaccgtgaatggcatgctgagcgcccctcctggccctgggggcggcggcggcggggccggcggcggggcccagagcctggtgcaccctggcctggtgcggggggacaccccagagctggccgagcaccaccaccaccaccaccaccacgcccacccccaccccccccacccccaccacgcccagggccccccccaccacggcggcggcggcggcggggccggccctggcctgaacagccatgacccccacagtgatgaggacacccccaccagtgatgacctggagcagtttgccaagcagttcaagcagaggcgcatcaagctgggcttcacccaggctgatgtgggcctggccctgggcaccctgtatggaaatgtgttcagccagaccaccatctgccgctttgaggccctgcagctgtccttcaagaacatgtgcaagctgaagcccctgctgaacaagtggctggaggaggccgacagcagcacaggcagccccaccagcattgacaagattgctgcccagggcaggaagaggaagaagaggaccagcattgaggtgtctgtgaagggggccctggagagccacttcctgaagtgccccaagcccagcgcccaggagatcaccaacctggccgacagcctgcagctggagaaggaggtggtgcgggtgtggttctgcaacagacggcagaaggagaagaggatgaccccacctggcatccagcagcagaccccagatgatgtgtacagccaggtgggcaccgtgtctgctgacaccccaccaccccaccacggcctgcagacctctgtgcagtag

SEQ ID NO: 165037 - DNA, 1086 bp, Artificial Sequence
  Description of Artificial Sequence: Synthetic coding sequence
atggccacagctgccagcaacccctacagcatcctgagcagcaccagcctggtgcacgccgacagcgctggcatgcagcagggcagccccttcaggaacccccagaagctgctgcagagcgactacctgcagggcgtgcccagcaatggccaccccctgggccaccactgggtgaccagcctgagtgatggcggcccctggagcagcaccctggccaccagccccctggaccagcaggatgtgaagccaggccgggaggacctgcagctgggcgccatcatccaccacaggagcccccacgtggcccaccacagcccccacaccaaccaccccaatgcctggggcgccagccctgcccccaaccccagcatcaccagcagcggccagcccctgaatgtgtacagccagcccggcttcaccgtgtctggcatgctggagcacggcggcctgaccccacctcctgctgctgccagcgcccagagcctgcaccctgtgctgcgggagcccccagaccacggggagctgggcagccaccactgccaggaccacagtgatgaggagacccccaccagtgatgagctggagcagtttgccaagcagttcaagcagaggcgcatcaagctgggcttcacccaggctgatgtgggcctggccctgggcaccctgtatggaaatgtgttcagccagaccaccatctgccgctttgagggcctgcagctgtccttcaagaacatgtgcaagctgaagcccctgctgaacaagtggctggaggaggccgacagcagcacaggcagccccaccagcattgacaagattgctgcccagggcaggaagaggaagaagaggaccagcattgaggtgtctgtgaagggcgtgctggagacccacttcctgaagtgccccaagccagctgcccaggagatcagcagcctggccgacagcctgcagctggagaaggaggtggtgcgggtgtggttctgcaacagacggcagaaggagaagaggatgaccccacctggggaccagcagccccatgaggtgtacagccacacagtgaagacagacaccagctgccacgacctgtag

SEQ ID NO: 165038 - DNA, 1260 bp, Artificial Sequence
  Description of Artificial Sequence: Synthetic coding sequence
atgatgtccatgaacagcaagcagccccactttgccatgcaccccaccctgcctgagcacaagtaccccagcctgcacagcagcagcgaggccatcagaagagcctgcctgcccaccccacccctgcagagcaacctgtttgccagcctggatgagaccctgctggcccgggcagaggccctggccgctgtggacattgctgtgtcccagggcaagagccaccccttcaagccagatgccacctaccacaccatgaacagcgtgccctgcaccagcaccagcacagtgcccctggcccaccaccaccaccaccaccaccaccaccaggccctggagcccggggacctgctggaccacatcagcagccccagcctggccctgatggccggggccggcggggccggggctgctgctgggggcggcggggcccatgatggccctgggggcggcggcggccctgggggcggcggcggccctgggggcggccctgggggcggcggcggcggcggccctgggggcggcggcggcggccctgggggcggcctgctgggcggcagcgcccacccccacccccacatgcacagcctgggccacctgagccaccctgctgctgctgctgccatgaacatgcccagcggcctgccccaccctggcctggtggccgctgctgcccaccacggggctgctgctgctgctgctgctgctgctgctggccaggtggccgccgccagcgctgctgctgctgtggtgggcgctgctggcctggccagcatctgtgacagcgacacagacccccgggagctggaggcctttgctgagcgcttcaagcagaggcgcatcaagctgggcgtgacccaggctgatgtgggcagcgccctggccaacctgaagatccctggggtgggcagcctgagccagagcaccatctgccgctttgagagcctgaccctgagccacaacaacatgattgccctgaagcccatcctgcaggcctggctggaggaggccgagggcgcccagcgggagaagatgaacaagccagagctgttcaatggaggagagaagaagaggaagaggaccagcattgctgcccctgagaagaggagcctggaggcctactttgctgtgcagccccggcccagcagcgagaagattgctgccatcgccgagaagctggacctgaagaagaatgtggtgcgggtgtggttctgcaaccagaggcagaagcagaagaggatgaagttcagcgccacctactag

SEQ ID NO: 165039 - DNA, 1911 bp, Artificial Sequence
  Description of Artificial Sequence: Synthetic coding sequence
atgaagaagctgcagggcgcccacctgaggaagcctgtgaccccagacctgctgatgacccccagcgaccagggagatgtggacctggatgtggactttgctgcccaccggggcaactggacaggcaagctggacttcctgctgagctgcatcggctactgtgtgggcctgggcaatgtgtggaggttcccctaccgggcctacaccaacggcggcggggccttcctggtgccctacttcctgatgctggccatctgtggcatccccctcttcttcctggagctgagcctgggccagttcagcagcctgggccccctggccgtgtggaagatcagccccctcttcaagggggccggggccgccatgctgctgattgtgggcctggtggccatctactacaacatgatcatcgcctacgtgctcttctacctgtttgccagcctgaccagtgacctgccctgggagcactgcggcaactggtggaacacagagctgtgcctggagcaccgggtgtccaaggatggaaatggagccctgcccctgaacctgacctgcaccgtgagccccagcgaggagtactggagccgctacgtgctgcacatccagggcagccagggcatcggcagccctggagagatccgctggaacctgtgcctgtgcctgctgctggcctgggtgattgtgttcctgtgcatcctgaagggcgtgaagagcagcggcaaggtggtgtacttcaccgccaccttcccctacctgatcctgctgatgctgctggtgcggggcgtgaccctgcccggggcctggaagggcatccagttctacctgaccccccagttccaccacctgctgagcagcaaggtgtggattgaagctgccctgcagatcttctacagcctgggcgtgggctttggaggcctgctgacctttgccagctacaacaccttccaccagaacatctacagagacaccttcatcgtgaccctgggcaatgccatcaccagcatcctggccggctttgccatcttctctgtgctgggctacatgagccaggagctgggcgtgcctgtggaccaggtggccaaggccggccctggcctggcctttgtggtgtacccccaggccatgaccatgctgcccctgagccccttctggagcttcctgttcttcttcatgctgctgaccctgggcctggacagccagtttgccttcctggagaccatcgtgacagctgtgacagatgagttcccctactacctgcggcccaagaaggctgtgttttctggcctcatctgtgtggccatgtacctgatgggcctcatcctgaccacagatggcggcatgtactggctggtgctgctggatgactacagcgccagctttggcctgatggtggtggtgatcaccacctgcctggccgtgaccagggtgtatggcatccagcgcttctgccgggacatccacatgatgctgggcttcaagccaggcctgtacttccgggcctgctggctgttcctgagccctgccaccctgctggccctgatggtgtacagcatcgtgaagtaccagcccagtgaatatggcagctaccgcttccccccctgggccgagctgctgggcatcctgatgggcctgctgagctgcctgatgatcccagctggcatgctggtggccgtgctgcgggaggagggcagcctgtgggagcggctgcagcaggccagcaggcctgccatggactggggccccagcctggaggagaacagaacaggcatgtatgtggccaccctggccggcagccagagccccaagcccctgatggtgcacatgaggaaatatggaggcatcaccagctttgagaacacagccatcgaggtggaccgggagattgctgaggaggaggagagcatgatgtag

SEQ ID NO: 165040 - DNA, 798 bp, Artificial Sequence
  Description of Artificial Sequence: Synthetic coding sequence
atgcacttctaccgcctcttcctgggcgccacccggcgcttcctgaaccctgagtggaagggggagattgacaactggtgtgtgtatgtgctgaccagcctgctgcccttcaagatccagagccaggacatcaaggccctgcagaaggagctggagcagtttgccaagctgctgaagcagaagaggatcaccctgggctacacccaggctgatgtgggcctgaccctgggcgtgctgtttgggaaggtgttcagccagaccaccatctgccgctttgaggccctgcagctgtccttcaagaacatgtgcaagctgcggcccctgctgcagaagtgggtggaggaggccgacaacaatgaaaacctgcaggagatctgcaaggccgagaccctggtgcaggccaggaagaggaagaggaccagcattgaaaatagagtgcggggcaacctggagaacctcttcctgcagtgccccaagcccaccctgcagcagatcagccacatcgcccagcagctgggcctggagaaggatgtggtgcgggtgtggttctgcaacagacggcagaagggcaagaggagcagcagtgactatgcccagagagaagattttgaagctgctggcagccccttcagcggcggccctgtgtccttccccctggcccctggcccccacttcggcaccccaggctacggcagcccccacttcaccgccctgtacagctctgtgcccttccctgagggggaggccttcccccctgtgtctgtgaccaccctgggcagccccatgcacagcaactag

SEQ ID NO: 165041 - DNA, 1083 bp, Artificial Sequence
  Description of Artificial Sequence: Synthetic coding sequence
atggccggccacctggccagtgactttgccttcagccccccacctgggggcggcggagatggccctgggggccctgagcccggctgggtggaccccaggacctggctgtccttccagggccccccaggcggccctggcatcggccctggggtgggccctggcagcgaggtgtggggcatccccccctgccccccaccctatgagttctgtggcggcatggcctactgcggcccccaggtgggcgtgggcctggtgccccagggcggcctggagaccagccagcctgagggggaggccggcgtgggcgtggagagcaacagtgatggagccagccctgagccctgcaccgtgaccccaggagctgtgaagctggagaaggagaagctggagcagaaccctgaggagagccaggacatcaaggccctgcagaaggagctggagcagtttgccaagctgctgaagcagaagaggatcaccctgggctacacccaggctgatgtgggcctgaccctgggcgtgctgtttgggaaggtgttcagccagaccaccatctgccgctttgaggccctgcagctgtccttcaagaacatgtgcaagctgcggcccctgctgcagaagtgggtggaggaggccgacaacaatgaaaacctgcaggagatctgcaaggccgagaccctggtgcaggccaggaagaggaagaggaccagcattgagaacagagtgcggggcaacctggagaacctcttcctgcagtgccccaagcccaccctgcagcagatcagccacatcgcccagcagctgggcctggagaaggatgtggtgcgggtgtggttctgcaacagacggcagaagggcaagaggagcagcagtgactatgcccagcgggaggactttgaggccgccggcagccccttcagcggcggccctgtgtccttccccctggcccctggcccccacttcggcaccccaggctacggcagcccccacttcaccgccctgtacagctctgtgcccttccctgagggggaggccttcccccctgtgtctgtgaccaccctgggcagccccatgcacagcaactag

SEQ ID NO: 165042 - DNA, 372 bp, Artificial Sequence
  Description of Artificial Sequence: Synthetic coding sequence
atggccggccacctggccagtgactttgccttcagccccccacctgggggcggcggagatggccctgggggccctgagcccggctgggtggaccccaggacctggctgtccttccagggccccccaggcggccctggcatcggccctggggtgggccctggcagcgaggtgtggggcatccccccctgccccccaccctatgagttctgtggcggcatggcctactgcggcccccaggtgggcgtgggcctggtgccccagggcggcctggagaccagccagcctgagggggaggccggcgtgggcgtggagacccccatgggccccccaagaagccctgccccccaccccttccccttccccctgctgtag

SEQ ID NO: 165043 - DNA, 558 bp, Artificial Sequence
  Description of Artificial Sequence: Synthetic coding sequence
atggccggccacctggccagtgactttgccttcagccccccacctgggggcggcggagatggccctgggggccctgagcccggctgggtggaccccaggacctggctgtccttccagggccccccaggcggccctggcatcggccctggggtgggccctggcagcgaggtgtggggcatccccccctgccccccaccctatgagttctgtggcggcatggcctactgcggcccccaggtgggcgtgggcctggtgccccagggcggcctggagaccagccagcctgagggggaggccggcgtgggcgtggagagcaacagtgatggagccagccctgagccctgcaccgtgaccccaggagctgtgaagctggagaaggagaagctggagcagaaccctgaggagagccaggacatcaaggccctgcagaaggagctggagcagtttgccaagctgctgaagcagaagaggatcaccctgggctacacccaggctgatgtgcaccctgggggcagcatctgggagggcatccagcccaatgaccacctgcccctgtag

SEQ ID NO: 165044 - DNA, 558 bp, Artificial Sequence; identical to SEQ ID NO: 165043
  Description of Artificial Sequence: Synthetic coding sequence

SEQ ID NO: 165045 - DNA, 495 bp, Artificial Sequence
  Description of Artificial Sequence: Synthetic coding sequence
atgtgcaagctgcggcccctgctgcagaagtgggtggaggaggccgacaacaatgaaaacctgcaggagatctgcaaggccgagaccctggtgcaggccaggaagaggaagaggaccagcattgagaacagagtgcggggcaacctggagaacctcttcctgcagtgccccaagcccaccctgcagcagatcagccacatcgcccagcagctgggcctggagaaggatgtggtgcgggtgtggttctgcaacagacggcagaagggcaagaggagcagcagtgactatgcccagcgggaggactttgaggccgccggcagccccttcagcggcggccctgtgtccttccccctggcccctggcccccacttcggcaccccaggctacggcagcccccacttcaccgccctgtacagctctgtgcccttccctgagggggaggccttcccccctgtgtctgtgaccaccctgggcagccccatgcacagcaactag

SEQ ID NO: 165046 - DNA, 495 bp, Artificial Sequence; identical to SEQ ID NO: 165045
  Description of Artificial Sequence: Synthetic coding sequence

SEQ ID NO: 165047 - DNA, 2076 bp, Artificial Sequence
  Description of Artificial Sequence: Synthetic coding sequence
atgtctgccctgctgcaggaccccatgattgctggccaggtgtccaagcccctgctgtctgtgcgctctgagatgaatgctgagctgcggggggaggacaaggccgccaccagtgacagcgagctgaatgagcccctgctggcccctgtggagagcaatgattctgaggacacccccagcaagctgtttggagcccggggcaacccagccctgagtgaccccggcaccccagaccagcaccaggccagccagacccacccccccttccctgtgggcccccagcccctgctgacagcccagcagctggccagcgctgtggccggcgtgatgcctgggggccccccagccctgaaccagcccatcctgatccccttcaacatggccggccagctgggcggccagcagggcctggtgctgaccctgcccacagccaacctgaccaacatccagggcctggtggccgctgctgctgctgggggcatcatgaccctgcccctgcagaacctgcaggccaccagcagcctgaacagccagctgcagcagctgcagctgcagctgcagcagcagcagcagcagcagcagcagcagcccccacccagcaccaaccagcacccccagcctgccccccaggcccccagccagagccagcagcagcccctgcagcccaccccaccccagcagcccccaccagccagccagcagcccccagcccccaccagccagctgcagcaggccccccagccccagcagcaccagccccacagccacagccagaaccagaaccagcccagccccacccagcagagcagcagccccccccagaagcccagccagagccctggccacggcctgcccagccccctgaccccacccaaccccctgcagctggtgaacaaccccctggccagccaggccgctgctgctgctgctgccatgagcagcatcgccagcagccaggcctttggaaatgccctgagcagcctgcagggcgtgacaggccagctggtgaccaatgcccagggccagatcatcggcaccatccccctgatgcccaaccctggccccagcagccaggccgccagcggcacccagggcctgcaggtgcagcccatcaccccccagctgctgaccaatgcccagggccagatcatcgccaccgtcatcggcaaccagatcctgcccgtcatcaacacccagggcatcaccctgagccccatcaagccaggccagcagctgcaccagcccagccagacctctgtgggccaggccgccagccagggcaacctgctgcacctggcccacagccaggcctccatgagccagagccctgtgcggcaggccagcagcagcagcagcagcagcagcagcagcagcgccctgtctgtgggccagctggtgagcaacccccagacagctgctggggaggtggatggagtgaacctggaggagatccgggagtttgccaaggccttcaagatccggcggctgagcctgggcctgacccagacccaggtgggccaggccctgagcgccacagagggccctgcctacagccagagcgccatctgccgccacaccatcctgcggagccacttcttcctgccccaggaggcccaggagaacaccatcgccagcagcctgacagccaagctgaaccctggcctgctgtacccagccaggtttgagaagctggacatcacccccaagagcgcccagaagatcaagcctgtgctggagcgctggatggccgaggccgaggcccggcacagagctggcatgcagaacctgacagagttcatcggcagcgagcccagcaagaagaggaagaggaggaccagcttcaccccccaggccctggagatcctgaatgcccactttgagaagaacacccaccccagcggccaggagatgacagaaattgctgagaagctgaactatgaccgggaggtggtgcgggtgtggttctgcaacaagaggcaggccctgaagaacaccatcaagaggctgaagcagcacgagcccgccacagctgtgcccctggagcccctgacagacagcctggaggagaacagctag

SEQ ID NO: 165048 - DNA, 1968 bp, Artificial Sequence
  Description of Artificial Sequence: Synthetic coding sequence
atgtctgccctgctgcaggaccccatgattgctggccaggtgtccaagcccctgctgtctgtgcgctctgagatgaatgctgagctgcggggggaggacaaggccgccaccagtgacagcgagctgaatgagcccctgctggcccctgtggagagcaatgattctgaggacacccccagcaagctgtttggagcccggggcaacccagccctgagtgaccccggcaccccagaccagcaccaggccagccagacccacccccccttccctgtgggcccccagcccctgctgacagcccagcagctggccagcgctgtggccggcgtgatgcctgggggccccccagccctgaaccagcccatcctgatccccttcaacatggccggccagctgggcggccagcagggcctggtgctgaccctgcccacagccaacctgaccaacatccagggcctggtggccgctgctgctgctgggggcatcatgaccctgcccctgcagaacctgcaggccaccagcagcctgaacagccagctgcagcagctgcagctgcagctgcagcagcagcagcagcagcagcagcagcagcccccacccagcaccaaccagcacccccagcctgccccccaggcccccagccagagccagcagcagcccctgcagcccaccccaccccagcagcccccaccagccagccagcagcccccagcccccaccagccagctgcagcaggccccccagccccagcagcaccagccccacagccacagccagaaccagaaccagcccagccccacccagcagagcagcagccccccccagaagcccagccagagccctggccacggcctgcccagccccctgaccccacccaaccccctgcagctggtgaacaaccccctggccagccaggccgctgctgctgctgctgccatgagcagcatcgccagcagccaggcctttggaaatgccctgagcagcctgcagggcgtgacaggccagctggtgaccaatgcccagggccagatcatcggcaccatccccctgatgcccaaccctggccccagcagccaggccgccagcggcacccagggcctgcaggtgcagcccatcaccccccagctgctgaccaatgcccagggccagatcatcgccaccgtcatcggcaaccagatcctgcccgtcatcaacacccagggcatcaccctgagccccatcaagccaggccagcagctgcaccagcccagccagacctctgtgggccaggccgccagccagggcaacctgctgcacctggcccacagccaggcctccatgagccagagccctgtgcggcaggccagcagcagcagcagcagcagcagcagcagcagcgccctgtctgtgggccagctggtgagcaacccccagacagctgctggggaggtggatggagtgaacctggaggagatccgggagtttgccaaggccttcaagatccggcggctgagcctgggcctgacccagacccaggtgggccaggccctgagcgccacagagggccctgcctacagccagagcgccatctgccgctttgagaagctggacatcacccccaagagcgcccagaagatcaagcctgtgctggagcgctggatggccgaggccgaggcccggcacagagctggcatgcagaacctgacagagttcatcggcagcgagcccagcaagaagaggaagaggaggaccagcttcaccccccaggccctggagatcctgaatgcccactttgagaagaacacccaccccagcggccaggagatgacagaaattgctgagaagctgaactatgaccgggaggtggtgcgggtgtggttctgcaacaagaggcaggccctgaagaacaccatcaagaggctgaagcagcacgagcccgccacagctgtgcccctggagcccctgacagacagcctggaggagaacagctag

SEQ ID NO: 165049 - DNA, 2076 bp, Artificial Sequence
  Description of Artificial Sequence: Synthetic coding sequence
atggagaagatctacagcagaggagagctgcaccacttcattgatggcttcaatgaggagaagagcaactggatgagatatgtgaacccagcccacagcccccgggagcagaacctggccgcctgccagaatggcatgaacatctacttctacaccatcaagcccatcccagccaaccaggagctgctggtgtggtactgccgggactttgctgagcggctgcactacccctacccaggagagctgaccatgatgaacctgacccagacccagagcagcctgaagcagcccagcacagagaagaatgagctgtgccccaagaatgtgcccaagcgggagtacagcgtgaaggagatcctgaagctggacagcaaccccagcaagggcaaggacctgtaccgcagcaacatcagccccctgaccagcgagaaggacctggatgacttcagaagaagaggcagccctgagatgcccttctacccccgggtggtgtaccccatccgggcccccctgcctgaggacttcctgaaggccagcctggcctacggcatcgagcggcccacctacatcaccaggagccccatccccagcagcaccacccccagccccagcgcccggagcagcccagaccagagcctgaagagcagcagcccccacagcagccctggcaacacagtgtcccctgtgggccctggcagccaggagcaccgggacagctatgcctacctgaatgccagctatggaacagagggcctgggcagctacccaggctacgcccccctgccccacctgcccccagccttcatccccagctacaatgcccactaccccaagttcctgctgcccccctacggcatgaactgcaatggcctgtctgctgtgtcctccatgaatggcatcaacaactttggcctcttcccccggctgtgccctgtgtacagcaacctgctgggcggcggcagcctgccccaccccatgctgaaccccaccagcctgcccagcagcctgcccagtgatggagcccggcggctgctgcagcctgagcacccccgggaggtgctggtgcctgccccccacagcgccttctccttcaccggggccgccgcctccatgaaggacaaggcctgcagccccaccagcggcagccccacagctggaacagctgccacagctgagcacgtggtgcagcccaaggccaccagcgctgccatggccgcccccagcagtgatgaggccatgaacctgatcaagaacaagaggaacatgacaggctacaagaccctgccctaccccctgaagaagcagaatggcaagatcaagtatgagtgcaatgtgtgtgccaagaccttcggccagctgagcaacctgaaggtgcacctgcgggtgcacagcggggagcggcccttcaagtgccagacctgcaacaagggcttcacccagctggcccacctgcagaagcactacctggtgcacactggagagaagccccatgagtgccaggtgtgccacaagcgcttcagcagcaccagcaacctgaagacccacctgcggctgcacagcggggagaagccctaccagtgcaaggtgtgcccagccaagttcacccagtttgtgcacctgaagctgcacaagaggctgcacacccgggagcggccccacaagtgcagccagtgccacaagaactacatccacctgtgcagcctgaaggtgcacctgaagggcaactgtgccgccgccccagcccctggcctgcccctggaggacctgacccgcatcaatgaggagattgagaagtttgacatcagtgacaatgctgaccggctggaggatgtggaggatgacatcagcgtcatctctgtggtggagaaggagatcctggccgtggtgaggaaggagaaggaggagaccggcctgaaggtgtccctgcagaggaacatgggaaatggcctgctgagcagcggctgcagcctgtatgagagcagtgacctgcccctgatgaagctgccccccagcaaccccctgcccctggtgcctgtgaaggtgaagcaggagaccgtggagcccatggacccctag

SEQ ID NO: 165050 - DNA, 2370 bp, Artificial Sequence
  Description of Artificial Sequence: Synthetic coding sequence
atgaagatggacatggaggatgctgacatgaccctgtggacagaggccgagtttgaggagaagtgcacctacatcgtgaatgaccacccctgggacagcggggctgatggcggcacctctgtgcaggccgaggccagcctgcccaggaacctgctcttcaagtatgccaccaacagcgaggaggtgattggagtgatgagcaaggagtacatccccaagggcaccaggtttggccccctgattggagagatctacaccaatgacacagtgcccaagaatgccaacaggaagtacttctggaggatctacagcagaggagagctgcaccacttcattgatggcttcaatgaggagaagagcaactggatgagatatgtgaacccagcccacagcccccgggagcagaacctggccgcctgccagaatggcatgaacatctacttctacaccatcaagcccatcccagccaaccaggagctgctggtgtggtactgccgggactttgctgagcggctgcactacccctacccaggagagctgaccatgatgaacctgacccagacccagagcagcctgaagcagcccagcacagagaagaatgagctgtgccccaagaatgtgcccaagcgggagtacagcgtgaaggagatcctgaagctggacagcaaccccagcaagggcaaggacctgtaccgcagcaacatcagccccctgaccagcgagaaggacctggatgacttcagaagaagaggcagccctgagatgcccttctacccccgggtggtgtaccccatccgggcccccctgcctgaggacttcctgaaggccagcctggcctacggcatcgagcggcccacctacatcaccaggagccccatccccagcagcaccacccccagccccagcgcccggagcagcccagaccagagcctgaagagcagcagcccccacagcagccctggcaacacagtgtcccctgtgggccctggcagccaggagcaccgggacagctatgcctacctgaatgccagctatggaacagagggcctgggcagctacccaggctacgcccccctgccccacctgcccccagccttcatccccagctacaatgcccactaccccaagttcctgctgcccccctacggcatgaactgcaatggcctgtctgctgtgtcctccatgaatggcatcaacaactttggcctcttcccccggctgtgccctgtgtacagcaacctgctgggcggcggcagcctgccccaccccatgctgaaccccaccagcctgcccagcagcctgcccagtgatggagcccggcggctgctgcagcctgagcacccccgggaggtgctggtgcctgccccccacagcgccttctccttcaccggggccgccgcctccatgaaggacaaggcctgcagccccaccagcggcagccccacagctggaacagctgccacagctgagcacgtggtgcagcccaaggccaccagcgctgccatggccgcccccagcagtgatgaggccatgaacctgatcaagaacaagaggaacatgacaggctacaagaccctgccctaccccctgaagaagcagaatggcaagatcaagtatgagtgcaatgtgtgtgccaagaccttcggccagctgagcaacctgaaggtgcacctgcgggtgcacagcggggagcggcccttcaagtgccagacctgcaacaagggcttcacccagctggcccacctgcagaagcactacctggtgcacactggagagaagccccatgagtgccaggtgtgccacaagcgcttcagcagcaccagcaacctgaagacccacctgcggctgcacagcggggagaagccctaccagtgcaaggtgtgcccagccaagttcacccagtttgtgcacctgaagctgcacaagaggctgcacacccgggagcggccccacaagtgcagccagtgccacaagaactacatccacctgtgcagcctgaaggtgcacctgaagggcaactgtgccgccgccccagcccctggcctgcccctggaggacctgacccgcatcaatgaggagattgagaagtttgacatcagtgacaatgctgaccggctggaggatgtggaggatgacatcagcgtcatctctgtggtggagaaggagatcctggccgtggtgaggaaggagaaggaggagaccggcctgaaggtgtccctgcagaggaacatgggaaatggcctgctgagcagcggctgcagcctgtatgagagcagtgacctgcccctgatgaagctgccccccagcaaccccctgcccctggtgcctgtgaaggtgaagcaggagaccgtggagcccatggacccctag

SEQ ID NO: 165051 - DNA, 2478 bp, Artificial Sequence
  Description of Artificial Sequence: Synthetic coding sequence
atgctggacatctgcctggagaagagggtgggcaccaccctggccgcccccaagtgcaacagcagcacagtgcgcttccagggcctggccgagggcaccaagggcaccatgaagatggacatggaggatgctgacatgaccctgtggacagaggccgagtttgaggagaagtgcacctacatcgtgaatgaccacccctgggacagcggggctgatggcggcacctctgtgcaggccgaggccagcctgcccaggaacctgctcttcaagtatgccaccaacagcgaggaggtgattggagtgatgagcaaggagtacatccccaagggcaccaggtttggccccctgattggagagatctacaccaatgacacagtgcccaagaatgccaacaggaagtacttctggaggatctacagcagaggagagctgcaccacttcattgatggcttcaatgaggagaagagcaactggatgagatatgtgaacccagcccacagcccccgggagcagaacctggccgcctgccagaatggcatgaacatctacttctacaccatcaagcccatcccagccaaccaggagctgctggtgtggtactgccgggactttgctgagcggctgcactacccctacccaggagagctgaccatgatgaacctgacccagacccagagcagcctgaagcagcccagcacagagaagaatgagctgtgccccaagaatgtgcccaagcgggagtacagcgtgaaggagatcctgaagctggacagcaaccccagcaagggcaaggacctgtaccgcagcaacatcagccccctgaccagcgagaaggacctggatgacttcagaagaagaggcagccctgagatgcccttctacccccgggtggtgtaccccatccgggcccccctgcctgaggacttcctgaaggccagcctggcctacggcatcgagcggcccacctacatcaccaggagccccatccccagcagcaccacccccagccccagcgcccggagcagcccagaccagagcctgaagagcagcagcccccacagcagccctggcaacacagtgtcccctgtgggccctggcagccaggagcaccgggacagctatgcctacctgaatgccagctatggaacagagggcctgggcagctacccaggctacgcccccctgccccacctgcccccagccttcatccccagctacaatgcccactaccccaagttcctgctgcccccctacggcatgaactgcaatggcctgtctgctgtgtcctccatgaatggcatcaacaactttggcctcttcccccggctgtgccctgtgtacagcaacctgctgggcggcggcagcctgccccaccccatgctgaaccccaccagcctgcccagcagcctgcccagtgatggagcccggcggctgctgcagcctgagcacccccgggaggtgctggtgcctgccccccacagcgccttctccttcaccggggccgccgcctccatgaaggacaaggcctgcagccccaccagcggcagccccacagctggaacagctgccacagctgagcacgtggtgcagcccaaggccaccagcgctgccatggccgcccccagcagtgatgaggccatgaacctgatcaagaacaagaggaacatgacaggctacaagaccctgccctaccccctgaagaagcagaatggcaagatcaagtatgagtgcaatgtgtgtgccaagaccttcggccagctgagcaacctgaaggtgcacctgcgggtgcacagcggggagcggcccttcaagtgccagacctgcaacaagggcttcacccagctggcccacctgcagaagcactacctggtgcacactggagagaagccccatgagtgccaggtgtgccacaagcgcttcagcagcaccagcaacctgaagacccacctgcggctgcacagcggggagaagccctaccagtgcaaggtgtgcccagccaagttcacccagtttgtgcacctgaagctgcacaagaggctgcacacccgggagcggccccacaagtgcagccagtgccacaagaactacatccacctgtgcagcctgaaggtgcacctgaagggcaactgtgccgccgccccagcccctggcctgcccctggaggacctgacccgcatcaatgaggagattgagaagtttgacatcagtgacaatgctgaccggctggaggatgtggaggatgacatcagcgtcatctctgtggtggagaaggagatcctggccgtggtgaggaaggagaaggaggagaccggcctgaaggtgtccctgcagaggaacatgggaaatggcctgctgagcagcggctgcagcctgtatgagagcagtgacctgcccctgatgaagctgccccccagcaaccccctgcccctggtgcctgtgaaggtgaagcaggagaccgtggagcccatggacccctag

SEQ ID NO: 165052 - DNA, 192 bp, Artificial Sequence
  Description of Artificial Sequence: Synthetic coding sequence
atgaagatggacatggaggatgctgacatgaccctgtggacagaggccgagtttgaggagaagtgcacctacatcgtgaatgaccacccctgggacagcggggctgatggcggcacctctgtgcaggccgaggccagcctgcccaggaacctgctcttcaagtatgccaccaacagcgaggaggtgatctag

SEQ ID NO: 165053 - DNA, 2367 bp, Artificial Sequence
  Description of Artificial Sequence: Synthetic coding sequence
atgaagatggacatggaggatgctgacatgaccctgtggacagaggccgagtttgaggagaagtgcacctacatcgtgaatgaccacccctgggacagcggggctgatggcggcacctctgtgcaggccgaggccagcctgcccaggaacctgctcttcaagtatgccaccaacagcgaggaggtgattggagtgatgagcaaggagtacatccccaagggcaccaggtttggccccctgattggagagatctacaccaatgacacagtgcccaagaatgccaacaggaagtacttctggaggatctacagcagaggagagctgcaccacttcattgatggcttcaatgaggagaagagcaactggatgagatatgtgaacccagcccacagcccccgggagcagaacctggccgcctgccagaatggcatgaacatctacttctacaccatcaagcccatcccagccaaccaggagctgctggtgtggtactgccgggactttgctgagcggctgcactacccctacccaggagagctgaccatgatgaacctgacccagacccagagcagcctgaagcagcccagcacagagaagaatgagctgtgccccaagaatgtgcccaagcgggagtacagcgtgaaggagatcctgaagctggacagcaaccccagcaagggcaaggacctgtaccgcagcaacatcagccccctgaccagcgagaaggacctggatgacttcagaagaagaggcagccctgagatgcccttctacccccgggtggtgtaccccatccgggcccccctgcctgaggacttcctgaaggccagcctggcctacggcatcgagcggcccacctacatcaccaggagccccatccccagcagcaccacccccagccccagcgcccggagcagcccagaccagagcctgaagagcagcagcccccacagcagccctggcaacacagtgtcccctgtgggccctggcagccaggagcaccgggacagctatgcctacctgaatgccagctatggaacagagggcctgggcagctacccaggctacgcccccctgccccacctgcccccagccttcatccccagctacaatgcccactaccccaagttcctgctgcccccctacggcatgaactgcaatggcctgtctgctgtgtcctccatgaatggcatcaacaactttggcctcttcccccggctgtgccctgtgtacagcaacctgctgggcggcggcagcctgcccaccccctgcagcacccccctgctgcccagcagcctgcccagtgatggagcccggcggctgctgcagcctgagcacccccgggaggtgctggtgcctgccccccacagcgccttctccttcaccggggctgctgcctccatgaaggacaaggcctgcagccccaccagcggcagccccacagctggaacagctgccacagctgagcacgtggtgcagcccaaggccaccagcgctgccatggccgcccccagcagtgatgaggccatgaacctgatcaagaacaagaggaacatgacaggctacaagaccctgccctaccccctgaagaagcagaatggcaagatcaagtatgaatgtaatgtgtgtgccaagaccttcggccagctgagcaacctgaaggtgcacctgcgggtgcacagcggggagcggcccttcaagtgccagacctgcaacaagggcttcacccagctggcccacctgcagaagcactacctggtgcacactggagagaagccccatgagtgccaggtgtgccacaagcgcttcagcagcaccagcaacctgaagacccacctgcggctgcacagcggggagaagccctaccagtgcaaggtgtgcccagccaagttcacccagtttgtgcacctgaagctgcacaagaggctgcacacccgggagcggccccacaagtgcagccagtgccacaagaactacatccacctgtgcagcctgaaggtgcacctgaagggcaactgtgccgccgccccagcccctggcctgcccctggaggacctgacccgcatcaatgaggagattgagaagtttgacatcagtgacaatgctgaccggctggaggatgtggaggatgacatcagcgtcatctctgtggtggagaaggagatcctggccgtggtgaggaaggagaaggaggagaccggcctgaaggtgtccctgcagaggaacatgggaaatggcctgctgagcagcggctgcagcctgtatgagagcagtgacctgcccctgatgaagctgccccccagcaaccccctgcccctggtgcctgtgaaggtgaagcaggagaccgtggagcccatggacccctag

SEQ ID NO: 165054 - DNA, 1716 bp, Artificial Sequence
  Description of Artificial Sequence: Synthetic coding sequence
atggccctgccccggcccagcgaggccgtgccccaggacaaggtgtgctacccacctgagagcagcccccagaacctggccgcctactacacccccttccccagctatggccactacagaaacagcctggccaccgtggaggaggacttccagcccttccggcagctggaggccgccgccagcgctgccccagccatgccacccttccccttcaggatggccccacccctgctgagccctggcctgggcctgcagcgggagcccctgtatgacctgccctggtacagcaagctgcccccctggtaccccatcccccacgtgccccgggaggtgccccccttcctgagcagcagccatgaatatgctggggccagcagcgaggacctgggccaccagatcatcggcggggacaatgaaagtggcccctgctgcggccctgacaccctcatccccccacctccagcagatgccagcctgctgcctgagggcctgcggaccagccagctgctgccctgcagccccagcaagcagagtgaagatggccccaagcccagcaaccaggagggcaagagccctgcccgcttccagttcacagaggaggacctgcactttgtgctgtatggagtgacccccagcctggagcacccagccagcctgcaccacgccatcagcggcctgctggtgcccccagacagcagcggcagtgacagcctgccccagaccctggacaaggacagcctgcagctgcctgagggcctgtgcctgatgcagacagtgtttggagaggtgccccactttggagtcttctgcagcagcttcatcgccaagggcgtgcgcttcggccccttccagggcaaggtggtgaatgccagcgaggtgaagacctacggggacaacagcgtgatgtgggagatctttgaagatggccacctgagccacttcattgatggcaagggcggcactggaaactggatgtcctatgtgaactgtgcccgcttccccaaggagcagaacctggtggccgtgcagtgccagggccacatcttctatgagagctgcaaggagatccaccagaaccaggagctgctggtgtggtacggggactgctatgagaagttcctggacatccctgtgtccctgcaggtgacagagcccgggaagcagcccagcggccccagcgaggagagcgctgagggctaccgctgtgagcgctgtgggaaggtgttcacctacaagtactacagagacaagcacctgaagtacaccccctgtgtggacaagggggacaggaagttcccctgcagcctgtgcaagaggagctttgagaagagggaccggctgcgcatccacatcctgcacgtgcatgagaagcaccggccccacaagtgcagcacctgtgggaagtgcttcagccagagcagcagcctgaacaagcacatgagggtgcacagcggggaccggccctaccagtgtgtgtactgcaccaagcgcttcaccgccagcagcatcctgcggacccacatccggcagcacagcggggagaagcccttcaagtgcaagtactgtgggaagagctttgccagccacgccgcccatgacagccacgtgagaagaagccacaaggaggatgatggctgcagctgcagcatctgtgggaagatcttcagtgaccaggagaccttctacagccacatgaagttccacgaggactactag

SEQ ID NO: 165055 - DNA, 303 bp, Artificial Sequence
  Description of Artificial Sequence: Synthetic coding sequence
atggccctgccccggcccagcgaggccgtgccccaggacaaggtgtgctacccacctgagagcagcccccagaacctggccgcctactacacccccttccccagctatggccactacagaaacagcctggccaccgtggaggaggacttccagcccttccggcagctggaggccgccgccagcgctgccccagccatgccacccttccccttcaggatggccccacccctgctgagccctggcctgggcctgcagcgggagcccctgtatgacctgccctggtacagcaagctgcccccatag

SEQ ID NO: 165056 - DNA, 3831 bp, Artificial Sequence
  Description of Artificial Sequence: Synthetic coding sequence
atgaggagcaaggcccgggccaggaagctggccaagagtgatggagatgtggtgaacaacatgtatgagcccaacagagacctgctggccagccacagcgcagaagatgaagcagaagattctgccatgagccccatccctgtgggcccccccagccccttccccaccagcgaggacttcacccccaaggagggcagcccctatgaggcccctgtgtacatccctgaggacatccccatcccagctgactttgagctgcgggagagcagcatccctggggccggcctgggcgtgtgggccaagaggaagatggaggccggggagcggctgggcccctgtgtggtggtgcccagggctgctgccaaggagacagactttggctgggagcagatcctgacagatgtggaggtgagcccccaggagggctgcatcaccaagatcagcgaggacctgggcagcgagaagttctgtgtggatgccaaccaggccggggccggctcctggctgaagtacatccgggtggcctgcagctgtgatgaccagaacctgaccatgtgccagatcagcgagcagatctactacaaggtgatcaaggacatcgagcccggggaggagctgctggtgcacgtgaaggagggcgtgtaccccctgggcaccgtgcccccaggcctggatgaggagcccaccttccgctgtgatgaatgtgatgagctgttccagagcaagctggacctgcggcggcacaagaagtacacctgtggctctgtgggcgccgccctgtatgagggcctggccgaggagctgaagccagagggcctgggcggcggcagcggccaggcccacgagtgcaaggactgtgagaggatgttccccaacaagtacagcctggagcagcacatggtgatccacacagaggagcgggagtacaagtgtgaccagtgccccaaggccttcaactggaagagcaacctgatccgccaccagatgagccatgattctgggaagagatttgaatgtgagaactgtgtgaaggtgttcacagaccccagcaacctgcagaggcacatccgcagccagcacgtgggcgcccgggcccacgcctgcccagactgtgggaagacctttgccaccagcagcggcctgaagcagcacaagcacatccacagcacagtgaagcccttcatctgtgaggtgtgccacaagagctacacccagttcagcaacctgtgccgccacaagaggatgcatgctgactgcaggacccagatcaagtgcaaggactgtggccagatgttcagcaccaccagcagcctgaacaagcaccggcgcttctgtgagggcaagaaccactacaccccaggcggcatctttgcccctggcctgcccctgacccccagccccatgatggacaaggccaagcccagccccagcctgaaccacgccagcctgggcttcaatgagtacttccccagccggccccaccctggcagcctgcccttcagcacagccccacccaccttccctgccctgaccccaggcttccctggcatcttcccccccagcctgtacccccggccccccctgctgccccccaccagcctgctgaagagccccctgaaccacacccaggatgccaagctgcccagccccctgggcaacccagccctgcccctggtgtctgctgtgagcaacagcagccagggcaccacagctgctgctggccctgaggagaagtttgagagccggctggaggacagctgtgtggagaagctgaagaccaggagcagtgacatgtctgatggcagtgactttgaagatgtgaacaccaccactggaacagacctggacaccaccactggaactggaagtgacctggacagtgatgtggacagcgaccctgacaaggacaagggcaagggcaagtctgctgagggccagcccaagtttggaggcggcctggcccctcctggggcccccaacagcgtggccgaggtgcctgtgttctacagccagcacagcttcttccccccaccagatgagcagctgctgacagccaccggggctgctggggacagcatcaaggccatcgccagcattgctgagaagtacttcggccctggcttcatgggcatgcaggagaagaagctgggcagcctgccctaccacagcgccttccccttccagttcctgcccaacttcccccacagcctgtaccccttcacagaccgggccctggcccacaacctgctggtgaaggccgagcccaagagccccagagatgccctgaaggtgggcggccccagcgctgagtgcccctttgacctgaccaccaagcccaaggatgtgaagcccatcctgcccatgcccaagggccccagcgccccagccagcggggaggagcagcccctggacctgagcatcggcagccgggcccgggccagccagaatggaggcggccgggagcccaggaagaaccacgtgtatggagagaggaagctgggcgctggggagggcctgccccaggtgtgcccagccaggatgccccagcagccccccctgcactacgccaagcccagccccttcttcatggaccccatctacagccgggtggagaagaggaaggtgacagatcctgtgggcgccctgaaggagaagtacctgcggcccagccccctgctcttccacccccagatgtctgccatcgagaccatgacagagaagctggagagctttgctgccatgaaggctgacagcggcagcagcctgcagcccctgccccaccaccccttcaacttccgcagccccccacccaccctgagtgaccccatcctgaggaagggcaaggagcgctacacctgccgctactgtgggaagatcttccccaggtctgccaacctgaccaggcacctgcggacccacactggagagcagccctaccgctgcaagtactgtgaccgctccttcagcatcagcagcaacctgcagagacatgtgaggaacatccacaacaaggagaagcccttcaagtgccacctgtgcaaccgctgcttcggccagcagaccaacctggacagacacctgaagaagcatgaacatgaaaatgcccctgtgtcccagcaccctggggtgctgaccaaccacctgggcaccagcgccagcagccccaccagcgagagtgacaaccacgccctgctggatgagaaggaggacagctacttcagcgagatccggaacttcatcgccaacagcgagatgaaccaggccagcaccaggacagagaagagagctgacatgcagatcgtggatggcagcgcccagtgccccggcctggccagcgagaagcaggaggatgtggaggaggaggatgatgatgacctggaggaggatgatgaggacagcctggccggcaagagccaggatgacacagtgtccccagcccctgagccccaggccgcctatgaagatgaagaagatgaggagcctgctgccagcctggccgtgggctttgaccacacccggcgctgtgctgaagatcatgaaggaggcctgctggccctggagcccatgcccaccttcggcaagggcctggacctgcggcgggctgctgaggaggcctttgaggtgaaggatgtgctgaacagcaccctggacagcgaggccctgaagcacaccctgtgccggcaggccaagaaccaggcctatgccatgatgctgagcctgtctgaggacacccccctgcacacccccagccagggcagcctggatgcctggctgaaggtgactggagccaccagcgagagcggggccttccaccccatcaaccacctgtag

SEQ ID NO: 165057 - DNA, 3831 bp, Artificial Sequence
  Description of Artificial Sequence: Synthetic coding sequence
atgaggagcaaggcccgggccaggaagctggccaagagtgatggagatgtggtgaacaacatgtatgagcccaacagagacctgctggccagccacagcgcagaagatgaagcagaagattctgccatgagccccatccctgtgggcccccccagccccttccccaccagcgaggacttcacccccaaggagggcagcccctatgaggcccctgtgtacatccctgaggacatccccatcccagctgactttgagctgcgggagagcagcatccctggggccggcctgggcgtgtgggccaagaggaagatggaggccggggagcggctgggcccctgtgtggtggtgcccagggctgctgccaaggagacagactttggctgggagcagatcctgacagatgtggaggtgagcccccaggagggctgcatcaccaagatcagcgaggacctgggcagcgagaagttctgtgtggatgccaaccaggccggggccggctcctggctgaagtacatccgggtggcctgcagctgtgatgaccagaacctgaccatgtgccagatcagcgagcaggtgatctactacaaggtgatcaaggacatcgagcctggagaggagctgctggtgcacgtgaaggagggcgtgtaccccctgggcaccgtgcccccaggcctggatgaggagcccaccttccgctgtgatgaatgtgatgagctgttccagagcaagctggacctgcggcggcacaagaagtacacctgtggctctgtgggcgccgccctgtatgagggcctggccgaggagctgaagccagagggcctgggcggcggcagcggccaggcccacgagtgcaaggactgtgagaggatgttccccaacaagtacagcctggagcagcacatggtgatccacacagaggagcgggagtacaagtgtgaccagtgccccaaggccttcaactggaagagcaacctgatccgccaccagatgagccatgacagcggcaagagatttgaatgtgagaactgtgtgaaggtgttcacagaccccagcaacctgcagaggcacatccgcagccagcacgtgggcgcccgggcccacgcctgcccagactgtgggaagacctttgccaccagcagcggcctgaagcagcacaagcacatccacagcacagtgaagcccttcatctgtgaggtgtgccacaagagctacacccagttcagcaacctgtgccgccacaagaggatgcacgccgactgcaggacccagatcaagtgcaaggactgtggccagatgttcagcaccaccagcagcctgaacaagcaccggcgcttctgtgagggcaagaaccactacacccctgggggcatctttgcccctggcctgcccctgacccccagccccatgatggacaaggccaagcccagccccagcctgaaccacgccagcctgggcttcaatgagtacttccccagccggccccaccctggcagcctgcccttcagcacagccccacccaccttccctgccctgaccccaggcttccctggcatcttcccccccagcctgtaccccaggcctcccctgctgccccccaccagcctgctgaagagccccctgaaccacacccaggatgccaagctgcccagccccctgggcaacccagccctgcccctggtgtctgctgtgagcaacagcagccagggcaccacagctgctgctggccctgaggagaagtttgagagccggctggaggacagctgtgtggagaagctgaagaccaggagcagtgacatgtctgatggcagtgactttgaagatgtgaacaccaccaccggcacagacctggacaccaccaccggcaccggcagtgacctggacagtgatgtggacagcgaccctgacaaggacaagggcaagggcaagtctgctgagggccagcccaagtttggaggcggcctggcccctcctggggcccccaacagcgtggccgaggtgcctgtgttctacagccagcacagcttcttccccccaccagatgagcagctgctgacagccactggagctgctggggacagcatcaaggccatcgccagcattgctgagaagtactttggacctggcttcatgggcatgcaggagaagaagctgggcagcctgccctaccacagcgccttccccttccagttcctgcccaacttcccccacagcctgtaccccttcacagaccgggccctggcccacaacctgctggtgaaggccgagcccaagagccccagagatgccctgaaggtgggcggccccagcgcagaatgtccctttgacctgaccaccaagcccaaggatgtgaagcccatcctgcccatgcccaagggccccagcgccccagccagcggggaggagcagcccctggacctgagcatcggcagccgggcccgggccagccagaatggaggcggccgggagcccaggaagaaccacgtgtatggagagaggaagctgggcgctggggagggcctgccccaggtgtgcccagccaggatgccccagcagccccccctgcactacgccaagcccagccccttcttcatggaccccatctacagagtggagaagaggaaggtgacagatcctgtgggcgccctgaaggagaagtacctgcggcccagccccctgctcttccacccccagatgtctgccatcgagaccatgacagagaagctggagagctttgctgccatgaaggctgacagcggcagcagcctgcagcccctgccccaccaccccttcaacttccgcagccccccacccaccctgagtgaccccatcctgaggaagggcaaggagcgctacacctgccgctactgtgggaagatcttccccaggtctgccaacctgaccaggcacctgcggacccacactggagagcagccctaccgctgcaagtactgtgaccgctccttcagcatcagcagcaacctgcagagacatgtgaggaacatccacaacaaggagaagcccttcaagtgccacctgtgcaaccgctgcttcggccagcagaccaacctggacagacacctgaagaagcatgaacatgaaaatgcccctgtgtcccagcaccctggggtgctgaccaaccacctgggcaccagcgccagcagccccaccagcgagagtgacaaccacgccctgctggatgagaaggaggacagctacttcagcgagatccggaacttcatcgccaacagcgagatgaaccaggccagcaccaggacagagaagagagctgacatgcagatcgtggatggcagcgcccagtgccccggcctggccagcgagaagcaggaggatgtggaggaggaggatgatgatgacctggaggaggatgatgaggacagcctggccggcaagagccaggatgacacagtgtccccagcccctgagccccaggccgcctatgaagatgaagaagatgaggagcctgctgccagcctggccgtgggctttgaccacacccggcgctgtgctgaagatcatgaaggaggcctgctggccctggagcccatgcccaccttcggcaagggcctggacctgcggcgggctgctgaggaggcctttgaggtgaaggatgtgctgaacagcaccctggacagcgaggccctgaagcacaccctgtgccggcaggccaagaaccaggcctatgccatgatgctgagcctgtctgaggacacccccctgcacacccccagccagggcagcctggatgcctggctgaaggtgactggagccaccagcgagagcggggccttccaccccatcaaccacctgtag

SEQ ID NO: 165058 - DNA, 3279 bp, Artificial Sequence
  Description of Artificial Sequence: Synthetic coding sequence
ttctgtgcctacagcgccaagatctactacaaggtgatcaaggacatcgagcccggggaggagctgctggtgcacgtgaaggagggcgtgtaccccctgggcaccgtgcccccaggcctggatgaggagcccaccttccgctgtgatgaatgtgatgagctgttccagagcaagctggacctgcggcggcacaagaagtacacctgtggctctgtgggcgccgccctgtatgagggcctggccgaggagctgaagccagagggcctgggcggcggcagcggccaggcccacgagtgcaaggactgtgagaggatgttccccaacaagtacagcctggagcagcacatggtgatccacacagaggagcgggagtacaagtgtgaccagtgccccaaggccttcaactggaagagcaacctgatccgccaccagatgagccatgattctgggaagagatttgaatgtgagaactgtgtgaaggtgttcacagaccccagcaacctgcagaggcacatccgcagccagcacgtgggcgcccgggcccacgcctgcccagactgtgggaagacctttgccaccagcagcggcctgaagcagcacaagcacatccacagcacagtgaagcccttcatctgtgaggtgtgccacaagagctacacccagttcagcaacctgtgccgccacaagaggatgcatgctgactgcaggacccagatcaagtgcaaggactgtggccagatgttcagcaccaccagcagcctgaacaagcaccggcgcttctgtgagggcaagaaccactacaccccaggcggcatctttgcccctggcctgcccctgacccccagccccatgatggacaaggccaagcccagccccagcctgaaccacgccagcctgggcttcaatgagtacttccccagccggccccaccctggcagcctgcccttcagcacagccccacccaccttccctgccctgaccccaggcttccctggcatcttcccccccagcctgtacccccggccccccctgctgccccccaccagcctgctgaagagccccctgaaccacacccaggatgccaagctgcccagccccctgggcaacccagccctgcccctggtgtctgctgtgagcaacagcagccagggcaccacagctgctgctggccctgaggagaagtttgagagccggctggaggacagctgtgtggagaagctgaagaccaggagcagtgacatgtctgatggcagtgactttgaagatgtgaacaccaccactggaacagacctggacaccaccactggaactggaagtgacctggacagtgatgtggacagcgaccctgacaaggacaagggcaagggcaagtctgctgagggccagcccaagtttggaggcggcctggcccctcctggggcccccaacagcgtggccgaggtgcctgtgttctacagccagcacagcttcttccccccaccagatgagcagctgctgacagccaccggggctgctggggacagcatcaaggccatcgccagcattgctgagaagtacttcggccctggcttcatgggcatgcaggagaagaagctgggcagcctgccctaccacagcgccttccccttccagttcctgcccaacttcccccacagcctgtaccccttcacagaccgggccctggcccacaacctgctggtgaaggccgagcccaagagccccagagatgccctgaaggtgggcggccccagcgctgagtgcccctttgacctgaccaccaagcccaaggatgtgaagcccatcctgcccatgcccaagggccccagcgccccagccagcggggaggagcagcccctggacctgagcatcggcagccgggcccgggccagccagaatggaggcggccgggagcccaggaagaaccacgtgtatggagagaggaagctgggcgctggggagggcctgccccaggtgtgcccagccaggatgccccagcagccccccctgcactacgccaagcccagccccttcttcatggaccccatctacagccgggtggagaagaggaaggtgacagatcctgtgggcgccctgaaggagaagtacctgcggcccagccccctgctcttccacccccagatgtctgccatcgagaccatgacagagaagctggagagctttgctgccatgaaggctgacagcggcagcagcctgcagcccctgccccaccaccccttcaacttccgcagccccccacccaccctgagtgaccccatcctgaggaagggcaaggagcgctacacctgccgctactgtgggaagatcttccccaggtctgccaacctgaccaggcacctgcggacccacactggagagcagccctaccgctgcaagtactgtgaccgctccttcagcatcagcagcaacctgcagagacatgtgaggaacatccacaacaaggagaagcccttcaagtgccacctgtgcaaccgctgcttcggccagcagaccaacctggacagacacctgaagaagcatgaacatgaaaatgcccctgtgtcccagcaccctggggtgctgaccaaccacctgggcaccagcgccagcagccccaccagcgagagtgacaaccacgccctgctggatgagaaggaggacagctacttcagcgagatccggaacttcatcgccaacagcgagatgaaccaggccagcaccaggacagagaagagagctgacatgcagatcgtggatggcagcgcccagtgccccggcctggccagcgagaagcaggaggatgtggaggaggaggatgatgatgacctggaggaggatgatgaggacagcctggccggcaagagccaggatgacacagtgtccccagcccctgagccccaggccgcctatgaagatgaagaagatgaggagcctgctgccagcctggccgtgggctttgaccacacccggcgctgtgctgaagatcatgaaggaggcctgctggccctggagcccatgcccaccttcggcaagggcctggacctgcggcgggctgctgaggaggcctttgaggtgaaggatgtgctgaacagcaccctggacagcgaggccctgaagcacaccctgtgccggcaggccaagaaccaggcctatgccatgatgctgagcctgtctgaggacacccccctgcacacccccagccagggcagcctggatgcctggctgaaggtgactggagccaccagcgagagcggggccttccaccccatcaaccacctgtag

SEQ ID NO: 165059 - DNA, 3828 bp, Artificial Sequence
  Description of Artificial Sequence: Synthetic coding sequence
atgaggagcaaggcccgggccaggaagctggccaagagtgatggagatgtggtgaacaacatgtatgagcccaacagagacctgctggccagccacagcgcagaagatgaagcagaagattctgccatgagccccatccctgtgggcccccccagccccttccccaccagcgaggacttcacccccaaggagggcagcccctatgaggcccctgtgtacatccctgaggacatccccatcccagctgactttgagctgcgggagagcagcatccctggggccggcctgggcgtgtgggccaagaggaagatggaggccggggagcggctgggcccctgtgtggtggtgcccagggctgctgccaaggagacagactttggctgggagcagatcctgacagatgtggaggtgagcccccaggagggctgcatcaccaagatcagcgaggacctgggcagcgagaagttctgtgtggatgccaaccaggccggggccggctcctggctgaagtacatccgggtggcctgcagctgtgatgaccagaacctgaccatgtgccagatcagcgagcagatctactacaaggtgatcaaggacatcgagcccggggaggagctgctggtgcacgtgaaggagggcgtgtaccccctgggcaccgtgcccccaggcctggatgaggagcccaccttccgctgtgatgaatgtgatgagctgttccagagcaagctggacctgcggcggcacaagaagtacacctgtggctctgtgggcgccgccctgtatgagggcctggccgaggagctgaagccagagggcctgggcggcggcagcggccaggcccacgagtgcaaggactgtgagaggatgttccccaacaagtacagcctggagcagcacatggtgatccacacagaggagcgggagtacaagtgtgaccagtgccccaaggccttcaactggaagagcaacctgatccgccaccagatgagccatgattctgggaagagatttgaatgtgagaactgtgtgaaggtgttcacagaccccagcaacctgcagaggcacatccgcagccagcacgtgggcgcccgggcccacgcctgcccagactgtgggaagacctttgccaccagcagcggcctgaagcagcacaagcacatccacagcacagtgaagcccttcatctgtgaggtgtgccacaagagctacacccagttcagcaacctgtgccgccacaagaggatgcatgctgactgcaggacccagatcaagtgcaaggactgtggccagatgttcagcaccaccagcagcctgaacaagcaccggcgcttctgtgagggcaagaaccactacaccccaggcggcatctttgcccctggcctgcccctgacccccagccccatgatggacaaggccaagcccagccccagcctgaaccacgccagcctgggcttcaatgagtacttccccagccggccccaccctggcagcctgcccttcagcacagccccacccaccttccctgccctgaccccaggcttccctggcatcttcccccccagcctgtacccccggccccccctgctgccccccaccagcctgctgaagagccccctgaaccacacccaggatgccaagctgcccagccccctgggcaacccagccctgcccctggtgtctgctgtgagcaacagcagccagggcaccacagctgctgctggccctgaggagaagtttgagagccggctggaggacagctgtgtggagaagctgaagaccaggagcagtgacatgtctgatggcagtgactttgaagatgtgaacaccaccactggaacagacctggacaccaccactggaactggaagtgacctggacagtgatgtggacagcgaccctgacaaggacaagggcaagggcaagtctgctgagggccagcccaagtttggaggcggcctggcccctcctggggcccccaacagcgtggccgaggtgcctgtgttctacagccagcacagcttcttccccccaccagatgagcagctgctgacagccaccggggctgctggggacagcatcaaggccatcgccagcattgctgagaagtacttcggccctggcttcatgggcatgcaggagaagaagctgggcagcctgccctaccacagcgccttccccttccagttcctgcccaacttcccccacagcctgtaccccttcacagaccgggccctggcccacaacctgctggtgaaggccgagcccaagagccccagagatgccctgaaggtgggcggccccagcgctgagtgcccctttgacctgaccaccaagcccaaggatgtgaagcccatcctgcccatgcccaagggccccagcgccccagccagcggggaggagcagcccctggacctgagcatcggcagccgggcccgggccagccagaatggaggcggccgggagcccaggaagaaccacgtgtatggagagaggaagctgggcgctggggagggcctgccccaggtgtgcccagccaggatgccccagcagccccccctgcactacgccaagcccagccccttcttcatggaccccatctacagagtggagaagaggaaggtgacagatcctgtgggcgccctgaaggagaagtacctgcggcccagccccctgctcttccacccccagatgtctgccatcgagaccatgacagagaagctggagagctttgctgccatgaaggctgacagcggcagcagcctgcagcccctgccccaccaccccttcaacttccgcagccccccacccaccctgagtgaccccatcctgaggaagggcaaggagcgctacacctgccgctactgcggcaagatcttccccaggtctgccaacctgaccaggcacctgcggacccacactggagagcagccctaccgctgcaagtactgtgacaggagcttcagcatcagcagcaacctgcagagacatgtgaggaacatccacaacaaggagaagcccttcaagtgccacctgtgcaaccgctgcttcggccagcagaccaacctggacagacacctgaagaagcatgaacatgaaaatgcccctgtgtcccagcaccctggggtgctgaccaaccacctgggcaccagcgccagcagccccaccagcgagagtgacaaccacgccctgctggatgagaaggaggacagctacttcagcgagatccggaacttcatcgccaacagcgagatgaaccaggccagcaccaggacagagaagagagctgacatgcagatcgtggatggcagcgcccagtgccccggcctggccagcgagaagcaggaggatgtggaggaggaggatgatgatgacctggaggaggatgatgaggacagcctggccggcaagagccaggatgacacagtgtccccagcccctgagccccaggccgcctatgaagatgaggaggatgaggagcctgctgccagcctggccgtgggctttgaccacacccggcgctgtgccgaggaccacgagggcggcctgctggccctggagcccatgcccaccttcggcaagggcctggacctgcggcgggctgctgaggaggcctttgaggtgaaggatgtgctgaacagcaccctggacagcgaggccctgaagcacaccctgtgccggcaggccaagaaccaggcctatgccatgatgctgagcctgtctgaggacacccccctgcacacccccagccagggcagcctggatgcctggctgaaggtgactggagccaccagcgagagcggggccttccaccccatcaaccacctgtag

SEQ ID NO: 165060 - DNA, 3771 bp, Artificial Sequence
  Description of Artificial Sequence: Synthetic coding sequence
atgaggagcaaggcccgggccaggaagctggccaagagtgatggagatgtggtgaacaacatgtatgagcccaacagagacctgctggccagccacagcgcagaagatgaagcagaagattctgccatgagccccatccctgtgggcccccccagccccttccccaccagcgaggacttcacccccaaggagggcagcccctatgaggcccctgtgtacatccctgaggacatccccatcccagctgactttgagctgcgggagagcagcatccctggggccggcctgggcgtgtgggccaagaggaagatggaggccggggagcggctgggcccctgtgtggtggtgcccagggctgctgccaaggagacagactttggctgggagcagatcctgacagatgtggaggtgagcccccaggagggctgcatcaccaagatcagcgaggacctgggcagcgagaagttctgtgtggatgccaaccaggccggggccggctcctggctgaagtacatccgggtggcctgcagctgtgatgaccagaacctgaccatgtgccagatcagcgagcagatctactacaaggtgatcaaggacatcgagcccggggaggagctgctggtgcacgtgaaggagggcgtgtaccccctgggcaccgtgcccccaggcctggatgaggagcccaccttccgctgtgatgaatgtgatgagctgttccagagcaagctggacctgcggcggcacaagaagtacacctgtggctctgtgggcgccgccctgtatgagggcctggccgaggagctgaagccagagggcctgggcggcggcagcggccaggcccacgagtgcaaggactgtgagaggatgttccccaacaagtacagcctggagcagcacatggtgatccacacagaggagcgggagtacaagtgtgaccagtgccccaaggccttcaactggaagagcaacctgatccgccaccagatgagccatgattctgggaagagatttgaatgtgagaactgtgtgaaggtgttcacagaccccagcaacctgcagaggcacatccgcagccagcacgtgggcgcccgggcccacgcctgcccagactgtgggaagacctttgccaccagcagcggcctgaagcagcacaagcacatccacagcacagtgaagcccttcatctgtgaggtgtgccacaagagctacacccagttcagcaacctgtgccgccacaagaggatgcatgctgactgcaggacccagatcaagtgcaaggactgtggccagatgttcagcaccaccagcagcctgaacaagcaccggcgcttctgtgagggcaagaaccactacaccccaggcggcatctttgcccctggcctgcccctgacccccagccccatgatggacaaggccaagcccagccccagcctgaaccacgccagcctgggcttcaatgagtacttccccagccggccccaccctggcagcctgcccttcagcacagccccacccaccttccctgccctgaccccaggcttccctggcatcttcccccccagcctgtacccccggccccccctgctgccccccaccagcctgctgaagagccccctgaaccacacccaggatgccaagctgcccagccccctgggcaacccagccctgcccctggtgtctgctgtgagcaacagcagccagggcaccacagctgctgctggccctgaggagaagtttgagagccggctggaggacagctgtgtggagaagctgaagaccaggagcagtgacatgtctgatggcagtgactttgaagatgtgaacaccaccactggaacagacctggacaccaccactggaactggaagtgacctggacagtgatgtggacagcgaccctgacaaggacaagggcaagggcaagtctgctgagggccagcccaagtttggaggcggcctggcccctcctggggcccccaacagcgtggccgaggtgcctgtgttctacagccagcacagcttcttccccccaccagatgagcagctgctgacagccaccggggctgctggggacagcatcaaggccatcgccagcattgctgagaagtacttcggccctggcttcatgggcatgcaggagaagaagctgggcagcctgccctaccacagcgccttccccttccagttcctgcccaacttcccccacagcctgtaccccttcacagaccgggccctggcccacaacctgctggtgaaggccgagcccaagagccccagagatgccctgaaggtgggcggccccagcgctgagtgcccctttgacctgaccaccaagcccaaggatgtgaagcccatcctgcccatgcccaagggccccagcgccccagccagcggggaggagcagcccctggacctgagcatcggcagccgggcccgggccagccagaatggaggcggccgggagcccaggaagaaccacgtgtatggagagaggaagctgggcgctggggagggcctgccccaggtgtgcccagccaggatgccccagcagccccccctgcactacgccaagcccagccccttcttcatggaccccatctacagagtggagaagaggaaggtgacagatcctgtgggcgccctgaaggagaagtacctgcggcccagccccctgctcttccacccccagatgtctgccatcgagaccatgacagagaagctggagagctttgctgccatgaaggctgacagcggcagcagcctgcagcccctgccccaccaccccttcaacttccgcagccccccacccaccctgagtgaccccatcctgaggaagggcaaggagcgctacacctgccgctactgcggcaagatcttccccaggtctgccaacctgaccaggcacctgcggacccacactggagagcagccctaccgctgcaagtactgtgacaggagcttcagcatcagcagcaacctgcagagacatgtgaggaacatccacaacaaggagaagcccttcaagtgccacctgtgcaaccgctgcttcggccagcagaccaacctggacagacacctgaagaagcatgaacatgaaaatgcccctgtgtcccagcaccctggggtgctgaccaaccacctgggcaccagcgccagcagccccaccagcgagagtgacaaccacgccctgctggatgagaaggaggacagctacttcagcgagatccggaacttcatcgccaacagcgagatgaaccaggccagcaccaggacagagaagagagctgacatgcagatcgtggatggcagcgcccagtgccccggcctggccagcgagaagcaggaggatgtggaggaggaggatgatgatgacctggaggaggatgatgaggacagcctggccggcaagagccaggatgacacagtgtccccagcccctgagccccaggccgcctatgaagatgaggaggatgaggagcctgctgccagcctggccgtgggctttgaccacacccggcgctgtgccgaggaccacgagggcggcctgctggccctggagcccatgcccaccttcggcaagggcctggacctgcggcgggctgctgaggaggcctttgaggtgaaggatgtgctgaacagcaccctggacagcgaggccctgaagcacaccctgtgccggcaggccaagaaccagggcagcctggatgcctggctgaaggtgactggagccaccagcgagagcggggccttccaccccatcaaccacctgtag

SEQ ID NO: 165061 - DNA, 3255 bp, Artificial Sequence
  Description of Artificial Sequence: Synthetic coding sequence
atctactacaaggtgatcaaggacatcgagcctggagaggagctgctggtgcacgtgaaggagggcgtgtaccccctgggcaccgtgcccccaggcctggatgaggagcccaccttccgctgtgatgaatgtgatgagctgttccagagcaagctggacctgcggcggcacaagaagtacacctgtggctctgtgggcgccgccctgtatgagggcctggccgaggagctgaagccagagggcctgggcggcggcagcggccaggcccacgagtgcaaggactgtgagaggatgttccccaacaagtacagcctggagcagcacatggtgatccacacagaggagcgggagtacaagtgtgaccagtgccccaaggccttcaactggaagagcaacctgatccgccaccagatgagccatgacagcggcaagagatttgaatgtgagaactgtgtgaaggtgttcacagaccccagcaacctgcagaggcacatccgcagccagcacgtgggcgcccgggcccacgcctgcccagactgtgggaagacctttgccaccagcagcggcctgaagcagcacaagcacatccacagcacagtgaagcccttcatctgtgaggtgtgccacaagagctacacccagttcagcaacctgtgccgccacaagaggatgcacgccgactgcaggacccagatcaagtgcaaggactgtggccagatgttcagcaccaccagcagcctgaacaagcaccggcgcttctgtgagggcaagaaccactacacccctgggggcatctttgcccctggcctgcccctgacccccagccccatgatggacaaggccaagcccagccccagcctgaaccacgccagcctgggcttcaatgagtacttccccagccggccccaccctggcagcctgcccttcagcacagccccacccaccttccctgccctgaccccaggcttccctggcatcttcccccccagcctgtaccccaggcctcccctgctgccccccaccagcctgctgaagagccccctgaaccacacccaggatgccaagctgcccagccccctgggcaacccagccctgcccctggtgtctgctgtgagcaacagcagccagggcaccacagctgctgctggccctgaggagaagtttgagagccggctggaggacagctgtgtggagaagctgaagaccaggagcagtgacatgtctgatggcagtgactttgaagatgtgaacaccaccaccggcacagacctggacaccaccaccggcaccggcagtgacctggacagtgatgtggacagcgaccctgacaaggacaagggcaagggcaagtctgctgagggccagcccaagtttggaggcggcctggcccctcctggggcccccaacagcgtggccgaggtgcctgtgttctacagccagcacagcttcttccccccaccagatgagcagctgctgacagccactggagctgctggggacagcatcaaggccatcgccagcattgctgagaagtactttggacctggcttcatgggcatgcaggagaagaagctgggcagcctgccctaccacagcgccttccccttccagttcctgcccaacttcccccacagcctgtaccccttcacagaccgggccctggcccacaacctgctggtgaaggccgagcccaagagccccagagatgccctgaaggtgggcggccccagcgcagaatgtccctttgacctgaccaccaagcccaaggatgtgaagcccatcctgcccatgcccaagggccccagcgccccagccagcggggaggagcagcccctggacctgagcatcggcagccgggcccgggccagccagaatggaggcggccgggagcccaggaagaaccacgtgtatggagagaggaagctgggcgctggggagggcctgccccaggtgtgcccagccaggatgccccagcagccccccctgcactacgccaagcccagccccttcttcatggaccccatctacagagtggagaagaggaaggtgacagatcctgtgggcgccctgaaggagaagtacctgcggcccagccccctgctcttccacccccagatgtctgccatcgagaccatgacagagaagctggagagctttgctgccatgaaggctgacagcggcagcagcctgcagcccctgccccaccaccccttcaacttccgcagccccccacccaccctgagtgaccccatcctgaggaagggcaaggagcgctacacctgccgctactgtgggaagatcttccccaggtctgccaacctgaccaggcacctgcggacccacactggagagcagccctaccgctgcaagtactgtgaccgctccttcagcatcagcagcaacctgcagagacatgtgaggaacatccacaacaaggagaagcccttcaagtgccacctgtgcaaccgctgcttcggccagcagaccaacctggacagacacctgaagaagcatgaacatgaaaatgcccctgtgtcccagcaccctggggtgctgaccaaccacctgggcaccagcgccagcagccccaccagcgagagtgacaaccacgccctgctggatgagaaggaggacagctacttcagcgagatccggaacttcatcgccaacagcgagatgaaccaggccagcaccaggacagagaagagagctgacatgcagatcgtggatggcagcgcccagtgccccggcctggccagcgagaagcaggaggatgtggaggaggaggatgatgatgacctggaggaggatgatgaggacagcctggccggcaagagccaggatgacacagtgtccccagcccctgagccccaggccgcctatgaagatgaagaagatgaggagcctgctgccagcctggccgtgggctttgaccacacccggcgctgtgctgaagatcatgaaggaggcctgctggccctggagcccatgcccaccttcggcaagggcctggacctgcggcgggctgctgaggaggcctttgaggtgaaggatgtgctgaacagcaccctggacagcgaggccctgaagcacaccctgtgccggcaggccaagaaccaggcctatgccatgatgctgagcctgtctgaggacacccccctgcacacccccagccagggcagcctggatgcctggctgaaggtgactggagccaccagcgagagcggggccttccaccccatcaaccacctgtag

SEQ ID NO: 165062 - DNA, 3774 bp, Artificial Sequence
  Description of Artificial Sequence: Synthetic coding sequence
atgaggagcaaggcccgggccaggaagctggccaagagtgatggagatgtggtgaacaacatgtatgagcccaacagagacctgctggccagccacagcgcagaagatgaagcagaagattctgccatgagccccatccctgtgggcccccccagccccttccccaccagcgaggacttcacccccaaggagggcagcccctatgaggcccctgtgtacatccctgaggacatccccatcccagctgactttgagctgcgggagagcagcatccctggggccggcctgggcgtgtgggccaagaggaagatggaggccggggagcggctgggcccctgtgtggtggtgcccagggctgctgccaaggagacagactttggctgggagcagatcctgacagatgtggaggtgagcccccaggagggctgcatcaccaagatcagcgaggacctgggcagcgagaagttctgtgtggatgccaaccaggccggggccggctcctggctgaagtacatccgggtggcctgcagctgtgatgaccagaacctgaccatgtgccagatcagcgagcagatctactacaaggtgatcaaggacatcgagcccggggaggagctgctggtgcacgtgaaggagggcgtgtaccccctgggcaccgtgcccccaggcctggatgaggagcccaccttccgctgtgatgaatgtgatgagctgttccagagcaagctggacctgcggcggcacaagaagtacacctgtggctctgtgggcgccgccctgtatgagggcctggccgaggagctgaagccagagggcctgggcggcggcagcggccaggcccacgagtgcaaggactgtgagaggatgttccccaacaagtacagcctggagcagcacatggtgatccacacagaggagcgggagtacaagtgtgaccagtgccccaaggccttcaactggaagagcaacctgatccgccaccagatgagccatgattctgggaagagatttgaatgtgagaactgtgtgaaggtgttcacagaccccagcaacctgcagaggcacatccgcagccagcacgtgggcgcccgggcccacgcctgcccagactgtgggaagacctttgccaccagcagcggcctgaagcagcacaagcacatccacagcacagtgaagcccttcatctgtgaggtgtgccacaagagctacacccagttcagcaacctgtgccgccacaagaggatgcatgctgactgcaggacccagatcaagtgcaaggactgtggccagatgttcagcaccaccagcagcctgaacaagcaccggcgcttctgtgagggcaagaaccactacaccccaggcggcatctttgcccctggcctgcccctgacccccagccccatgatggacaaggccaagcccagccccagcctgaaccacgccagcctgggcttcaatgagtacttccccagccggccccaccctggcagcctgcccttcagcacagccccacccaccttccctgccctgaccccaggcttccctggcatcttcccccccagcctgtacccccggccccccctgctgccccccaccagcctgctgaagagccccctgaaccacacccaggatgccaagctgcccagccccctgggcaacccagccctgcccctggtgtctgctgtgagcaacagcagccagggcaccacagctgctgctggccctgaggagaagtttgagagccggctggaggacagctgtgtggagaagctgaagaccaggagcagtgacatgtctgatggcagtgactttgaagatgtgaacaccaccactggaacagacctggacaccaccactggaactggaagtgacctggacagtgatgtggacagcgaccctgacaaggacaagggcaagggcaagtctgctgagggccagcccaagtttggaggcggcctggcccctcctggggcccccaacagcgtggccgaggtgcctgtgttctacagccagcacagcttcttccccccaccagatgagcagctgctgacagccaccggggctgctggggacagcatcaaggccatcgccagcattgctgagaagtacttcggccctggcttcatgggcatgcaggagaagaagctgggcagcctgccctaccacagcgccttccccttccagttcctgcccaacttcccccacagcctgtaccccttcacagaccgggccctggcccacaacctgctggtgaaggccgagcccaagagccccagagatgccctgaaggtgggcggccccagcgctgagtgcccctttgacctgaccaccaagcccaaggatgtgaagcccatcctgcccatgcccaagggccccagcgccccagccagcggggaggagcagcccctggacctgagcatcggcagccgggcccgggccagccagaatggaggcggccgggagcccaggaagaaccacgtgtatggagagaggaagctgggcgctggggagggcctgccccaggtgtgcccagccaggatgccccagcagccccccctgcactacgccaagcccagccccttcttcatggaccccatctacagccgggtggagaagaggaaggtgacagatcctgtgggcgccctgaaggagaagtacctgcggcccagccccctgctcttccacccccagatgtctgccatcgagaccatgacagagaagctggagagctttgctgccatgaaggctgacagcggcagcagcctgcagcccctgccccaccaccccttcaacttccgcagccccccacccaccctgagtgaccccatcctgaggaagggcaaggagcgctacacctgccgctactgtgggaagatcttccccaggtctgccaacctgaccaggcacctgcggacccacactggagagcagccctaccgctgcaagtactgtgaccgctccttcagcatcagcagcaacctgcagagacatgtgaggaacatccacaacaaggagaagcccttcaagtgccacctgtgcaaccgctgcttcggccagcagaccaacctggacagacacctgaagaagcatgaacatgaaaatgcccctgtgtcccagcaccctggggtgctgaccaaccacctgggcaccagcgccagcagccccaccagcgagagtgacaaccacgccctgctggatgagaaggaggacagctacttcagcgagatccggaacttcatcgccaacagcgagatgaaccaggccagcaccaggacagagaagagagctgacatgcagatcgtggatggcagcgcccagtgccccggcctggccagcgagaagcaggaggatgtggaggaggaggatgatgatgacctggaggaggatgatgaggacagcctggccggcaagagccaggatgacacagtgtccccagcccctgagccccaggccgcctatgaagatgaagaagatgaggagcctgctgccagcctggccgtgggctttgaccacacccggcgctgtgctgaagatcatgaaggaggcctgctggccctggagcccatgcccaccttcggcaagggcctggacctgcggcgggctgctgaggaggcctttgaggtgaaggatgtgctgaacagcaccctggacagcgaggccctgaagcacaccctgtgccggcaggccaagaaccagggcagcctggatgcctggctgaaggtgactggagccaccagcgagagcggggccttccaccccatcaaccacctgtag

SEQ ID NO: 165063 - DNA, 600 bp, Artificial Sequence
  Description of Artificial Sequence: Synthetic coding sequence
atgagcagcgagaactgctttgtggccgagaacagcagcctgcaccctgagagcggccaggagaatgatgccaccagcccccacttcagcaccaggcatgagggcagcttccaggtgcctgtgctgtgtgctgtgatgaatgtggtgttcatcaccatcctgatcatcgccctgattgccctgtctgtgggccagtacaactgccccggccagtacaccttctccatgcccagcgacagccacgtgagcagctgcagcgaggactgggtgggctaccagaggaagtgctacttcatcagcacagtgaagaggtcctggaccagcgcccagaatgcctgcagcgagcacggggccaccctggccgtgattgattctgagaaggacatgaacttcctgaagagatatgccggccgggaggagcactgggtgggcctgaagaaggagcccggccacccctggaagtggagcaatggcaaggagttcaacaactggttcaacgtgacaggcagtgacaagtgtgtgttcctgaagaacacagaggtgtcctccatggagtgtgagaagaacctgtactggatctgcaacaagccctacaagtag

SEQ ID NO: 165064 - DNA, 228 bp, Artificial Sequence
  Description of Artificial Sequence: Synthetic coding sequence
atgcaccacaggatgaatgagatgaacctgagccctgtgggcatggagcagctgaccagcagctctgtgtccaatgccctgcctgtgtctggcagccacctgggcctggccgccagccccacccacagcgccatcccagcccctggcctgcctgtggccatccccaacctgggccccagcctgagcagcctgcccagcgccctgagcctgatgctgcccatgggctag

SEQ ID NO: 165065 - DNA, 1893 bp, Artificial Sequence
  Description of Artificial Sequence: Synthetic coding sequence
atgctgggcatgtatgtgcctgaccgcttcagcctgaagagcagccgggtgcaggacggcatgggcctgtacacagccaggagagtgaggaaaggagagaagtttggcccctttgctggggagaagaggatgcctgaggacctggatgagaacatggactaccgcctgatgtgggaggtgcggggcagcaagggggaggtgctgtacatcctggatgccaccaaccccaggcacagcaactggctgcgctttgtgcatgaggcccccagccaggagcagaagaacctggccgccatccaggagggggagaacatcttctacctggccgtggaggacattgaaacagacacagagctgctgattggctacctggacagcgacatggaggccgaggaggaggagcagcagatcatgaccgtcatcaaggagggggaggtggagaacagccggcggcagagcacagctggcaggaaggaccggctgggctgcaaggaggactatgcctgcccccagtgtgagagcagcttcaccagcgaggacatcctggccgagcacctgcagaccctgcaccagaagcccacagaggagaaggagttcaagtgcaagaactgtgggaagaagtttcctgtgaagcaggccctgcagagacatgtgctgcagtgcacagccaagagcagcctgaaggagagcagccgctccttccagtgcagcgtgtgcaacagcagcttcagcagcgccagcagctttgagcagcaccaggagacctgcagaggagatgccaggtttgtgtgcaaggctgacagctgtgggaagaggctgaagagcaaggatgccctgaagaggcaccaggagaatgtgcacactggagaccccaagaagaagctgatctgcagcgtgtgcaacaagaagtgcagcagcgccagcagcctgcaggagcacaggaagatccacgagatctttgactgccaggagtgcatgaagaagttcatcagcgccaaccagctgaagaggcacatgatcacccacagcgagaagaggccctacaactgtgagatctgcaacaagagcttcaagaggctggaccaggtgggcgcccacaaggtgatccacagcgaggacaagccctacaagtgcaagctgtgtgggaaaggatttgcccacagaaatgtgtacaagaaccacaagaagacccacagcgaggagcggcccttccagtgtgaggagtgcaaggccctcttccgcacccccttcagcctgcagaggcacctgctgatccacaacagcgagaggaccttcaagtgccaccactgtgatgccaccttcaagaggaaggacaccctgaatgtgcacgtgcaggtggtgcatgagcggcacaagaagtaccgctgtgagctgtgcaacaaggcctttgtgacccccagcgtgctgcggagccacaagaagacccacactggagagaaggagaagatctgcccctactgcggccagaagtttgccagcagcggcaccctgcgggtgcacatccgcagccacactggagagcggccctaccagtgcccctactgtgagaagggcttcagcaagaatgatggcctgaagatgcacatccgcacccacacccgggagaagccctacaagtgcagtgaatgttccaaggccttcagccagaagaggggcctggatgagcacaagaggacccacactggagagaagcccttccagtgtgatgtgtgtgacctggccttcagcctgaagaagatgctgatccgccacaagatgacccacaaccccaaccggcccctggccgagtgccagttctgccacaagaagttcaccagaaatgactacctgaaggtgcacatggacaacatccatggagtggccgacagctag

SEQ ID NO: 165066 - DNA, 336 bp, Artificial Sequence
  Description of Artificial Sequence: Synthetic coding sequence
atgctgggcatgtatgtgcctgaccgcttcagcctgaagagcagccgggtgcaggacggcatgggcctgtacacagccaggagagtgaggaaaggagagaagtttggcccctttgctggggagaagaggatgcctgaggacctggatgagaacatggactaccgcctgatgtgggaggtgcggggcagcaagggggaggtgctgtacatcctggatgccaccaaccccaggcacagcaactggctgcgctttgtgcatgaggcccccagccaggagcagaagaacctggccgccatccaggacaagaacctgggccctgctgagtggaggggctag

SEQ ID NO: 165067 - DNA, 1800 bp, Artificial Sequence
  Description of Artificial Sequence: Synthetic coding sequence
atgctgggcatgtatgtgcctgaccgcttcagcctgaagagcagccgggtgcaggacggcatgggcctgtacacagccaggagagtgaggaaaggagagaagtttggcccctttgctggggagaagaggatgcctgaggacctggatgagaacatggactaccgcctgatgtgggaggtgcggggcagcaagggggaggtgctgtacatcctggatgccaccaaccccaggcacagcaactggctgcgctttgtgcatgaggcccccagccaggagcagaagaacctggccgccatccaggagggggagaacatcttctacctggccgtggaggacattgaaacagacacagagctgctgattggctacctggacagcgacatggaggccgaggaggaggagcagcagatcatgaccgtcatcaaggagggggaggtggagaacagccggcggcagagcacagctggcaggaaggaccggctgggctgcaaggaggactatgcctgcccccagtgtgagagcagcttcaccagcgaggacatcctggccgagcacctgcagaccctgcaccagaagcccacagaggagaaggagttcaagtgcaagaactgtgggaagaagtttcctgtgaagcaggccctgcagaggcactttgagcagcaccaggagacctgcagaggagatgccaggtttgtgtgcaaggctgacagctgtgggaagaggctgaagagcaaggatgccctgaagaggcaccaggagaatgtgcacactggagaccccaagaagaagctgatctgcagcgtgtgcaacaagaagtgcagcagcgccagcagcctgcaggagcacaggaagatccacgagatctttgactgccaggagtgcatgaagaagttcatcagcgccaaccagctgaagaggcacatgatcacccacagcgagaagaggccctacaactgtgagatctgcaacaagagcttcaagaggctggaccaggtgggcgcccacaaggtgatccacagcgaggacaagccctacaagtgcaagctgtgtgggaagggctttgcccacagaaatgtgtacaagaaccacaagaagacccacagcgaggagcggcccttccagtgtgaggagtgcaaggccctcttccgcacccccttcagcctgcagaggcacctgctgatccacaacagcgagaggaccttcaagtgccaccactgtgatgccaccttcaagaggaaggacaccctgaatgtgcacgtgcaggtggtgcatgagcggcacaagaagtaccgctgtgagctgtgcaacaaggcctttgtgaccccatctgtgctgcggagccacaagaagacccacactggagagaaggagaagatctgcccctactgcggccagaagtttgccagcagcggcaccctgcgggtgcacatccgcagccacactggagagcggccctaccagtgcccctactgtgagaagggcttcagcaagaatgatggcctgaagatgcacatccgcacccacacccgggagaagccctacaagtgcagcgagtgcagcaaggccttcagccagaagaggggcctggatgagcacaagaggacccacactggagagaagcccttccagtgtgatgtgtgtgacctggccttcagcctgaagaagatgctgatccgccacaagatgacccacaaccccaaccggcccctggccgagtgccagttctgccacaagaagttcaccagaaatgactacctgaaggtgcacatggacaacatccacggcgtggccgacagctag

SEQ ID NO: 165068 - DNA, 1506 bp, Artificial Sequence
  Description of Artificial Sequence: Synthetic coding sequence
atgctgggcatgtatgtgcctgaccgcttcagcctgaagagcagccgggtgcaggacggcatgggcctgtacacagccaggagagtgaggaaaggagagaagtttggcccctttgctggggagaagaggatgcctgaggacctggatgagaacatggactaccgcctgatgtgggaggtgcggggcagcaagggggaggtgctgtacatcctggatgccaccaaccccaggcacagcaactggctgcgctttgtgcatgaggcccccagccaggagcagaagaacctggccgccatccaggagggggagaacatcttctacctggccgtggaggacattgaaacagacacagagctgctgattggctacctggacagcgacatggaggccgaggaggaggagcagcagatcatgaccgtcatcaaggagggggaggtggagaacagccggcggcagagcacagctggcaggaaggaccggctgggctgcaaggaggactatgcctgcccccagtgtgagagcagcttcaccagcgaggacatcctggccgagcacctgcagaccctgcaccagaagcccacagaggagaaggagttcaagtgcaagaactgtgggaagaagtttcctgtgaagcaggccctgcagaggcactttgagcagcaccaggagacctgcagaggagatgccaggtttgtgtgcaaggctgacagctgtgggaagaggctgaagagcaaggatgccctgaagaggcaccaggagaatgtgcacactggagaccccaagaagaagctgatctgcagcgtgtgcaacaagaagtgcagcagcgccagcagcctgcaggagcacaggaagatccacgagatctttgactgccaggagtgcatgaagaagttcatcagcgccaaccagctgaagaggcacatgatcacccacagcgagaagaggccctacaactgtgagatctgcaacaagagcttcaagaggctggaccaggtgggcgcccacaaggtgatccacagcgaggacaagccctacaagtgcaagctgtgtgggaagggctttgcccacagaaatgtgtacaagaaccacaagaagacccacagcgaggagcggcccttccagtgtgaggagtgcaaggccctcttccgcacccccttcagcctgcagaggcacctgctgatccacaacagcgagaggaccttcaagtgccaccactgtgatgccaccttcaagaggaaggacaccctgaatgtgcacgtgcaggtggtgcatgagcggcacaagaagtaccgctgtgagctgtgcaacaaggcctttgtgaccccatctgtgctgcggagccacaagaagacccacactggagagaaggagaagatctgcccctactgcggccagaagtttgccagcagcggcaccctgcgggtgcacatccgcagccacactggagaggccgtgcaggtgctgcgggtgcagcagggcctgcagcctgaggcccggcccggctag

SEQ ID NO: 165069 - DNA, 1227 bp, Artificial Sequence
  Description of Artificial Sequence: Synthetic coding sequence
atgtgccagaacttcttcatcgacagctgtgccgcccacggcccccccacctttgtgaaggacagcgctgtggacaagggccaccccaacagaagtgccctgagcctgcccccaggcctgcgcatcggccccagcggcatcccccaggccggcctgggcgtgtggaatgaggccagtgacctgcccctgggcctgcacttcggcccctatgagggccgcatcacagaagatgaggaggccgccaacaacggctacagctggctgatcaccaagggcaggaactgctatgaatatgtggatggcaaggacaagtcctgggccaactggatgagatatgtgaactgtgccagagatgatgaggagcagaacctggtggccttccagtaccaccggcagatcttctaccgcacctgcagggtcatccggcccggctgtgagctgctggtgtggtatggagatgaatatggccaggagctgggcatcaagtggggcagcaagtggaagaaggagctgatggccggccgggagcccaagccagagatccacccctgccccagctgctgcctggccttcagcagccagaagttcctgagccagcacgtggagaggaaccacagcagccagaacttccctggccccagcgccaggaagctgctgcagcctgagaacccctgccctggggaccagaaccaggagcagcagtacccagacccccacagcagaaatgacaagaccaagggccaggagatcaaggagaggagcaagctgctgaacaagaggacctggcagcgggagatcagccgggccttcagcagcccccccaagggccagatgggcagctgccgggtgggcaagaggatcatggaggaggagagcaggacaggccagaaggtgaaccctggcaacacaggcaagctgtttgtgggcgtgggcatcagcagaattgccaaggtgaagtacggggagtgtggccagggcttctctgtgaagagtgatgtgatcacccaccagaggacccacactggagagaagccctacgtgtgccgggagtgtggccggggcttctcctggcagagcgtgctgctgacccaccagaggacccacactggagagaagccctacgtgtgccgggagtgtggccggggcttcagccggcagagcgtgctgctgacccaccagaggacccacactggagagaagccctacgtgtgccgggaggatgaatag

SEQ ID NO: 165070 - DNA, 2685 bp, Artificial Sequence
  Description of Artificial Sequence: Synthetic coding sequence
atgagccctgagaagagccaggaggagagccctgaggaggacacagagaggacagagaggaagcccatggtgaaggatgccttcaaggacatcagcatctacttcaccaaggaggagtgggccgagatgggagactgggagaagacccgctacagaaatgtgaagaggaactacaatgccctgatcaccatcggcctgcgggccaccaggcctgccttcatgtgccaccggcggcaggccatcaagctgcaggtggatgacacagaagattctgatgaggagtggaccccccggcagcaggtgaagccaccctggatggccctgcgggtggagcagaggaagcaccagaagggcatgcccaaggccagcttcagcaatgaaagcagcctgaaggagctgagcaggacagccaacctgctgaatgccagcggcagcgagcaggcccagaagcctgtgagccccagcggggaggccagcaccagcggccagcacagccggctgaagctggagctgaggaagaaggagacagagaggaagatgtacagcctgcgggagaggaaaggacatgcctacaaggaggtgtctgagccccaggatgatgactacctgtactgtgagatgtgccagaacttcttcatcgacagctgtgccgcccacggcccccccacctttgtgaaggacagcgctgtggacaagggccaccccaacagaagtgccctgagcctgcccccaggcctgcgcatcggccccagcggcatcccccaggccggcctgggcgtgtggaatgaggccagtgacctgcccctgggcctgcacttcggcccctatgagggccgcatcacagaagatgaggaggccgccaacaacggctacagctggctgatcaccaagggcaggaactgctatgaatatgtggatggcaaggacaagtcctgggccaactggatgagatatgtgaactgtgccagagatgatgaggagcagaacctggtggccttccagtaccaccggcagatcttctaccgcacctgcagggtcatccggcccggctgtgagctgctggtgtggtatggagatgaatatggccaggagctgggcatcaagtggggcagcaagtggaagaaggagctgatggccggccgggagcccaagccagagatccacccctgccccagctgctgcctggccttcagcagccagaagttcctgagccagcacgtggagaggaaccacagcagccagaacttccctggccccagcgccaggaagctgctgcagcctgagaacccctgccctggggaccagaaccaggagcagcagtacccagacccccacagcagaaatgacaagaccaagggccaggagatcaaggagaggagcaagctgctgaacaagaggacctggcagcgggagatcagccgggccttcagcagcccccccaagggccagatgggcagctgccgggtgggcaagaggatcatggaggaggagagcaggacaggccagaaggtgaaccctggcaacacaggcaagctgtttgtgggcgtgggcatcagcagaattgccaaggtgaagtacggggagtgtggccagggcttctctgtgaagagtgatgtgatcacccaccagaggacccacactggagagaagctgtatgtgtgccgggagtgtggccggggcttctcctggaagagccacctgctgatccaccagaggatccacactggagagaagccctacgtgtgccgggagtgtggccggggcttctcctggcagagcgtgctgctgacccaccagaggacccacactggagagaagccctacgtgtgccgggagtgtggccggggcttcagccggcagagcgtgctgctgacccaccagaggaggcacactggagagaagccctacgtgtgccgggagtgtggccggggcttcagccggcagagcgtgctgctgacccaccagaggaggcacactggagagaagccctacgtgtgccgggagtgtggccggggcttctcctggcagagcgtgctgctgacccaccagaggacccacactggagagaagccctacgtgtgccgggagtgtggccggggcttctcctggcagagcgtgctgctgacccaccagaggacccacactggagagaagccctacgtgtgccgggagtgtggccggggcttcagcaacaagagccacctgctgcggcaccagaggacccacactggagagaagccctacgtgtgccgggagtgtggccggggcttccgggacaagagccacctgctgcggcaccagaggacccacactggagagaagccctacgtgtgccgggagtgtggccggggcttccgggacaagagcaacctgctgagccaccagaggacccacactggagagaagccctacgtgtgccgggagtgtggccggggcttcagcaacaagagccacctgctgcggcaccagaggacccacactggagagaagccctacgtgtgccgggagtgtggccggggcttcaggaacaagagccacctgctgcggcaccagaggacccacactggagagaagccctacgtgtgccgggagtgtggccggggcttcagtgacaggagcagcctgtgctaccaccagaggacccacactggagagaagccctacgtgtgccgggaggatgaatag

SEQ ID NO: 165071 - DNA, 303 bp, Artificial Sequence
  Description of Artificial Sequence: Synthetic coding sequence
atgagccctgagaagagccaggaggagagccctgaggaggacacagagaggacagagaggaagcccatggtgaaggatgccttcaaggacatcagcatctacttcaccaaggaggagtgggccgagatgggagactgggagaagacccgctacagaaatgtgaagaggaactacaatgccctgatcaccatcggcctgcgggccaccaggcctgccttcatgtgccaccggcggcaggccatcaagctgcaggtggatgacacagaagattctgatgaggagtggaccccccggcagcagtag

SEQ ID NO: 165072 - DNA, 537 bp, Artificial Sequence
  Description of Artificial Sequence: Synthetic coding sequence
atgtctgaggtgcggctgccccccctgcgggccctggatgactttgtgctgggcagcgcccggctggccgccccagacccctgtgacccccagcgctggtgccacagggtcatcaacaacctgctgtactaccagaccaactacctgctgtgcttcggcatcggcctggccctggccggctacgtgcggcccctgcacaccctgctgagcgccctggtggtggccgtggccctgggcgtgctggtgtgggccgctgagaccagggctgctgtgcggcgctgcagaagaagccaccctgctgcctgcctggccgctgtgctggccgtgggcctgctggtgctgtgggtggccggcggggcctgcaccttcctgttcagcattgctggccctgtgctgctgatcctggtgcacgccagcctgcggctgaggaacctgaagaacaagattgagaacaagattgagagcatcggcctgaagaggacccccatgggcctgctgctggaggccctgggccaggagcaggaggccggcagctag

SEQ ID NO: 165073 - DNA, 846 bp, Artificial Sequence
  Description of Artificial Sequence: Synthetic coding sequence
atggccggcacctggctgctgctgctgctggccctgggctgcccagccctgcccactggagtgggcggcacccccttccccagcctggccccacccatcatgctgctggtggatggcaagcagcagatggtggtggtgtgcctggtgctggatgtggcccctcctggcctggacagccccatctggttctctgctggaaatggaagtgccctggatgccttcacctacggccccagccctgccacagatggcacctggaccaacctggcccacctgagcctgcccagcgaggagctggcctcctgggagcccctggtgtgccacactggacctggagctgagggccacagccgcagcacccagcccatgcacctgagcggggaggccagcacagcccggacctgcccccaggagcccctgcggggcacccctgggggcgccctgtggctgggcgtgctgcggctgctgctcttcaagctgctgctgtttgacctgctgctgacctgcagctgcctgtgtgaccctgctggccccctgcccagccctgccaccaccacccggctgcgggccctgggcagccaccggctgcacccagccacagagaccggcggccgggaggccaccagcagcccccggccccagccccgggaccggcgctggggagacaccccacctggcaggaagccaggcagccctgtgtggggcgagggcagctacctgagcagctaccccacctgcccagcccaggcctggtgcagccgcagcgccctgcgggcccccagcagcagcctgggcgccttctttgctggggacctgcccccacccctgcaggccggggccgcctag

SEQ ID NO: 165074 - DNA, 384 bp, Artificial Sequence
  Description of Artificial Sequence: Synthetic coding sequence
atggccgccaccagccctggcccctgggtgagcagccccacccacaggagctgcttcctgcccttcctgacccggggctgccacaacagagtgtgggccgcccaccccttcctgctgtggccccaccagagctgctgctggtggatggagagcagccgctggtggtggagcgcctggagcctgatgctgcaccccctggccctgacagcccctggcaggaagccaggcagccctgtgtggggcgagggcagctacctgagcagctaccccacctgcccagcccaggcctggtgcagccgcagcgccctgcgggcccccagcagcagcctgggcgccttctttgctggggacctgcccccacccctgcaggccggggccgcctag

SEQ ID NO: 165075 - DNA, 771 bp, Artificial Sequence
  Description of Artificial Sequence: Synthetic coding sequence
atggccggcacctggctgctgctgctgctggccctgggctgcccagccctgcccactggacctgtgtccttccccagcagccctgaggccgccaccaccggccccatctggttctctgctggaaatggcagcgccctggatgccttcacctacggccccagccctgccacagatggcacctggaccaacctggcccacctgagcctgcccagcgaggagctggcctcctgggagcccctggtgtgccacacaggccctggagctgagggccacagccgcagcacccagcccatgcacctgtctggagaggccagcacagcccggacctgcccccaggagcccctgcggggcaccccaggaggagccctgtggctgggcgtgctgcggctgctgctcttcaagctgctgctgtttgacctgctgctgacctgcagctgcctgtgtgaccctgctggccccctgcccagccctgccaccaccacccggctgcgggccctgggcagccaccggctgcacccagccacagaaacaggaggccgggaggccaccagcagcccccggccccagccccgggaccggcgctggggagacaccccacctggcaggaagccaggcagccctgtgtggggcgagggcagctacctgagcagctaccccacctgcccagcccaggcctggtgcagccgcagcgccctgcgggcccccagcagcagcctgggcgccttctttgctggggacctgcccccacccctgcaggccggggccgcctag

SEQ ID NO: 165076 - DNA, 525 bp, Artificial Sequence
  Description of Artificial Sequence: Synthetic coding sequence
atggccggcacctggctgctgctgctgctggccctgggctgcccagccctgcccactggagaggccagcacagcccggacctgcccccaggagcccctgcggggcaccccaggaggagccctgtggctgggcgtgctgcggctgctgctcttcaagctgctgctgtttgacctgctgctgacctgcagctgcctgtgtgaccctgctggccccctgcccagccctgccaccaccacccggctgcgggccctgggcagccaccggctgcacccagccacagaaacaggaggccgggaggccaccagcagcccccggccccagccccgggaccggcgctggggagacaccccacctggcaggaagccaggcagccctgtgtggggcgagggcagctacctgagcagctaccccacctgcccagcccaggcctggtgcagccgcagcgccctgcgggcccccagcagcagcctgggcgccttctttgctggggacctgcccccacccctgcaggccggggccgcctag

SEQ ID NO: 165077 - DNA, 438 bp, Artificial Sequence
  Description of Artificial Sequence: Synthetic coding sequence
atgtcctgggcccctgtgctgctgatgctgtttgtgtactgcaccggctgcggcccccagcctgtgctgcaccagcccccagccatgagcagcgccctgggcaccaccatccggctgacctgcaccctgagaaatgaccatgacattggagtgtacagcgtgtactggtaccagcagaggcctggccaccccccacgcttcctgctgcgctacttcagccagagcgacaagagccagggcccccaggtgcccccacgcttcagcggcagcaaggatgtggccaggaacagaggctacctgagcatcagcgagctgcagccagaagatgaggccatgtactactgtgccatgggcgcccggagcagcgagaaggaggagcgggagcgggagtgggaggaggagatggagcccacagctgcccggaccagggtgccctag

SEQ ID NO: 165078 - DNA, 372 bp, Artificial Sequence
  Description of Artificial Sequence: Synthetic coding sequence
atggcctgccgctgcctgtccttcctgctgatgggcaccttcctgtctgtgtcccagacagtgctggcccagctggatgccctgctggtgtttcctggccaggtggcccagctgagctgcaccctgagcccccagcacgtgaccatccgggactatggagtgtcctggtaccagcagagagctggcagcgccccccgctacctgctgtactacagaagtgaggaggaccaccacaggcctgctgacatcccagaccgcttctctgctgccaaggatgaggcccacaatgcctgtgtgctgaccatcagccctgtgcagccagaagatgatgctgactactactgcagcgtgggctacggcttcagcccctag

SEQ ID NO: 165079 - DNA, 513 bp, Artificial Sequence
  Description of Artificial Sequence: Synthetic coding sequence
atggatgagcagccccggctgatgcacagccacgccggcgtgggcatggccggccaccctggcctgagccagcacctgcaggatggagctgggggcacagaaggagagggcggcaggaagcaggacattggagacatcctgcagcagatcatgaccatcacagaccagagcctggatgaggcccaggccaggaagcacgccctgaactgccacaggatgaagccagccctcttcaacgtgctgtgtgagatcaaggagaagacagtgctgagcatccggggggcccaggaggaggagcccacagacccccagctgatgaggctggacaacatgctgctggccgagggcgtggccggccctgagaagggcggcggcagcgctgctgctgctgctgctgctgctgccagcggcggggccggcagtgacaacagcgtggagcacagcgactaccgggccaagctgagccagatccggcagatctaccacacagagctggagaagtatgagcagtag

SEQ ID NO: 165080 - DNA, 1044 bp, Artificial Sequence
  Description of Artificial Sequence: Synthetic coding sequence
atggatgagcagccccggctgatgcacagccacgccggcgtgggcatggccggccaccctggcctgagccagcacctgcaggatggagctgggggcacagaaggagagggcggcaggaagcaggacattggagacatcctgcagcagatcatgaccatcacagaccagagcctggatgaggcccaggccaggaagcacgccctgaactgccacaggatgaagccagccctcttcaacgtgctgtgtgagatcaaggagaagacagtgctgagcatccggggggcccaggaggaggagcccacagacccccagctgatgaggctggacaacatgctgctggccgagggcgtggccggccctgagaagggcggcggcagcgctgctgctgctgctgctgctgctgccagcggcggggccggcagtgacaacagcgtggagcacagcgactaccgggccaagctgagccagatccggcagatctaccacacagagctggagaagtatgagcaggcctgcaatgagttcaccacccacgtgatgaacctgctgcgggagcagagcaggacccggcccatcagccccaaggagattgaaagaatggtgtccatcatccacaggaagttcagcagcatccagatgcagctgaagcagagcacctgtgaggccgtgatgatcctgcggagccgcttcctggatgcccggaggaagagaagaaacttcaacaagcaggccacagagatcctgaatgagtacttctacagccacctgagcaacccctaccccagcgaggaggccaaggaggagctggccaagaagtgtggcatcaccgtgtcccaggtgagcaactggtttggaaacaagaggatccgctacaagaagaacatcggcaagttccaggaggaggccaacatctatgctgccaagacagctgtgacagccaccaacgtgtctgcccacggcagccaggccaacagccccagcacccccaacagcgctgggggctaccccagcccctgctaccagcctgaccggcgcatccagtag

SEQ ID NO: 165081 - DNA, 1044 bp, Artificial Sequence; identical to SEQ ID NO: 165080
  Description of Artificial Sequence: Synthetic coding sequence

SEQ ID NO: 165082 - DNA, 1293 bp, Artificial Sequence
  Description of Artificial Sequence: Synthetic coding sequence
atggatgagcagccccggctgatgcacagccacgccggcgtgggcatggccggccaccctggcctgagccagcacctgcaggatggagctgggggcacagaaggagagggcggcaggaagcaggacattggagacatcctgcagcagatcatgaccatcacagaccagagcctggatgaggcccaggccaggaagcacgccctgaactgccacaggatgaagccagccctcttcaacgtgctgtgtgagatcaaggagaagacagtgctgagcatccggggggcccaggaggaggagcccacagacccccagctgatgaggctggacaacatgctgctggccgagggcgtggccggccctgagaagggcggcggcagcgctgctgctgctgctgctgctgctgccagcggcggggccggcagtgacaacagcgtggagcacagcgactaccgggccaagctgagccagatccggcagatctaccacacagagctggagaagtatgagcaggcctgcaatgagttcaccacccacgtgatgaacctgctgcgggagcagagcaggacccggcccatcagccccaaggagattgaaagaatggtgtccatcatccacaggaagttcagcagcatccagatgcagctgaagcagagcacctgtgaggccgtgatgatcctgcggagccgcttcctggatgcccggaggaagagaagaaacttcaacaagcaggccacagagatcctgaatgagtacttctacagccacctgagcaacccctaccccagcgaggaggccaaggaggagctggccaagaagtgtggcatcaccgtgtcccaggtgagcaactggtttggaaacaagaggatccgctacaagaagaacatcggcaagttccaggaggaggccaacatctatgctgccaagacagctgtgacagccaccaacgtgtctgcccacggcagccaggccaacagccccagcacccccaacagcgctggcagcagcagcagcttcaacatgagcaacagcggggacctcttcatgtctgtgcagagcctgaatggagacagctaccagggcgcccaggtgggcgccaacgtgcagagccaggtggacaccctgcggcacgtgatcagccagacaggaggctacagtgatggcctggccgccagccagatgtacagcccccagggcatcagcgccaacggcggctggcaggatgccaccacccccagctctgtgaccagccccacagagggccctggctctgtgcacagcgacaccagcaactag

SEQ ID NO: 165083 - DNA, 978 bp, Artificial Sequence
  Description of Artificial Sequence: Synthetic coding sequence
atgaggctggacaacatgctgctggccgagggcgtggccggccctgagaagggcggcggcagcgctgctgctgctgctgctgctgctgccagcggcggggccggcagtgacaacagcgtggagcacagcgactaccgggccaagctgagccagatccggcagatctaccacacagagctggagaagtatgagcaggcctgcaatgagttcaccacccacgtgatgaacctgctgcgggagcagagcaggacccggcccatcagccccaaggagattgaaagaatggtgtccatcatccacaggaagttcagcagcatccagatgcagctgaagcagagcacctgtgaggccgtgatgatcctgcggagccgcttcctggatgcccggaggaagagaagaaacttcaacaagcaggccacagagatcctgaatgagtacttctacagccacctgagcaacccctaccccagcgaggaggccaaggaggagctggccaagaagtgtggcatcaccgtgtcccaggtgagcaactggtttggaaacaagaggatccgctacaagaagaacatcggcaagttccaggaggaggccaacatctatgctgccaagacagctgtgacagccaccaacgtgtctgcccacggcagccaggccaacagccccagcacccccaacagcgctggcagcagcagcagcttcaacatgagcaacagcggggacctcttcatgtctgtgcagagcctgaatggagacagctaccagggcgcccaggtgggcgccaacgtgcagagccaggtggacaccctgcggcacgtgatcagccagacaggaggctacagtgatggcctggccgccagccagatgtacagcccccagggcatcagcgccaatggaggctggcaggatgccaccacccccagctctgtgaccagccccacagagggccctggctctgtgcacagcgacaccagcaactag

SEQ ID NO: 165084 - DNA, 1113 bp, Artificial Sequence
  Description of Artificial Sequence: Synthetic coding sequence
atgctgctggtgttctttgtgctgtggacctgcagcctggccctgctggccagcagccagagccccccaccaccctgtgcctctgtgctgagcatccggggggcccaggaggaggagcccacagacccccagctgatgaggctggacaacatgctgctggccgagggcgtggccggccctgagaagggcggcggcagcgctgctgctgctgctgctgctgctgccagcggcggggccggcagtgacaacagcgtggagcacagcgactaccgggccaagctgagccagatccggcagatctaccacacagagctggagaagtatgagcaggcctgcaatgagttcaccacccacgtgatgaacctgctgcgggagcagagcaggacccggcccatcagccccaaggagattgaaagaatggtgtccatcatccacaggaagttcagcagcatccagatgcagctgaagcagagcacctgtgaggccgtgatgatcctgcggagccgcttcctggatgcccggaggaagagaagaaacttcaacaagcaggccacagagatcctgaatgagtacttctacagccacctgagcaacccctaccccagcgaggaggccaaggaggagctggccaagaagtgtggcatcaccgtgtcccaggtgagcaactggtttggaaacaagaggatccgctacaagaagaacatcggcaagttccaggaggaggccaacatctatgctgccaagacagctgtgacagccaccaacgtgtctgcccacggcagccaggccaacagccccagcacccccaacagcgctggcagcagcagcagcttcaacatgagcaacagcggggacctcttcatgtctgtgcagagcctgaatggagacagctaccagggcgcccaggtgggcgccaacgtgcagagccaggtggacaccctgcggcacgtgatcagccagacaggaggctacagtgatggcctggccgccagccagatgtacagcccccagggcatcagcgccaacggcggctggcaggatgccaccacccccagctctgtgaccagccccacagagggccctggctctgtgcacagcgacaccagcaactag

SEQ ID NO: 165085 - DNA, 1263 bp, Artificial Sequence
  Description of Artificial Sequence: Synthetic coding sequence
atggatgagcagccccggctgatgcacagccacgccggcgtgggcatggccggccaccctggcctgagccagcacctgcaggatggagctgggggcacagaaggagagggcggcaggaagcaggacattggagacatcctgcagcagatcatgaccatcacagaccagagcctggatgaggcccaggccaggaagcacgccctgaactgccacaggatgaagccagccctcttcaacgtgctgtgtgagatcaaggagaagacagtgctgagcatccggggggcccaggaggaggagcccacagacccccagctgatgaggctggacaacatgctgctggccgagggcgtggccggccctgagaagggcggcggcagcgctgctgctgctgctgctgctgctgccagcggcggggccggcagtgacaacagcgtggagcacagcgactaccgggccaagctgagccagatccggcagatctaccacacagagctggagaagtatgagcaggcctgcaatgagttcaccacccacgtgatgaacctgctgcgggagcagagcaggacccggcccatcagccccaaggagattgaaagaatggtgtccatcatccacaggaagttcagcagcatccagatgcagctgaagcagagcacctgtgaggccgtgatgatcctgcggagccgcttcctggatgcccggaggaagagaagaaacttcaacaagcaggccacagagatcctgaatgagtacttctacagccacctgagcaacccctaccccagcgaggaggccaaggaggagctggccaagaagtgtggcatcaccgtgtcccaggtgagcaactggtttggaaacaagaggatccgctacaagaagaacatcggcaagttccaggaggaggccaacatctatgctgccaagacagctgtgacagccaccaacgtgtctgcccacggcagccaggccaacagccccagcacccccaacagcgctggcagcagcagcagcttcaacatgagcaacagcggggacctcttcatgtctgtgcagagcctgaatggagacagctaccagggcgcccaggtgggcgccaacgtgcagagccaggtggacaccctgcggcacgtgatcagccagacaggaggctacagtgatggcctggccgccagccagatgtacagcccccagggcatcagccacctgcccaggcacccccggcaggcccactaccacttccggctgcccacctggcacccctag

SEQ ID NO: 165086 - DNA, 906 bp, Artificial Sequence
  Description of Artificial Sequence: Synthetic coding sequence
atgaggctggacaacatgctgctggccgagggcgtggccggccctgagaagggcggcggcagcgctgctgctgctgctgctgctgctgccagcggcggggccggcagtgacaacagcgtggagcacagcgactaccgggccaagctgagccagatccggcagatctaccacacagagctggagaagtatgagcaggcctgcaatgagttcaccacccacgtgatgaacctgctgcgggagcagagcaggacccggcccatcagccccaaggagattgaaagaatggtgtccatcatccacaggaagttcagcagcatccagatgcagctgaagcagagcacctgtgaggccgtgatgatcctgcggagccgcttcctggatgcccggaggaagagaagaaacttcaacaagcaggccacagagatcctgaatgagtacttctacagccacctgagcaacccctaccccagcgaggaggccaaggaggagctggccaagaagtgtggcatcaccgtgtcccaggtgagcaactggtttggaaacaagaggatccgctacaagaagaacatcggcaagttccaggaggaggccaacatctatgctgccaagacagctgtgacagccaccaacgtgtctgcccacggcagccaggccaacagccccagcacccccaacagcgctggcagcagcagcagcttcaacatgagcaacagcggggacctcttcatgtctgtgcagagcctgaatggagacagctaccagggcgcccaggtgggcgccaacgtgcagagccaggtggacaccctgcggcacgtgatcagccagacaggaggctacagtgatggcctggccgccagccagatgtacagcccccagggcatcagcgagatcgcccggacctactag

SEQ ID NO: 165087 - DNA, 1020 bp, Artificial Sequence
  Description of Artificial Sequence: Synthetic coding sequence
atggatgagcagccccggctgatgcacagccacgccggcgtgggcatggccggccaccctggcctgagccagcacctgcaggatggagctgggggcacagaaggagagggcggcaggaagcaggacattggagacatcctgcagcagatcatgaccatcacagaccagagcctggatgaggcccaggccaggaagcacgccctgaactgccacaggatgaagccagccctcttcaacgtgctgtgtgagatcaaggagaagacagtgctgagcatccggggggcccaggaggaggagcccacagacccccagctgatgaggctggacaacatgctgctggccgagggcgtggccggccctgagaagggcggcggcagcgctgctgctgctgctgctgctgctgccagcggcggggccggcagtgacaacagcgtggagcacagcgactaccgggccaagctgagccagatccggcagatctaccacacagagctggagaagtatgagcaggcctgcaatgagttcaccacccacgtgatgaacctgctgcgggagcagagcaggacccggcccatcagccccaaggagattgaaagaatggtgtccatcatccacaggaagttcagcagcatccagatgcagctgaagcagagcacctgtgaggccgtgatgatcctgcggagccgcttcctggatgcccggaggaagagaagaaacttcaacaagcaggccacagagatcctgaatgagtacttctacagccacctgagcaacccctaccccagcgaggaggccaaggaggagctggccaagaagtgtggcatcaccgtgtcccaggtggacaccctgcggcacgtgatcagccagacaggaggctacagtgatggcctggccgccagccagatgtacagcccccagggcatcagcgccaatggaggctggcaggatgccaccacccccagctctgtgaccagccccacagagggccctggctctgtgcacagcgacaccagcaactag

SEQ ID NO: 165088 - DNA, 978 bp, Artificial Sequence; identical to SEQ ID NO: 165083
  Description of Artificial Sequence: Synthetic coding sequence

SEQ ID NO: 165089 - DNA, 978 bp, Artificial Sequence; identical to SEQ ID NO: 165083
  Description of Artificial Sequence: Synthetic coding sequence

SEQ ID NO: 165090 - DNA, 1293 bp, Artificial Sequence
  Description of Artificial Sequence: Synthetic coding sequence
atggatgagcggctgctgggccccccacctcctgggggcggccggggcggcctgggcctggtgtctggagagcccggcggccctggagagcccccaggcggcggggaccccggcggcggcagcggaggagtgcctgggggccggggcaagcaggacattggagacatcctgcagcagatcatgaccatcacagaccagagcctggatgaggcccaggccaagaagcacgccctgaactgccacaggatgaagccagccctcttctctgtgctgtgtgagatcaaggagaagacaggcctgagcatccgcagcagccaggaggaggagcctgtggacccccagctgatgaggctggacaacatgctgctggccgagggcgtggccggccctgagaagggcggcggcagcgctgctgctgctgctgctgctgctgccagcggcggcggcgtgtccccagacaacagcattgagcacagcgactaccgcagcaagctggcccagatccgccacatctaccacagcgagctggagaagtatgagcaggcctgcaatgagttcaccacccacgtgatgaacctgctgcgggagcagagcaggaccaggcctgtggcccccaaggagatggagaggatggtgtccatcatccacaggaagttcagcgccatccagatgcagctgaagcagagcacctgtgaggccgtgatgatcctgcggagccgcttcctggatgcccggaggaagagaagaaacttcagcaagcaggccacagaggtgctgaatgagtacttctacagccacctgagcaacccctaccccagcgaggaggccaaggaggagctggccaagaagtgtggcatcaccgtgtcccaggtgagcaactggtttggaaacaagaggatccgctacaagaagaacatcggcaagttccaggaggaggccaacatctatgctgtgaagacagctgtgtctgtgacccagggcggccacagcaggaccagcagccccaccccacccagcagcgctggcagcggcggcagcttcaacctgagcggcagcggggacatgttcctgggcatgcctggcctgaatggagacagctacagcgccagccaggtggagagcctgcggcacagcatgggccctgggggctacggggacaacctgggcggcggccagatgtacagcccccgggagatgagggccaacggctcctggcaggaggccgtgacccccagctctgtgaccagccccacagagggccctggctctgtgcacagcgacaccagcaactag

SEQ ID NO: 165091 - DNA, 1293 bp, Artificial Sequence; identical to SEQ ID NO: 165090
  Description of Artificial Sequence: Synthetic coding sequence

SEQ ID NO: 165092 - DNA, 1293 bp, Artificial Sequence; identical to SEQ ID NO: 165090
  Description of Artificial Sequence: Synthetic coding sequence

SEQ ID NO: 165093 - DNA, 1293 bp, Artificial Sequence; identical to SEQ ID NO: 165090
  Description of Artificial Sequence: Synthetic coding sequence

SEQ ID NO: 165094 - DNA, 1293 bp, Artificial Sequence; identical to SEQ ID NO: 165090
  Description of Artificial Sequence: Synthetic coding sequence

SEQ ID NO: 165095 - DNA, 1293 bp, Artificial Sequence; identical to SEQ ID NO: 165090
  Description of Artificial Sequence: Synthetic coding sequence

SEQ ID NO: 165096 - DNA, 1293 bp, Artificial Sequence; identical to SEQ ID NO: 165090
  Description of Artificial Sequence: Synthetic coding sequence

SEQ ID NO: 165097 - DNA, 1392 bp, Artificial Sequence
  Description of Artificial Sequence: Synthetic coding sequence
atggatgagcggctgctgggccccccacctcctgggggcggccggggcggcctgggcctggtgtctggagagcccggcggccctggagagcccccaggcggcggggaccccggcggcggcagcggaggagtgcctgggggccggggcaagcaggacattggagacatcctgcagcagatcatgaccatcacagaccagagcctggatgaggcccaggccaagaagcacgccctgaactgccacaggatgaagccagccctcttctctgtgctgtgtgagatcaaggagaagacaggcctgagcatccgcagcagccaggaggaggagcctgtggacccccagctgatgaggctggacaacatgctgctggccgagggcgtggccggccctgagaagggcggcggcagcgctgctgctgctgctgctgctgctgccagcggcggcggcgtgtccccagacaacagcattgagcacagcgactaccgcagcaagctggcccagatccgccacatctaccacagcgagctggagaagtatgagcaggcctgcaatgagttcaccacccacgtgatgaacctgctgcgggagcagagcaggaccaggcctgtggcccccaaggagatggagaggatggtgtccatcatccacaggaagttcagcgccatccagatgcagctgaagcagagcacctgtgaggccgtgatgatcctgcggagccgcttcctggatgcccggaggaagagaagaaacttcagcaagcaggccacagaggtgctgaatgagtacttctacagccacctgagcaacccctaccccagcgaggaggccaaggaggagctggccaagaagtgtggcatcaccgtgtcccaggtgctgtggaggctgcgggaggagctgagcggcaaggtgcacgccagccagctgggcgctgtggtgagcaactggtttggaaacaagaggatccgctacaagaagaacatcggcaagttccaggaggaggccaacatctatgctgtgaagacagctgtgatcatcgccgagcggggcccctttggagtgcggggcacagagctgagcctgcccagcctgcccccccagggcagcggcggcagcttcaacctgagcggcagcggggacatgttcctgggcatgcctggcctgaatggagacagctacagcgccagccaggtgcgctgccccagccccctgcaggtggagagcctgcggcacagcatgggccctgggggctatggagacaacctgggcggcggccagatgtacagcccccgggagatgagggccaacggctcctggcaggaggccgtgacccccagctctgtgaccagccccacagagggccctggctctgtgcacagcgacaccagcaactag

SEQ ID NO: 165098 - DNA, 1392 bp, Artificial Sequence; identical to SEQ ID NO: 165097
  Description of Artificial Sequence: Synthetic coding sequence

SEQ ID NO: 165099 - DNA, 1317 bp, Artificial Sequence
  Description of Artificial Sequence: Synthetic coding sequence
atggatgagcggctgctgggccccccacctcctgggggcggccggggcggcctgggcctggtgtctggagagcccggcggccctggagagcccccaggcggcggggaccccggcggcggcagcggaggagtgcctgggggccggggcaagcaggacattggagacatcctgcagcagatcatgaccatcacagaccagagcctggatgaggcccaggccaagaagcacgccctgaactgccacaggatgaagccagccctcttctctgtgctgtgtgagatcaaggagaagacaggcctgagcatccgcagcagccaggaggaggagcctgtggacccccagctgatgaggctggacaacatgctgctggccgagggcgtggccggccctgagaagggcggcggcagcgctgctgctgctgctgctgctgctgccagcggcggcggcgtgtccccagacaacagcattgagcacagcgactaccgcagcaagctggcccagatccgccacatctaccacagcgagctggagaagtatgagcaggcctgcaatgagttcaccacccacgtgatgaacctgctgcgggagcagagcaggaccaggcctgtggcccccaaggagatggagaggatggtgtccatcatccacaggaagttcagcgccatccagatgcagctgaagcagagcacctgtgaggccgtgatgatcctgcggagccgcttcctggatgcccggaggaagagaagaaacttcagcaagcaggccacagaggtgctgaatgagtacttctacagccacctgagcaacccctaccccagcgaggaggccaaggaggagctggccaagaagtgtggcatcaccgtgtcccaggtgagcaactggtttggaaacaagaggatccgctacaagaagaacatcggcaagttccaggaggaggccaacatctatgctgtgaagacagctgtgtctgtgacccagggcggccacagcaggaccagcagccccaccccacccagcagcgctggcagcggcggcagcttcaacctgagcggcagcggggacatgttcctgggcatgcctggcctgaatggagacagctacagcgccagccaggtgcgctgccccagccccctgcaggtggagagcctgcggcacagcatgggccctgggggctacggggacaacctgggcggcggccagatgtacagcccccgggagatgagggccaacggctcctggcaggaggccgtgacccccagctctgtgaccagccccacagagggccctggctctgtgcacagcgacaccagcaactag

SEQ ID NO: 165100 - DNA, 1317 bp, Artificial Sequence; identical to SEQ ID NO: 165099
  Description of Artificial Sequence: Synthetic coding sequence

SEQ ID NO: 165101 - DNA, 1392 bp, Artificial Sequence; identical to SEQ ID NO: 165097
  Description of Artificial Sequence: Synthetic coding sequence

SEQ ID NO: 165102 - DNA, 1392 bp, Artificial Sequence; identical to SEQ ID NO: 165097
  Description of Artificial Sequence: Synthetic coding sequence

SEQ ID NO: 165103 - DNA, 1332 bp, Artificial Sequence
  Description of Artificial Sequence: Synthetic coding sequence
ggggctgagcagggcggcggcctgcgggccccaccccagctgtggaccaacggctactggggccggcccctgcaggccggggccggcggcctgggcctggtgtctggagagcccggcggccctggagagcccccaggcggcggggaccccggcggcggcagcggcggcgtgcctgggggccggggcaagcaggacatcggggacatcctgcagcagatcatgaccatcacagaccagagcctggatgaggcccaggccaagaagcacgccctgaactgccacaggatgaagccagccctcttctctgtgctgtgtgagatcaaggagaagacaggcctgagcatccgcagcagccaggaggaggagcctgtggacccccagctgatgaggctggacaacatgctgctggccgagggcgtggccggccctgagaagggcggcggcagcgctgctgctgctgctgctgctgctgccagcggcggcggcgtgtccccagacaacagcattgagcacagcgactaccgcagcaagctggcccagatccgccacatctaccacagcgagctggagaagtatgagcaggcctgcaatgagttcaccacccacgtgatgaacctgctgcgggagcagagcaggaccaggcctgtggcccccaaggagatggagaggatggtgtccatcatccacaggaagttcagcgccatccagatgcagctgaagcagagcacctgtgaggccgtgatgatcctgcggagccgcttcctggatgcccggaggaagagaagaaacttcagcaagcaggccacagaggtgctgaatgagtacttctacagccacctgagcaacccctaccccagcgaggaggccaaggaggagctggccaagaagtgtggcatcaccgtgtcccaggtgagcaactggtttggaaacaagaggatccgctacaagaagaacatcggcaagttccaggaggaggccaacatctatgctgtgaagacagctgtgtctgtgacccagggcggccacagcaggaccagcagccccaccccacccagcagcgctggcagcggcggcagcttcaacctgagcggcagcggggacatgttcctgggcatgcctggcctgaatggagacagctacagcgccagccaggtggagagcctgcggcacagcatgggccctgggggctatggagacaacctgggcggcggccagatgtacagcccccgggagatgagggccaacggctcctggcaggaggccgtgacccccagctctgtgaccagccccacagagggccctggctctgtgcacagcgacaccagcaactag

SEQ ID NO: 165104 - DNA, 1332 bp, Artificial Sequence; identical to SEQ ID NO: 165103
  Description of Artificial Sequence: Synthetic coding sequence

SEQ ID NO: 165105 - DNA, 1317 bp, Artificial Sequence; identical to SEQ ID NO: 165099
  Description of Artificial Sequence: Synthetic coding sequence

SEQ ID NO: 165106 - DNA, 1380 bp, Artificial Sequence
  Description of Artificial Sequence: Synthetic coding sequence
atggatgagcggctgctgggccccccacctcctgggggcggccggggcggcctgggcctggtgtctggagagcccggcggccctggagagcccccaggcggcggggaccccggcggcggcagcggaggagtgcctgggggccggggcaagcaggacattggagacatcctgcagcagatcatgaccatcacagaccagagcctggatgaggcccaggccaagaagcacgccctgaactgccacaggatgaagccagccctcttctctgtgctgtgtgagatcaaggagaagacaggcctgagcatccgcagcagccaggaggaggagcctgtggacccccagctgatgaggctggacaacatgctgctggccgagggcgtggccggccctgagaagggcggcggcagcgctgctgctgctgctgctgctgctgccagcggcggcggcgtgtccccagacaacagcattgagcacagcgactaccgcagcaagctggcccagatccgccacatctaccacagcgagctggagaagtatgagcaggcctgcaatgagttcaccacccacgtgatgaacctgctgcgggagcagagcaggaccaggcctgtggcccccaaggagatggagaggatggtgtccatcatccacaggaagttcagcgccatccagatgcagctgaagcagagcacctgtgaggccgtgatgatcctgcggagccgcttcctggatgcccggaggaagagaagaaacttcagcaagcaggccacagaggtgctgaatgagtacttctacagccacctgagcaacccctaccccagcgaggaggccaaggaggagctggccaagaagtgtggcatcaccgtgtcccaggtgctgtggaggctgcgggaggagctgagcggcaaggtgcacgccagccagctgggcgctgtggtgagcaactggtttggaaacaagaggatccgctacaagaagaacatcggcaagttccaggaggaggccaacatctatgctgtgaagacagctgtgtctgtgacccagggcggccacagcaggaccagcagccccaccccacccagcagcgctggcagcggcggcagcttcaacctgagcggcagcggggacatgttcctgggcatgcctggcctgaatggagacagctacagcgccagccaggtgcgctgccccagccccctgcaggtggagagcctgcggcacagcatgggccctgggggctatggagacaacctgggcggcggccagatgtacagcccccgggagatgagggccaacggctcctggcaggaggccgtgacccccagctctgtgaccagccccacagagggccctggctctgtgcacagcgacaccagcaactag

SEQ ID NO: 165107 - DNA, 1332 bp, Artificial Sequence; identical to SEQ ID NO: 165103
  Description of Artificial Sequence: Synthetic coding sequence

SEQ ID NO: 165108 - DNA, 1317 bp, Artificial Sequence; identical to SEQ ID NO: 165099
  Description of Artificial Sequence: Synthetic coding sequence

SEQ ID NO: 165109 - DNA, 1317 bp, Artificial Sequence; identical to SEQ ID NO: 165099
  Description of Artificial Sequence: Synthetic coding sequence

SEQ ID NO: 165110 - DNA, 1332 bp, Artificial Sequence; identical to SEQ ID NO: 165103
  Description of Artificial Sequence: Synthetic coding sequence

SEQ ID NO: 165111 - DNA, 1392 bp, Artificial Sequence; identical to SEQ ID NO: 165097
  Description of Artificial Sequence: Synthetic coding sequence

SEQ ID NO: 165112 - DNA, 1332 bp, Artificial Sequence; identical to SEQ ID NO: 165103
  Description of Artificial Sequence: Synthetic coding sequence

SEQ ID NO: 165113 - DNA, 1332 bp, Artificial Sequence; identical to SEQ ID NO: 165103
  Description of Artificial Sequence: Synthetic coding sequence

SEQ ID NO: 165114 - DNA, 1056 bp, Artificial Sequence
  Description of Artificial Sequence: Synthetic coding sequence
atggatgaccagagcaggatgctgcagaccctggccggcgtgaacctggccggccacagcgtgcagggcggcatggccctgcccccaccaccccacggccacgagggcgcagatggagatggcaggaagcaggacatcggggacatcctgcaccagatcatgaccatcacagaccagagcctggatgaggcccaggccaagaagcacgccctgaactgccacaggatgaagccagccctcttctctgtgctgtgtgagatcaaggagaagacaggcctgagcatccggggggcccaggaggaggaccccccagacccccagctgatgaggctggacaacatgctgctggccgagggcgtgtctggccctgagaagggcggcggcagcgctgctgctgctgctgctgctgctgccagcggcggcagcagtgacaacagcattgagcacagcgactaccgggccaagctgacccagatccggcagatctaccacacagagctggagaagtatgagcaggcctgcaatgagttcaccacccacgtgatgaacctgctgcgggagcagagcaggacccggcccatcagccccaaggagattgaaagaatggtgggcatcatccacaggaagttcagcagcatccagatgcagctgaagcagagcacctgtgaggccgtgatgatcctgcggagccgcttcctggatgcccggaggaagagaagaaacttcagcaagcaggccacagagatcctgaatgagtacttctacagccacctgagcaacccctaccccagcgaggaggccaaggaggagctggccaagaagtgcagcatcaccgtgtcccaggtgagcaactggtttggaaacaagaggatccgctacaagaagaacatcggcaagttccaggaggaggccaacctgtatgctgccaagacagctgtgacagctgcccatgctgtggccgctgctgtgcagaacaaccagaccaacagccccaccacccccaacagcggcggctacccacccagctgctaccagagtgatggccgcctgcagtag

SEQ ID NO: 165115 - DNA, 762 bp, Artificial Sequence
  Description of Artificial Sequence: Synthetic coding sequence
atgaacctgctgcgggagcagagcaggacccggcccatcagccccaaggagattgaaagaatggtgggcatcatccacaggaagttcagcagcatccagatgcagctgaagcagagcacctgtgaggccgtgatgatcctgcggagccgcttcctggatgcccggaggaagagaagaaacttcagcaagcaggccacagagatcctgaatgagtacttctacagccacctgagcaacccctaccccagcgaggaggccaaggaggagctggccaagaagtgcagcatcaccgtgtcccaggtgagcaactggtttggaaacaagaggatccgctacaagaagaacatcggcaagttccaggaggaggccaacctgtatgctgccaagacagctgtgacagctgcccatgctgtggccgctgctgtgcagaacaaccagaccaacagccccaccacccccaacagcggcagcagcggcagcttcaacctgcccaacagcggggacatgttcatgaacatgcagagcctgaatggagacagctaccagggcagccaggtgggcgccaacgtgcagagccaggtggacaccctgcggcacgtgatcaaccagacaggaggctacagtgatggcctgggcggcaacagcctgtacagcccccacaacctgaatgccaatggaggctggcaggatgccaccacccccagctctgtgaccagccccacagagggccctggctctgtgcacagcgacaccagcaactag

SEQ ID NO: 165116 - DNA, 1368 bp, Artificial Sequence
  Description of Artificial Sequence: Synthetic coding sequence
atggatgaccagagcaggatgctgcagaccctggccggcgtgaacctggccggccacagcgtgcagggcggcatggccctgcccccaccaccccacggccacgagggcgcagatggagatggcaggaagcaggacatcggggacatcctgcaccagatcatgaccatcacagaccagagcctggatgaggcccaggccaagaagcacgccctgaactgccacaggatgaagccagccctcttctctgtgctgtgtgagatcaaggagaagacaggcctgagcatccggggggcccaggaggaggaccccccagacccccagctgatgaggctggacaacatgctgctggccgagggcgtgtctggccctgagaagggcggcggcagcgctgctgctgctgctgctgctgctgccagcggcggcagcagtgacaacagcattgagcacagcgactaccgggccaagctgacccagatccggcagatctaccacacagagctggagaagtatgagcaggcctgcaatgagttcaccacccacgtgatgaacctgctgcgggagcagagcaggacccggcccatcagccccaaggagattgaaagaatggtgggcatcatccacaggaagttcagcagcatccagatgcagctgaagcagagcacctgtgaggccgtgatgatcctgcggagccgcttcctggatgcccggaggaagagaagaaacttcagcaagcaggccacagagatcctgaatgagtacttctacagccacctgagcaacccctaccccagcgaggaggccaaggaggagctggccaagaagtgcagcatcaccgtgtcccagagcctggtgaaggaccccaaggagcggggcagcaaaggaagtgacatccagcccacctctgtggtgagcaactggtttggaaacaagaggatccgctacaagaagaacatcggcaagttccaggaggaggccaacctgtatgctgccaagacagctgtgacagctgcccatgctgtggccgctgctgtgcagaacaaccagaccaacagccccaccacccccaacagcggcagcagcggcagcttcaacctgcccaacagcggggacatgttcatgaacatgcagagcctgaatggagacagctaccagggcagccaggtgggcgccaacgtgcagagccaggtggacaccctgcggcacgtgatcaaccagacaggaggctacagtgatggcctgggcggcaacagcctgtacagcccccacaacctgaatgccaatggaggctggcaggatgccaccacccccagctctgtgaccagccccacagagggccctggctctgtgcacagcgacaccagcaactag

SEQ ID NO: 165117 - DNA, 1305 bp, Artificial Sequence
  Description of Artificial Sequence: Synthetic coding sequence
atggatgaccagagcaggatgctgcagaccctggccggcgtgaacctggccggccacagcgtgcagggcggcatggccctgcccccaccaccccacggccacgagggcgcagatggagatggcaggaagcaggacatcggggacatcctgcaccagatcatgaccatcacagaccagagcctggatgaggcccaggccaagaagcacgccctgaactgccacaggatgaagccagccctcttctctgtgctgtgtgagatcaaggagaagacaggcctgagcatccggggggcccaggaggaggaccccccagacccccagctgatgaggctggacaacatgctgctggccgagggcgtgtctggccctgagaagggcggcggcagcgctgctgctgctgctgctgctgctgccagcggcggcagcagtgacaacagcattgagcacagcgactaccgggccaagctgacccagatccggcagatctaccacacagagctggagaagtatgagcaggcctgcaatgagttcaccacccacgtgatgaacctgctgcgggagcagagcaggacccggcccatcagccccaaggagattgaaagaatggtgggcatcatccacaggaagttcagcagcatccagatgcagctgaagcagagcacctgtgaggccgtgatgatcctgcggagccgcttcctggatgcccggaggaagagaagaaacttcagcaagcaggccacagagatcctgaatgagtacttctacagccacctgagcaacccctaccccagcgaggaggccaaggaggagctggccaagaagtgcagcatcaccgtgtcccaggtgagcaactggtttggaaacaagaggatccgctacaagaagaacatcggcaagttccaggaggaggccaacctgtatgctgccaagacagctgtgacagctgcccatgctgtggccgctgctgtgcagaacaaccagaccaacagccccaccacccccaacagcggcagcagcggcagcttcaacctgcccaacagcggggacatgttcatgaacatgcagagcctgaatggagacagctaccagggcagccaggtgggcgccaacgtgcagagccaggtggacaccctgcggcacgtgatcaaccagacaggaggctacagtgatggcctgggcggcaacagcctgtacagcccccacaacctgaatgccaacggcggctggcaggatgccaccacccccagctctgtgaccagccccacagagggccctggctctgtgcacagcgacaccagcaactag

SEQ ID NO: 165118 - DNA, 789 bp, Artificial Sequence
  Description of Artificial Sequence: Synthetic coding sequence
atgaggggcctgagcatccggggggcccaggaggaggaccccccagacccccagctgatgaggctggacaacatgctgctggccgagggcgtgtctggccctgagaagggcggcggcagcgctgctgctgctgctgctgctgctgccagcggcggcagcagtgacaacagcattgagcacagcgactaccgggccaagctgacccagatccggcagatctaccacacagagctggagaagtatgagcaggcctgcaatgagttcaccacccacgtgatgaacctgctgcgggagcagagcaggacccggcccatcagccccaaggagattgaaagaatggtgggcatcatccacaggaagttcagcagcatccagatgcagctgaagcagagcacctgtgaggccgtgatgatcctgcggagccgcttcctggatgcccggaggaagagaagaaacttcagcaagcaggccacagagatcctgaatgagtacttctacagccacctgagcaacccctaccccagcgaggaggccaaggaggagctggccaagaagtgcagcatcaccgtgtcccaggtgagcaactggtttggaaacaagaggatccgctacaagaagaacatcggcaagttccaggaggaggccaacctgtatgctgccaagacagctgtgacagctgcccatgctgtggccgctgctgtgcagaacaaccagaccaacagccccaccacccccaacagcggcggctacccacccagctgctaccagagtgatggccgcctgcagtag

SEQ ID NO: 165119 - DNA, 1080 bp, Artificial Sequence
  Description of Artificial Sequence: Synthetic coding sequence
atgaagccagccctcttctctgtgctgtgtgagatcaaggagaagacaggcctgagcatccggggggcccaggaggaggaccccccagacccccagctgatgaggctggacaacatgctgctggccgagggcgtgtctggccctgagaagggcggcggcagcgctgctgctgctgctgctgctgctgccagcggcggcagcagtgacaacagcattgagcacagcgactaccgggccaagctgacccagatccggcagatctaccacacagagctggagaagtatgagcaggcctgcaatgagttcaccacccacgtgatgaacctgctgcgggagcagagcaggacccggcccatcagccccaaggagattgaaagaatggtgggcatcatccacaggaagttcagcagcatccagatgcagctgaagcagagcacctgtgaggccgtgatgatcctgcggagccgcttcctggatgcccggaggaagagaagaaacttcagcaagcaggccacagagatcctgaatgagtacttctacagccacctgagcaacccctaccccagcgaggaggccaaggaggagctggccaagaagtgcagcatcaccgtgtcccaggtgagcaactggtttggaaacaagaggatccgctacaagaagaacatcggcaagttccaggaggaggccaacctgtatgctgccaagacagctgtgacagctgcccatgctgtggccgctgctgtgcagaacaaccagaccaacagccccaccacccccaacagcggcagcagcggcagcttcaacctgcccaacagcggggacatgttcatgaacatgcagagcctgaatggagacagctaccagggcagccaggtgggcgccaacgtgcagagccaggtggacaccctgcggcacgtgatcaaccagacaggaggctacagtgatggcctgggcggcaacagcctgtacagcccccacaacctgaatgccaatggaggctggcaggatgccaccacccccagctctgtgaccagccccacagagggccctggctctgtgcacagcgacaccagcaactag

SEQ ID NO: 165120 - DNA, 1530 bp, Artificial Sequence
  Description of Artificial Sequence: Synthetic coding sequence
atggagcggcggcggctgtggggcagcatccagagccgctacatctccatgtctgtgtggaccagcccccggcggctggtggagctggccggccagagcctgctgaaggatgaggccctggccatcgccgccctggagctgctgccccgggagctgttccccccactcttcatggccgcctttgatggccgccacagccagaccctgaaggccatggtgcaggcctggcccttcacctgcctgcccctgggcgtgctgatgaagggccagcacctgcacctggagaccttcaaggctgtgctggatggcctggatgtgctgctggcccaggaggtgcggccccggcgctggaagctgcaggtgctggacctgaggaagaacagccaccaggacttctggacagtgtggagcggcaacagagccagcctgtacagcttccctgagcctgaggccgcccagcccatgaccaagaagaggaaggtggatggcctgagcacagaggccgagcagcccttcatccctgtggaggtgctggtggacctcttcctgaaggagggcgcctgtgatgagctgttctcctacctgattgagaaggtgaagaggaagaagaatgtgctgcggctgtgctgcaagaagctgaagatctttgccatgcccatgcaggacatcaagatgatcctgaagatggtgcagctggacagcattgaggacctggaggtgacctgcacctggaagctgcccaccctggccaagttcagcccctacctgggccagatgatcaacctgcggcggctgctgctgagccacatccacgccagcagctacatcagccctgagaaggaggagcagtacatcgcccagttcaccagccagttcctgagcctgcagtgcctgcaggccctgtatgtggacagcctcttcttcctgcggggccgcctggaccagctgctgcggcacgtgatgaaccccctggagaccctgagcatcaccaactgccgcctgtctgaaggagatgtgatgcacctgagccagagccccagcgtgtcccagctgtctgtgctgagcctgtctggagtgatgctgacagatgtgtccccagagcccctgcaggccctgctggagcgggccagcgccaccctgcaggacctggtgtttgatgaatgtggcatcacagatgaccagctgctggccctgctgcccagcctgagccactgcagccagctgaccaccctgtccttctacggcaacagcatcagcatcagcgccctgcagagcctgctgcagcacctgattggcctgagcaacctgacccacgtgctgtaccctgtgcccctggagagctatgaggacatccacggcaccctgcacctggagcggctggcctacctgcacgcccggctgcgggagctgctgtgtgagctgggccggcccagcatggtgtggctgagcgccaacccctgcccccactgtggggacaggaccttctatgaccctgagcccatcctgtgcccctgcttcatgcccaactag

SEQ ID NO: 165121 - DNA, 1530 bp, Artificial Sequence; identical to SEQ ID NO: 165120
  Description of Artificial Sequence: Synthetic coding sequence

SEQ ID NO: 165122 - DNA, 1530 bp, Artificial Sequence; identical to SEQ ID NO: 165120
  Description of Artificial Sequence: Synthetic coding sequence

SEQ ID NO: 165123 - DNA, 261 bp, Artificial Sequence
  Description of Artificial Sequence: Synthetic coding sequence
atggagcggcggcggctgtggggcagcatccagagccgctacatctccatgtctgtgtggaccagcccccggcggctggtggagctggccggccagagcctgctgaaggatgaggccctggccatcgccgccctggagctgctgccccgggagctgttccccccactcttcatggccgcctttgatggccgccacagccagaccctgaaggccatggtgcaggcctggcccttcacctgcctgcccctgggcgtgctgtag

SEQ ID NO: 165124 - DNA, 1530 bp, Artificial Sequence; identical to SEQ ID NO: 165120
  Description of Artificial Sequence: Synthetic coding sequence

SEQ ID NO: 165125 - DNA, 348 bp, Artificial Sequence
  Description of Artificial Sequence: Synthetic coding sequence
atggagcggcggcggctgtggggcagcatccagagccgctacatctccatgtctgtgtggaccagcccccggcggctggtggagctggccggccagagcctgctgaaggatgaggccctggccatcgccgccctggagctgctgccccgggagctgttccccccactcttcatggccgcctttgatggccgccacagccagaccctgaaggccatggtgcaggcctggcccttcacctgcctgcccctgggcgtgctgatgaagggccagcacctgcacctggagaccttcaaggctgtgctggatggcctggatgtgctgctggcccaggaggtgcggcccaggtag

SEQ ID NO: 165126 - DNA, 459 bp, Artificial Sequence
  Description of Artificial Sequence: Synthetic coding sequence
atggagcggcggcggctgtggggcagcatccagagccgctacatctccatgtctgtgtggaccagcccccggcggctggtggagctggccggccagagcctgctgaaggatgaggccctggccatcgccgccctggagctgctgccccgggagctgttccccccactcttcatggccgcctttgatggccgccacagccagaccctgaaggccatggtgcaggcctggcccttcacctgcctgcccctgggcgtgctgatgaagggccagcacctgcacctggagaccttcaaggctgtgctggatggcctggatgtgctgctggcccaggaggtgcggccccggcgctggaagctgcaggtgctggacctgaggaagaacagccaccaggacttctggacagtgtggagcggcaacagagccagcctgtacagcttccctgagcctgaggccgcctag

SEQ ID NO: 165127 - DNA, 1482 bp, Artificial Sequence
  Description of Artificial Sequence: Synthetic coding sequence
atgtctgtgtggaccagcccccggcggctggtggagctggccggccagagcctgctgaaggatgaggccctggccatcgccgccctggagctgctgccccgggagctgttccccccactcttcatggccgcctttgatggccgccacagccagaccctgaaggccatggtgcaggcctggcccttcacctgcctgcccctgggcgtgctgatgaagggccagcacctgcacctggagaccttcaaggctgtgctggatggcctggatgtgctgctggcccaggaggtgcggccccggcgctggaagctgcaggtgctggacctgaggaagaacagccaccaggacttctggacagtgtggagcggcaacagagccagcctgtacagcttccctgagcctgaggccgcccagcccatgaccaagaagaggaaggtggatggcctgagcacagaggccgagcagcccttcatccctgtggaggtgctggtggacctcttcctgaaggagggcgcctgtgatgagctgttctcctacctgattgagaaggtgaagaggaagaagaatgtgctgcggctgtgctgcaagaagctgaagatctttgccatgcccatgcaggacatcaagatgatcctgaagatggtgcagctggacagcattgaggacctggaggtgacctgcacctggaagctgcccaccctggccaagttcagcccctacctgggccagatgatcaacctgcggcggctgctgctgagccacatccacgccagcagctacatcagccctgagaaggaggagcagtacatcgcccagttcaccagccagttcctgagcctgcagtgcctgcaggccctgtatgtggacagcctcttcttcctgcggggccgcctggaccagctgctgcggcacgtgatgaaccccctggagaccctgagcatcaccaactgccgcctgtctgaaggagatgtgatgcacctgagccagagccccagcgtgtcccagctgtctgtgctgagcctgtctggagtgatgctgacagatgtgtccccagagcccctgcaggccctgctggagcgggccagcgccaccctgcaggacctggtgtttgatgaatgtggcatcacagatgaccagctgctggccctgctgcccagcctgagccactgcagccagctgaccaccctgtccttctacggcaacagcatcagcatcagcgccctgcagagcctgctgcagcacctgattggcctgagcaacctgacccacgtgctgtaccctgtgcccctggagagctatgaggacatccacggcaccctgcacctggagcggctggcctacctgcacgcccggctgcgggagctgctgtgtgagctgggccggcccagcatggtgtggctgagcgccaacccctgcccccactgtggggacaggaccttctatgaccctgagcccatcctgtgcccctgcttcatgcccaactag

SEQ ID NO: 165128 - DNA, 606 bp, Artificial Sequence
  Description of Artificial Sequence: Synthetic coding sequence
atggagcggcggcggctgtggggcagcatccagagccgctacatctccatgtctgtgtggaccagcccccggcggctggtggagctggccggccagagcctgctgaaggatgaggccctggccatcgccgccctggagctgctgccccgggagctgttccccccactcttcatggccgcctttgatggccgccacagccagaccctgaaggccatggtgcaggcctggcccttcacctgcctgcccctgggcgtgctgatgaagggccagcacctgcacctggagaccttcaaggctgtgctggatggcctggatgtgctgctggcccaggaggtgcggccccggcgctggaagctgcaggtgctggacctgaggaagaacagccaccaggacttctggacagtgtggagcggcaacagagccagcctgtacagcttccctgagcctgaggccgcccagcccatgaccaagaagaggaaggtggatggcctgagcacagaggccgagcagcccttcatccctgtggaggtgctggtggacctcttcctgaaggagggcgcctgtgatgagctgttctcctacctgattgagaaggtgaagaggtag

SEQ ID NO: 165129 - DNA, 1482 bp, Artificial Sequence; identical to SEQ ID NO: 165127
  Description of Artificial Sequence: Synthetic coding sequence

SEQ ID NO: 165130 - DNA, 1530 bp, Artificial Sequence; identical to SEQ ID NO: 165120
  Description of Artificial Sequence: Synthetic coding sequence

SEQ ID NO: 165131 - DNA, 369 bp, Artificial Sequence
  Description of Artificial Sequence: Synthetic coding sequence
atggccgcccctgtggacctggagctgaagaaggccttcacagagctgcaggccaaggtgattgacacccagcagaaggtgaagctggccgacatccagatcgagcagctgaacagaaccaagaagcacgcccacctgacagacacagagatcatgaccctggtggatgagaccaacatgtatgaaggagtgggccgcatgttcatcctgcagagcaaggaggccatccacagccagctgctggagaagcagaagattgctgaggagaagatcaaggagctggagcagaagaagagctacctggagaggtctgtgaaggaggccgaggacaacatccgggagatgctgatggcccggcgggcccagtag

SEQ ID NO: 165132 - DNA, 465 bp, Artificial Sequence
  Description of Artificial Sequence: Synthetic coding sequence
atggctgaaaattctggccgggccggcaagagcagcggcagcggggccgggaaaggagctgtgtctgctgagcaggtgattgctggcttcaaccggctgcggcaggagcagaggggcctggccagcaaggctgctgagctggagatggagctgaatgagcacagcctggtgattgacaccctgaaggaggtggatgagaccaggaagtgctacaggatggtgggcggcgtgctggtggagaggacagtgaaggaggtgctgcctgccctggagaacaacaaggagcagatccagaagatcatcgagaccctgacccagcagctgcaggccaagggcaaggagctgaatgagttccgggagaagcacaacatccggctgatgggagaagatgagaagccagctgccaaggaaaattctgagggcgctggggccaaggccagcagcgctggggtgctggtgtcctag

SEQ ID NO: 165133 - DNA, 405 bp, Artificial Sequence
  Description of Artificial Sequence: Synthetic coding sequence
atggccgccaccatgaagaaggctgctgctgaagatgtgaatgtgacctttgaggaccagcagaagatcaacaagtttgccaggaacaccagccgcatcacagagctgaaggaggagattgaggtgaagaagaagcagctgcagaacctggaggatgcctgtgatgacatcatgctggctgatgatgactgcctgatgatcccctaccagattggagatgtgttcatcagccacagccaggaggagacccaggagatgctggaggaggccaagaagaacctgcaggaggagattgatgccctggagagccgggtggagagcatccagagggtgctggccgacctgaaggtgcagctgtatgccaagtttggcagcaacatcaacctggaggctgatgagagctag

SEQ ID NO: 165134 - DNA, 465 bp, Artificial Sequence
  Description of Artificial Sequence: Synthetic coding sequence
atggcccagagcatcaacatcacagagctgaacctgccccagctggagatgctgaagaaccagctggaccaggaggtggagttcctgagcaccagcatcgcccagctgaaggtggtgcagaccaagtatgtggaggccaaggactgcctgaatgtgctgaacaagagcaatgaaggcaaggagctgctggtgcccctgaccagctccatgtatgtgcctgggaagctgcatgatgtggagcacgtgctgattgatgtgggcaccggctactacgtggagaagacagcagaagatgccaaggacttcttcaagaggaagattgacttcctgaccaagcagatggagaagatccagcctgccctgcaggagaagcacgccatgaagcaggccgtgatggagatgatgagccagaagatccagcagctgacagccctgggcgccgcccaggccacagccaaggcctag

SEQ ID NO: 165135 - DNA, 330 bp, Artificial Sequence
  Description of Artificial Sequence: Synthetic coding sequence
atggcccagagcatcaacatcacagagctgaacctgccccagctggagatgctgaagaaccagctggaccagatgtatgtgcctgggaagctgcatgatgtggagcacgtgctgattgatgtgggcaccggctactacgtggagaagacagcagaagatgccaaggacttcttcaagaggaagattgacttcctgaccaagcagatggagaagatccagcctgccctgcaggagaagcacgccatgaagcaggccgtgatggagatgatgagccagaagatccagcagctgacagccctgggcgccgcccaggccacagccaaggcctag

SEQ ID NO: 165136 - DNA, 465 bp, Artificial Sequence; identical to SEQ ID NO: 165134
  Description of Artificial Sequence: Synthetic coding sequence

SEQ ID NO: 165137 - DNA, 1281 bp, Artificial Sequence
  Description of Artificial Sequence: Synthetic coding sequence
atgggcaccctgagcgccccaccctgcacccagaggatcaagtggaagggcctgctgctgacagccagcctgctgaacttctggaacctgcccaccacagcccaggtgaccatcgaggccgagcccaccaaggtgtctgagggcaaggatgtgctgctgctggtgcacaacctgccccagaacctgaccggctacatctggtacaagggccagatgagggacctgtaccactacatcaccagctatgtggtggatggagagatcatcatctacggccctgcctacagcggccgggagacagcctacagcaatgccagcctgctgatccagaatgtgaccagagaagatgctggcagctacaccctgcacatcatcaagggagatgatggcacccggggcgtgacaggccgcttcaccttcaccctgcacctggagacccccaagcccagcatcagcagcagcaacctgaacccccgggagaccatggaggccgtgtccctgacctgtgaccctgagaccccagatgccagctacctgtggtggatgaatggccagagcctgcccatgacccacagcctgaagctgtctgagaccaacagaaccctcttcctgctgggcgtgaccaagtacacagctggcccctatgaatgtgagatccggaaccctgtgtctgccagcagaagtgaccctgtgaccctgaacctgctgcccaagctgcccaagccctacatcaccatcaacaacctgaacccccgggagaacaaggatgtgctgaacttcacctgtgagcccaagtctgagaactacacctacatctggtggctgaatggccagagcctgcctgtgagcccccgggtgaagaggcccattgaaaatcgcatcctgatcctgcccagcgtgaccagaaatgaaacaggcccctaccagtgtgagatccgggacagatatggaggcatccgcagtgaccctgtgaccctgaatgtgctgtatggccctgacctgccccgcatctaccccagcttcacctactaccgcagcggggaggtgctgtacctgagctgcagcgctgacagcaaccccccagcccagtacagctggaccatcaatgagaagttccagctgcccggccagaagctgttcatccgccacatcaccaccaagcacagcggcctgtatgtgtgcagcgtgagaaattctgccaccgggaaggagagcagcaagtccatgacagtggaggtgtctgggaagtggatcccagccagcctggccatcggcttctag

SEQ ID NO: 165138 - DNA, 432 bp, Artificial Sequence
  Description of Artificial Sequence: Synthetic coding sequence
atgggcaccctgagcgccccaccctgcacccagaggatcaagtggaagggcctgctgctgacagccagcctgctgaacttctggaacctgcccaccacagcccaggtgaccatcgaggccgagcccaccaaggtgtctgagggcaaggatgtgctgctgctggtgcacaacctgccccagaacctgaccggctacatctggtacaagggccagatgagggacctgtaccactacatcaccagctatgtggtggatggagagatcatcatctacggccctgcctacagcggccgggagacagcctacagcaatgccagcctgctgatccagaatgtgaccagagaagatgctggcagctacaccctgcacatcatcaagggagatgatggcacccggggcgtgacaggccgcttcaccttcaccctgcactag

SEQ ID NO: 165139 - DNA, 1287 bp, Artificial Sequence
  Description of Artificial Sequence: Synthetic coding sequence
atgggcaccctgagcgccccaccctgcacccagaggatcaagtggaagggcctgctgctgacagccagcctgctgaacttctggaacctgcccaccacagcccaggtgaccatcgaggccgagcccaccaaggtgtctgagggcaaggatgtgctgctgctggtgcacaacctgccccagaacctgaccggctacatctggtacaagggccagatgagggacctgtaccactacatcaccagctatgtggtggatggagagatcatcatctacggccctgcctacagcggccgggagacagcctacagcaatgccagcctgctgatccagaatgtgaccagagaagatgctggcagctacaccctgcacatcatcaagggagatgatggcacccggggcgtgacaggccgcttcaccttcaccctgcacctggagacccccaagcccagcatcagcagcagcaacctgaacccccgggagaccatggaggccgtgtccctgacctgtgaccctgagaccccagatgccagctacctgtggtggatgaatggccagagcctgcccatgacccacagcctgaagctgtctgagaccaacagaaccctcttcctgctgggcgtgaccaagtacacagctggcccctatgaatgtgagatccggaaccctgtgtctgccagcagaagtgaccctgtgaccctgaacctgctgcccaagctgcccaagccctacatcaccatcaacaacctgaacccccgggagaacaaggatgtgctgaacttcacctgtgagcccaagtctgagaactacacctacatctggtggctgaatggccagagcctgcctgtgagcccccgggtgaagaggcccattgaaaatcgcatcctgatcctgcccagcgtgaccagaaatgaaacaggcccctaccagtgtgagatccgggacagatatggaggcatccgcagtgaccctgtgaccctgaatgtgctgtatggccctgacctgccccgcatctaccccagcttcacctactaccgcagcggggaggtgctgtacctgagctgcagcgctgacagcaaccccccagcccagtacagctggaccatcaatgagaagttccagctgcccggccagaagctgttcatccgccacatcaccaccaagcacagcggcctgtatgtgtgcagcgtgagaaattctgccaccgggaaggagagcagcaagtccatgacagtggaggtgtctgcctacagcagcagcatcaactacaccagcggcaacagaaattag

SEQ ID NO: 165140 - DNA, 1260 bp, Artificial Sequence
  Description of Artificial Sequence: Synthetic coding sequence
atgggcaccctgagcgccccaccctgcacccagaggatcaagtggaagggcctgctgctgacagccagcctgctgaacttctggaacctgcccaccacagcccaggtgaccatcgaggccgagcccaccaaggtgtctgagggcaaggatgtgctgctgctggtgcacaacctgccccagaacctgaccggctacatctggtacaagggccagatgagggacctgtaccactacatcaccagctatgtggtggatggagagatcatcatctacggccctgcctacagcggccgggagacagcctacagcaatgccagcctgctgatccagaatgtgaccagagaagatgctggcagctacaccctgcacatcatcaagggagatgatggcacccggggcgtgacaggccgcttcaccttcaccctgcacctggagacccccaagcccagcatcagcagcagcaacctgaacccccgggagaccatggaggccgtgtccctgacctgtgaccctgagaccccagatgccagctacctgtggtggatgaatggccagagcctgcccatgacccacagcctgaagctgtctgagaccaacagaaccctcttcctgctgggcgtgaccaagtacacagctggcccctatgaatgtgagatccggaaccctgtgtctgccagcagaagtgaccctgtgaccctgaacctgctgcccaagctgcccaagccctacatcaccatcaacaacctgaacccccgggagaacaaggatgtgctgaacttcacctgtgagcccaagtctgagaactacacctacatctggtggctgaatggccagagcctgcctgtgagcccccgggtgaagaggcccattgaaaatcgcatcctgatcctgcccagcgtgaccagaaatgaaacaggcccctaccagtgtgagatccgggacagatatggaggcatccgcagtgaccctgtgaccctgaatgtgctgtatggccctgacctgccccgcatctaccccagcttcacctactaccgcagcggggaggtgctgtacctgagctgcagcgctgacagcaaccccccagcccagtacagctggaccatcaatgagaagttccagctgcccggccagaagctgttcatccgccacatcaccaccaagcacagcggcctgtatgtgtgcagcgtgagaaattctgccaccgggaaggagagcagcaagtccatgacagtggaggtgtctgactggacagtgccctag

SEQ ID NO: 165141 - DNA, 1254 bp, Artificial Sequence
  Description of Artificial Sequence: Synthetic coding sequence
atgggcaccctgagcgccccaccctgcacccagaggatcaagtggaagggcctgctgctgacagccagcctgctgaacttctggaacctgcccaccacagcccaggtgaccatcgaggccgagcccaccaaggtgtctgagggcaaggatgtgctgctgctggtgcacaacctgccccagaacctgaccggctacatctggtacaagggccagatgagggacctgtaccactacatcaccagctatgtggtggatggagagatcatcatctacggccctgcctacagcggccgggagacagcctacagcaatgccagcctgctgatccagaatgtgaccagagaagatgctggcagctacaccctgcacatcatcaagggagatgatggcacccggggcgtgacaggccgcttcaccttcaccctgcacctggagacccccaagcccagcatcagcagcagcaacctgaacccccgggagaccatggaggccgtgtccctgacctgtgaccctgagaccccagatgccagctacctgtggtggatgaatggccagagcctgcccatgacccacagcctgaagctgtctgagaccaacagaaccctcttcctgctgggcgtgaccaagtacacagctggcccctatgaatgtgagatccggaaccctgtgtctgccagcagaagtgaccctgtgaccctgaacctgctgcccaagctgcccaagccctacatcaccatcaacaacctgaacccccgggagaacaaggatgtgctgaacttcacctgtgagcccaagtctgagaactacacctacatctggtggctgaatggccagagcctgcctgtgagcccccgggtgaagaggcccattgaaaatcgcatcctgatcctgcccagcgtgaccagaaatgaaacaggcccctaccagtgtgagatccgggacagatatggaggcatccgcagtgaccctgtgaccctgaatgtgctgtatggccctgacctgccccgcatctaccccagcttcacctactaccgcagcggggaggtgctgtacctgagctgcagcgctgacagcaaccccccagcccagtacagctggaccatcaatgagaagttccagctgcccggccagaagctgttcatccgccacatcaccaccaagcacagcggcctgtatgtgtgcagcgtgagaaattctgccaccgggaaggagagcagcaagtccatgacagtggaggtgtctgaggccctgtag

SEQ ID NO: 165142 - DNA, 642 bp, Artificial Sequence
  Description of Artificial Sequence: Synthetic coding sequence
atgggccccctgagcgccccaccctgcacagagcacatcaagtggaagggcctgctgctgactgtggagacccccaagcccagcatcagcagcagcaacctgaacccccgggaggccatggagaccgtcatcctgacctgcaaccctgagaccccagatgccagctacctgtggtggatgaatggccagagcctgcccatgacccacaggatgcagctgtctgagaccaacagaaccctcttcctgtttggagtgaccaagtacacagctggcccctatgaatgtgagatctggaacagcggcagcgccagcagaagtgaccctgtgaccctgaacctgctgcacggccctgacctgccccgcatcttccccagcgtgaccagctactacagcggggagaacctggacctgagctgctttgccaacagcaaccccccagcccagtacagctggaccatcaacgggaagttccagctgagcggccagaagctgttcatcccccagatcacccccaagcacaacggcctgtatgcctgcagcgccaggaacagcgccaccggggaggagagcagcaccagcctgaccatccgggtgattgcccctcctggcctgggcacctttgccttcaacaaccccacctag

SEQ ID NO: 165143 - DNA, 1008 bp, Artificial Sequence
  Description of Artificial Sequence: Synthetic coding sequence
atgggccccctgagcgccccaccctgcacagagcacatcaagtggaagggcctgctgctgacagccctgctgctgaacttctggaacctgcccaccacagcccaggtgatgattgaggcccagccccccaaggtgtctgagggcaaggatgtgctgctgctggtgcacaacctgccccagaacctgaccggctacatctggtacaagggccagatccgggacctgtaccactacatcaccagctatgtggtggatggccagatcatcatctacggccctgcctacagcggccgggagaccgtgtacagcaatgccagcctgctgatccagaatgtgaccagagaagatgctggcagctacaccctgcacatcatcaagagaggagatggcacccggggcgtgacaggctacttcaccttcaccctgtacctggagacccccaagcccagcatcagcagcagcaacctgaacccccgggaggccatggagaccgtcatcctgacctgcaaccctgagaccccagatgccagctacctgtggtggatgaatggccagagcctgcccatgacccacaggatgcagctgtctgagaccaacagaaccctcttcctgtttggagtgaccaagtacacagctggcccctatgaatgtgagatctggaacagcggcagcgccagcagaagtgaccctgtgaccctgaacctgctgcacggccctgacctgccccgcatcttccccagcgtgaccagctactacagcggggagaacctggacctgagctgctttgccaacagcaaccccccagcccagtacagctggaccatcaacgggaagttccagctgagcggccagaagctgttcatcccccagatcacccccaagcacaacggcctgtatgcctgcagcgccaggaacagcgccaccggggaggagagcagcaccagcctgaccatccgggtgattgcccctcctggcctgggcacctttgccttcaacaaccccacctag

SEQ ID NO: 165144 - DNA, 1008 bp, Artificial Sequence; identical to SEQ ID NO: 165143
  Description of Artificial Sequence: Synthetic coding sequence

SEQ ID NO: 165145 - DNA, 642 bp, Artificial Sequence; identical to SEQ ID NO: 165142
  Description of Artificial Sequence: Synthetic coding sequence

SEQ ID NO: 165146 - DNA, 1008 bp, Artificial Sequence
  Description of Artificial Sequence: Synthetic coding sequence
atgggccccctgagcgccccaccctgcacagagcacatcaagtggaagggcctgctggtgacagccagcctgctgaacttctggaacctgcccaccacagcccaggtgaccatcgaggcccagccccccaaggtgtctgagggcaaggatgtgctgctgctggtgcacaacctgccccagaacctgaccggctacatctggtacaagggccagatccgggacctgtaccactacatcaccagctatgtggtggatggccagatcatcatctacggccctgcctacagcggccgggagacagcctacagcaatgccagcctgctgatccagaatgtgaccagagaagatgctggcagctacaccctgcacatcatcaagagaggagatggcacccggggcgtgacaggctacttcaccttcaccctgtacctggagacccccaagcccagcatcagcagcagcaacctgaacccccgggaggccatggagaccgtcatcctgacctgtgaccctgagaccccagacaccagctaccagtggtggatgaatggccagagcctgcccatgacccaccgcttccagctgtctgagaccaacagaaccctcttcctgtttggagtgaccaagtacacagctggcccctatgaatgtgagatccggaacagcggcagcgccagcagaagtgaccctgtgaccctgaacctgctgcacggccctgacctgccccgcatccaccccagctacaccaactacagaagtggggacaacctgtacctgagctgctttgccaacagcaaccccccagcccagtacagctggaccatcaacgggaagttccagcagagcggccagaacctcttcatcccccagatcaccaccaagcacagcggcctgtatgtgtgcagcgtgaggaacagcgccaccggggaggagagcagcaccagcctgactgtgaaggtgtctgccagcacccgcatcggcctgctgcccctgctgaaccccacctag

SEQ ID NO: 165147 - DNA, 1008 bp, Artificial Sequence; identical to SEQ ID NO: 165146
  Description of Artificial Sequence: Synthetic coding sequence

SEQ ID NO: 165148 - DNA, 1008 bp, Artificial Sequence; identical to SEQ ID NO: 165146
  Description of Artificial Sequence: Synthetic coding sequence

SEQ ID NO: 165149 - DNA, 1287 bp, Artificial Sequence
  Description of Artificial Sequence: Synthetic coding sequence
atgggccccctgagcgccccaccctgcacccagaggatcacctggaagggcctgctgctgacagccctgctgctgaacttctggaacctgcccaccacagcccaggtgaccatcgaggccgagcccaccaaggtgtccaagggcaaggatgtgctgctgctggtgcacaacctgccccagaacctggccggctacatctggtacaagggccagatgaaggacctgtaccactacatcaccagctatgtggtggatggccagatcatcatctacggccctgcctacagcggccgggagaccgtgtacagcaatgccagcctgctgatccagaatgtgaccagagaagatgctggcagctacaccctgcacatcgtgaagagaggagatggcaccagaggagaaacaggccacttcaccttcaccctgtacctggagacccccaagcccagcatcagcagcagcaacctgtacccccgggaggacatggaggccgtgtccctgacctgtgaccctgagaccccagatgccagctacctgtggtggatgaatggccagagcctgcccatgacccacagcctgcagctgagcaagaacaagaggaccctcttcctgtttggagtgaccaagtacacagctggcccctatgaatgtgagatccggaaccctgtgtctgccagcagaagtgaccctgtgaccctgaacctgctgcccaagctgcccaagccctacatcaccatcaacaacctgaacccccgggagaacaaggatgtgctggccttcacctgtgagcccaagtctgagaactacacctacatctggtggctgaatggccagagcctgcctgtgagcccccgggtgaagaggcccattgaaaatcgcatcctgatcctgcccagcgtgaccagaaatgaaacaggcccctaccagtgtgagatccaggacagatatggaggcatccgcagctaccctgtgaccctgaatgtgctgtatggccctgacctgccccgcatctaccccagcttcacctactaccacagcggggagaacctgtacctgagctgctttgctgacagcaaccccccagctgagtacagctggaccatcaatggcaagttccagctgagcggccagaagctgttcatcccccagatcaccaccaagcacagcggcctgtatgcctgcagcgtgagaaattctgccaccggcatggagagcagcaagtccatgacagtgaaggtgtctgcccccagcggcaccggccacctgcccggcctgaaccccctgtag

SEQ ID NO: 165150 - DNA, 981 bp, Artificial Sequence
  Description of Artificial Sequence: Synthetic coding sequence
atgggccccctgagcgccccaccctgcacccagaggatcacctggaagggcgtgctgctgacagccagcctgctgaacttctggaacccccccaccacagcccaggtgaccatcgaggcccagccccccaaggtgtctgagggcaaggatgtgctgctgctggtgcacaacctgccccagaacctggccggctacatctggtacaagggccagatgacctacctgtaccactacatcaccagctatgtggtggatggccagaggatcatctacggccctgcctacagcggccgggagcgggtgtacagcaatgccagcctgctgatccagaatgtgacccaggaggatgctggcagctacaccctgcacatcatcaagagaagagatggcactggaggagtgacaggccacttcaccttcaccctgcacctggagacccccaagcccagcatcagcagcagcaacctgaacccccgggaggccatggaggccgtcatcctgacctgtgaccctgccaccccagctgccagctaccagtggtggatgaatggccagagcctgcccatgacccaccggctgcagctgagcaagaccaacagaaccctcttcatctttggagtgaccaagtacatcgccggcccctatgaatgtgagatccggaaccctgtgtctgccagcagaagtgaccctgtgaccctgaacctgctgcacggccctgacctgcccagcatctaccccagcttcacctactacagaagtggagaaaatctctacctgagctgctttgctgagagcaacccccgggcccagtacagctggaccatcaacgggaagttccagctgagcggccagaagctgagcatcccccagatcaccaccaagcacagcggcctgtatgcctgcagcgtgaggaacagcgccaccgggaaggagagcagcaagagcatcaccgtgaaggtgtctgactggatcctgccctag

SEQ ID NO: 165151 - DNA, 1260 bp, Artificial Sequence
  Description of Artificial Sequence: Synthetic coding sequence
atgggccccctgagcgccccaccctgcacccagaggatcacctggaagggcgtgctgctgacagccagcctgctgaacttctggaacccccccaccacagcccaggtgaccatcgaggcccagccccccaaggtgtctgagggcaaggatgtgctgctgctggtgcacaacctgccccagaacctggccggctacatctggtacaagggccagatgacctacctgtaccactacatcaccagctatgtggtggatggccagaggatcatctacggccctgcctacagcggccgggagcgggtgtacagcaatgccagcctgctgatccagaatgtgacccaggaggatgctggcagctacaccctgcacatcatcaagagaagagatggcactggaggagtgacaggccacttcaccttcaccctgcacctggagacccccaagcccagcatcagcagcagcaacctgaacccccgggaggccatggaggccgtcatcctgacctgtgaccctgccaccccagctgccagctaccagtggtggatgaatggccagagcctgcccatgacccaccggctgcagctgagcaagaccaacagaaccctcttcatctttggagtgaccaagtacatcgccggcccctatgaatgtgagatccggaaccctgtgtctgccagcagaagtgaccctgtgaccctgaacctgctgcccaagctgagcaagccctacatcaccatcaacaacctgaacccccgggagaacaaggatgtgctgaccttcacctgtgagcccaagagcaagaactacacctacatctggtggctgaatggccagagcctgcctgtgagcccccgggtgaagaggcccattgaaaatcgcatcctgatcctgcccaacgtgaccagaaatgaaacaggcccctaccagtgtgagatccgggacagatatggaggcatccgcagtgaccctgtgaccctgaatgtgctgtatggccctgacctgcccagcatctaccccagcttcacctactaccgcagcggggagaacctgtacctgagctgctttgctgagagcaacccccgggcccagtacagctggaccatcaatggcaagttccagctgagcggccagaagctgagcatcccccagatcaccaccaagcacagcggcctgtatgcctgcagcgtgagaaattctgccaccgggaaggagagcagcaagagcatcaccgtgaaggtgtctgactggatcctgccctag

SEQ ID NO: 165152 - DNA, 981 bp, Artificial Sequence
  Description of Artificial Sequence: Synthetic coding sequence
atgggccccctgagcgccccaccctgcacccagaggatcacctggaagggcgtgctgctgacagccagcctgctgaacttctggaacccccccaccacagcccaggtgaccatcgaggcccagccccccaaggtgtctgagggcaaggatgtgctgctgctggtgcacaacctgccccagaacctggccggctacatctggtacaagggccagatgacctacctgtaccactacatcaccagctatgtggtggatggccagaggatcatctacggccctgcctacagcggccgggagcgggtgtacagcaatgccagcctgctgatccagaatgtgacccaggaggatgctggcagctacaccctgcacatcatcaagagaagagatggcactggaggagtgacaggccacttcaccttcaccctgcaccccaagctgagcaagccctacatcaccatcaacaacctgaacccccgggagaacaaggatgtgctgaccttcacctgtgagcccaagagcaagaactacacctacatctggtggctgaatggccagagcctgcctgtgagcccccgggtgaagaggcccatcgagaaccgcatcctgatcctgcccaacgtgaccagaaatgagaccggcccctaccagtgtgagatccgggacagatatggaggcatccgcagtgaccctgtgaccctgaatgtgctgtatggccctgacctgcccagcatctaccccagcttcacctactacagaagtggagaaaatctctacctgagctgctttgctgagagcaacccccgggcccagtacagctggaccatcaacgggaagttccagctgagcggccagaagctgagcatcccccagatcaccaccaagcacagcggcctgtatgcctgcagcgtgaggaacagcgccaccgggaaggagagcagcaagagcatcaccgtgaaggtgtctgactggatcctgccctag

SEQ ID NO: 165153 - DNA, 1008 bp, Artificial Sequence
  Description of Artificial Sequence: Synthetic coding sequence
atgggccccctgagcgccccaccctgcacccagcacatcacctggaagggcctgctgctgacagccagcctgctgaacttctggaacctgcccatcacagcccaggtgaccatcgaggccctgccccccaaggtgtctgagggcaaggatgtgctgctgctggtgcacaacctgccccagaacctggccggctacatctggtacaagggccagctgatggacctgtaccactacatcaccagctatgtggtggatggccagatcaacatctacggccctgcctacacaggccgggagaccgtgtacagcaatgccagcctgctgatccagaatgtgaccagagaagatgctggcagctacaccctgcacatcatcaagagaggagacaggacccggggcgtgacaggctacttcaccttcaacctgtacctgaagctgcccaagccctacatcaccatcaacaacagcaagccccgggagaacaaggatgtgctggccttcacctgtgagcccaagtctgagaactacacctacatctggtggctgaatggccagagcctgcctgtgagcccccgggtgaagaggcccatcgagaaccgcatcctgatcctgcccagcgtgaccagaaatgagaccggcccctatgaatgtgagatccgggacagagatggcggcatgagaagtgaccctgtgaccctgaatgtgctgtatggccctgacctgcccagcatctaccccagcttcacctactacagaagtggagaaaatctctacctgagctgctttgctgagagcaaccccccagctgagtacttctggaccatcaacgggaagttccagcagagcggccagaagctgagcatcccccagatcaccaccaagcaccggggcctgtacacctgcagcgtgaggaacagcgccaccgggaaggagagcagcaagtccatgacagtggaggtgtctgcccccagcggcatcggccgcctgcccctgctgaaccccatctag

SEQ ID NO: 165154 - DNA, 1008 bp, Artificial Sequence; identical to SEQ ID NO: 165153
  Description of Artificial Sequence: Synthetic coding sequence

SEQ ID NO: 165155 - DNA, 1008 bp, Artificial Sequence; identical to SEQ ID NO: 165153
  Description of Artificial Sequence: Synthetic coding sequence

SEQ ID NO: 165156 - DNA, 1275 bp, Artificial Sequence
  Description of Artificial Sequence: Synthetic coding sequence
atgggccccctgagcgccccaccctgcacccagcacatcacctggaagggcctgctgctgacagccagcctgctgaacttctggaacctgcccaccacagcccaggtgatcatcgaggccaagccacccaaggtgtctgagggcaaggatgtgctgctgctggtgcacaacctgccccagaacctgaccggctacatctggtacaagggccagatgacagacctgtaccactacatcaccagctatgtggtgcacggccagatcatctacggccctgcctacagcggccgggagaccgtgtacagcaatgccagcctgctgatccagaatgtgacccaggaggatgctggcagctacaccctgcacatcatcaagagaggagatggcaccggcggcgtgacaggctacttcaccgtgaccctgtacagcgagacccccaagcccagcatcagcagcagcaacctgaacccccgggaggtgatggaggccgtgcggctcatctgtgaccctgagaccccagatgccagctacctgtggctgctgaatggccagaacctgcccatgacccaccggctgcagctgagcaagaccaacagaaccctgtacctgtttggagtgaccaagtacatcgccggcccctatgaatgtgagatcagaaatcctgtgtctgccagcagaagtgaccctgtgaccctgaacctgctgcccaagctgcccatgccctacatcaccatcaacaacctgaacccccgggagaagaaggatgtgctggccttcacctgtgagcccaagagcaggaactacacctacatctggtggctgaatggccagagcctgcctgtgagcccccgggtgaagaggcccatcgagaaccgcatcctgatcctgcccagcgtgaccagaaatgagaccggcccctaccagtgtgagatccgggacagatatggaggcatccgcagcaaccctgtgaccctgaatgtgctgtatggccctgacctgccccgcatctaccccagcttcacctactacagaagtggagagaacctggacctgagctgctttgctgacagcaaccccccagctgagtacagctggaccatcaacgggaagttccagctgagcggccagaagctgttcatcccccagatcaccaccaaccacagcggcctgtatgcctgcagcgtgaggaacagcgccaccgggaaggagatcagcaagtccatgattgtgaaggtgtctggcccctgccacggcaaccagacagagagccactag

SEQ ID NO: 165157 - DNA, 1308 bp, Artificial Sequence
  Description of Artificial Sequence: Synthetic coding sequence
atgggccccctgagcgccccaccctgcacccagcacatcacctggaagggcctgctgctgacagccagcctgctgaacttctggaacctgcccaccacagcccaggtgatcatcgaggccaagccacccaaggtgtctgagggcaaggatgtgctgctgctggtgcacaacctgccccagaacctgaccggctacatctggtacaagggccagatgacagacctgtaccactacatcaccagctatgtggtgcacggccagatcatctacggccctgcctacagcggccgggagaccgtgtacagcaatgccagcctgctgatccagaatgtgacccaggaggatgctggcagctacaccctgcacatcatcaagagaggagatggcaccggcggcgtgacaggctacttcaccgtgaccctgtacagcgagacccccaagcccagcatcagcagcagcaacctgaacccccgggaggtgatggaggccgtgcggctcatctgtgaccctgagaccccagatgccagctacctgtggctgctgaatggccagaacctgcccatgacccaccggctgcagctgagcaagaccaacagaaccctgtacctgtttggagtgaccaagtacatcgccggcccctatgaatgtgagatcagaaatcctgtgtctgccagcagaagtgaccctgtgaccctgaacctgctgcccaagctgcccatgccctacatcaccatcaacaacctgaacccccgggagaagaaggatgtgctggccttcacctgtgagcccaagagcaggaactacacctacatctggtggctgaatggccagagcctgcctgtgagcccccgggtgaagaggcccatcgagaaccgcatcctgatcctgcccagcgtgaccagaaatgagaccggcccctaccagtgtgagatccgggacagatatggaggcatccgcagcaaccctgtgaccctgaatgtgctgtatggccctgacctgccccgcatctaccccagcttcacctactacagaagtggagagaacctggacctgagctgctttgctgacagcaaccccccagctgagtacagctggaccatcaacgggaagttccagctgagcggccagaagctgttcatcccccagatcaccaccaaccacagcggcctgtatgcctgcagcgtgaggaacagcgccaccgggaaggagatcagcaagtccatgattgtgaaggtgtctgaaacagccagcccccaggtgacctacgccggccccaacacctggttccaggagatcctgctgctgtag

SEQ ID NO: 165158 - DNA, 606 bp, Artificial Sequence
  Description of Artificial Sequence: Synthetic coding sequence
atgggaggagatgaaaatagaggagtgacaggccacttcaccttcaccctgtacctggagacccccaagcccagcatcagcagcagcaagctgaacccccgggaggccatggaggccgtgtccctgacctgtgaccctgagaccccagatgccagctacctgtggtggatgaatggccagagcctgcccatgagccaccggctgcagctgtctgagaccaacagaaccctcttcctgctgggcgtgaccaagtacacagctggcccctatgaatgtgagatcagaaatcctgtgtctgccagcagaagtgaccccttcaccctgaacctgctgcacggccctgacctgccccgcatctaccccagcttcacctactaccgcagcggggaggtgctgtacctgagctgcagcgctgacagcaaccccccagcccagtacagctggaccatcaatggcaagttccagctgagcggccagaagctgttcatcccccagatcaccaccaagcacagcggcctgtatgcctgcagcgtgagaaattctgccaccgggaaggagagcagcaagtccatgacagtgaaggtgtctgactggaccctgccctag

SEQ ID NO: 165159 - DNA, 1281 bp, Artificial Sequence
  Description of Artificial Sequence: Synthetic coding sequence
atgggcctgctgagcgccccaccctgcacccagaggatcacctggaagggcctgctgctgacagccagcctgctgaacttctggaacccccccaccacagcccaggtgaccatcgaggcccagcccaccaaggtgtctgagggcaaggatgtgctgctgctggtgcacaacctgccccagaacctgaccggctacatctggtacaagggccagatccgggacctgtaccactacatcaccagctatgtggtggatggccagatcatcatctacggccctgcctacagcggccgggagaccatctacagcaatgccagcctgctgatccagaatgtgacccaggaggatgctggcagctacaccctgcacatcatcatgggaggagatgagaacagaggagtgacaggccacttcaccttcaccctgtacctggagacccccaagcccagcatcagcagcagcaagctgaacccccgggaggccatggaggccgtgtccctgacctgtgaccctgagaccccagatgccagctacctgtggtggatgaatggccagagcctgcccatgagccaccggctgcagctgtctgagaccaacagaaccctcttcctgctgggcgtgaccaagtacacagctggcccctatgaatgtgagatccggaaccctgtgtctgccagcagaagtgaccccttcaccctgaacctgctgcccaagctgcccaagccctacatcaccatcaacaacctgaagccccgggagaacaaggatgtgctgaacttcacctgtgagcccaagtctgagaactacacctacatctggtggctgaatggccagagcctgcctgtgagcccccgggtgaagaggcccattgaaaatcgcatcctgatcctgcccagcgtgaccagaaatgaaacaggcccctaccagtgtgagatccgggaccagtatggaggcatccgcagctaccctgtgaccctgaatgtgctgtatggccctgacctgccccgcatctaccccagcttcacctactaccgcagcggggaggtgctgtacctgagctgcagcgctgacagcaaccccccagcccagtacagctggaccatcaatggcaagttccagctgagcggccagaagctgttcatcccccagatcaccaccaagcacagcggcctgtatgcctgcagcgtgagaaattctgccaccgggaaggagagcagcaagtccatgacagtgaaggtgtctgggaagagaattcctgtgtccctggccatcggcatctag

SEQ ID NO: 165160 - DNA, 717 bp, Artificial Sequence
  Description of Artificial Sequence: Synthetic coding sequence
atgagccaccggctgcagctgtctgagaccaacagaaccctcttcctgctgggcgtgaccaagtacacagctggcccctatgaatgtgagatccggaaccctgtgtctgccagcagaagtgaccccttcaccctgaacctgctgcccaagctgcccaagccctacatcaccatcaacaacctgaagccccgggagaacaaggatgtgctgaacttcacctgtgagcccaagtctgagaactacacctacatctggtggctgaatggccagagcctgcctgtgagcccccgggtgaagaggcccattgaaaatcgcatcctgatcctgcccagcgtgaccagaaatgaaacaggcccctaccagtgtgagatccgggaccagtatggaggcatccgcagctaccctgtgaccctgaatgtgctgtatggccctgacctgccccgcatctaccccagcttcacctactaccgcagcggggaggtgctgtacctgagctgcagcgctgacagcaaccccccagcccagtacagctggaccatcaatggcaagttccagctgagcggccagaagctgttcatcccccagatcaccaccaagcacagcggcctgtatgcctgcagcgtgagaaattctgccaccgggaaggagagcagcaagtccatgacagtgaaggtgtctgcctacagcagcagcatcaactacacagctgtgtactag

SEQ ID NO: 165161 - DNA, 1260 bp, Artificial Sequence
  Description of Artificial Sequence: Synthetic coding sequence
atgggcctgctgagcgccccaccctgcacccagaggatcacctggaagggcctgctgctgacagccagcctgctgaacttctggaacccccccaccacagcccaggtgaccatcgaggcccagcccaccaaggtgtctgagggcaaggatgtgctgctgctggtgcacaacctgccccagaacctgaccggctacatctggtacaagggccagatccgggacctgtaccactacatcaccagctatgtggtggatggccagatcatcatctacggccctgcctacagcggccgggagaccatctacagcaatgccagcctgctgatccagaatgtgacccaggaggatgctggcagctacaccctgcacatcatcatgggaggagatgagaacagaggagtgacaggccacttcaccttcaccctgtacctggagacccccaagcccagcatcagcagcagcaagctgaacccccgggaggccatggaggccgtgtccctgacctgtgaccctgagaccccagatgccagctacctgtggtggatgaatggccagagcctgcccatgagccaccggctgcagctgtctgagaccaacagaaccctcttcctgctgggcgtgaccaagtacacagctggcccctatgaatgtgagatccggaaccctgtgtctgccagcagaagtgaccccttcaccctgaacctgctgcccaagctgcccaagccctacatcaccatcaacaacctgaagccccgggagaacaaggatgtgctgaacttcacctgtgagcccaagtctgagaactacacctacatctggtggctgaatggccagagcctgcctgtgagcccccgggtgaagaggcccattgaaaatcgcatcctgatcctgcccagcgtgaccagaaatgaaacaggcccctaccagtgtgagatccgggaccagtatggaggcatccgcagctaccctgtgaccctgaatgtgctgtatggccctgacctgccccgcatctaccccagcttcacctactaccgcagcggggaggtgctgtacctgagctgcagcgctgacagcaaccccccagcccagtacagctggaccatcaatggcaagttccagctgagcggccagaagctgttcatcccccagatcaccaccaagcacagcggcctgtatgcctgcagcgtgagaaattctgccaccgggaaggagagcagcaagtccatgacagtgaaggtgtctgactggaccctgccctag

SEQ ID NO: 165162 - DNA, 894 bp, Artificial Sequence
  Description of Artificial Sequence: Synthetic coding sequence
atgggcctgctgagcgccccaccctgcacccagaggatcacctggaagggcctgctgctgactgtggagacccccaagcccagcatcagcagcagcaagctgaacccccgggaggccatggaggccgtgtccctgacctgtgaccctgagaccccagatgccagctacctgtggtggatgaatggccagagcctgcccatgagccaccggctgcagctgtctgagaccaacagaaccctcttcctgctgggcgtgaccaagtacacagctggcccctatgaatgtgagatccggaaccctgtgtctgccagcagaagtgaccccttcaccctgaacctgctgcccaagctgcccaagccctacatcaccatcaacaacctgaagccccgggagaacaaggatgtgctgaacttcacctgtgagcccaagtctgagaactacacctacatctggtggctgaatggccagagcctgcctgtgagcccccgggtgaagaggcccattgaaaatcgcatcctgatcctgcccagcgtgaccagaaatgaaacaggcccctaccagtgtgagatccgggaccagtatggaggcatccgcagctaccctgtgaccctgaatgtgctgtatggccctgacctgccccgcatctaccccagcttcacctactaccgcagcggggaggtgctgtacctgagctgcagcgctgacagcaaccccccagcccagtacagctggaccatcaatggcaagttccagctgagcggccagaagctgttcatcccccagatcaccaccaagcacagcggcctgtatgcctgcagcgtgagaaattctgccaccgggaaggagagcagcaagtccatgacagtgaaggtgtctgactggaccctgccctag

SEQ ID NO: 165163 - DNA, 1209 bp, Artificial Sequence
  Description of Artificial Sequence: Synthetic coding sequence
atgggccccctgcctgcccccagctgcacccagaggatcacctggaagggcctgctgctgacagccagcctgctgaacttctggaacccccccaccacagctgaggtgaccatcgaggcccagccccccaaggtgtctgagggcaaggatgtgctgctgctggtgcacaacctgccccagaacctgcccggctacttctggtacaagggggagatgacagacctgtaccactacatcatctcctacatcgtggatggcaagatcatcatctacggccctgcctacagcggccgggagaccgtgtacagcaatgccagcctgctgatccagaatgtgaccaggaaggatgctggcacctacaccctgcacatcatcaagagaggagatgagacccgggaggagatccgccacttcaccttcaccctgtacctggagacccccaagccctacatcagcagcagcaacctgaacccccgggaggccatggaggccgtgcggctcatctgtgaccctgagaccctggatgccagctacctgtggtggatgaatggccagagcctgcctgtgacccaccggctgcagctgagcaagaccaacagaaccctgtacctgtttggagtgaccaagtacatcgccggcccctatgaatgtgagatccggaaccctgtgtctgccagcagaagtgaccctgtgaccctgaacctgctgcacggccctgacctgccccgcatctaccccagcttcacctactacagaagtggagagaacctggacctgagctgcttcacagagagcaaccccccagctgagtacttctggaccatcaacgggaagttccagcagagcggccagaagctgttcatcccccagatcaccaggaaccacagcggcctgtatgcctgcagcgtgcacaacagcgccaccgggaaggagatcagcaagtccatgacagtgaaggtgtctgggaagtggatcccagccagcctggccgtgggcttctacgtggagagcatctggctgtctgagaagagccaggagaacatcttcatccccagcctgtgccccatgggcaccagcaagagccagatcctgctgctgaacccccccaacctgagcctgcagaccctcttcagcctcttcttctgcttcctgatggctgacctggtgtctggcctgaagaaggtgggccggggcctgtaccagccctag

SEQ ID NO: 165164 - DNA, 1281 bp, Artificial Sequence
  Description of Artificial Sequence: Synthetic coding sequence
atgggccccctgcctgcccccagctgcacccagaggatcacctggaagggcctgctgctgacagccagcctgctgaacttctggaacccccccaccacagctgaggtgaccatcgaggcccagccccccaaggtgtctgagggcaaggatgtgctgctgctggtgcacaacctgccccagaacctgcccggctacttctggtacaagggggagatgacagacctgtaccactacatcatctcctacatcgtggatggcaagatcatcatctacggccctgcctacagcggccgggagaccgtgtacagcaatgccagcctgctgatccagaatgtgaccaggaaggatgctggcacctacaccctgcacatcatcaagagaggagatgagacccgggaggagatccgccacttcaccttcaccctgtacctggagacccccaagccctacatcagcagcagcaacctgaacccccgggaggccatggaggccgtgcggctcatctgtgaccctgagaccctggatgccagctacctgtggtggatgaatggccagagcctgcctgtgacccaccggctgcagctgagcaagaccaacagaaccctgtacctgtttggagtgaccaagtacatcgccggcccctatgaatgtgagatccggaaccctgtgtctgccagcagaagtgaccctgtgaccctgaacctgctgcccaagctgcccatcccctacatcaccatcaacaacctgaacccccgggagaacaaggatgtgctggccttcacctgtgagcccaagtctgagaactacacctacatctggtggctgaatggccagagcctgcctgtgtcccctggggtgaagaggcccattgaaaatcgcatcctgatcctgcccagcgtgaccagaaatgaaacaggcccctaccagtgtgagatccgggacagatatggaggcctgcggagcaaccctgtgatcctgaatgtgctgtatggccctgacctgccccgcatctaccccagcttcacctactaccgcagcggggagaacctggacctgagctgcttcacagagagcaaccccccagctgagtacttctggaccatcaatggcaagttccagcagagcggccagaagctgttcatcccccagatcaccaggaaccacagcggcctgtatgcctgcagcgtgcacaacagcgccaccgggaaggagatcagcaagtccatgacagtgaaggtgtctggcccctgccacggggacctgacagagagccagagctag

SEQ ID NO: 165165 - DNA, 723 bp, Artificial Sequence
  Description of Artificial Sequence: Synthetic coding sequence
atgggccccctgcctgcccccagctgcacccagaggatcacctggaagggcctgctgctgacagccagcctgctgaacttctggaacccccccaccacagctgaggtgaccatcgaggcccagccccccaaggtgtctgagggcaaggatgtgctgctgctggtgcacaacctgccccagaacctgcccggctacttctggtacaagggggagatgacagacctgtaccactacatcatctcctacatcgtggatggcaagatcatcatctacggccctgcctacagcggccgggagaccgtgtacagcaatgccagcctgctgatccagaatgtgaccaggaaggatgctggcacctacaccctgcacatcatcaagagaggagatgagacccgggaggagatccgccacttcaccttcaccctgtactacggccctgacctgccccgcatctaccccagcttcacctactaccgcagcggggagaacctggacctgagctgcttcacagagagcaaccccccagctgagtacttctggaccatcaatggcaagttccagcagagcggccagaagctgttcatcccccagatcaccaggaaccacagcggcctgtatgcctgcagcgtgcacaacagcgccaccgggaaggagatcagcaagtccatgacagtgaaggtgtctggcccctgccacggggacctgacagagagccagagctag

SEQ ID NO: 165166 - DNA, 1164 bp, Artificial Sequence
  Description of Artificial Sequence: Synthetic coding sequence
atgggccccctgcctgcccccagctgcacccagaggatcacctggaagggcctgctgctgacagccagcctgctgaacttctggtacaagggggagatgacagacctgtaccactacatcatctcctacatcgtggatggcaagatcatcatctacggccctgcctacagcggccgggagaccgtgtacagcaatgccagcctgctgatccagaatgtgaccaggaaggatgctggcacctacaccctgcacatcatcaagagaggagatgagacccgggaggagatccgccacttcaccttcaccctgtacctggagacccccaagccctacatcagcagcagcaacctgaacccccgggaggccatggaggccgtgcggctcatctgtgaccctgagaccctggatgccagctacctgtggtggatgaatggccagagcctgcctgtgacccaccggctgcagctgagcaagaccaacagaaccctgtacctgtttggagtgaccaagtacatcgccggcccctatgaatgtgagatcagaaatcctgtgtctgccagcagaagtgaccctgtgaccctgaacctgctgcccaagctgcccatcccctacatcaccatcaacaacctgaacccccgggagaacaaggatgtgctggccttcacctgtgagcccaagtctgagaactacacctacatctggtggctgaatggccagagcctgcctgtgtccccaggagtgaagaggcccatcgagaaccgcatcctgatcctgcccagcgtgaccagaaatgagaccggcccctaccagtgtgagatccgggacagatatggaggcctgcggagcaaccctgtgatcctgaatgtgctgtatggccctgacctgccccgcatctaccccagcttcacctactacagaagtggagagaacctggacctgagctgcttcacagagagcaaccccccagctgagtacttctggaccatcaacgggaagttccagcagagcggccagaagctgttcatcccccagatcaccaggaaccacagcggcctgtatgcctgcagcgtgcacaacagcgccaccgggaaggagatcagcaagtccatgacagtgaaggtgtctggcccctgccacggggacctgacagagagccagagctag

SEQ ID NO: 165167 - DNA, 1002 bp, Artificial Sequence
  Description of Artificial Sequence: Synthetic coding sequence
atgggccccctgcctgcccccagctgcacccagaggatcacctggaagggcctgctgctgacagccagcctgctgaacttctggaacccccccaccacagctgaggtgaccatcgaggcccagccccccaaggtgtctgagggcaaggatgtgctgctgctggtgcacaacctgccccagaacctgcccggctacttctggtacaagggggagatgacagacctgtaccactacatcatctcctacatcgtggatggcaagatcatcatctacggccctgcctacagcggccgggagaccgtgtacagcaatgccagcctgctgatccagaatgtgaccaggaaggatgctggcacctacaccctgcacatcatcaagagaggagatgagacccgggaggagatccgccacttcaccttcaccctgtacagcaagctgcccatcccctacatcaccatcaacaacctgaacccccgggagaacaaggatgtgctggccttcacctgtgagcccaagtctgagaactacacctacatctggtggctgaatggccagagcctgcctgtgtccccaggagtgaagaggcccatcgagaaccgcatcctgatcctgcccagcgtgaccagaaatgagaccggcccctaccagtgtgagatccgggacagatatggaggcctgcggagcaaccctgtgatcctgaatgtgctgtatggccctgacctgccccgcatctaccccagcttcacctactacagaagtggagagaacctggacctgagctgcttcacagagagcaaccccccagctgagtacttctggaccatcaacgggaagttccagcagagcggccagaagctgttcatcccccagatcaccaggaaccacagcggcctgtatgcctgcagcgtgcacaacagcgccaccgggaaggagatcagcaagtccatgacagtgaaggtgtctggcccctgccacggggacctgacagagagccagagctag

SEQ ID NO: 165168 - DNA, 1032 bp, Artificial Sequence
  Description of Artificial Sequence: Synthetic coding sequence
atgctgctgctgaagaagcacacagaggacatcagctctgtgtatgagatccgggagcggctgggcagcggggccttcagcgaggtggtgctggcccaggagcggggcagcgcccacctggtggccctgaagtgcatccccaagaaggccctgcggggcaaggaggccctggtggagaatgaaattgctgtgctgcggcgcatcagccaccccaacatcgtggccctggaggatgtgcatgagagccccagccacctgtacctggccatggagctggtgactggaggagagctgtttgaccgcatcatggagcggggcagctacacagagaaggatgccagccacctggtgggccaggtgctgggcgctgtgtcctacctgcacagcctgggcatcgtgcaccgggacctgaagccagagaacctgctgtatgccaccccatttgaggacagcaagatcatggtgtctgactttggcctgagcaagatccaggccggcaacatgctgggcacagcctgtggcaccccaggctacgtggcccctgagctgctggagcagaagccctacggcaaggctgtggatgtgtgggccctgggcgtcatctcctacatcctgctgtgtggctacccacccttctatgatgaaagtgaccctgagctgttcagccagatcctgcgggccagctatgaatttgacagccccttctgggatgacatcagcgagagcgccaaggacttcatccgccacctgctggagcgggacccccagaagcgcttcacctgccagcaggccctgcggcacctgtggatcagcggggacacagcctttgaccgggacatcctgggctctgtgtctgagcagatcaggaagaactttgcccggacccactggaagagggccttcaatgccaccagcttcctgcggcacatcaggaagctgggccagatccctgagggggagggcgccagcgagcagggcatggcccggcacagccacagcggcctgcgggccggccagccccccaagtggtag

SEQ ID NO: 165169 - DNA, 1101 bp, Artificial Sequence
  Description of Artificial Sequence: Synthetic coding sequence
atgctgctgctgaagaagcacacagaggacatcagctctgtgtatgagatccgggagcggctgggcagcggggccttcagcgaggtggtgctggcccaggagcggggcagcgcccacctggtggccctgaagtgcatccccaagaaggccctgcggggcaaggaggccctggtggagaatgaaattgctgtgctgcggcgcatcagccaccccaacatcgtggccctggaggatgtgcatgagagccccagccacctgtacctggccatggagctggtgactggaggagagctgtttgaccgcatcatggagcggggcagctacacagagaaggatgccagccacctggtgggccaggtgctgggcgctgtgtcctacctgcacagcctgggcatcgtgcaccgggacctgaagccagagaacctgctgtatgccaccccatttgaggacagcaagatcatggtgtctgactttggcctgagcaagatccaggccggcaacatgctgggcacagcctgtggcaccccaggctatgcagagcctgtgaccctgagcggcatggccgcctgtgtgcctgtgcgggcctctgtgtgcctgtggcccccagcccctgagctgctggagcagaagccctacggcaaggctgtggatgtgtgggccctgggcgtcatctcctacatcctgctgtgtggctacccacccttctatgatgaaagtgaccctgagctgttcagccagatcctgcgggccagctatgaatttgacagccccttctgggatgacatcagcgagagcgccaaggacttcatccgccacctgctggagcgggacccccagaagcgcttcacctgccagcaggccctgcggcacctgtggatcagcggggacacagcctttgaccgggacatcctgggctctgtgtctgagcagatcaggaagaactttgcccggacccactggaagagggccttcaatgccaccagcttcctgcggcacatcaggaagctgggccagatccctgagggggagggcgccagcgagcagggcatggcccggcacagccacagcggcctgcgggccggccagccccccaagtggtag

SEQ ID NO: 165170 - DNA, 1083 bp, Artificial Sequence
  Description of Artificial Sequence: Synthetic coding sequence
atgtggaggagagtgtgtggcggcctggccggccggcggcccagcggggacatgctgctgctgaagaagcacacagaggacatcagctctgtgtatgagatccgggagcggctgggcagcggggccttcagcgaggtggtgctggcccaggagcggggcagcgcccacctggtggccctgaagtgcatccccaagaaggccctgcggggcaaggaggccctggtggagaatgaaattgctgtgctgcggcgcatcagccaccccaacatcgtggccctggaggatgtgcatgagagccccagccacctgtacctggccatggagctggtgactggaggagagctgtttgaccgcatcatggagcggggcagctacacagagaaggatgccagccacctggtgggccaggtgctgggcgctgtgtcctacctgcacagcctgggcatcgtgcaccgggacctgaagccagagaacctgctgtatgccaccccatttgaggacagcaagatcatggtgtctgactttggcctgagcaagatccaggccggcaacatgctgggcacagcctgtggcaccccaggctacgtggcccctgagctgctggagcagaagccctacggcaaggctgtggatgtgtgggccctgggcgtcatctcctacatcctgctgtgtggctacccacccttctatgatgaaagtgaccctgagctgttcagccagatcctgcgggccagctatgaatttgacagccccttctgggatgacatcagcgagagcgccaaggacttcatccgccacctgctggagcgggacccccagaagcgcttcacctgccagcaggccctgcggcacctgtggatcagcggggacacagcctttgaccgggacatcctgggctctgtgtctgagcagatcaggaagaactttgcccggacccactggaagagggccttcaatgccaccagcttcctgcggcacatcaggaagctgggccagatccctgagggggagggcgccagcgagcagggcatggcccggcacagccacagcggcctgcgggccggccagccccccaagtggtag

SEQ ID NO: 165171 - DNA, 1032 bp, Artificial Sequence; identical to SEQ ID NO: 165168
  Description of Artificial Sequence: Synthetic coding sequence

SEQ ID NO: 165172 - DNA, 1101 bp, Artificial Sequence; identical to SEQ ID NO: 165169
  Description of Artificial Sequence: Synthetic coding sequence

SEQ ID NO: 165173 - DNA, 132 bp, Artificial Sequence
  Description of Artificial Sequence: Synthetic coding sequence
atgctgctgctgaagaagcacacagaggacatcagctctgtgtatgagatccgggagcggctgggcagcggggccttcagcgaggtggtgctggcccaggagcggggcagcgcccacctggtggccctgtag

SEQ ID NO: 165174 - DNA, 675 bp, Artificial Sequence
  Description of Artificial Sequence: Synthetic coding sequence
atgctgctgctgaagaagcacacagaggacatcagctctgtgtatgagatccgggagcggctgggcagcggggccttcagcgaggtggtgctggcccaggagcggggcagcgcccacctggtggccctgaagtgcatccccaagaaggccctgcggggcaaggaggccctggtggagaatgaaattgctgtgctgcggcgcatcagccaccccaacatcgtggccctggaggatgtgcatgagagccccagccacctgtacctggccatggagctggtgactggaggagagctgtttgaccgcatcatggagcggggcagctacacagagaaggatgccagccacctggtgggccaggtgctgggcgctgtgtcctacctgcacagcctgggcatcgtgcaccgggacctgaagccagagaacctgctgtatgccaccccatttgaggacagcaagatcatggtgtctgactttggcctgagcaagatccaggccggcaacatgctgggcacagcctgtggcaccccaggctacgtggcccctgagctgctggagcagaagccctacggcaaggctgtggatgtgtgggccctgggcgtcatctcctacatcctgctgtgtggctacccacccttctatgatgaaagtgaccctgagctgttcagccagatctag

SEQ ID NO: 165175 - DNA, 132 bp, Artificial Sequence; identical to SEQ ID NO: 165173
  Description of Artificial Sequence: Synthetic coding sequence

SEQ ID NO: 165176 - DNA, 132 bp, Artificial Sequence; identical to SEQ ID NO: 165173
  Description of Artificial Sequence: Synthetic coding sequence

SEQ ID NO: 165177 - DNA, 261 bp, Artificial Sequence
  Description of Artificial Sequence: Synthetic coding sequence
atgctgctgctgaagaagcacacagaggacatcagctctgtgtatgagatccgggagcggctgggcagcggggccttcagcgaggtggtgctggcccaggagcggggcagcgcccacctggtggccctgaagtgcatccccaagaaggccctgcggggcaaggaggccctggtggagaatgaaattgctgtgctgcggcgcatcagccaccccaacatcgtggccctggaggatgtgcatgagagccccagccacctgtag

SEQ ID NO: 165178 - DNA, 246 bp, Artificial Sequence
  Description of Artificial Sequence: Synthetic coding sequence
tgaatttctggggacacagcctttgaccgggacatcctgggctctgtgtctgagcagatcaggaagaactttgcccggacccactggaagagggccttcaatgccaccagcttcctgcggcacatcaggaagctgggccagatccctgagggggagggcgccagcgagcagggcatggcccggcacagccacagcggcggcccccagggcctgtccttcctgcacggctgctgcgtgctgaggtag

SEQ ID NO: 165179 - DNA, 681 bp, Artificial Sequence
  Description of Artificial Sequence: Synthetic coding sequence
atgctgctgctgaagaagcacacagaggacatcagctctgtgtatgagatccgggagcggctgggcagcggggccttcagcgaggtggtgctggcccaggagcggggcagcgcccacctggtggccctgaagtgcatccccaagaaggccctgcggggcaaggaggccctggtggagaatgaaattgctgtgctgcggcgcatcagccaccccaacatcgtggccctggaggatgtgcatgagagccccagccacctgtacctggccatggagctggtgactggaggagagctgtttgaccgcatcatggagcggggcagctacacagagaaggatgccagccacctggtgggccaggtgctgggcgctgtgtcctacctgcacagcctgggcatcgtgcaccgggacctgaagccagagaacctgctgtatgccaccccatttgaggacagcaagatcatggtgtctgactttggcctgagcaagatccaggccggcaacatgctgggcacagcctgtggcaccccaggctacgtggcccctgagctgctggagcagaagccctacggcaaggctgtggatgtgtgggccctgggcgtcatctcctacatcctgctgtgtggctacccacccttctatgatgaaagtgaccctgagctgttcagccagatcctgaggtag

SEQ ID NO: 165180 - DNA, 1281 bp, Artificial Sequence
  Description of Artificial Sequence: Synthetic coding sequence
atggaggccgccttcggccaggtggccggcagcgcctgccccaggagaggaggagagggccgggactggaaggccgagagcctggccgacctgtggcccaagagcagccctggggacagccaccgctggtgcaagggccctggagctggccctgctggcccccagctgcgggaggccgcccgggccagcagcggcctgggcggcggcggccgccaccccagccgcatcccagccatcgccctgcaggacatgctgctgctgaagaagcacacagaggacatcagctctgtgtatgagatccgggagcggctgggcagcggggccttcagcgaggtggtgctggcccaggagcggggcagcgcccacctggtggccctgaagtgcatccccaagaaggccctgcggggcaaggaggccctggtggagaatgaaattgctgtgctgcggcgcatcagccaccccaacatcgtggccctggaggatgtgcatgagagccccagccacctgtacctggccatggagctggtgactggaggagagctgtttgaccgcatcatggagcggggcagctacacagagaaggatgccagccacctggtgggccaggtgctgggcgctgtgtcctacctgcacagcctgggcatcgtgcaccgggacctgaagccagagaacctgctgtatgccaccccatttgaggacagcaagatcatggtgtctgactttggcctgagcaagatccaggccggcaacatgctgggcacagcctgtggcaccccaggctacgtggcccctgagctgctggagcagaagccctacggcaaggctgtggatgtgtgggccctgggcgtcatctcctacatcctgctgtgtggctacccacccttctatgatgaaagtgaccctgagctgttcagccagatcctgcgggccagctatgaatttgacagccccttctgggatgacatcagcgagagcgccaaggacttcatccgccacctgctggagcgggacccccagaagcgcttcacctgccagcaggccctgcggcacctgtggatcagcggggacacagcctttgaccgggacatcctgggctctgtgtctgagcagatcaggaagaactttgcccggacccactggaagagggccttcaatgccaccagcttcctgcggcacatcaggaagctgggccagatccctgagggggagggcgccagcgagcagggcatggcccggcacagccacagcggcctgcgggccggccagccccccaagtggtag

SEQ ID NO: 165181 - DNA, 132 bp, Artificial Sequence; identical to SEQ ID NO: 165173
  Description of Artificial Sequence: Synthetic coding sequence

SEQ ID NO: 165182 - DNA, 4884 bp, Artificial Sequence
  Description of Artificial Sequence: Synthetic coding sequence
atgaggctgtggagctgggtgctgcacctgggcctgctgtctgctgccctgggctgcggcctggccgagcggccccggcgggcccggcgggacccccgggccggccggccccccaggcctgctgctggccctgccacctgtgccaccagggctgcccggggcagaagagccagccccccacctcctcctcctcctggaggagcctgggaggccgtgcgggtgccccggcggcggcagcagcgggaggcccggggggccacagaggagcccagcccccccagccgggccctgtacttcagcggccgcggggagcagctgcggctgcgggctgacctggagctgcccagagatgccttcaccctgcaggtgtggctgcgggcagagggcggccagaggagccctgctgtgatcaccggcctgtatgacaagtgcagctacatcagccgggaccggggctgggtggtgggcatccacaccatcagtgaccaggacaacaaggacccccgctacttcttcagcctgaagacagaccgggcccggcaggtgaccaccatcaatgcccacaggagctacctgcccggccagtgggtgtacctggccgccacctatgatggccagttcatgaagctgtatgtgaatggagcccaggtggccaccagcggggagcaggtgggcggcatcttcagccccctgacccagaagtgcaaggtgctgatgctgggcggcagcgccctgaaccacaactaccggggctacatcgagcacttcagcctgtggaaggtggcccggacccagcgggagatcctgagtgacatggagacccatggagcccacacagccctgccccagctgctgctgcaggagaactgggacaacgtgaagcacgcctggagccccatgaaggatggcagcagccccaaggtggagttcagcaatgcccacggcttcctgctggacaccagcctggagccccccctgtgtggccagaccctgtgtgacaacacagaggtgattgccagctacaaccagctgagcagcttccggcagcccaaggtggtgcgctacagagtggtgaacctgtatgaagatgaccacaagaaccccaccgtgacccgggagcaggtggacttccagcaccaccagctggccgaggccttcaagcagtacaacatctcctgggagctggatgtgctggaggtgagcaacagcagcctgcggcggcggctcatcctggccaactgtgacatcagcaagattggagatgagaactgtgaccctgagtgcaaccacaccctgactggacatgatggaggagactgccgccacctgcggcacccagcctttgtgaagaagcagcacaacggggtgtgtgacatggactgcaactatgagcgcttcaactttgatggaggagagtgctgtgaccctgagatcaccaacgtgacccagacctgctttgatcctgacagcccccaccgggcctacctggatgtgaatgagctgaagaacatcctgaagctggatggcagcacccacctgaacatcttctttgccaagagcagcgaggaggagctggccggcgtggccacctggccctgggacaaggaggccctgatgcacctgggcggcatcgtgctgaaccccagcttctacggcatgcctggccacacccacaccatgatccacgagatcggccacagcctgggcctgtaccacgtgttccggggcatcagcgagatccagagctgcagcgacccctgcatggagacagagcccagctttgagaccggggacctgtgcaatgacaccaacccagcccccaagcacaagagctgtggggaccccggccctggaaatgacacctgtggcttccacagcttcttcaacaccccctacaacaacttcatgtcctatgcagatgatgactgcacagacagcttcacccccaaccaggtggccaggatgcactgctacctggacctggtgtaccagggctggcagcccagcaggaagccagcccctgtggccctggccccccaggtgctgggccacaccacagacagcgtgaccctggagtggttcccccccattgatggccacttctttgagcgggagctgggcagcgcctgccacctgtgcctggagggccgcatcctggtgcagtatgccagcaatgccagcagccccatgccctgcagccccagcggccactggagcccccgggaggccgagggccacccagatgtggagcagccctgcaagagctctgtgaggacctggagccccaacagcgctgtgaacccccacacagtgcccccagcctgcccagagccccagggctgctacctggagctggagttcctgtaccccctggtgcctgagagcctgaccatctgggtgacctttgtgtccacagactgggacagcagcggggctgtgaatgacatcaagctgctggccgtgtctgggaagaacatcagcctgggcccccagaatgtgttctgtgatgtgcccctgaccatccggctgtgggatgtgggggaggaggtgtatggcatccagatctacaccctggatgagcacctggagattgatgctgccatgctgaccagcacagctgacacccccctgtgcctgcagtgcaagcccctgaagtacaaggtggtgcgggacccccccctgcagatggatgtggccagcatcctgcacctgaacaggaagtttgtggacatggacctgaacctgggctctgtgtaccagtactgggtgatcaccatctctggaacagaggagagcgagcccagccctgctgtgacctacatccacggcagcggctactgtggagatggcatcatccagaaggaccagggcgagcagtgtgatgacatgaacaagatcaatggagatggctgcagcctcttctgccggcaggaggtgtccttcaactgcattgatgagcccagccgctgctacttccatgatggagatggagtgtgtgaggagtttgagcagaagaccagcatcaaggactgtggggtgtacaccccccagggcttcctggaccagtgggccagcaatgcctctgtgagccaccaggaccagcagtgccccggctgggtgatcatcggccagcctgctgccagccaggtgtgcaggaccaaggtgattgacctgtctgagggcatcagccagcacgcctggtacccctgcaccatctcctacccctacagccagctggcccagaccaccttctggctgcgggcctacttcagccagcccatggtggccgccgccgtcatcgtgcacctggtgacagatggcacctactacggggaccagaagcaggagaccatctctgtgcagctgctggacaccaaggaccagagccatgacctgggcctgcacgtgctgagctgcaggaacaaccccctcatcatccctgtggtgcatgacctgagccagcccttctaccacagccaggccgtgcgggtgtccttcagcagccccctggtggccatcagcggcgtggccctgcggagctttgacaactttgatcctgtgaccctgagcagctgccagagaggagagacctacagccctgctgagcagagctgtgtgcactttgcctgtgagaagacagactgcccagagctggccgtggagaatgccagcctgaactgcagcagcagtgaccgctaccacggggcccagtgcaccgtgtcctgcaggacaggctacgtgctgcagatcagaagagatgatgagctgatcaagagccagacaggccccagcgtgacagtgacctgcacagagggcaagtggaacaagcaggtggcctgtgagcctgtggactgcagcatcccagaccaccaccaggtgtatgctgccagcttcagctgcccagagggcaccaccttcggcagccagtgcagcttccagtgccgccacccagcccagctgaagggcaacaacagcctgctgacctgcatggaggatggcctgtggagcttccctgaggccctgtgtgagctgatgtgcctggcccctcctcctgtgcccaatgctgacctgcagacagcccgctgccgggagaacaagcacaaggtgggcagcttctgcaagtacaagtgcaagccaggctaccacgtgcccggcagcagcaggaagagcaagaagagggccttcaagacccagtgcacccaggacggctcctggcaggagggcgcctgtgtgcctgtgacctgtgaccccccaccacccaagttccacggcctgtaccagtgcaccaacggcttccagttcaacagtgaatgtcgcatcaagtgtgaagattctgatgccagccagggcctgggcagcaatgtcatccactgcaggaaggatggcacctggaatggcagcttccacgtgtgccaggagatgcagggccagtgcagcgtgcccaatgagctgaacagcaacctgaagctgcagtgcccagatggctacgccatcggctctgaatgtgccaccagctgcctggaccacaacagcgagagcatcatcctgcccatgaatgtgacagtgcgggacatcccccactggctgaaccccaccagggtggagcgggtggtgtgcacagctggcctgaagtggtacccccacccagccctgatccactgtgtgaagggctgtgagcccttcatgggagacaactactgtgatgccatcaacaacagagccttctgcaactatgatggaggagactgctgcaccagcacagtgaagaccaagaaggtgacccccttccccatgagctgtgacctgcagggcgactgtgcctgccgggacccccaggcccaggagcacagcaggaaggacctgcggggctacagccacggctag

SEQ ID NO: 165183 - DNA, 1701 bp, Artificial Sequence
  Description of Artificial Sequence: Synthetic coding sequence
atggactgcaactatgagcgcttcaactttgatggaggagagtgctgtgaccctgagatcaccaacgtgacccagacctgctttgatcctgacagcccccaccgggcctacctggatgtgaatgagctgaagaacatcctgaagctggatggcagcacccacctgaacatcttctttgccaagagcagcgaggaggagctggccggcgtggccacctggccctgggacaaggaggccctgatgcacctggatgatgactgcacagacagcttcacccccaaccaggtggccaggatgcactgctacctggacctggtgtaccagggctggcagcccagcaggaagccagcccctgtggccctggccccccaggtgctgggccacaccacagacagcgtgaccctggagtggttcccccccattgatggccacttctttgagcgggagctgggcagcgcctgccacctgtgcctggagggccgcatcctggtgcagtatgccagcaatgccagcagccccatgccctgcagccccagcggccactggagcccccgggaggccgagggccacccagatgtggagcagccctgcaagagctctgtgaggacctggagccccaacagcgctgtgaacccccacacagtgcccccagcctgcccagagccccagggctgctacctggagctggagttcctgtaccccctggtgcctgagagcctgaccatctgggtgacctttgtgtccacagactgggacagcagcggggctgtgaatgacatcaagctgctggccgtgtctgggaagaacatcagcctgggcccccagaatgtgttctgtgatgtgcccctgaccatccggctgtgggatgtgggggaggaggtgtatggcatccagatctacaccctggatgagcacctggagattgatgctgccatgctgaccagcacagctgacacccccctgtgcctgcagtgcaagcccctgaagtacaaggtggtgcgggacccccccctgcagatggatgtggccagcatcctgcacctgaacaggaagtttgtggacatggacctgaacctgggctctgtgtaccagtactgggtgatcaccatctctggaacagaggagagcgagcccagccctgctgtgacctacatccacggcagcggctactgtggagatggcatcatccagaaggaccagggcgagcagtgtgatgacatgaacaagatcaatggagatggctgcagcctcttctgccggcaggaggtgtccttcaactgcattgatgagcccagccgctgctacttccatgatggagatggagtgtgtgaggagtttgagcagaagaccagcatcaaggactgtggggtgtacaccccccagggcttcctggaccagtgggccagcaatgcctctgtgagccaccaggaccagcagtgccccggctgggtgatcatcggccagcctgctgccagccaggtgtgcaggaccaaggtgattgacctgtctgagggcatcagcgcctgcctggtgcccctgcaccaccagctgcccatcttccctgctggcagtgaccacttcctggcccctggggtcttcttcagcaccaacggctgccgcagctgccactgccccccaggagatggctgggacatcctgtggggccccaaggccggggaccaccagagagctgctgcctag

SEQ ID NO: 165184 - DNA, 1998 bp, Artificial Sequence
  Description of Artificial Sequence: Synthetic coding sequence
atgaacaagatcaatggagatggctgcagcctcttctgccggcaggaggtgtccttcaactgcattgatgagcccagccgctgctacttccatgatggagatggagtgtgtgaggagtttgagcagaagaccagcatcaaggactgtggggtgtacaccccccagggcttcctggaccagtgggccagcaatgcctctgtgagccaccaggaccagcagtgccccggctgggtgatcatcggccagcctgctgccagccaggtgtgcaggaccaaggtgattgacctgtctgagggcatcagccagcacgcctggtacccctgcaccatctcctacccctacagccagctggcccagaccaccttctggctgcgggcctacttcagccagcccatggtggccgccgccgtcatcgtgcacctggtgacagatggcacctactacggggaccagaagcaggagaccatctctgtgcagctgctggacaccaaggaccagagccatgacctgggcctgcacgtgctgagctgcaggaacaaccccctcatcatccctgtggtgcatgacctgagccagcccttctaccacagccaggccgtgcgggtgtccttcagcagccccctggtggccatcagcggcgtggccctgcggagctttgacaactttgatcctgtgaccctgagcagctgccagagaggagagacctacagccctgctgagcagagctgtgtgcactttgcctgtgagaagacagactgcccagagctggccgtggagaatgccagcctgaactgcagcagcagtgaccgctaccacggggcccagtgcaccgtgtcctgcaggacaggctacgtgctgcagatcagaagagatgatgagctgatcaagagccagacaggccccagcgtgacagtgacctgcacagagggcaagtggaacaagcaggtggcctgtgagcctgtggactgcagcatcccagaccaccaccaggtgtatgctgccagcttcagctgcccagagggcaccaccttcggcagccagtgcagcttccagtgccgccacccagcccagctgaagggcaacaacagcctgctgacctgcatggaggatggcctgtggagcttccctgaggccctgtgtgagctgatgtgcctggcccctcctcctgtgcccaatgctgacctgcagacagcccgctgccgggagaacaagcacaaggtgggcagcttctgcaagtacaagtgcaagccaggctaccacgtgcccggcagcagcaggaagagcaagaagagggccttcaagacccagtgcacccaggacggctcctggcaggagggcgcctgtgtgcctgtgacctgtgaccccccaccacccaagttccacggcctgtaccagtgcaccaacggcttccagttcaacagtgaatgtcgcatcaagtgtgaagattctgatgccagccagggcctgggcagcaatgtcatccactgcaggaaggatggcacctggaatggcagcttccacgtgtgccaggagatgcagggccagtgcagcgtgcccaatgagctgaacagcaacctgaagctgcagtgcccagatggctacgccatcggctctgaatgtgccaccagctgcctggaccacaacagcgagagcatcatcctgcccatgaatgtgacagtgcgggacatcccccactggctgaaccccaccagggtggagcgggtggtgtgcacagctggcctgaagtggtacccccacccagccctgatccactgtgtgaagggctgtgagcccttcatgggagacaactactgtgatgccatcaacaacagagccttctgcaactatgatggaggagactgctgcaccagcacagtgaagaccaagaaggtgacccccttccccatgagctgtgacctgcagggcgactgtgcctgccgggacccccaggcccaggagcacagcaggaaggacctgcggggctacagccacggctag

SEQ ID NO: 165185 - DNA, 4449 bp, Artificial Sequence
  Description of Artificial Sequence: Synthetic coding sequence
atgaggaaggaccggctgctgcacctgtgcctggtgctgctgctgatcctgctgagcgccagtgacagcaacagcacagagccccagtacatggtgctggtgcccagcctgctgcacacagaggcccccaagaagggctgtgtgctgctgagccacctgaatgagaccgtgacagtgtctgccagcctggagagcggccgggagaacagaagcctcttcacagacctggtggccgagaaggacctcttccactgtgtgtccttcaccctgccccgcatcagcgccagcagcgaggtggccttcctgagcatccagatcaagggccccacccaggacttcaggaagaggaacacagtgctggtgctgaacacccagagcctggtgtttgtgcagacagacaagcccatgtacaagccaggccagacagtgcgcttccgggtggtgtctgtggatgagaacttccggcccagaaatgagctgatccccctcatctacctggagaaccccaggaggaaccgcatcgcccagtggcagagcctgaagctggaggccggcatcaaccagctgtccttccccctgagcagcgagcccatccagggcagctacagagtggtggtgcagacagagagcggcggccgcatccagcaccccttcaccgtggaggagtttgtgctgcccaagtttgaggtgaaggtgcaggtgcccaagatcatcagcatcatggatgagaaggtgaacatcaccgtgtgtggggagtacacctacggcaagcctgtgcccggcctggccaccgtgtccctgtgcaggaagctgagccgggtgctgaactgtgacaagcaggaggtgtgtgaggagttcagccagcagctgaacagcaatggctgcatcacccagcaggtgcacaccaagatgctgcagatcaccaacacaggctttgagatgaagctgcgggtggaggcccgcatccgggaggagggcacagacctggaggtgacagccaaccgcatcagcgagatcaccaacatcgtgtccaagctgaagtttgtgaaggtggacagccacttccggcagggcatccccttctttgcccaggtgctgctggtggatggaaaaggagtgcccatccccaacaagctgttcttcatctctgtgaatgatgccaactactacagcaatgccaccaccaatgagcagggcctggcccagttcagcatcaacaccaccagcatctctgtgaacaagctgtttgtgcgggtcttcaccgtgcaccccaacctgtgcttccactacagctgggtggccgaggaccaccagggcgcccagcacacagccaacagagtcttcagcctgagcggcagctacatccacctggagcctgtggccggcaccctgccctgtggccacacagagaccatcacagcccactacaccctgaaccggcaggccatgggagagctgtctgagctgtccttccactacctgatcatggccaagggcgtgattgtgcgcagcggcacccacaccctgcctgtggagagcggggacatgaagggcagctttgccctgtccttccctgtggagagtgatgtggcccccatcgccaggatgttcatctttgccatcctgcctgatggagaggtggtgggggacagcgagaagtttgaaattgagaactgcctggccaacaaggtggacctgtccttcagccctgcccagagccccccagccagccacgcccacctgcaggtggccgccgccccccagagcctgtgtgccctgcgggctgtggaccagagcgtgctgctgatgaagccagaggccgagctgtctgtgtcctctgtgtacaacctgctgactgtgaaggacctgaccaacttcccagacaacgtggaccagcaggaggaggagcagggccactgcccccggcccttcttcatccacaacggggccatctacgtgcccctgagcagcaatgaggccgacatctacagcttcctgaagggcatgggcctgaaggtgttcaccaacagcaagatcaggaagcccaagagctgcagcgtcatccccagcgtgtctgctggagctgtgggccagggctactatggagctggcctgggcgtggtggagcggccctacgtgccccagctgggcacctacaacgtcatccccctgaacaatgagcagagcagcggccctgtgcctgagaccgtgcgcagctacttccctgagacctggatctgggagctggtggccgtgaacagcagtggagtggccgaggtgggcgtgacagtgcctgacaccatcacagagtggaaggccggggccttctgcctgtctgaagatgctggcctgggcatcagcagcacagccagcctgcgggccttccagcccttctttgtggagctgaccatgccctacagcgtcatccggggggaggtgttcaccctgaaggccaccgtgctgaactacctgcccaagtgcatccgggtgtctgtgcagctgaaggccagccctgccttcctggccagccagaacaccaagggggaggagagctactgcatctgtggaaatgaaaggcagaccctgtcctggacagtgacccccaagaccctgggcaatgtgaacttctctgtgtctgctgaggccatgcagagcctggagctgtgtggaaatgaggtggtggaggtgcctgagatcaagaggaaggacaccgtcatcaagaccctgctggtggaggccgagggcatcgagcaggagaagaccttcagctccatgacctgtgccagcggggccaacgtgtctgagcagctgagcctgaagctgcccagcaatgtggtgaaggagagcgcccgggccagcttctctgtgctgggggacatcctgggcagcgccatgcagaacatccagaacctgctgcagatgccctacggctgtggggagcagaacatggtgctgtttgcccccaacatctacgtgctgaactacctgaatgagacccagcagctgacccaggagatcaaggccaaggctgtgggctacctgatcaccggctaccagaggcagctgaactacaagcaccaggacggcagctacagcaccttcggggagagatatggcaggaaccagggcaacacctggctgacagcctttgtgctgaagacctttgcccaggcccggagctacatcttcattgatgaggcccacatcacccagagcctgacctggctgagccagatgcagaaggacaatggctgcttccgcagcagcggcagcctgctgaacaatgccatcaagggcggcgtggaggatgaggccaccctgagcgcctacgtgaccatcgccctgctggagatccccctgcctgtgaccaaccccatcgtgagaaatgccctcttctgcctggagagcgcctggaatgtggccaaggagggcacccacggcagccacgtgtacaccaaggccctgctggcctatgccttcagcctgctgggcaagcagaaccagaaccgggagatcctgaacagcctggacaaggaggccgtgaaggaggacaacctggtgcactgggagcggccccagaggcccaaggcccctgtgggccacctgtaccagacccaggcccccagcgctgaggtggagatgaccagctatgtgctgctggcctacctgacagcccagcctgcccccaccagcggggacctgaccagcgccaccaacatcgtgaagtggatcatgaagcagcagaatgcccagggcggcttcagcagcacccaggacacagtggtggccctgcacgccctgagccgctacggggccgccaccttcaccaggacagagaagacagcccaggtgacagtgcaggacagccagaccttcagcaccaacttccaggtggacaacaacaacctgctgctgctgcagcagatcagcctgcctgagctgcctggagaatatgtgatcaccgtgactggagagcgctgtgtgtacctgcagacctccatgaagtacaacatcctgcctgagaaggaggacagcccctttgccctgaaggtgcagacagtgccccagacctgtgatggccacaaggcccacaccagcttccagatcagcctgaccatctcctacacaggcaacagacctgccagcaacatggtgattgtggatgtgaagatggtgtctggcttcatccccctgaagcccaccgtgaagatgctggagaggagcagctctgtgtccaggacagaggtgagcaacaaccacgtgctgatctacgtggagcaggtgaccaaccagaccctgtccttctccttcatggtgctgcaggacatccctgtgggggacctgaagccagccatcgtgaaggtgtatgactactatgaaacagatgagagcgtggtggccgagtacatcgccccctgcagcacagacacagaacatggaaatgtgtag

SEQ ID NO: 165186 - DNA, 3807 bp, Artificial Sequence
  Description of Artificial Sequence: Synthetic coding sequence
atgtctgagagctacagaaggaccaccttccctgtgcgcttccgggtggtgtctgtggatgagaacttccggcccagaaatgaactcatccccctcatctacctggagaaccccaggaggaacagaattgcccagtggcagagcctgaagctggaggccggcatcaaccagctgtccttccccctgagcagcgagcccatccagggcagctacagagtggtggtgcagacagaaagtggcggccgcatccagcaccccttcaccgtggaggagtttgtgctgcccaagtttgaggtgaaggtgcaggtgcccaagatcatcagcatcatggatgagaaggtgaacatcaccgtgtgtggggagtacacctacggcaagcctgtgcccggcctggccaccgtgtccctgtgcaggaagctgagccgggtgctgaactgtgacaagcaggaggtgtgtgaggagttcagccagcagctgaacagcaatggctgcatcacccagcaggtgcacaccaagatgctgcagatcaccaacacaggctttgagatgaagctgcgggtggaggcccgcatccgggaggagggcacagacctggaggtgacagccaaccgcatcagcgagatcaccaacatcgtgtccaagctgaagtttgtgaaggtggacagccacttccggcagggcatccccttctttgcccaggtgctgctggtggatggcaagggcgtgcccatccccaacaagctgttcttcatctctgtgaatgatgccaactactacagcaatgccaccaccaatgagcagggcctggcccagttcagcatcaacaccaccagcatctctgtgaacaagctgtttgtgcgggtcttcaccgtgcaccccaacctgtgcttccactacagctgggtggccgaggaccaccagggcgcccagcacacagccaacagagtcttcagcctgagcggcagctacatccacctggagcctgtggccggcaccctgccctgtggccacacagagaccatcacagcccactacaccctgaaccggcaggccatgggagagctgtctgagctgtccttccactacctgatcatggccaagggcgtcatcgtgcgcagcggcacccacaccctgcctgtggagagcggggacatgaagggcagctttgccctgtccttccctgtggagagtgatgtggcccccatcgccaggatgttcatctttgccatcctgcctgatggagaggtggtgggggacagcgagaagtttgaaattgagaactgcctggccaacaaggtggacctgtccttctccccagcccagagccccccagccagccacgcccacctgcaggtggccgccgccccccagagcctgtgtgccctgcgggctgtggaccagagcgtgctgctgatgaagccagaggccgagctgtctgtgtcctctgtgtacaacctgctgactgtgaaggacctgaccaacttcccagacaacgtggaccagcaggaggaggagcagggccactgcccccggcccttcttcatccacaatggagccatctacgtgcccctgagcagcaatgaagctgacatctacagcttcctgaagggcatgggcctgaaggtgttcaccaacagcaagatcaggaagcccaagagctgcagcgtcatccccagcgtgtctgctggagctgtgggccagggctactacggggccggcctgggcgtggtggagcggccctacgtgccccagctgggcacctacaacgtcatccccctgaacaatgagcagagcagcggccctgtgcctgagaccgtgcgcagctacttccctgagacctggatctgggagctggtggccgtgaacagcagcggcgtggccgaggtgggcgtgacagtgcctgacaccatcacagagtggaaggccggggccttctgcctgtctgaagatgctggcctgggcatcagcagcacagccagcctgcgggccttccagcccttctttgtggagctgaccatgccctacagcgtcatccggggggaggtgttcaccctgaaggccaccgtgctgaactacctgcccaagtgcatccgggcagagggcatcgagcaggagaagaccttcagctccatgacctgtgccagcggggccaacgtgtctgagcagctgagcctgaagctgcccagcaatgtggtgaaggagagcgcccgggccagcttctctgtgctgggggacatcctgggcagcgccatgcagaacatccagaacctgctgcagatgccctacggctgtggggagcagaacatggtgctgtttgcccccaacatctacgtgctgaactacctgaatgagacccagcagctgacccaggagatcaaggccaaggctgtgggctacctgatcaccggctaccagaggcagctgaactacaagcaccaggacggcagctacagcaccttcggggagagatatggcaggaaccagggcaacacctggctgacagcctttgtgctgaagacctttgcccaggcccggagctacatcttcattgatgaggcccacatcacccagagcctgacctggctgagccagatgcagaaggacaatggctgcttccgcagcagcggcagcctgctgaacaatgccatcaagggcggcgtggaggatgaggccaccctgagcgcctacgtgaccatcgccctgctggagatccccctgcctgtgaccaaccccatcgtgagaaatgccctcttctgcctggagagcgcctggaatgtggccaaggagggcacccacggcagccacgtgtacaccaaggccctgctggcctatgccttcagcctgctgggcaagcagaaccagaaccgggagatcctgaacagcctggacaaggaggccgtgaaggaggacaacctggtgcactgggagcggccccagaggcccaaggcccctgtgggccacctgtaccagacccaggcccccagcgctgaggtggagatgaccagctatgtgctgctggcctacctgacagcccagcctgcccccaccagcggggacctgaccagcgccaccaacatcgtgaagtggatcatgaagcagcagaatgcccagggcggcttcagcagcacccaggacacagtggtggccctgcacgccctgagccgctacggggccgccaccttcaccaggacagagaagacagcccaggtgacagtgcaggacagccagaccttcagcaccaacttccaggtggacaacaacaacctgctgctgctgcagcagatcagcctgcctgagctgcctggagaatatgtgatcaccgtgactggagagcgctgtgtgtacctgcagacctccatgaagtacaacatcctgcctgagaaggaggacagcccctttgccctgaaggtgcagacagtgccccagacctgtgatggccacaaggcccacaccagcttccagatcagcctgaccatctcctacacaggcaacagacctgccagcaacatggtgattgtggatgtgaagatggtgtctggcttcatccccctgaagcccaccgtgaagatgctggagaggagcagctctgtgtccaggacagaggtgagcaacaaccacgtgctgatctacgtggagcaggtgaccaaccagaccctgtccttctccttcatggtgctgcaggacatccctgtgggggacctgaagccagccatcgtgaaggtgtatgactactatgaaacagatgagagcgtggtggccgagtacatcgccccctgcagcacagacacagaacatggaaatgtgtag

SEQ ID NO: 165187 - DNA, 660 bp, Artificial Sequence
  Description of Artificial Sequence: Synthetic coding sequence
atggtgaagtacttcctgggccagagcgtgctgcggagctcctgggaccaggtgtttgctgccttctggcagcgctaccccaacccctacagcaagcacgtgctgacagaagatattgtgcaccgggaggtgaccccagaccagaagctgctgagccggcggctgctgaccaagaccaacaggatgccccgctgggccgagcggctcttccctgccaacgtggcccacagcgtgtatgtgctggaggacagcatcgtggacccccagaaccagaccatgaccaccttcacctggaacatcaaccacgcccggctgatggtggtggaggagcgctgtgtgtactgtgtgaacagcgacaacagcggctggacagagatcagaagagaggcctgggtgagcagcagcctgtttggagtgtccagagctgtgcaggagtttggcctggcccgcttcaagagcaatgtgaccaagaccatgaagggctttgagtacatcctggccaagctgcagggcgaggcccccagcaagaccctggtggagacagccaaggaggccaaggagaaggccaaggagacagccctggccgccacagagaaggccaaggacctggccagcaaggccgccaccaagaagcagcagcagcagcagcagtttgtgtag

SEQ ID NO: 165188 - DNA, 1770 bp, Artificial Sequence
  Description of Artificial Sequence: Synthetic coding sequence
atgagcagcagctactggagcgagaccagcagcagcagctgtggcacccagcagctgcctgaggtgctgcagtgccagccccagcactaccactgctaccaccagagcagccaggcccagcagcccccagagaagaatgtggtgtatgagcgggtgaggacctacagcggccccatgaacaaggtggtgcaggccctggaccccttcaacagccgggaggtgctgagccccctgaagaccaccagcagctaccagaacctggtgtggagcgaccacagccaggagctgcacagccccaccctgaagatcagcacctgtgcccccagcaccctgcacatcacccagaacacagagcaggagctgcacagccccaccgtgaagctgaccacctacccccagaccaccatcagaaaatatgtggtgcagaaccctgagcaggagcccctgagccagttcctgcggggcagccacttcttccctggcaacaacgtcatctatgagaagaccatcaggaaggtggagaagctgaacacagaccagggctgccacccccaggcccagtgccaccaccacatcatccagcagccccaggtgatccacagcgcccactggcagcagcctgacagcagccagcagatccaggccatcactggaaacaaccccatcagcacccacatcggaaatgagctgtgccacagcggcagcagccagatctgtgagcaggtgatcatccaggatgatggccctgagaagctggacccccgctactttggagagctgctggccgacctgagcaggaagaacacagacctgtaccactgcctgctggagcacctgcagagaattggaggcagcaagcaggactttgagagcacagatgaaagtgaggacatcgagagcctcatccccaagggcctgtctgagttcaccaagcagcagatccgctacatcctgcagatgaggggcatgtctgacaagagcctgcggctggtgctgagcaccttcagcaacatccgggaggagctgggccacctgcagaatgacatgaccagcctggagaatgacaagatgaggctggagaaggacctgtccttcaaggacacccagctgaaggagtatgaggagctgctggcctctgtgcgggccaacaaccaccagcagcagcagggcctgcaggacagcagcagcaagtgccaggccctggaggagaacaacctgagcctgcggcacaccctgagtgacatggagtaccgcctgaaggagctggagtactgcaagaggaacctggagcaggagaaccagaacctgaggatgcaggtgtctgagacctgcaccggccccatgctgcaggccaagatggatgagatcggcaaccactacacagagatggtgaagaacctgaggatggagaaggaccgggagatctgccgcctgcggagccagctgaaccagtaccacaaggatgtgtccaagcgggagggcagctgcagcgacttccagttcaagctgcacgagctgaccagcctgctggaggagaaggacagcctcatcaagaggcagagcgaggagctgagcaagctgcggcaggagatctacagcagccacaaccagcccagcactggaggccgcaccaccatcaccaccaagaagtaccgcacccagtaccccatcctgggcctgctgtatgatgattatgagtacatccccccaggcagcgagacccagaccatcgtgattgagaagacagaggacaagtacacctgcccctag

SEQ ID NO: 165189 - DNA, 921 bp, Artificial Sequence
  Description of Artificial Sequence: Synthetic coding sequence
atgagcagcagctactggagcgagaccagcagcagcagctgtggcacccagcagctgcctgaggtgctgcagtgccagccccagcactaccactgctaccaccagagcagccaggcccagcagcccccagagaagaatgtggtgtatgagcgggtgaggacctacagcggccccatgaacaaggtggtgcaggccctggaccccttcaacagccgggaggtgctgagccccctgaagaccaccagcagctaccagaacctggtgtggagcgaccacagccaggagctgcacagccccaccctgaagatcagcacctgtgcccccagcaccctgcacatcacccagaacacagagcaggagctgcacagccccaccgtgaagctgaccacctacccccagaccaccatcagaaaatatgtggtgcagaaccctgagcaggagcccctgagccagttcctgcggggcagccacttcttccctggcaacaacgtcatctatgagaagaccatcaggaaggtggagaagctgaacacagaccagggctgccacccccaggcccagtgccaccaccacatcatccagcagccccaggtgatccacagcgcccactggcagcagcctgacagcagccagcagatccaggccatcactggaaacaaccccatcagcacccacatcggaaatgagctgtgccacagcggcagcagccagatctgtgagcaggtgatcatccaggatgatggccctgagaagctggacccccgctactttggagagctgctggccgacctgagcaggaagaacacagacctgtaccactgcctgctggagcacctgcagagaattggaaggaagcagagcctgagcagcacctacaccatccgccacggcatccagaccaagaggacaggcatcctgtag

SEQ ID NO: 165190 - DNA, 1788 bp, Artificial Sequence
  Description of Artificial Sequence: Synthetic coding sequence
atgagcagcagctactggagcgagaccagcagcagcagctgtggcacccagcagctgcctgaggtgctgcagtgccagccccagcactaccactgctaccaccagagcagccaggcccagcagcccccagagaagaatgtggtgtatgagcgggtgaggacctacagcggccccatgaacaaggtggtgcaggccctggaccccttcaacagccgggaggtgctgagccccctgaagaccaccagcagctaccagaacctggtgtggagcgaccacagccaggagctgcacagccccaccctgaagatcagcacctgtgcccccagcaccctgcacatcacccagaacacagagcaggagctgcacagccccaccgtgaagctgaccacctacccccagaccaccatcagaaaatatgtggtgcagaaccctgagcaggagcccctgagccagttcctgcggggcagccacttcttccctggcaacaacgtcatctatgagaagaccatcaggaaggtggagaagctgaacacagaccagggctgccacccccaggcccagtgccaccaccacatcatccagcagccccaggtgatccacagcgcccactggcagcagcctgacagcagccagcagatccaggccatcactggaaacaaccccatcagcacccacatcggaaatgagctgtgccacagcggcagcagccagatctgtgagcaggtgatcatccaggatgatggccctgagaagctggacccccgctactttggagagctgctggccgacctgagcaggaagaacacagacctgtaccactgcctgctggagcacctgcagagaattggaggcagcaagcaggactttgagagcacagatgaaagtgaggacatcgagagcctcatccccaagggcctgtctgagttcaccaagcagcagatccgctacatcctgcagatgaggggcatgtctgacaagagcctgcggctggtgctgagcaccttcagcaacatccgggaggagctgggccacctgcagaatgacatgaccagcctggagaatgacaagatgaggctggagaaggacctgtccttcaaggacacccagctgaaggagtatgaggagctgctggcctctgtgcgggccaacaaccaccagcagcagcagggcctgcaggacagcagcagcaagtgccaggccctggaggagaacaacctgagcctgcggcacaccctgagtgacatggagtaccgcctgaaggagctggagtactgcaagaggaacctggagcaggagaaccagaacctgaggatgcaggtgtctgagacctgcaccggccccatgctgcaggccaagatggatgagatcggcaaccactacacagagatggtgaagaacctgaggatggagaaggaccgggagatctgccgcctgcggagccagctgaaccagtaccacaaggatgtgtccaagcgggagggcagctgcagcgacttccagttcaagctgcacgagctgaccagcctgctggaggagaaggacagcctcatcaagaggcagagcgaggagctgagcaagctgcggcaggagatctacagcagccacaaccagcccagcactggaggccgcaccaccatcaccaccaagaagtaccgcacccagtaccccatcctgggcctgctgtatgatgattatgagtacatccccccaggcagcgagacccagaccatcgtgattgagaagacagaggacaagtacacctgtgtgagcagcctgggccacttctag

SEQ ID NO: 165191 - DNA, 921 bp, Artificial Sequence
  Description of Artificial Sequence: Synthetic coding sequence
atggccagccgctggtggcgctggaggcggggctgctcctggaagccagctgcccggagccctggccctggcagccctggccgggccggccccctgggccccagcgctgctgctgaggtgcgggcccaggtgcacaggaggaagggcctggacctgagccagatcccctacatcaacctggtgaagcacctgaccagcgcctgccccaacgtgtgccgcatcagccgcttccaccacaccaccccagacagcaagacccacagcggggagaagtacacagaccccttcaagctgggctggagggacctgaagggcctgtatgaggacatcaggaaggagctgctgatcagcaccagcgagctgaaggagatgtctgagtactactttgatggcaagggcaaggccttccggcccatcatcgtggccctgatggcccgggcctgcaacatccaccacaacaacagcagacatgtgcaggccagccagagggccatcgccctgattgctgagatgatccacacagccagcctggtgcatgatgatgtgattgatgatgccagcagcagaagaggcaagcacacagtgaacaagatctggggcgagaagaaggctgtgctggccggggacctgatcctgtctgctgccagcatcgccctggcccgcatcggcaacaccaccgtcatcagcatcctgacccaggtgattgaggacctggtgcggggggagttcctgcagctgggcagcaaagaaaatgaaaatgaaagatttgcccactacctggagaagaccttcaagaagacagccagcctgattgccaacagctgcaaggctgtgttccccagaaatgaatgttatgaccacgccaccgtgcagtttgcctggcgctgccggcagagcagcacagtgtgcaccacagaatag

SEQ ID NO: 165192 - DNA, 1248 bp, Artificial Sequence
  Description of Artificial Sequence: Synthetic coding sequence
atggccagccgctggtggcgctggaggcggggctgctcctggaagccagctgcccggagccctggccctggcagccctggccgggccggccccctgggccccagcgctgctgctgaggtgcgggcccaggtgcacaggaggaagggcctggacctgagccagatcccctacatcaacctggtgaagcacctgaccagcgcctgccccaacgtgtgccgcatcagccgcttccaccacaccaccccagacagcaagacccacagcggggagaagtacacagaccccttcaagctgggctggagggacctgaagggcctgtatgaggacatcaggaaggagctgctgatcagcaccagcgagctgaaggagatgtctgagtactactttgatggcaagggcaaggccttccggcccatcatcgtggccctgatggcccgggcctgcaacatccaccacaacaacagcagacatgtgcaggccagccagagggccatcgccctgattgctgagatgatccacacagccagcctggtgcatgatgatgtgattgatgatgccagcagcagaagaggcaagcacacagtgaacaagatctggggcgagaagaaggctgtgctggccggggacctgatcctgtctgctgccagcatcgccctggcccgcatcggcaacaccaccgtcatcagcatcctgacccaggtgattgaggacctggtgcggggggagttcctgcagctgggcagcaaagaaaatgaaaatgaaagatttgcccactacctggagaagaccttcaagaagacagccagcctgattgccaacagctgcaaggctgtgtctgtgctgggctgcccagaccctgtggtgcatgaaattgcctaccagtatggcaagaatgtgggcatcgccttccagctgattgatgatgtgctggacttcaccagctgcagcgaccagatgggcaagcccaccagcgctgacctgaagctgggcctggccactggacctgtgctgtttgcctgccagcagtttcctgagatgaatgccatgatcatgaggcgcttcagcctgcctggagatgtggaccgggcccggcagtatgtgctgcagagtgatggagtgcagcagaccacctacctggcccagcagtactgccacgaggccatccgggagatcagcaagctgcggcccagccctgagagagatgccctgatccagctgtctgaaattgtgctgacccgggacaagtag

SEQ ID NO: 165193 - DNA, 1131 bp, Artificial Sequence
  Description of Artificial Sequence: Synthetic coding sequence
atgcctgcccacgtgcacaggaggaagggcctggacctgagccagatcccctacatcaacctggtgaagcacctgaccagcgcctgccccaacgtgtgccgcatcagccgcttccaccacaccaccccagacagcaagacccacagcggggagaagtacacagaccccttcaagctgggctggagggacctgaagggcctgtatgaggacatcaggaaggagctgctgatcagcaccagcgagctgaaggagatgtctgagtactactttgatggcaagggcaaggccttccggcccatcatcgtggccctgatggcccgggcctgcaacatccaccacaacaacagccgccacgtgcaggccagccagagggccatcgccctgattgctgagatgatccacacagccagcctggtgcatgatgatgtgattgatgatgccagcagccggcggggcaagcacacagtgaacaagatctggggcgagaagaaggctgtgctggccggggacctgatcctgtctgctgccagcatcgccctggccagaattggcaacaccaccgtcatcagcatcctgacccaggtgattgaggacctggtgcggggggagttcctgcagctgggcagcaaagaaaatgaaaatgaaagatttgcccactacctggagaagaccttcaagaagacagccagcctcatcgccaacagctgcaaggctgtgtctgtgctgggctgcccagaccctgtggtgcatgagatcgcctaccagtatggcaagaatgtgggcatcgccttccagctgattgatgatgtgctggacttcaccagctgcagcgaccagatgggcaagcccaccagcgctgacctgaagctgggcctggccaccggccctgtgctgtttgcctgccagcagtttcctgagatgaatgccatgatcatgaggcgcttcagcctgcctggagatgtggaccgggcccggcagtatgtgctgcagagtgatggagtgcagcagaccacctacctggcccagcagtactgccacgaggccatccgggagatcagcaagctgcggcccagccctgagagagatgccctgatccagctgtctgagatcgtgctgacccgggacaagtag

SEQ ID NO: 165194 - DNA, 723 bp, Artificial Sequence
  Description of Artificial Sequence: Synthetic coding sequence
atgaacttccggcagctgctgctgcacctgccccgctacctgggcgccagcggcagcccccggcggctgtggtggagccccagcctggacaccatcagctctgtgggctcctggaggggccgcagcagcaagagccctgcccactggaaccaggtggtgtctgaggccgagaagatcgtgggctaccccaccagcttcatgagcctgcgctgcctgctgagtgatgagctgagcaacatcgccatgcaggtgaggaagctggtgggcacccagcaccccctgctgaccacagcccggggcctggtgcatgacagctggaacagcctgcagctgcggggcctggtggtgctgctgatcagcaaggctgctggccccagctctgtgaacaccagctgccagaactatgacatggtgtctggcatctacagctgccagaggagcctggccgagatcacagagctgatccacatcgccctgctggtgcaccggggcatcgtgaacctgaatgagctgcagagcagtgatggccccctgaaggacatgcagtttggaaacaagatcgccatcctgagcggggacttcctgctggccaatgcctgcaatggcctggccctgctgcagaacaccaagagcttctccttcaacggccccatcgccatctaccagatgggagactgtgagagcgcctggatcctgagcaagcacccccgggccctgtcctag

SEQ ID NO: 165195 - DNA, 270 bp, Artificial Sequence
  Description of Artificial Sequence: Synthetic coding sequence
atggagctggccaagcatgatgctgaggtgcagaacatggccttccagtatggcaagcacatggccatgagccacaagatcaacagtgatgtgcagcccttcatcaaggagaagaccagtgacagcatgaccttcaacctgaacagcgcccctgtggtgctgcaccaggagttcctgggccgggacctgtggatcaagcagatcggggagagcagcagcacagaggtgcagctgagcaacttccagcagatgctgctgagcaccctgtag

SEQ ID NO: 165196 - DNA, 1200 bp, Artificial Sequence
  Description of Artificial Sequence: Synthetic coding sequence
atgaacttccggcagctgctgctgcacctgccccgctacctgggcgccagcggcagcccccggcggctgtggtggagccccagcctggacaccatcagctctgtgggctcctggaggggccgcagcagcaagagccctgcccactggaaccaggtggtgtctgaggccgagaagatcgtgggctaccccaccagcttcatgagcctgcgctgcctgctgagtgatgagctgagcaacatcgccatgcaggtgaggaagctggtgggcacccagcaccccctgctgaccacagcccggggcctggtgcatgacagctggaacagcctgcagctgcggggcctggtggtgctgctgatcagcaaggctgctggccccagctctgtgaacaccagctgccagaactatgacatggtgtctggcatctacagctgccagaggagcctggccgagatcacagagctgatccacatcgccctgctggtgcaccggggcatcgtgaacctgaatgagctgcagagcagtgatggccccctgaaggacatgcagtttggaaacaagatcgccatcctgagcggggacttcctgctggccaatgcctgcaatggcctggccctgctgcagaacaccaaggtggtggagctgctggccagcgccctgatggacctggtgcagggcgtgtaccacgagaacagcaccagcaaggagagctacatcacagatgacatcggcatcagcacctggaaggagcagaccttcctgagccatggagccctgctggccaagagctgccaggccgccatggagctggccaagcatgatgctgaggtgcagaacatggccttccagtatggcaagcacatggccatgagccacaagatcaacagtgatgtgcagcccttcatcaaggagaagaccagtgacagcatgaccttcaacctgaacagcgcccctgtggtgctgcaccaggagttcctgggccgggacctgtggatcaagcagatcggggaggcccaggagaagggccgcctggactatgccaagctgcgggagcgcatcaaggccggcaagggcgtgaccagcgccatcgacctgtgccgctaccacggcaacaaggccctggaggccctggagagcttcccccccagcgaggcccggagcgccctggagaacatcgtgtttgctgtgacccgcttctcctag

SEQ ID NO: 165197 - DNA, 243 bp, Artificial Sequence
  Description of Artificial Sequence: Synthetic coding sequence
gtgcagaacatggccttccagtatggcaagcacatggccatgagccacaagatcaacagtgatgtgcagcccttcatcaaggagaagaccagtgacagcatgaccttcaacctgaacagcgcccctgtggtgctgcaccaggagttcctgggccgggacctgtggatcaagcagattggagagagcagcagcacagaggtgcagctgagcaacttccagcagatgctgctgagcaccctgtag

SEQ ID NO: 165198 - DNA, 894 bp, Artificial Sequence
  Description of Artificial Sequence: Synthetic coding sequence
atgaacttccggcagctgctgctgcacctgccccgctacctgggcgccagcggcagcccccggcggctgtggtggagccccagcctggacaccatcagctctgtgggctcctggaggggccgcagcagcaagagccctgcccactggaaccaggtggtgtctgaggccgagaagatcgtgggctaccccaccagcttcatgagcctgcgctgcctgctgagtgatgagctgagcaacatcgccatgcaggtgaggaagctggtgggcacccagcaccccctgctgaccacagcccggggcctggtgcatgacagctggaacagcctgcagctgcggggcctggtggtgctgctgatcagcaaggctgctggccccagctctgtgaacaccagctgccagaactatgacatggtgtctggcatctacagctgccagaggagcctggccgagatcacagagctgatccacatcgccctgctggtgcaccggggcatcgtgaacctgaatgagctgcagagcagtgatggccccctgaaggacatgcagtttggaaacaagatcgccatcctgagcggggacttcctgctggccaatgcctgcaatggcctggccctgctgcagaacaccaaggtggtggagctgctggccagcgccctgatggacctggtgcagggcgtgtaccacgagaacagcaccagcaaggcccaggagaagggccgcctggactatgccaagctgcgggagcgcatcaaggccggcaagggcgtgaccagcgccatcgacctgtgccgctaccacggcaacaaggccctggaggccctggagagcttcccccccagcgaggcccggagcgccctggagaacatcgtgtttgctgtgacccgcttctcctag

SEQ ID NO: 165199 - DNA, 882 bp, Artificial Sequence
  Description of Artificial Sequence: Synthetic coding sequence
atgggccgggtggtggccgagctggtgagcagcctgctgggcctgtggctgctgctgtgcagctgtggctgcccagagggcgctgagctgcgggcccccccagacaagatcgccatcatcggggccggcatcggcggcaccagcgctgcctactacctgcggcagaagtttgggaaggatgtgaagattgacctgtttgagcgggaggaggtgggcggccgcctggccaccatgatggtgcagggccaggagtatgaagctgggggcagcgtcatccaccccctgaacctgcacatgaagagatttgtgaaggacctgggcctgtctgctgtgcaggccagcggcggcctgctgggcatctacaacggggagaccctggtgtttgaggagagcaactggttcatcatcaacgtcatcaagctggtgtggaggtatggcttccagagcctgaggatgcacatgtgggtggaggatgtgctggacaagttcatgaggatctaccgctaccagagccatgactatgccttcagctctgtggagaagctgctgcacgccctgggcggagatgacttcctgggcatgctgaacagaaccctgctggagaccctgcagaaggccggcttcagcgagaagttcctgaatgagatgattgcccctgtgatgagggtgaactacggccagagcacagacatcaatgcctttgtgggcgctgtgtccctgagctgcagcgacagcggcctgtgggccgtggagggcggcaacaagctggtgtgcagcggcctgctgcaggccagcaagagcaacctgatcagcggctctgtgatgtacatcgaggagaagaccaagaccaagtacacagtgctgggcctgtgccccctgtag

SEQ ID NO: 165200 - DNA, 1518 bp, Artificial Sequence
  Description of Artificial Sequence: Synthetic coding sequence
atgggccgggtggtggccgagctggtgagcagcctgctgggcctgtggctgctgctgtgcagctgtggctgcccagagggcgctgagctgcgggcccccccagacaagatcgccatcatcggggccggcatcggcggcaccagcgctgcctactacctgcggcagaagtttgggaaggatgtgaagattgacctgtttgagcgggaggaggtgggcggccgcctggccaccatgatggtgcagggccaggagtatgaagctgggggcagcgtcatccaccccctgaacctgcacatgaagagatttgtgaaggacctgggcctgtctgctgtgcaggccagcggcggcctgctgggcatctacaacggggagaccctggtgtttgaggagagcaactggttcatcatcaacgtcatcaagctggtgtggaggtatggcttccagagcctgaggatgcacatgtgggtggaggatgtgctggacaagttcatgaggatctaccgctaccagagccatgactatgccttcagctctgtggagaagctgctgcacgccctgggcggagatgacttcctgggcatgctgaacagaaccctgctggagaccctgcagaaggccggcttcagcgagaagttcctgaatgagatgattgcccctgtgatgagggtgaactacggccagagcacagacatcaatgcctttgtgggcgctgtgtccctgagctgcagcgacagcggcctgtgggccgtggagggcggcaacaagctggtgtgcagcggcctgctgcaggccagcaagagcaacctgatcagcggctctgtgatgtacatcgaggagaagaccaagaccaagtacacaggcaaccccaccaagatgtatgaggtggtgtaccagattggaacagagaccaggagtgacttctatgacatcgtgctggtggccacccccctgaacaggaagatgagcaacatcaccttcctgaactttgatcctcccatcgaggagttccaccagtactaccagcacatcgtgaccaccctggtgaagggggagctgaacaccagcatcttcagcagccggcccatcgacaagtttggcctgaacacagtgctgaccacagacaacagcgacctcttcatcaacagcattggaattgtgcccagcgtgcgggagaaggaggaccctgagcccagcacagatggcacctacgtgtggaagatcttcagccaggagaccctgaccaaggcccagatcctgaagctgttcctgtcctatgactatgctgtgaagaagccctggctggcctacccccactacaagcccccagagaagtgccccagcatcatcctgcatgaccggctgtactacctgaatggaattgaatgtgccgccagcgccatggagatgtctgccatcgccgcccacaatgctgccctgctggcctaccaccgctggaatggccacacagacatgattgaccaggacggcctgtatgagaagctgaagacagagctgtag

SEQ ID NO: 165201 - DNA, 1287 bp, Artificial Sequence
  Description of Artificial Sequence: Synthetic coding sequence
atgatggtgcagggccaggagtatgaggccggcggcagcgtcatccaccccctgaacctgcacatgaagagatttgtgaaggacctgggcctgtctgctgtgcaggccagcggcggcctgctgggcatctacaatggagagaccctggtgtttgaggagagcaactggttcatcatcaacgtcatcaagctggtgtggaggtatggcttccagagcctgaggatgcacatgtgggtggaggatgtgctggacaagttcatgaggatctaccgctaccagagccatgactatgccttcagctctgtggagaagctgctgcacgccctgggcggagatgacttcctgggcatgctgaacagaaccctgctggagaccctgcagaaggccggcttcagcgagaagttcctgaatgagatgattgcccctgtgatgagggtgaactacggccagagcacagacatcaatgcctttgtgggcgctgtgtccctgagctgcagcgacagcggcctgtgggccgtggagggcggcaacaagctggtgtgcagcggcctgctgcaggccagcaagagcaacctgatcagcggctctgtgatgtacatcgaggagaagaccaagaccaagtacacaggcaaccccaccaagatgtatgaggtggtgtaccagatcggcacagagaccaggagtgacttctatgacatcgtgctggtggccacccccctgaacaggaagatgagcaacatcaccttcctgaactttgacccccccatcgaggagttccaccagtactaccagcacatcgtgaccaccctggtgaagggggagctgaacaccagcatcttcagcagccggcccatcgacaagtttggcctgaacacagtgctgaccacagacaacagcgacctcttcatcaacagcatcggcatcgtgcccagcgtgcgggagaaggaggaccctgagcccagcacagatggcacctacgtgtggaagatcttcagccaggagaccctgaccaaggcccagatcctgaagctgttcctgtcctatgactatgctgtgaagaagccctggctggcctacccccactacaagcccccagagaagtgccccagcatcatcctgcatgaccggctgtactacctgaatggaattgaatgtgccgccagcgccatggagatgtctgccatcgccgcccacaatgctgccctgctggcctaccaccgctggaatggccacacagacatgattgaccaggacggcctgtatgagaagctgaagacagagctgtag

SEQ ID NO: 165202 - DNA, 1284 bp, Artificial Sequence
  Description of Artificial Sequence: Synthetic coding sequence
atggtgcagggccaggagtatgaagctgggggcagcgtcatccaccccctgaacctgcacatgaagagatttgtgaaggacctgggcctgtctgctgtgcaggccagcggcggcctgctgggcatctacaacggggagaccctggtgtttgaggagagcaactggttcatcatcaacgtcatcaagctggtgtggaggtatggcttccagagcctgaggatgcacatgtgggtggaggatgtgctggacaagttcatgaggatctaccgctaccagagccatgactatgccttcagctctgtggagaagctgctgcacgccctgggcggagatgacttcctgggcatgctgaacagaaccctgctggagaccctgcagaaggccggcttcagcgagaagttcctgaatgagatgattgcccctgtgatgagggtgaactacggccagagcacagacatcaatgcctttgtgggcgctgtgtccctgagctgcagcgacagcggcctgtgggccgtggagggcggcaacaagctggtgtgcagcggcctgctgcaggccagcaagagcaacctgatcagcggctctgtgatgtacatcgaggagaagaccaagaccaagtacacaggcaaccccaccaagatgtatgaggtggtgtaccagattggaacagagaccaggagtgacttctatgacatcgtgctggtggccacccccctgaacaggaagatgagcaacatcaccttcctgaactttgatcctcccatcgaggagttccaccagtactaccagcacatcgtgaccaccctggtgaagggggagctgaacaccagcatcttcagcagccggcccatcgacaagtttggcctgaacacagtgctgaccacagacaacagcgacctcttcatcaacagcattggaattgtgcccagcgtgcgggagaaggaggaccctgagcccagcacagatggcacctacgtgtggaagatcttcagccaggagaccctgaccaaggcccagatcctgaagctgttcctgtcctatgactatgctgtgaagaagccctggctggcctacccccactacaagcccccagagaagtgccccagcatcatcctgcatgaccggctgtactacctgaatggaattgaatgtgccgccagcgccatggagatgtctgccatcgccgcccacaatgctgccctgctggcctaccaccgctggaatggccacacagacatgattgaccaggacggcctgtatgagaagctgaagacagagctgtag

SEQ ID NO: 165203 - DNA, 1485 bp, Artificial Sequence
  Description of Artificial Sequence: Synthetic coding sequence
atggcccgggccgcccccctgctggccgccctgacagccctgctggccgctgctgctgctggaggagatgcccctcctgggaagattgctgtggtgggcgccggcatcggcggcagcgctgtggcccacttcctgcagcagcacttcggcccccgggtgcagattgatgtgtatgagaagggcaccgtgggcggccgcctggccaccatctctgtgaacaagcagcactatgaaagtggagctgccagcttccacagcctgagcctgcacatgcaggactttgtgaagctgctgggcctgcggcacagaagagaggtggtgggccgcagcgccatctttggaggagagcacttcatgctggaggagacagactggtacctgctgaacctcttccggctgtggtggcactacggcatctccttcctgcggctgcagatgtgggtggaggaggtgatggagaagttcatgaggatctacaagtaccaggcccacggctacgccttctctggagtggaggagctgctgtacagcctgggggagagcacctttgtgaacatgacccagcacagcgtggccgagagcctgctgcaggtgggcgtgacccagcgcttcattgatgatgtggtgtctgctgtgctgcgggccagctatggccagagcgctgccatgcctgcctttgctggggccatgagcctggccggggcccagggcagcctgtggagcgtggagggcggcaacaagctggtgtgcagcggcctgctgaagctgaccaaggccaacgtcatccacgccaccgtgacctctgtgaccctgcacagcacagagggcaaggccctgtaccaggtggcctatgaaaatgaggtgggcaacagcagtgacttctatgacatcgtggtgattgccacccccctgcacctggacaacagcagcagcaacctgacctttgctggcttccacccccccattgatgatgtgcagggcagcttccagcccaccgtggtgtccctggtgcacggctacctgaacagcagctacttcggcttcccagaccccaagctgttcccctttgccaacatcctgaccacagacttccccagcttcttctgcaccctggacaacatctgccctgtgaacatcagcgccagcttccggaggaagcagccccaggaggccgctgtgtggagggtgcagagccccaagcccctcttccgcacccagctgaagaccctcttccgcagctactacagcgtgcagacagctgagtggcaggcccaccccctgtatggcagccggcccaccctgcccaggtttgccctgcatgaccagctgttctacctgaatgccctggagtgggccgccagctctgtggaggtgatggctgtggccgccaagaatgtggccctgctggcctacaaccgctggtaccaggacctggacaagattgaccagaaggacctgatgcacaaggtgaagacagagctgtag

SEQ ID NO: 165204 - DNA, 531 bp, Artificial Sequence
  Description of Artificial Sequence: Synthetic coding sequence
atgaaggtgctgctgtgtgacctgctgctgctgagcctcttcagcagcgtcttcagcagctgccagagggactgcctgacctgccaggagaagctgcacccagccctggacagctttgacctggaggtgtgcatcctggagtgtgaggagaaggtgttccccagccccctgtggaccccctgcaccaaggtgatggcccggagctcctggcagctgagccctgctgcccctgagcacgtggccgccgccctgtaccagccccgggccagcgagatgcagcacctgcggaggatgccccgggtgcgcagcctcttccaggagcaggaggagcctgagcccggcatggaggaggccggggagatggagcagaagcagctgcagaagagatttggaggcttcaccggggccaggaagagcgccaggaagctggccaaccagaagcgcttcagcgagttcatgaggcagtacctggtgctgtccatgcagagcagccagaggaggaggaccctgcaccagaatggaaatgtgtag

SEQ ID NO: 165205 - DNA, 465 bp, Artificial Sequence
  Description of Artificial Sequence: Synthetic coding sequence
atgaaggtgctgctgtgtgacctgctgctgctgagcctcttcagcagcgtcttcagcagctgccagagggactgcctgacctgccaggagaagctgcacccagccctggacagctttgacctggaggtgtgcatcctggagtgtgaggagaaggtgttccccagccccctgtggaccccctgcaccaaggtgatggcccggagctcctggcagctgagccctgctgcccctgagcacgtggccgccgccctgtaccagccccgggccagcgagatgcagcacctgcggaggatgccccgggtgcgcagcctcttccaggagcaggaggagcctgagcccggcatggaggaggccggggagatggagcagaagcagctgcagaagagatttggaggcttcaccggggccaggaagagcgccaggaagctggccaaccagaagcgcttcagcgagttcatgaggtag

SEQ ID NO: 165206 - DNA, 1230 bp, Artificial Sequence
  Description of Artificial Sequence: Synthetic coding sequence
atgacagagctgcctgcccccctgagctacttccagaatgcccagatgtctgaggacaaccacctgagcaacacagtgcgcagccagaatgacaaccgggagcggcaggagcacaatgacagaagaagcctgggccaccctgagcccctgagcaatggccggccccagggcaacagccggcaggtggtggagcaggatgaggaggaggatgaggagctgaccctgaagtatggagccaagcacgtgatcatgctgtttgtgcctgtgaccctgtgcatggtggtggtggtggccaccatcaagtctgtgtccttctacaccaggaaggatggccagctgatctacacccccttcacagaggacacagagaccgtgggccagagggccctgcacagcatcctgaatgctgccatcatgatctctgtgattgtggtgatgaccatcctgctggtggtgctgtacaagtaccgctgctacaaggtgattcatgcctggctgatcatcagcagcctgctgctgctcttcttcttctccttcatctacctgggggaggtgttcaagacctacaacgtggccgtggactacatcaccgtggccctgctgatctggaactttggagtggtgggcatgatcagcatccactggaagggccccctgcggctgcagcaggcctacctgatcatgatcagcgccctgatggccctggtgttcatcaagtacctgcctgagtggacagcctggctgatcctggccgtcatctctgtgtatgacctggtggccgtgctgtgccccaagggccccctgaggatgctggtggagacagcccaggagagaaatgagaccctcttccctgccctgatctacagcagcaccatggtgtggctggtgaacatggccgagggggaccctgaggcccagaggagagtgtccaagaacagcaagtacaatgctgagcggggcgtgaagctgggcctgggggacttcatcttctacagcgtgctggtgggcaaggccagcgccacagccagcggggactggaacaccaccatcgcctgctttgtggccatcctgattggcctgtgcctgaccctgctgctgctggccatcttcaagaaggccctgcctgccctgcccatcagcatcaccttcggcctggtgttctactttgccacagactacctggtgcagcccttcatggaccagctggccttccaccagttctacatctag

SEQ ID NO: 165207 - DNA, 1404 bp, Artificial Sequence
  Description of Artificial Sequence: Synthetic coding sequence
atgacagagctgcctgcccccctgagctacttccagaatgcccagatgtctgaggacaaccacctgagcaacacagtgcgcagccagaatgacaaccgggagcggcaggagcacaatgacagaagaagcctgggccaccctgagcccctgagcaatggccggccccagggcaacagccggcaggtggtggagcaggatgaggaggaggatgaggagctgaccctgaagtatggagccaagcacgtgatcatgctgtttgtgcctgtgaccctgtgcatggtggtggtggtggccaccatcaagtctgtgtccttctacaccaggaaggatggccagctgatctacacccccttcacagaggacacagagaccgtgggccagagggccctgcacagcatcctgaatgctgccatcatgatctctgtgattgtggtgatgaccatcctgctggtggtgctgtacaagtaccgctgctacaaggtgattcatgcctggctgatcatcagcagcctgctgctgctcttcttcttctccttcatctacctgggggaggtgttcaagacctacaacgtggccgtggactacatcaccgtggccctgctgatctggaactttggagtggtgggcatgatcagcatccactggaagggccccctgcggctgcagcaggcctacctgatcatgatcagcgccctgatggccctggtgttcatcaagtacctgcctgagtggacagcctggctgatcctggccgtcatctctgtgtatgacctggtggccgtgctgtgccccaagggccccctgaggatgctggtggagacagcccaggagagaaatgagaccctcttccctgccctgatctacagcagcaccatggtgtggctggtgaacatggccgagggggaccctgaggcccagaggagagtgtccaagaacagcaagtacaatgctgagagcacagagcgggagagccaggacacagtggccgagaatgatgatggcggcttcagcgaggagtgggaggcccagagggacagccacctgggcccccacaggagcaccccagagagcagagctgctgtgcaggagctgagcagcagcatcctggccggggaggaccctgaggagcggggcgtgaagctgggcctgggggacttcatcttctacagcgtgctggtgggcaaggccagcgccacagccagcggggactggaacaccaccatcgcctgctttgtggccatcctgattggcctgtgcctgaccctgctgctgctggccatcttcaagaaggccctgcctgccctgcccatcagcatcaccttcggcctggtgttctactttgccacagactacctggtgcagcccttcatggaccagctggccttccaccagttctacatctag

SEQ ID NO: 165208 - DNA, 1137 bp, Artificial Sequence
  Description of Artificial Sequence: Synthetic coding sequence
atgacagagctgcctgcccccctgagctacttccagaatgcccagatgtctgaggacaaccacctgagcaacacagtgcgcagccagaatgacaaccgggagcggcaggagcacaatgacagaagaagcctgggccaccctgagcccctgagcaatggccggccccagggcaacagccggcaggtggtggagcaggatgaggaggaggatgaggagctgaccctgaagtatggagccaagcacgtgatcatgctgtttgtgcctgtgaccctgtgcatggtggtggtggtggccaccatcaagtctgtgtccttctacaccaggaaggatggccagctgatctacacccccttcacagaggacacagagaccgtgggccagagggccctgcacagcatcctgaatgctgccatcatgatctctgtgattgtggtgatgaccatcctgctggtggtgctgtacaagtaccgctgctacaaggtgattcatgcctggctgatcatcagcagcctgctgctgctcttcttcttctccttcatctacctgggggaggtgttcaagacctacaacgtggccgtggactacatcaccgtggccctgctgatctggaactttggagtggtgggcatgatcagcatccactggaagggccccctgcggctgcagcaggcctacctgatcatgatcagcgccctgatggccctggtgttcatcaagtacctgcctgagtggacagcctggctgatcctggccgtcatctctgtgtatgacctggtggccgtgctgtgccccaagggccccctgaggatgctggtggagacagcccaggagagaaatgagaccctcttccctgccctgatctacagcagcaccatggtgtggctggtgaacatggccgagggggaccctgaggcccagaggagagtgtccaagaacagcaagtacaatgctgagcgggcctgcctgcccccagctgccatcaacctgctgagcatcgcccccatggcccccaggctcttcatgcccaagggggcctgccggcccacagcccagaagggcagccacaagaccctgctgcagaggatgatgatggccggctctgtgagaaatggcaagccccggggcaccgtcatctag

SEQ ID NO: 165209 - DNA, 1392 bp, Artificial Sequence
  Description of Artificial Sequence: Synthetic coding sequence
atgacagagctgcctgcccccctgagctacttccagaatgcccagatgtctgaggacaaccacctgagcaacaccaatgacaaccgggagcggcaggagcacaatgacagaagaagcctgggccaccctgagcccctgagcaatggccggccccagggcaacagccggcaggtggtggagcaggatgaggaggaggatgaggagctgaccctgaagtatggagccaagcacgtgatcatgctgtttgtgcctgtgaccctgtgcatggtggtggtggtggccaccatcaagtctgtgtccttctacaccaggaaggatggccagctgatctacacccccttcacagaggacacagagaccgtgggccagagggccctgcacagcatcctgaatgctgccatcatgatctctgtgattgtggtgatgaccatcctgctggtggtgctgtacaagtaccgctgctacaaggtgattcatgcctggctgatcatcagcagcctgctgctgctcttcttcttctccttcatctacctgggggaggtgttcaagacctacaacgtggccgtggactacatcaccgtggccctgctgatctggaactttggagtggtgggcatgatcagcatccactggaagggccccctgcggctgcagcaggcctacctgatcatgatcagcgccctgatggccctggtgttcatcaagtacctgcctgagtggacagcctggctgatcctggccgtcatctctgtgtatgacctggtggccgtgctgtgccccaagggccccctgaggatgctggtggagacagcccaggagagaaatgagaccctcttccctgccctgatctacagcagcaccatggtgtggctggtgaacatggccgagggggaccctgaggcccagaggagagtgtccaagaacagcaagtacaatgctgagagcacagagcgggagagccaggacacagtggccgagaatgatgatggcggcttcagcgaggagtgggaggcccagagggacagccacctgggcccccacaggagcaccccagagagcagagctgctgtgcaggagctgagcagcagcatcctggccggggaggaccctgaggagcggggcgtgaagctgggcctgggggacttcatcttctacagcgtgctggtgggcaaggccagcgccacagccagcggggactggaacaccaccatcgcctgctttgtggccatcctgattggcctgtgcctgaccctgctgctgctggccatcttcaagaaggccctgcctgccctgcccatcagcatcaccttcggcctggtgttctactttgccacagactacctggtgcagcccttcatggaccagctggccttccaccagttctacatctag

SEQ ID NO: 165210 - DNA, 555 bp, Artificial Sequence
  Description of Artificial Sequence: Synthetic coding sequence
atgacagagctgcctgcccccctgagctacttccagaatgcccagatgtctgaggacaaccacctgagcaacacagtgcgcagccagaatgacaaccgggagcggcaggagcacaatgacagaagaagcctgggccaccctgagcccctgagcaatggccggccccagggcaacagccggcaggtggtggagcaggatgaggaggaggatgaggagctgaccctgaagtatggagccaagcacgtgatcatgctgtttgtgcctgtgaccctgtgcatggtggtggtggtggccaccatcaagtctgtgtccttctacaccaggaaggatggccagctgatctacacccccttcacagaggacacagagaccgtgggccagagggccctgcacagcatcctgaatgctgccatcatgatctctgtgattgtggtgatgaccatcctgctggtggtgctgtacaagtaccgctgctacaaggtgtccatgaggcacaggagcctgctgagcaccctcttcttcctgtggctgggcatcctggtgacagtgacctag

SEQ ID NO: 165211 - DNA, 1392 bp, Artificial Sequence; identical to SEQ ID NO: 165209
  Description of Artificial Sequence: Synthetic coding sequence

SEQ ID NO: 165212 - DNA, 279 bp, Artificial Sequence
  Description of Artificial Sequence: Synthetic coding sequence
atgacagagctgcctgcccccctgagctacttccagaatgcccagatgtctgaggacaaccacctgagcaacaccaatgacaaccgggagcggcaggagcacaatgacagaagaagcctgggccaccctgagcccctgagcaatggccggccccagggcaacagccggcaggtggtggagcaggatgaggaggaggatgaggagctgaccctgaagtatggagccaagcacgtgatcatgctgtttgtgcctgtgaccctgtgcatggtggtggtgtag

SEQ ID NO: 165213 - DNA, 444 bp, Artificial Sequence
  Description of Artificial Sequence: Synthetic coding sequence
atgacagagctgcctgcccccctgagctacttccagaatgcccagatgtctgaggacaaccacctgagcaacaccaatgacaaccgggagcggcaggagcacaatgacagaagaagcctgggccaccctgagcccctgagcaatggccggccccagggcaacagccggcaggtggtggagcaggatgaggaggaggatgaggagctgaccctgaagtatggagccaagcacgtgatcatgctgtttgtgcctgtgaccctgtgcatggtggtggtggtggccaccatcaagtctgtgtccttctacaccaggaaggatggccagctgatctacacccccttcacagaggacacagagaccgtgggccagagggccctgcacagcatcctgaatgctgccatcatgatctctgtgattgtggtgatgaccatcctgctggtgtag

SEQ ID NO: 165214 - DNA, 330 bp, Artificial Sequence
  Description of Artificial Sequence: Synthetic coding sequence
atgacagagctgcctgcccccctgagctacttccagaatgcccagatgtctgaggacaaccacctgagcaacacagtgcgcagccagaatgacaaccgggagcggcaggagcacaatgacagaagaagcctgggccaccctgagcccctgagcaatggccggccccagggcaacagccggcaggtggtggagcaggatgaggaggaggatgaggagctgaccctgaagtatggagccaagcacgtgatcatgctgtttgtgcctgtgaccctgtgcatggtggtggtggtggccaccatcaagtctgtgtccttctacaccaggaagtag

SEQ ID NO: 165215 - DNA, 468 bp, Artificial Sequence
  Description of Artificial Sequence: Synthetic coding sequence
atgacagagctgcctgcccccctgagctacttccagaatgcccagatgtctgaggacaaccacctgagcaacacagtgcgcagccagaatgacaaccgggagcggcaggagcacaatgacagaagaagcctgggccaccctgagcccctgagcaatggccggccccagggcaacagccggcaggtggtggagcaggatgaggaggaggatgaggagctgaccctgaagtatggagccaagcacgtgatcatgctgtttgtgcctgtgaccctgtgcatggtggtggtggtggccaccatcaagtctgtgtccttctacaccaggaaggatggccagctgatctacacccccttcacagaggacacagagaccgtgggccagagggccctgcacagcatcctgaatgctgccatcatgatctctgtgattgtggtgatgaccatcctgctggtggtgctgtacaagtag

SEQ ID NO: 165216 - DNA, 177 bp, Artificial Sequence
  Description of Artificial Sequence: Synthetic coding sequence
atgacagagctgcctgcccccctgagctacttccagaatgcccagatgtctgaggacaaccacctgagcaacaccaatgacaaccgggagcggcaggagcacaatgacagaagaagcctgggccaccctgagcccctgagcaatggccggccccagggcaacagccggcaggtgtag

SEQ ID NO: 165217 - DNA, 279 bp, Artificial Sequence; identical to SEQ ID NO: 165212
  Description of Artificial Sequence: Synthetic coding sequence

SEQ ID NO: 165218 - DNA, 192 bp, Artificial Sequence
  Description of Artificial Sequence: Synthetic coding sequence
atgacagagctgcctgcccccctgagctacttccagaatgcccagatgtctgaggacaaccacctgagcaacaccaatgacaaccgggagcggcaggagcacaatgacagaagaagcctgggccaccctgagcccctgagcaatggccggccccagggcaacagccggcaggtggtggagcaggatgaatag

SEQ ID NO: 165219 - DNA, 276 bp, Artificial Sequence
  Description of Artificial Sequence: Synthetic coding sequence
atgacagagctgcctgcccccctgagctacttccagaatgcccagatgtctgaggacaaccacctgagcaacaccaatgacaaccgggagcggcaggagcacaatgacagaagaagcctgggccaccctgagcccctgagcaatggccggccccagggcaacagccggcaggtggtggagcaggatgaggaggaggatgaggagctgaccctgaagtatggagccaagcacgtgatcatgctgtttgtgcctgtgaccctgtgcatggtggtgtag

SEQ ID NO: 165220 - DNA, 189 bp, Artificial Sequence
  Description of Artificial Sequence: Synthetic coding sequence
atgacagagctgcctgcccccctgagctacttccagaatgcccagatgtctgaggacaaccacctgagcaacaccaatgacaaccgggagcggcaggagcacaatgacagaagaagcctgggccaccctgagcccctgagcaatggccggccccagggcaacagccggcaggtggtggagcaggactag

SEQ ID NO: 165221 - DNA, 300 bp, Artificial Sequence
  Description of Artificial Sequence: Synthetic coding sequence
atgacagagctgcctgcccccctgagctacttccagaatgcccagatgtctgaggacaaccacctgagcaacacagtgcgcagccagaatgacaaccgggagcggcaggagcacaatgacagaagaagcctgggccaccctgagcccctgagcaatggccggccccagggcaacagccggcaggtggtggagcaggatgaggaggaggatgaggagctgaccctgaagtatggagccaagcacgtgatcatgctgtttgtgcctgtgaccctgtgcatggtggtggtggtggccacctag

SEQ ID NO: 165222 - DNA, 408 bp, Artificial Sequence
  Description of Artificial Sequence: Synthetic coding sequence
atgacagagctgcctgcccccctgagctacttccagaatgcccagatgtctgaggacaaccacctgagcaacaccaatgacaaccgggagcggcaggagcacaatgacagaagaagcctgggccaccctgagcccctgagcaatggccggccccagggcaacagccggcaggtggtggagcaggatgaggaggaggatgaggagctgaccctgaagtatggagccaagcacgtgatcatgctgtttgtgcctgtgaccctgtgcatggtggtggtggtggccaccatcaagtctgtgtccttctacaccaggaaggatggccagctgatctacacccccttcacagaggacacagagaccgtgggccagagggccctgcacagcatcctgaatgctgccatcatgtag

SEQ ID NO: 165223 - DNA, 330 bp, Artificial Sequence
  Description of Artificial Sequence: Synthetic coding sequence
atgacagagctgcctgcccccctgagctacttccagaatgcccagatgtctgaggacaaccacctgagcaacaccaatgacaaccgggagcggcaggagcacaatgacagaagaagcctgggccaccctgagcccctgagcaatggccggccccagggcaacagccggcaggtggtggagcaggatgaggaggaggatgaggagctgaccctgaagtatggagccaagcacgtgatcatgctgtttgtgcctgtgaccctgtgcatggtggtggtggtggccaccatcaagtctgtgtccttctacaccaggaaggatggccagctgtag

SEQ ID NO: 165224 - DNA, 1248 bp, Artificial Sequence
  Description of Artificial Sequence: Synthetic coding sequence
atgctgaccttcatggccagtgacagcgaggaggaggtgtgtgatgagaggaccagcctgatgtctgctgagagccccacccccaggagctgccaggagggccggcagggcccagaagatggagagaacacagcccagtggaggagccaggagaatgaggaggatggagaggaggaccctgacagatatgtgtgcagcggcgtgcccggccggcccccaggcctggaggaggagctgaccctgaagtatggagccaagcacgtgatcatgctgtttgtgcctgtgaccctgtgcatgattgtggtggtggccaccatcaagtctgtgcgcttctacacagagaagaatggccagctgatctacacccccttcacagaggacacccccagcgtgggccagaggctgctgaacagcgtgctgaacaccctcatcatgatctctgtgattgtggtgatgaccatcttcctggtggtgctgtacaagtaccgctgctacaagttcatccacggctggctgatcatgagcagcctgatgctgctcttcctgttcacctacatctacctgggggaggtgctgaagacctacaacgtggccatggactaccccaccctgctgctgactgtgtggaactttggagctgtgggcatggtgtgcatccactggaagggccccctggtgctgcagcaggcctacctgatcatgatcagcgccctgatggccctggtgttcatcaagtacctgcctgagtggagcgcctgggtgatcctgggcgccatctctgtgtatgctgccatggtgtggacagtgggcatggccaagctggaccccagcagccagggcgccctgcagctgccctatgaccctgagatggaggaggacagctatgacagctttggagagcccagctacccagaggtgtttgagccccccctgaccggctacccaggagaggagctggaggaggaggaggagcggggcgtgaagctgggcctgggggacttcatcttctacagcgtgctggtgggcaaggctgctgccactggaagtggggactggaacaccaccctggcctgctttgtggccatcctgattggcctgtgcctgaccctgctgctgctggccgtgttcaagaaggccctgcctgccctgcccatcagcatcaccttcggcctcatcttctacttcagcacagacaacctggtgcggcccttcatggacaccctggccagccaccagctgtacatctag

SEQ ID NO: 165225 - DNA, 1446 bp, Artificial Sequence
  Description of Artificial Sequence: Synthetic coding sequence
atgctggccggcaccgtgcgctttgcccggcactgcctgaagttcttccctgcccagaagccagcctgtgtggactttggagccagccggggccgggccatgctgaccttcatggccagtgacagcgaggaggaggtgtgtgatgagaggaccagcctgatgtctgctgagagccccacccccaggagctgccaggagggccggcagggcccagaagatggagaaaatacagcccagtggaggagccaggagaatgaagaagatggagaagaagatcctgaccgctacgtgtgcagcggcgtgcccggccggcccccaggcctggaggaggagctgaccctgaagtacggggccaagcacgtgatcatgctgtttgtgcctgtgaccctgtgcatgattgtggtggtggccaccatcaagtctgtgcgcttctacacagagaagaatggccagctgatctacacccccttcacagaggacaccccatctgtgggccagaggctgctgaacagcgtgctgaacaccctcatcatgatcagcgtcatcgtggtgatgaccatcttcctggtggtgctgtacaagtaccgctgctacaagttcatccacggctggctgatcatgagcagcctgatgctgctcttcctgttcacctacatctacctgggggaggtgctgaagacctacaacgtggccatggactaccccaccctgctgctgactgtgtggaactttggagctgtgggcatggtgtgcatccactggaagggccccctggtgctgcagcaggcctacctgatcatgatcagcgccctgatggccctggtgttcatcaagtacctgcctgagtggagcgcctgggtgatcctgggcgccatctctgtgtatgacctggtggccgtgctgtgccccaagggccccctgaggatgctggtggagacagcccaggagagaaatgagcccatcttccctgccctgatctacagcagcgccatggtgtggacagtgggcatggccaagctggaccccagcagccagggcgccctgcagctgccctatgaccctgagatggaggaggacagctatgacagctttggagagcccagctacccagaggtgtttgagccccccctgaccggctacccaggagaggagctggaggaggaggaggagcggggcgtgaagctgggcctgggggacttcatcttctacagcgtgctggtgggcaaggctgctgccactggaagtggggactggaacaccaccctggcctgctttgtggccatcctgattggcctgtgcctgaccctgctgctgctggccgtgttcaagaaggccctgcctgccctgcccatcagcatcaccttcggcctcatcttctacttcagcacagacaacctggtgcggcccttcatggacaccctggccagccaccagctgtacatctag

SEQ ID NO: 165226 - DNA, 1347 bp, Artificial Sequence
  Description of Artificial Sequence: Synthetic coding sequence
atgctgaccttcatggccagtgacagcgaggaggaggtgtgtgatgagaggaccagcctgatgtctgctgagagccccacccccaggagctgccaggagggccggcagggcccagaagatggagagaacacagcccagtggaggagccaggagaatgaggaggatggagaggaggaccctgacagatatgtgtgcagcggcgtgcccggccggcccccaggcctggaggaggagctgaccctgaagtatggagccaagcacgtgatcatgctgtttgtgcctgtgaccctgtgcatgattgtggtggtggccaccatcaagtctgtgcgcttctacacagagaagaatggccagctgatctacacccccttcacagaggacacccccagcgtgggccagaggctgctgaacagcgtgctgaacaccctcatcatgatctctgtgattgtggtgatgaccatcttcctggtggtgctgtacaagtaccgctgctacaagttcatccacggctggctgatcatgagcagcctgatgctgctcttcctgttcacctacatctacctgggggaggtgctgaagacctacaacgtggccatggactaccccaccctgctgctgactgtgtggaactttggagctgtgggcatggtgtgcatccactggaagggccccctggtgctgcagcaggcctacctgatcatgatcagcgccctgatggccctggtgttcatcaagtacctgcctgagtggagcgcctgggtgatcctgggcgccatctctgtgtatgacctggtggccgtgctgtgccccaagggccccctgaggatgctggtggagacagcccaggagagaaatgagcccatcttccctgccctgatctacagcagcgccatggtgtggacagtgggcatggccaagctggaccccagcagccagggcgccctgcagctgccctatgaccctgagatggaggaggacagctatgacagctttggagagcccagctacccagaggtgtttgagccccccctgaccggctacccaggagaggagctggaggaggaggaggagcggggcgtgaagctgggcctgggggacttcatcttctacagcgtgctggtgggcaaggccgccgccaccggcagcggggactggaacaccaccctggcctgctttgtggccatcctgattggcctgtgcctgaccctgctgctgctggccgtgttcaagaaggccctgcctgccctgcccatcagcatcaccttcggcctcatcttctacttcagcacagacaacctggtgcggcccttcatggacaccctggccagccaccagctgtacatctag

SEQ ID NO: 165227 - DNA, 1446 bp, Artificial Sequence; identical to SEQ ID NO: 165225
  Description of Artificial Sequence: Synthetic coding sequence

SEQ ID NO: 165228 - DNA, 1344 bp, Artificial Sequence
  Description of Artificial Sequence: Synthetic coding sequence
atgctgaccttcatggccagtgacagcgaggaggaggtgtgtgatgagaggaccagcctgatgtctgctgagagccccacccccaggagctgccaggagggccggcagggcccagaagatggagagaacacagcccagtggaggagccaggagaatgaggaggatggagaggaggaccctgacagatatgtgtgcagcggcgtgcccggccggcccccaggcctggaggaggagctgaccctgaagtatggagccaagcacgtgatcatgctgtttgtgcctgtgaccctgtgcatgattgtggtggtggccaccatcaagtctgtgcgcttctacacagagaagaatggccagctgatctacacccccttcacagaggacacccccagcgtgggccagaggctgctgaacagcgtgctgaacaccctcatcatgatctctgtgattgtggtgatgaccatcttcctggtggtgctgtacaagtaccgctgctacaagttcatccacggctggctgatcatgagcagcctgatgctgctcttcctgttcacctacatctacctgggggaggtgctgaagacctacaacgtggccatggactaccccaccctgctgctgactgtgtggaactttggagctgtgggcatggtgtgcatccactggaagggccccctggtgctgcagcaggcctacctgatcatgatcagcgccctgatggccctggtgttcatcaagtacctgcctgagtggagcgcctgggtgatcctgggcgccatctctgtgtatgacctggtggccgtgctgtgccccaagggccccctgaggatgctggtggagacagcccaggagagaaatgagcccatcttccctgccctgatctacagcagcgccatggtgtggacagtgggcatggccaagctggaccccagcagccagggcgccctgcagctgccctatgaccctgagatggaggacagctatgacagctttggagagcccagctacccagaggtgtttgagccccccctgaccggctacccaggagaggagctggaggaggaggaggagcggggcgtgaagctgggcctgggggacttcatcttctacagcgtgctggtgggcaaggctgctgccactggaagtggggactggaacaccaccctggcctgctttgtggccatcctgattggcctgtgcctgaccctgctgctgctggccgtgttcaagaaggccctgcctgccctgcccatcagcatcaccttcggcctcatcttctacttcagcacagacaacctggtgcggcccttcatggacaccctggccagccaccagctgtacatctag

SEQ ID NO: 165229 - DNA, 390 bp, Artificial Sequence
  Description of Artificial Sequence: Synthetic coding sequence
atgctgaccttcatggccagtgacagcgaggaggaggtgtgtgatgagaggaccagcctgatgtctgctgagagccccacccccaggagctgccaggagggccggcagggcccagaagatggagagaacacagcccagtggaggagccaggagaatgaggaggatggagaggaggaccctgacagatatgtgtgcagcggcgtgcccggccggcccccaggcctggaggaggagctgaccctgaagtatggagccaagcacgtgatcatgctgtttgtgcctgtgaccctgtgcatgattgtggtggtggccaccatcaagtctgtgcgcttctacacagagaagaatggccagctgatctacacccccttcacagaggacaccccctag

SEQ ID NO: 165230 - DNA, 66 bp, Artificial Sequence
  Description of Artificial Sequence: Synthetic coding sequence
atgctgaccttcatggccagtgacagcgaggaggaggtgtgtgatgagaggaccagcctgatgtag

SEQ ID NO: 165231 - DNA, 990 bp, Artificial Sequence
  Description of Artificial Sequence: Synthetic coding sequence
atggcctggaggggctgggcccagaggggctggggctgcggccaggcctggggcgcctctgtgggcggccgcagctgtgaggagctgacagctgtgctgaccccaccccagctgctgggccgccgcttcaacttcttcatccagcagaagtgtggcttcaggaaggcccccaggaaggtggagcccaggagaagtgaccccggcaccagcggggaggcctacaagaggtctgccctgatcccccctgtggaggagaccgtcttctaccccagcccctaccccatccgcagcctcatcaagcccctcttcttcaccgtgggcttcaccggctgtgcctttggatctgctgccatctggcagtatgagagcctgaagagccgggtgcagagctactttgatggcatcaaggctgactggctggacagcatccggccccagaaggagggggacttcaggaaggagatcaacaagtggtggaacaacctgagtgatggccagaggacagtgacaggcatcatcgccgccaacgtgctggtgttctgcctgtggagggtgcccagcctgcagaggaccatgatccgctacttcaccagcaacccagccagcagcgtcatcagcaactttgtgtcctatgtgggcaaggtggccaccggccgctatggccccagcctgggcgccagcggggccatcatgacagtgctggccgctgtgtgcaccaagatccctgagggccgcctggccatcatcttcctgcccatgttcaccttcaccgctggaaatgccctgaaggccatcatcgccatggacacagctggcatgatcctgggctggaagttctttgaccatgctgcccacctgggcggggccctgtttggcatctggtacgtgacctacggccacgagctgatctggaagaaccgggagcccctggtgaagatctggcatgagatccgcaccaacggccccaagaagggcggcggcagcaagtag

SEQ ID NO: 165232 - DNA, 1140 bp, Artificial Sequence
  Description of Artificial Sequence: Synthetic coding sequence
atggcctggaggggctgggcccagaggggctggggctgcggccaggcctggggcgcctctgtgggcggccgcagctgtgaggagctgacagctgtgctgaccccaccccagctgctgggccgccgcttcaacttcttcatccagcagaagtgtggcttcaggaaggcccccaggaaggtggagcccaggagaagtgaccccggcaccagcggggaggcctacaagaggtctgccctgatcccccctgtggaggagaccgtcttctaccccagcccctaccccatccgcagcctcatcaagcccctcttcttcaccgtgggcttcaccggctgtgcctttggatctgctgccatctggcagtatgagagcctgaagagccgggtgcagagctactttgatggcatcaaggctgactggctggacagcatccggccccagaaggagggggacttcaggaaggagatcaacaagtggtggaacaacctgagtgatggccagaggacagtgacaggcatcatcgccgccaacgtgctggtgttctgcctgtggagggtgcccagcctgcagaggaccatgatccgctacttcaccagcaacccagccagcaaggtgctgtgcagccccatgctgctgagcaccttcagccacttcagcctcttccacatggccgccaacatgtatgtgctgtggagcttcagcagcagcatcgtgaacatcctgggccaggagcagttcatggctgtgtacctgtctgctggggtcatcagcaactttgtgtcctatgtgggcaaggtggccaccggccgctatggccccagcctgggcgccagcggggccatcatgacagtgctggccgctgtgtgcaccaagatccctgagggccgcctggccatcatcttcctgcccatgttcaccttcaccgctggaaatgccctgaaggccatcatcgccatggacacagctggcatgatcctgggctggaagttctttgaccatgctgcccacctgggcggggccctgtttggcatctggtacgtgacctacggccacgagctgatctggaagaaccgggagcccctggtgaagatctggcatgagatccgcaccaacggccccaagaagggcggcggcagcaagtag

SEQ ID NO: 165233 - DNA, 663 bp, Artificial Sequence
  Description of Artificial Sequence: Synthetic coding sequence
atggccagcgccacagacagccgctatggccagaaggagagcagtgaccagaactttgactacatgttcaagatcctgatcatcggcaacagctctgtgggcaagaccagcttcctgttccgctatgcagatgacagcttcaccccagcctttgtgtccacagtgggcatcgacttcaaggtgaagaccatctacagaaatgacaagaggatcaagctgcagatctgggacacagctggccaggagcgctaccgcaccatcaccacagcctactacagaggagccatgggcttcatcctgatgtatgacatcaccaatgaggagagcttcaatgctgtgcaggactggagcacccagatcaagacctacagctgggacaatgcccaggtgctgctggtgggcaacaagtgtgacatggaggatgagcgggtggtgtcctctgagcggggccggcagctggccgaccacctgggctttgagttctttgaggccagcgccaaggacaacatcaacgtgaagcagacctttgagcggctggtggatgtgatctgtgagaagatgtctgagagcctggacacagctgaccctgctgtgactggagccaagcagggcccccagctgagtgaccagcaggtgcccccccaccaggactgtgcctgctag

SEQ ID NO: 165234 - DNA, 306 bp, Artificial Sequence
  Description of Artificial Sequence: Synthetic coding sequence
atgaacctggagcgggtgtccaatgaggagaagctgaacctgtgcaggaagtactacctgggcggctttgccttcctgcccttcctgtggctggtgaacatcttctggttcttccgggaggccttcctggtgcctgcctacacagagcagagccagatcaagggctacgtgtggaggtctgctgtgggcttcctgttctgggtgattgtgctgacctcctggatcaccatcttccagatctaccggccccgctggggcgccctgggggactacctgtccttcaccatccccctgggcaccccctag

SEQ ID NO: 165235 - DNA, 378 bp, Artificial Sequence
  Description of Artificial Sequence: Synthetic coding sequence
atggccaagtacctggcccagatcatcgtgatgggcgtgcaggtggtgggccgggcctttgcccgggccctgcggcaggagtttgctgccagcagagctgctgctgatgcccggggccgggccggccacaggtctgctgctgccagcaacctgagcggcctgagcctgcaggaggcccagcagatcctgaatgtgtccaagctgagccctgaggaggtgcagaagaactatgagcacctgttcaaggtgaatgacaagtctgtgggcggcagcttctacctgcagagcaaggtggtgcgggccaaggagcggctggatgaggagctgaagatccaggcccaggaggaccgggagaagggccagatgccccacacctag

SEQ ID NO: 165236 - DNA, 2496 bp, Artificial Sequence
  Description of Artificial Sequence: Synthetic coding sequence
atgcccctggagatggagcccaagatgagcaagctggccttcggctgccagaggagcagcaccagtgatgatgacagcggctgtgccctggaggagtatgcctgggtgcccccaggcctgcggcctgagcagatccagctgtactttgcctgcctgcctgaggagaaggtgccctacgtgaacagccctggagagaagcaccgcatcaagcagctgctgtaccagctgccccctcatgacaatgaggtgcgctactgccagagcctgtctgaggaggagaagaaggagctgcaggtgttttctgcccagaggaagaaggaggccctgggccggggcaccatcaagctgctgagcagagctgtgatgcatgctgtgtgtgagcagtgtggcctgaagatcaatggaggagaggtggccgtgtttgccagcagagctggccctggggtgtgctggcaccccagctgctttgtgtgcttcacctgcaatgagctgctggtggacctgatctacttctaccaggacggcaagatccactgcggccgccaccacgccgagctgctgaagccccgctgcagcgcctgtgatgagatcatctttgctgatgagtgcacagaggccgagggccgccactggcacatgaagcacttctgctgcctggagtgtgaaacagtgctgggcggccagcgctacatcatgaaggatggccggcccttctgctgcggctgctttgagagcctgtatgcagagtactgtgagacctgtggggagcacatcggcgtggaccacgcccagatgacctatgatggccagcactggcacgccacagaggcctgcttcagctgtgcccagtgcaaggccagcctgctgggctgccccttcctgcccaagcagggccagatctactgcagcaagacctgcagcctgggggaggatgtgcacgccagtgacagcagtgacagcgccttccagagcgcccggagccgggacagcagaagatctgtgaggatgggcaagagcagccgctctgctgaccagtgccggcagagcctgctgctgagccctgccctgaactacaagtttcctggcctgtctggaaatgctgatgacaccctgagcaggaagctggatgacctgagcctgagccggcagggcaccagctttgccagcgaggagttctggaagggccgggtggagcaggagaccccagaagatcctgaggagtgggccgaccacgaggactacatgacccagctgctgctgaagtttggagacaagagcctcttccagccccagcccaatgagatggacatccgggccagcgagcactggatcagtgacaacatggtgaagagcaagacagagctgaagcagaacaaccagagcctggccagcaagaagtaccagagcgacatgtactgggcccagagccaggacggcctgggggacagcgcctacggcagccaccctggccctgccagcagccggcggctgcaggagctggagctggaccacggggccagcggctacaaccatgatgagacccagtggtatgaggacagcctggagtgcctgagtgacctgaagccagagcagagcgtgcgggacagcatggacagcctggccctgagcaacatcaccggggcctctgtggatggagagaacaagccccggcccagcctgtacagcctgcagaactttgaggagatggagacagaggactgtgagaagatgagcaacatgggcaccctgaacagctccatgctgcacaggtctgctgagagcctgaagagcctgagcagcgagctgtgcccagagaagatcctgcctgaggagaagcctgtgcacctgcctgtgctgcggcgcagcaagagccagagccggccccagcaggtgaagttcagtgatgatgtgattgacaatggaaattatgacatcgagatccggcagccccccatgtctgagaggacccggcggcgggtgtacaactttgaggagcggggcagccgcagccaccaccacagaagaagaagaagcaggaagagcagaagtgacaatgccctgaacctggtgacagagaggaagtacagccccaaggaccggctgcggctgtacaccccagacaactatgagaagttcatccagaacaagagcgcccgggagatccaggcctacatccagaatgctgacctgtatggccagtatgcccacgccaccagtgactatggcctgcagaaccctggcatgaaccgcttcctgggcctgtatggagaagatgatgacagctggtgcagcagcagcagcagcagcagtgacagcgaggaggagggctacttcctgggccagcccatcccccagccccggccccagagatttgcctactacacagatgacctgagcagccccccatctgccctgcccaccccccagtttggccagaggaccaccaagagcaagaagaagaagggccacaagggcaagaactgcatcatctcctag

SEQ ID NO: 165237 - DNA, 2496 bp, Artificial Sequence; identical to SEQ ID NO: 165236
  Description of Artificial Sequence: Synthetic coding sequence

SEQ ID NO: 165238 - DNA, 2496 bp, Artificial Sequence; identical to SEQ ID NO: 165236
  Description of Artificial Sequence: Synthetic coding sequence

SEQ ID NO: 165239 - DNA, 333 bp, Artificial Sequence
  Description of Artificial Sequence: Synthetic coding sequence
atgcccctggagatggagcccaagatgagcaagctggccttcggctgccagaggagcagcaccagtgatgatgacagcggctgtgccctggaggagtatgcctgggtgcccccaggcctgcggcctgagcagatccagctgtactttgcctgcctgcctgaggagaaggtgccctacgtgaacagccctggagagaagcaccgcatcaagcagctgctgtaccagctgccccctcatgacaatgaggtgcgctactgccagagcctgtctgaggaggagaagaaggagctgcaggtgttttctgcccagaggaagaaggaggccctgggctag

SEQ ID NO: 165240 - DNA, 2496 bp, Artificial Sequence; identical to SEQ ID NO: 165236
  Description of Artificial Sequence: Synthetic coding sequence

SEQ ID NO: 165241 - DNA, 360 bp, Artificial Sequence
  Description of Artificial Sequence: Synthetic coding sequence
atgcccctggagatggagcccaagatgagcaagctggccttcggctgccagaggagcagcaccagtgatgatgacagcggctgtgccctggaggagtatgcctgggtgcccccaggcctgcggcctgagcagatccagctgtactttgcctgcctgcctgaggagaaggtgccctacgtgaacagccctggagagaagcaccgcatcaagcagctgctgtaccagctgccccctcatgacaatgaggtgcgctactgccagagcctgtctgaggaggagaagaaggagctgcaggtgttttctgcccagaggaagaaggaggccctgggccggggcaccatcaagctgctgagcaggtag

SEQ ID NO: 165242 - DNA, 480 bp, Artificial Sequence
  Description of Artificial Sequence: Synthetic coding sequence
atgcccctggagatggagcccaagatgagcaagctggccttcggctgccagaggagcagcaccagtgatgatgacagcggctgtgccctggaggagtatgcctgggtgcccccaggcctgcggcctgagcagatccagctgtactttgcctgcctgcctgaggagaaggtgccctacgtgaacagccctggagagaagcaccgcatcaagcagctgctgtaccagctgccccctcatgacaatgaggtgcgctactgccagagcctgtctgaggaggagaagaaggagctgcaggtgttttctgcccagaggaagaaggaggccctgggccggggcaccatcaagctgctgagcagagctgtgatgcatgctgtgtgtgagcagtgtggcctgaagatcaatggaggagaggtggccgtgtttgccagcagagctggccctggggtgtgctggcaccccagctgctttgtgtgcttctag

SEQ ID NO: 165243 - DNA, 2496 bp, Artificial Sequence; identical to SEQ ID NO: 165236
  Description of Artificial Sequence: Synthetic coding sequence

SEQ ID NO: 165244 - DNA, 2535 bp, Artificial Sequence
  Description of Artificial Sequence: Synthetic coding sequence
atggtgacagtgatgcccctggagatggagaagaccatcagcaagctgatgtttgacttccagaggaacagcaccagtgatgatgacagcggctgtgccctggaggagtatgcctgggtgcccccaggcctgaagccagagcaggtgcaccagtactacagctgcctgcctgaggagaaggtgccctacgtgaacagccctggagagaagctgcgcatcaagcagctgctgcaccagctgccccctcatgacaatgaggtgcgctactgcaacagcctggatgaggaggagaagcgggagctgaagctgttcagcagccagaggaagcgggagaacctgggcagaggaaatgtgcggcccttccctgtgaccatgaccggggccatctgtgagcagtgtggcggccagatcaatggaggagacattgctgtgtttgccagcagagctggccatggagtgtgctggcaccccccctgctttgtgtgcaccgtgtgcaatgagctgctggtggacctgatctacttctaccaggacggcaagatctactgcggccgccaccacgcagaatgtctgaagccccgctgtgccgcctgtgatgagatcatctttgctgatgagtgcacagaggccgagggccgccactggcacatgaagcacttctgctgctttgaatgtgaaacagtgctgggcggccagcgctacatcatgaaggagggccggccctactgctgccactgctttgagagcctgtatgcagagtactgtgacacctgtgcccagcacatcggcatcgaccagggccagatgacctatgatggccagcactggcacgccacagagacctgcttctgctgtgcccactgcaagaagagcctgctgggccggcccttcctgcccaagcagggccagatcttctgcagccgggcctgcagcgctggggaggaccccaatggaagtgacagcagtgacagcgccttccagaatgcccgggccaaggagagcagaagaagtgccaagattggcaagaacaagggcaagacagaggagcccatgctgaaccagcacagccagctgcaggtgagcagcaaccggctgtctgcagatgtggaccccctgagcctgcagatggacatgctgagcctgagcagccagacccccagcctgaacagagaccccatctggaggagccgggaggagccctaccactacggcaacaagatggagcagaaccagacccagagccccctgcagctgctgagccagtgcaacatccgcaccagctacagccctgggggccagggcgctggggcccagcctgagatgtggggcaagcacttcagcaaccccaagaggagcagcagcctggccatgacaggccatgctggcagcttcatcaaggaatgtcgggaggactactacccaggccgcctgcggagccaggagagctacagcgacatgagcagccagagcttcagcgagacccggggcagcatccaggtgcccaagtatgaggaggaggaggaggaggagggcggcctgagcacccagcagtgcaggaccaggcaccccatcagcagcctgaagtacacagaggacatgacccccacagagcagaccccccggggctccatggagagcctggccctgagcaatgccaccggcctgtctgcagatggaggagccaagaggcaggagcacctgagccgcttctccatgccagacctgagcaaggacagcggcatgaatgtgtctgagaagctgagcaacatgggcaccctgaacagctccatgcagttccgctctgctgagagcgtgcgcagcctgctgagcgcccagcagtaccaggagatggagggcaacctgcaccagctgagcaaccccatcggctacagagacctgcagagccacggccgcatgcaccagagctttgattttgatggcggcatggccggcagcaagctgcccggccaggagggcgtgcgcatccagcccatgtctgagaggaccaggagaagagccaccagcagagatgacaacagacgcttccggccccacaggagccgccgcagcagaagaagcagaagtgacaatgccctgcacctggccagcgagcgggaggccatcagccggctgaaggacaggcctcccctgcgggccagagaagattatgaccagttcatgaggcagaggagcttccaggagagcatgggccacggcagcagaagagacctgtatggccagtgccccaggacagtgtctgacctggccctgcagaatgcctttggagaccgctggggcccctactttgctgaatatgactggtgcagcacctgcagcagcagcagcgagagtgacaatgaaggctacttcctgggggagcccatcccccagcctgcccggctgcgctacgtgaccagtgatgagctgctgcacaagtacagcagctatggcctgcccaagagcagcaccctgggcggccggggccagctgcacagcaggaagaggcagaagagcaagaactgcatcatctcctag

SEQ ID NO: 165245 - DNA, 453 bp, Artificial Sequence
  Description of Artificial Sequence: Synthetic coding sequence
atggtgacagtgatgcccctggagatggagaagaccatcagcaagctgatgtttgacttccagaggaacagcaccagtgatgatgacagcggctgtgccctggaggagtatgcctgggtgcccccaggcctgaagccagagcaggtgcaccagtactacagctgcctgcctgaggagaaggtgccctacgtgaacagccctggagagaagctgcgcatcaagcagctgctgcaccagctgccccctcatgacaatgaggtgcgctactgcaacagcctggatgaggaggagaagcgggagctgaagctgttcagcagccagaggaagcgggagaacctgggcagaggaaatgtgcggcccttccctgtgaccatgaccggggccatctgtgagcagtgtggcggccagatcaatggaggagacattgctgtgtttgccagcagagctggatag

SEQ ID NO: 165246 - DNA, 1263 bp, Artificial Sequence
  Description of Artificial Sequence: Synthetic coding sequence
atggagacctttgaccccacagagctgcctgagctgctgaagctgtactaccgccgcctcttcccctacagccagtactaccgctggctgaactacggcggcgtcatcaagaactacttccagcaccgggagttctccttcaccctgaaggatgacatctacatccgctaccagagcttcaacaaccagagcgacctggagaaggagatgcagaagatgaacccctacaagattgacatcggggctgtgtacagccaccggcccaaccagcacaacacagtgaagctgggcgccttccaggcccaggagaaggagctggtgtttgacatcgacatgacagattatgatgatgtgcggcgctgctgcagcagcgctgacatctgccccaagtgctggaccctgatgaccatggccatccgcatcatcgaccgggccctgaaggaggactttggcttcaagcaccggctgtgggtgtacagcggccggcggggcgtgcactgctgggtgtgtgatgaatctgtgaggaagctgagcagcgctgtgcgctctggaattgtggagtacctgagcctggtgaagggcggccaggatgtgaagaagaaggtgcacctgtctgagaagatccaccccttcatcaggaagagcatcaacatcatcaagaagtactttgaggagtatgccctggtgaaccaggacatcctggagaacaaggagagctgggacaagatcctggccctggtgcctgagaccatccatgatgagctgcagcagagcttccagaagagccacaacagcctgcagcgctgggagcacctgaagaaggtggccagccgctaccagaacaacatcaagaatgacaagtatggcccctggctggagtgggagatcatgctgcagtactgcttcccccggctggacatcaacgtgtccaagggcatcaaccacctgctgaagagccccttctctgtgcaccccaagacaggccgcatctctgtgcccatcgacctgcagaaggtggaccagtttgaccccttcaccgtgcccaccatctccttcatctgccgggagctggatgccatcagcaccaatgaggaggagaaggaggagaatgaggccgagagtgatgtgaagcacaggacccgggactacaagaagaccagcctggccccctacgtgaaggtgtttgagcacttcctggagaacctggacaagagcaggaaaggagagctgctgaagaagagtgacctgcagaaggacttctag

SEQ ID NO: 165247 - DNA, 1284 bp, Artificial Sequence
  Description of Artificial Sequence: Synthetic coding sequence
atggagacctttgaccccacagagctgcctgagctgctgaagctgtactaccgccgcctcttcccctacagccagtactaccgctggctgaactacggcggcgtcatcaagaactacttccagcaccgggagttctccttcaccctgaaggatgacatctacatccgctaccagagcttcaacaaccagagcgacctggagaaggagatgcagaagatgaacccctacaagattgacatcggggctgtgtacagccaccggcccaaccagcacaacacagtgaagctgggcgccttccaggcccaggagaaggagctggtgtttgacatcgacatgacagattatgatgatgtgcggcgctgctgcagcagcgctgacatctgccccaagtgctggaccctgatgaccatggccatccgcatcatcgaccgggccctgaagggcaaggactttggcttcaagcaccggctgtgggtgtacagcggcagaagaggagtgcactgctgggtgtgtgatgagagcgtgaggaagctgagcagcgctgtgcgcagcggcatcgtggagtacctgagcctggtgaagggcggccaggatgtgaagaagaaggtgcacctgtctgagaagatccaccccttcatcaggaagagcatcaacatcatcaagaagtactttgaggagtatgccctggtgaaccaggacatcctggagaacaaggagagctgggacaagatcctggccctgatgggcctcttcctgaatgaccccagccccatccatgatgagctgcagcagagcttccagaagagccacaacagcctgcagcgctgggagcacctgaagaaggtggccagccgctaccagaacaacatcaagaatgacaagtatggcccctggctggagtgggagatcatgctgcagtactgcttcccccggctggacatcaacgtgtccaagggcatcaaccacctgctgaagagccccttctctgtgcaccccaagacaggccgcatctctgtgcccatcgacctgcagaaggtggaccagtttgaccccttcaccgtgcccaccatctccttcatctgccgggagctggatgccatcagcaccaatgaggaggagaaggaggagaatgaagctgagagtgatgtgaagcacaggacccgggactacaagaagaccagcctggccccctacgtgaaggtgtttgagcacttcctggagaacctggacaagagcaggaagggggagctgctgaagaagagtgacctgcagaaggacttctag

SEQ ID NO: 165248 - DNA, 762 bp, Artificial Sequence
  Description of Artificial Sequence: Synthetic coding sequence
atggccaacctgggctgctggatgctggtgctgtttgtggccacctggagcgacctgggcctgtgcaagaagaggcccaagccaggcggctggaacacaggaggcagccgctacccaggccagggcagccctgggggcaaccgctacccaccccagggcggcggcggctggggccagccccatggaggcggctggggccagccccatggaggcggctggggccagccccatggaggcggctggggccagccccatggaggcggctggggccagggcggcggcacccacagccagtggaacaagcccagcaagcccaagaccaacatgaagcacatggccggggctgctgctgctggagctgtggtgggcggcctgggcggctacatgctgggcagcgccatgagccggcccatcatccactttggaagtgactatgaggaccgctactaccgggagaacatgcaccgctaccccaaccaggtgtactaccggcccatggatgagtacagcaaccagaacaactttgtgcatgactgtgtgaacatcaccatcaagcagcacacagtgaccaccaccaccaagggggagaacttcacagaaacagatgtgaagatgatggagcgggtggtggagcagatgtgcatcacccagtatgaaagagagagccaggcctactaccagaggggcagctccatggtgctcttcagcagcccccctgtgatcctgctgatctccttcctgatcttcctgattgtgggctag

SEQ ID NO: 165249 - DNA, 750 bp, Artificial Sequence
  Description of Artificial Sequence: Synthetic coding sequence
atggccaacctgggctgctggatgctggtgctgtttgtggccacctggagcgacctgggcctgtgcaagaagaggcccaagccaggcggctggaacacaggaggcagccgctacccaggccagggcagccctgggggcaaccgctacccaccccagggcggcggcggctggggccagccccatggaggcggctggggccagccccatggaggcggctggggccagccccatggaggcggctggggccagccccatggaggcggctggggccagggcggcggcacccacagccagtggaacaagcccagcaagcccaagaccaacatgaagcacatggccggggctgctgctgctggagctgtggtgggcggcctgggcggctacatgctgggcagcgccatgagccggcccatcatccactttggaagtgactatgaggaccgctactaccgggagaacatgcaccgctaccccaaccaggtgtactaccggcccatggatgagtacagcaaccagaacaactttgtgcatgactgtgtgaacatcaccatcaagcagcacacagtgaccaccaccaccaagggggagaacttcacagaaacagatgtgaagatgatggagcgggtggtggagcagatgtgcatcacccagtatgaaagagagagccaggcctactaccagaggggcagctccatggtgctcttcagcagcccccctgtgatcctgctgatctccttcctgatcttctag

SEQ ID NO: 165250 - DNA, 762 bp, Artificial Sequence; identical to SEQ ID NO: 165248
  Description of Artificial Sequence: Synthetic coding sequence

SEQ ID NO: 165251 - DNA, 579 bp, Artificial Sequence
  Description of Artificial Sequence: Synthetic coding sequence
atggagcactggggccagccccacggcggcggctggggccagccccacggcggcggctggggccagccccacggcggcggctggggccagggcggcggcacccacagccagtggaacaagcccagcaagcccaagaccaacatgaagcacatggccggggctgctgctgctggagctgtggtgggcggcctgggcggctacatgctgggcagcgccatgagccggcccatcatccacttcggcagtgactatgaagatcgctactaccgggagaacatgcaccgctaccccaaccaggtgtactaccggcccatggatgagtacagcaaccagaacaactttgtgcatgactgtgtgaacatcaccatcaagcagcacacagtgaccaccaccaccaagggggagaacttcacagaaacagatgtgaagatgatggagcgggtggtggagcagatgtgcatcacccagtatgagcgggagagccaggcctactaccagaggggcagctccatggtgctcttcagcagcccccctgtgatcctgctgatctccttcctgatcttcctgattgtgggctag

SEQ ID NO: 165252 - DNA, 654 bp, Artificial Sequence
  Description of Artificial Sequence: Synthetic coding sequence
atggccaacctgggctgctggatgctggtgctgtttgtggccacctggagcgacctgggcctgtgcaagaagaggcccaagccaggcggctggaacacaggaggcagccgctacccaggccagggcagccctgggggcaaccgctacccaccccagggcggcggcggctggggccagccccatggaggcggctggggccagccccatggaggcggctggggccagccccatggaggcggctggggccagccccatggaggcggctggggccagggcggcggcacccacagccagtggaacaagcccagcaagcccaagaccaacatgaagcacatggccggggctgctgctgctggagctgtggtgggcggcctgggcggctacatgctgggcagcgccatgagccggcccatcatccactttggaagtgactatgaggaccgctactaccgggagaacatgcaccgctaccccaaccaggtgtactaccggcccatggatgagtacagcaaccagaacaactttgtgcatgactgtgtgaacatcaccatcaagcagcacacagtgaccaccaccaccaagggggagaacttcacagaaacagatgtgaagatgatggagcgggtggtggagcagatgtgcatcacccagtag

SEQ ID NO: 165253 - DNA, 531 bp, Artificial Sequence
  Description of Artificial Sequence: Synthetic coding sequence
atgaggaagcacctgtcctggtggtggctggccaccgtgtgcatgctgctcttcagccacctgtctgctgtgcagacccggggcatcaagcaccgcatcaagtggaacaggaaggccctgcccagcacagcccagatcacagaggcccaggtggctgaaaatagacctggggccttcatcaagcagggcaggaagctggacatcgactttggagctgagggcaaccgctactatgaggccaactactggcagttcccagatggcatccactacaacggctgcagcgaggccaacgtgaccaaggaggcctttgtgacaggctgcatcaatgccacccaggccgccaaccagggcgagttccagaagccagacaacaagctgcaccagcaggtgctgtggaggctggtgcaggagctgtgcagcctgaagcactgtgagttctggctggagagaggagctggcctgcgggtgaccatgcaccagcctgtgctgctgtgcctgctggccctgatctggctgactgtgaagtag

SEQ ID NO: 165254 - DNA, 1023 bp, Artificial Sequence
  Description of Artificial Sequence: Synthetic coding sequence
atggccactggaggctaccgcaccagcagcggcctgggcggcagcaccacagacttcctggaggagtggaaggccaagcgggagaagatgagggccaagcagaaccccccaggccctgcccctcctgggggcggcagcagtgatgctgctgggaagcccccagctggggccctgggcaccccagctgctgctgctgccaatgagctgaacaacaacctgcccggcggggccccagctgccccagctgtgcccggccctgggggcgtgaactgtgctgtgggcagcgccatgctgaccagggctgcccctggcccccggcggagtgaagatgagcccccagctgccagcgccagcgctgcccccccaccccagagagatgaggaggagccagatggagtgcctgagaagggcaagagcagcggccccagcgccaggaagggcaagggccagatcgagaagaggaagctgcgggagaagaggaggagcactggagtggtgaacatcccagctgctgagtgcctggatgaatatgaagatgatgaggccggccagaaggagaggaagcgggaggatgccatcacccagcagaacaccatccagaatgaagctgtgaacctgctggaccccggcagcagctacctgctgcaggagccccccaggacagtgtctggccgctacaagagcaccacctctgtgtctgaagaagatgtgagcagccgctacagcaggacagacagaagtggcttcccccgctacaacagagatgccaacgtgtctggcaccctggtgagcagcagcaccctggagaagaagattgaggacctggagaaggaggtggtgcgggagcggcaggagaacctgcggctggtgcggctgatgcaggacaaggaggagatgattggcaagctgaaggaggagattgacctgctgaacagagacctggatgacattgaagatgaaaatgagcagctgaagcaggagaacaagaccctgctgaaggtggtgggccagctgaccaggtag

SEQ ID NO: 165255 - DNA, 231 bp, Artificial Sequence
  Description of Artificial Sequence: Synthetic coding sequence
atggccactggaggctaccgcaccagcagcggcctgggcggcagcaccacagacttcctggaggagtggaaggccaagcgggagaagatgagggccaagcagaaccccccaggccctgcccctcctgggggcggcagcagtgatgctgctgggaagcccccagctggggccctgggcaccccagctgctgctgctgccaatgagctgaacaacaacctgcccggcggctag

SEQ ID NO: 165256 - DNA, 195 bp, Artificial Sequence
  Description of Artificial Sequence: Synthetic coding sequence
atggccactggaggctaccgcaccagcagcggcctgggcggcagcaccacagacttcctggaggagtggaaggccaagcgggagaagatgagggccaagcagaaccccccaggccctgcccctcctgggggcggcagcagtgatgctgctgggaagcccccagctggggccctgggcaccccagctgctgcctag

SEQ ID NO: 165257 - DNA, 663 bp, Artificial Sequence
  Description of Artificial Sequence: Synthetic coding sequence
atgaagagcgtcatctaccacgccctgagccagaaggaggccaatgacagtgatgtgcagcccagcggggcccagagagctgaggcctttgtgcgggccttcctgaagaggagcacccccaggatgagcccccaggcccgggaggaccagctgcagaggaaggctgtggtgctggagtacttcaccaggcacaagaggaaggagaagaagaagaaggccaagggcctgagcgcccggcagaggcgggagctgcggctgtttgacatcaagccagagcagcagcgctacagcctcttcctgcccctgcacgagctgtggaagcagtacatccgggacctgtgcagcggcctgaagccagacacccagccccagatgatccaggccaagctgctgaaggctgacctgcacggggccatcatctctgtgaccaagagcaagtgccccagctatgtgggcatcaccggcatcctgctgcaggagaccaagcacatcttcaagatcatcaccaaggaggaccggctgaaggtgatccccaagctgaactgtgtgttcaccgtggagacagatggcttcatctcctacatctacggcagcaagttccagctgcggagcagcgagaggtctgccaagaagttcaaggccaagggcaccatcgacctgtag

SEQ ID NO: 165258 - DNA, 1695 bp, Artificial Sequence
  Description of Artificial Sequence: Synthetic coding sequence
atgagcagccacggcaacagcctcttcctgcgggagagcggccagaggctgggccgggtgggctggctgcagaggctgcaggagagcctgcagcagagggccctgcggacccggctgcggctgcagaccatgaccctggagcacgtgctgcgcttcctgcggagaaatgccttcatcctgctgactgtgtctgctgtggtgattggagtgtccctggcctttgccctgcggccctaccagctgacctaccggcagatcaagtacttctccttccctggagagctgctgatgaggatgctgcagatgctggtgctgcccctcatcgtgagcagcctggtgacaggcatggccagcctggacaacaaggccaccggccgcatgggcatgagagctgctgtgtactacatggtgaccaccatcatcgctgtgttcatcggcatcctgatggtgaccatcatccaccctgggaagggcagcaaggagggcctgcaccgggagggcagaattgagaccatccccacagcagatgccttcatggacctgatccggaacatgtttcctcccaacctggtggaggcctgcttcaagcagttcaagacccagtacagcaccagggtggtgaccaggaccatggtgaggacagaaaatggcagcgagcccggggcctccatgcccccacccttctctgtggagaatggcaccagcttcctggagaatgtgacccgggccctgggcaccctgcaggagatgctgagctttgaggagaccgtgcctgtgcccggcagcgccaacggcatcaatgccctgggcctggtggtgttttctgtggccttcggcctggtgattggaggcatgaagcacaagggccgggtgctgcgggacttctttgacagcctgaatgaggccatcatgaggctggtgggcatcatcatctggtacgcccctgtgggcatcctcttcctgattgctgggaagatcctggagatggaggacatggctgtgctgggcggccagctgggcatgtacaccctgactgtgattgtgggcctcttcctgcacgccggcatcgtgctgcccctcatctacttcctggtgacccacaggaaccccttccccttcatcggcggcatgctgcaggccctgatcacagccatgggcaccagcagcagcagcgccaccctgcccatcaccttccgctgcctggaggagggcctgggcgtggaccggcgcatcaccaggtttgtgctgcctgtgggcgccaccgtgaacatggatggaacagccctgtatgaggccctggccgccatcttcatcgcccaggtgaacaactatgagctgaacctgggccagatcaccaccatcagcatcacagccacagctgcctctgtgggcgccgccggcatcccccaggccggcctggtgaccatggtgattgtgctgacctctgtgggcctgcccacagaggacatcaccctcatcatcgctgtggactggttcctggaccggctgcggaccatgaccaacgtgctgggggacagcatcggggctgctgtgattgagcacctgagccagcgggagctggagctgcaggaggccgagctgaccctgcccagcctgggcaagccctacaagagcctgatggcccaggagaagggggccagccggggccggggcggcaatgaaagtgccatgtag

SEQ ID NO: 165259 - DNA, 420 bp, Artificial Sequence
  Description of Artificial Sequence: Synthetic coding sequence
atgcactgcctgaggaagaggaggatgacccccatgagccgctacagcctcttcctgcccctgcacgagctgtggaagcagtacatccgggacctgtgcagcggcctgaagccagacacccagccccagatgatccaggccaagctgctgaaggctgacctgcatggagccatcatctctgtgaccaagagcaaatgtcccagctatgtgggcatcaccggcatcctgctgcaggagaccaagcacatcttcaagatcatcaccaaggaggaccggctgaaggtgatccccaagctgaactgtgtgttcaccgtggagacagatggcttcatctcctacatctacggcagcaagttccagctgcggagcagcgagaggtctgccaagaagttcaaggccaagggcaccatcgacctgtag

SEQ ID NO: 165260 - DNA, 342 bp, Artificial Sequence
  Description of Artificial Sequence: Synthetic coding sequence
atggtgcgcttcaagcaccgctacctgctgtgtgagctggtgtctgatgacccccgctgccgcctgagcctggatgacagagtgctgagcagcctggtgcgggacaccatcgcccgggtgcacggcaccttcggggctgctgcctgcagcattggatttgctggcaccatccgcacctgccagaagttcctgatccagtacaacagacggcagctgctgatcctgctgcagaactgcacagatgaaggagagcgggaggccatccagaagtctgtgaccaggagctgcctgctggaggaggaggaggagagcggggaggaggccgctgaggccatggagtag

SEQ ID NO: 165261 - DNA, 492 bp, Artificial Sequence
  Description of Artificial Sequence: Synthetic coding sequence
atggtgcgcttcaagcaccgctacctgctgtgtgagctggtgtctgatgacccccgctgccgcctgagcctggatgacagagtgctgagcagcctggtgcgggacaccatcgcccgggtgcacggcaccttcggggctgctgcctgcagcattggatttgctgtgcgctacctgaatgcctacacaggcatcgtgctgctgcgctgcaggaaggagttctaccagctggtgtggagcgccctgcccttcatcacctacctggagaacaagggccaccgctacccctgcttcttcaacaccctgcacgtgggcggcaccatccgcacctgccagaagttcctgatccagtacaacagacggcagctgctgatcctgctgcagaactgcacagatgaaggagagcgggaggccatccagaagtctgtgaccaggagctgcctgctggaggaggaggaggagagcggggaggaggccgctgaggccatggagtag

SEQ ID NO: 165262 - DNA, 423 bp, Artificial Sequence
  Description of Artificial Sequence: Synthetic coding sequence
atggctgaaaatcgggagcccagaggagctgtggaggccgagctggaccctgtggagtacaccctgaggaagaggctgcccagccggctgccccggcggcccaatgacatctacgtgaacatgaagacagacttcaaggcccagctggcccgctgccagaagctgctggatggaggagcccggggccagaatgcctgcagcgagatctacatccacggcctgggcctggccatcaacagagccatcaacatcgccctgcagctgcaggccggcagctttggcagcctgcaggtggccgccaacaccagcacagtggagctggtggatgagctggagcctgagacagacacccgggagcccctgacccgcatccggaacaacagcgccatccacatccgggtcttccgggtgacccccaagtag

SEQ ID NO: 165263 - DNA, 414 bp, Artificial Sequence
  Description of Artificial Sequence: Synthetic coding sequence
atggctgaaaatcgggagcccagaggagctgtggaggccgagctggaccctgtggagtacaccctgaggaagaggctgcccagccggctgccccggcggcccaatgacatctacgtgaacatgaagacagacttcaaggcccagctggcccgctgccagaagctgctggatggaggagcccggggccagaatgcctgcagcgagatctacatccacggcctgggcctggccatcaacagagccatcaacatcgccctgcagctgcaggccggcagctttggcagcctgcaggtggccgccaacaccagcacagtggagctggtggatgagctggagcctgagacagacacccgggagcccctgacccgcatccggaacaacagcgccatccacatccgggtcttccgggtgtag

SEQ ID NO: 165264 - DNA, 708 bp, Artificial Sequence
  Description of Artificial Sequence: Synthetic coding sequence
atgagaagaggagccccccaggaccaggagctggtgggccctggccccccaggccggggcagcagaggagcccccccacccctgggccctgtggtgcctgtgctggtgttccccccagacctggtgttccgggctgaccagaggagcggcccccggcagctgctgaccctgtacaaccccactggaacagccctgcgcttccgggtgctgtgcacagccccagccaagtacacagtgtttgatgctgagggctacgtgaagccccagagctgcatcgacatcgtcatccgccacgtggcccccatccccagccactatgatgtgcaggaccgcttccgcatcgagctgtctgaggagggcgctgagggccgggtggtgggcaggaaggacatcaccagcatcctgcgggccccagcctaccccctggagctgcagggccagcctgaccctgccccccggcccggccccccagctggcaccccaccacccacagcccggcacttccaggagcacccccggcagcagctggccaccagcagcttcctgctcttcctgctgactggaattgtgtctgtggccttcctgctgctgcccctgcctgatgagctgggcagccagctgccccaggtgctgcacgtgtccctgggccagaagctggtggccgcctacgtgctgggcctgctgaccatggtgttcctgcggacctag

SEQ ID NO: 165265 - DNA, 1248 bp, Artificial Sequence
  Description of Artificial Sequence: Synthetic coding sequence
atgagaggagccaatgcctgggcccccctgtgcctgctgctggccgccgccacccagctgagccggcagcagagccctgagaggcctgtgttcacctgtggcggcatcctgaccggggagagcggcttcatcggcagcgagggcttccctggggtgtacccacccaacagcaagtgcacctggaagatcaccgtgcctgagggcaaggtggtggtgctgaacttccgcttcatcgacctggagagtgacaacctgtgccgctatgactttgtggatgtgtacaatggacatgccaacggccagagaattggccgcttctgtggcaccttccggcctggggccctggtgagcagcggcaacaagatgatggtgcagatgatcagtgatgccaacacagctggaaatggcttcatggccatgttttctgctgctgagcccaatgaaagaggagaccagtactgcggcggcctgctggaccggcccagcggcagcttcaagacccccaactggccagaccgggactacccagctggggtgacctgtgtgtggcacatcgtggcccccaagaaccagctgattgagctgaagtttgagaagtttgatgtggagcgggacaactactgccgctatgactatgtggccgtgttcaatggaggagaggtgaatgatgccaggagaattggcaagtactgtggggacagccccccagcccccatcgtgtctgaaagaaatgagctgctgatccagttcctgagtgacctgagcctgacagcagatggcttcatcggccactacatcttccggcccaagaagctgcccaccaccacagagcagcctgtgaccaccaccttccctgtgaccaccggcctgaagcccaccgtggccctgtgccagcagaagtgcagaagaacaggcaccctggagggcaactactgcagcagtgactttgtgctggccggcaccgtcatcaccaccatcaccagagatggcagcctgcacgccaccgtgtccatcatcaacatctacaaggagggcaacctggccatccagcaggccggcaagaacatgtctgcccggctgactgtggtgtgcaagcagtgccccctgctgcggcggggcctgaactacatcatcatgggccaggtgggggaggatggccggggcaagatcatgcccaacagcttcatcatgatgttcaagaccaagaaccagaagctgctggatgccctgaagaacaagcagtgctag

SEQ ID NO: 165266 - DNA, 2184 bp, Artificial Sequence
  Description of Artificial Sequence: Synthetic coding sequence
atgaggcccctgctgctgctggccctgctgggctggctgctgctggccgaggccaagggagatgccaagccagaggacaacctgctggtgctgactgtggccaccaaggagacagagggcttccgccgcttcaagaggtctgcccagttcttcaactacaagatccaggccctgggcctgggggaggactggaatgtggagaagggcaccagcgctgggggcggccagaaggtgcggctgctgaagaaggccctggagaagcatgctgacaaggaggacctggtgatcctgtttgctgacagctatgatgtgctgtttgccagcggcccccgggagctgctgaagaagttccggcaggcccggagccaggtggtgttttctgctgaggagctgatctacccagaccggcggctggagaccaagtaccctgtggtgtctgatggcaagcgcttcctgggcagcggcggcttcatcggctacgcccccaacctgagcaagctggtggccgagtgggagggccaggacagcgacagcgaccagctgttctacaccaagatcttcctggaccctgagaagcgggagcagatcaacatcaccctggaccaccgctgccgcatcttccagaacctggatggagccctggatgaggtggtgctgaagtttgagatgggccacgtgcgggccaggaacctggcctatgacaccctgcctgtgctgattcatggaaatggccccaccaagctgcagctgaactacctgggcaactacatcccccgcttctggacctttgaaacaggctgcaccgtgtgtgatgagggcctgcggagcctgaagggcattggagatgaggccctgcccaccgtgctggtgggcgtcttcatcgagcagcccaccccatttgtgtccctcttcttccagaggctgctgcggctgcactacccccagaagcacatgaggctcttcatccacaaccacgagcagcaccacaaggcccaggtggaggagttcctggcccagcacggcagcgagtaccagagcgtgaagctggtgggccctgaggtgaggatggccaatgctgatgccaggaacatgggcgctgacctgtgccggcaggacaggagctgcacctactacttctctgtggatgctgatgtggccctgacagagcccaacagcctgcggctgctgatccagcagaacaagaatgtcatcgcccccctgatgaccaggcatggccgcctgtggagcaacttctggggcgccctgtctgcagatggctactatgcccggtctgaggactatgtggacatcgtgcagggcagaagagtgggcgtgtggaatgtgccctacatcagcaacatctacctgatcaagggcagcgccctgcggggggagctgcagagcagtgacctcttccaccacagcaagctggaccctgacatggccttctgtgccaacatccggcagcaggatgtgttcatgttcctgaccaacagacacaccctgggccacctgctgagcctggacagctaccgcaccacccacctgcacaatgacctgtgggaggtgttcagcaaccctgaggactggaaggagaagtacatccaccagaactacaccaaggccctggccggcaagctggtggagaccccctgcccagatgtgtactggttccccatcttcacagaggtggcctgtgatgagctggtggaggagatggagcacttcggccagtggagcctgggcaacaacaaggacaaccgcatccagggcggctatgaaaatgtgcccaccatcgacatccacatgaaccagatcggctttgagcgggagtggcacaagttcctgctggagtacatcgcccccatgacagagaagctgtacccaggctactacacccgggcccagtttgacctggcctttgtggtgcgctacaagccagatgagcagcccagcctgatgccccaccatgatgccagcaccttcaccatcaacatcgccctgaacagagtgggcgtggactatgaaggaggcggctgccgcttcctgcgctacaactgcagcatccgggcccccaggaagggctggaccctgatgcaccctggccgcctgacccactaccacgagggcctgcccaccacccggggcacccgctacatcgctgtgtcctttgtggacccctag

SEQ ID NO: 165267 - DNA, 600 bp, Artificial Sequence
  Description of Artificial Sequence: Synthetic coding sequence
atgaggcccctgctgctgctggccctgctgggctggctgctgctggccgaggccaagggagatgccaagccagaggacaacctgctggtgctgactgtggccaccaaggagacagagggcttccgccgcttcaagaggtctgcccagttcttcaactacaagatccaggccctgggcctgggggaggactggaatgtggagaagggcaccagcgctgggggcggccagaaggtgcggctgctgaagaaggccctggagaagcatgctgacaaggaggacctggtgatcctgtttgctgacagctatgatgtgctgtttgccagcggcccccgggagctgctgaagaagttccggcaggcccggagccaggtggtgttttctgctgaggagctgatctacccagaccggcggctggagaccaagtaccctgtggtgtctgatggcaagcgcttcctgggcagcggcggcttcatcggctacgcccccaacctgagcaagctggtggccgagtgggagggccaggacagcgacagcgaccagctgttctacaccaagatcttcctggaccctgagaagagggtgtcccggctgcacagctag

SEQ ID NO: 165268 - DNA, 2325 bp, Artificial Sequence
  Description of Artificial Sequence: Synthetic coding sequence
atgaggcccctgctgctgctggccctgctgggctggctgctgctggccgaggccaagggagatgccaagccagaggccccctgctgccaggagggcctgcgggccggcggcagcggcagcctgcacctgggccgggacttcaccgtgctggccggggcccggggcagccccagccccagcgtgagcagcatcccccgcttctggatccctggcagtgacaacctgctggtgctgactgtggccaccaaggagacagagggcttccgccgcttcaagaggtctgcccagttcttcaactacaagatccaggccctgggcctgggggaggactggaatgtggagaagggcaccagcgctgggggcggccagaaggtgcggctgctgaagaaggccctggagaagcacgccgacaaggaggacctggtgatcctgtttgctgacagctatgatgtgctgtttgccagcggcccccgggagctgctgaagaagttccggcaggcccggagccaggtggtgttttctgctgaggagctgatctacccagaccggcggctggagaccaagtaccctgtggtgtctgatggcaagcgcttcctgggcagcggcggcttcatcggctacgcccccaacctgagcaagctggtggccgagtgggagggccaggacagcgacagcgaccagctgttctacaccaagatcttcctggaccctgagaagcgggagcagatcaacatcaccctggaccaccgctgccgcatcttccagaacctggatggagccctggatgaggtggtgctgaagtttgagatgggccacgtgcgggccaggaacctggcctatgacaccctgcctgtgctgatccacggcaatggccccaccaagctgcagctgaactacctgggcaactacatcccccgcttctggacctttgagaccggctgcaccgtgtgtgatgagggcctgcggagcctgaagggcattggagatgaggccctgcccaccgtgctggtgggcgtcttcatcgagcagcccaccccatttgtgtccctcttcttccagaggctgctgcggctgcactacccccagaagcacatgaggctcttcatccacaaccacgagcagcaccacaaggcccaggtggaggagttcctggcccagcacggcagcgagtaccagagcgtgaagctggtgggccctgaggtgaggatggccaatgctgatgccaggaacatgggcgctgacctgtgccggcaggacaggagctgcacctactacttctctgtggatgctgatgtggccctgacagagcccaacagcctgcggctgctgatccagcagaacaagaatgtgattgcccccctgatgaccaggcatggccgcctgtggagcaacttctggggcgccctgtctgcagatggctactatgcccggagtgaagattatgtggacatcgtgcagggccggcgggtgggcgtgtggaatgtgccctacatcagcaacatctacctgatcaagggcagcgccctgcggggggagctgcagagcagtgacctcttccaccacagcaagctggaccctgacatggccttctgtgccaacatccggcagcaggatgtgttcatgttcctgaccaacagacacaccctgggccacctgctgagcctggacagctaccgcaccacccacctgcacaatgacctgtgggaggtgttcagcaaccctgaggactggaaggagaagtacatccaccagaactacaccaaggccctggccggcaagctggtggagaccccctgcccagatgtgtactggttccccatcttcacagaggtggcctgtgatgagctggtggaggagatggagcacttcggccagtggagcctgggcaacaacaaggacaaccgcatccagggcggctatgaaaatgtgcccaccatcgacatccacatgaaccagattggatttgagcgggagtggcacaagttcctgctggagtacatcgcccccatgacagagaagctgtacccaggctactacacccgggcccagtttgacctggcctttgtggtgcgctacaagccagatgagcagcccagcctgatgccccaccatgatgccagcaccttcaccatcaacatcgccctgaacagagtgggcgtggactatgagggcggcggctgccgcttcctgcgctacaactgcagcatccgggcccccaggaagggctggaccctgatgcaccctggccgcctgacccactaccacgagggcctgcccaccacccggggcacccgctacatcgctgtgtcctttgtggacccctag

SEQ ID NO: 165269 - DNA, 1176 bp, Artificial Sequence
  Description of Artificial Sequence: Synthetic coding sequence
atgaggcccctgctgctgctggccctgctgggctggctgctgctggccgaggccaagggagatgccaagccagaggacaacctgctggtgctgactgtggccaccaaggagacagagggcttccgccgcttcaagaggtctgcccagttcttcaactacaagatccaggccctgggcctgggggaggactggaatgtggagaagggcaccagcgctgggggcggccagaaggtgcggctgctgaagaaggccctggagaagcatgctgacaaggaggacctggtgatcctgtttgctgacagctatgatgtgctgtttgccagcggcccccgggagctgctgaagaagttccggcaggcccggagccaggtggtgttttctgctgaggagctgatctacccagaccggcggctggagaccaagtaccctgtggtgtctgatggcaagcgcttcctgctggaggatgtgttcatgttcctgaccaacagacacaccctgggccacctgctgagcctggacagctaccgcaccacccacctgcacaatgacctgtgggaggtgttcagcaaccctgaggactggaaggagaagtacatccaccagaactacaccaaggccctggccggcaagctggtggagaccccctgcccagatgtgtactggttccccatcttcacagaggtggcctgtgatgagctggtggaggagatggagcacttcggccagtggagcctgggcaacaacaaggacaaccgcatccagggcggctatgaaaatgtgcccaccatcgacatccacatgaaccagatcggctttgagcgggagtggcacaagttcctgctggagtacatcgcccccatgacagagaagctgtacccaggctactacacccgggcccagtttgacctggcctttgtggtgcgctacaagccagatgagcagcccagcctgatgccccaccatgatgccagcaccttcaccatcaacatcgccctgaacagagtgggcgtggactatgaaggaggcggctgccgcttcctgcgctacaactgcagcatccgggcccccaggaagggctggaccctgatgcaccctggccgcctgacccactaccacgagggcctgcccaccacccggggcacccgctacatcgctgtgtcctttgtggacccctag

SEQ ID NO: 165270 - DNA, 852 bp, Artificial Sequence
  Description of Artificial Sequence: Synthetic coding sequence
atgaggcccctgctgctgctggccctgctgggctggctgctgctggccgaggccaagggagatgccaagccagaggacaacctgctggtgctgactgtggccaccaaggagacagagggcttccgccgcttcaagaggtctgcccagttcttcaactacaagatccaggccctgggcctgggggaggactggaatgtggagaagggcaccagcgctgggggcggccagaaggtgcggctgctgaagaaggccctggagaagcatgctgacaaggaggacctggtgatcctgtttgctgacagctatgatgtgctgtttgccagcggcccccgggagctgctgaagaagttccggcaggcccggagccaggtggtgttttctgctgaggagctgatctacccagaccggcggctggagaccaagtaccctgtggtgtctgatggcaagcgcttcctgggcagcggcggcttcatcggctacgcccccaacctgagcaagctggtggccgagtgggagggccaggacagcgacagcgaccagctgttctacaccaagatcttcctggaccctgagaagcgggagcagatcaacatcaccctggaccaccgctgccgcatcttccagaacctggatggagccctggtgagcccctggggccagggccacctgcccggggcctgctatgagctgacagcctctgtgctgaccagcgagctgtctgtgatgcccagcttccctgctgtggtgctgcagctgaactacctgggcaactacatcccccgcttctggacctttgaaacaggctgcaccgtgtgtgatgagggcctgcggagcctgaagggcatcggctag

SEQ ID NO: 165271 - DNA, 678 bp, Artificial Sequence
  Description of Artificial Sequence: Synthetic coding sequence
atgaggcccctgctgctgctggccctgctgggctggctgctgctggccgaggccaagggagatgccaagccagaggccccctgctgccaggagggcctgcgggccggcggcagcggcagcctgcacctgggccgggacttcaccgtgctggccggggcccggggcagccccagccccagcgtgagcagcatcccccgcttctggatccctggcagtgacaacctgctggtgctgactgtggccaccaaggagacagagggcttccgccgcttcaagaggtctgcccagttcttcaactacaagatccaggccctgggcctgggggaggactggaatgtggagaagggcaccagcgctgggggcggccagaaggtgcggctgctgaagaaggccctggagaagcacgccgacaaggaggacctggtgatcctgtttgctgacagctatgatgtgctgtttgccagcggcccccgggagctgctgaagaagttccggcaggcccggagccaggtggtgttttctgctgaggagctgatctacccagaccggcggctggagaccaagtaccctgtggtgtctgatggcaagcgcttcctgggcagcggcggcttcatcggctacgcccccaacctgagcaagctggtggccgagtgggagggccaggacagcgacagctag

SEQ ID NO: 165272 - DNA, 2277 bp, Artificial Sequence
  Description of Artificial Sequence: Synthetic coding sequence
atgggcggctgcaccgtgaagccccagctgctgctgctggccctggtgctgcacccctggaacccctgcctgggcgctgacagcgagaagcccagcagcatccccacagacaagctgctggtgatcaccgtggccaccaaggagagtgatggcttccaccgcttcatgcagagcgccaagtacttcaactacacagtgaaggtgctgggccagggcgaggagtggagaggaggagatggcatcaacagcatcggcggcggccagaaggtgcggctgatgaaggaggtgatggagcactatgctgaccaggatgacctggtggtgatgttcacagagtgctttgatgtgatctttgctgggggccctgaggaggtgctgaagaagttccagaaggccaaccacaaggtggtgtttgctgctgatggcatcctgtggccagacaagaggctggccgacaagtaccctgtggtgcacatcggcaagcgctacctgaacagcggcggcttcatcggctacgccccctacgtgaacagaattgtgcagcagtggaacctgcaggacaatgatgatgaccagctgttctacaccaaggtgtacatcgaccccctgaagcgggaggccatcaacatcaccctggaccacaagtgcaagatcttccagaccctgaatggagctgtggatgaggtggtgctgaagtttgaaaatggcaaggcccgggccaagaacaccttctatgagaccctgcctgtggccatcaatggaaatggccccaccaagatcctgctgaactactttggaaactacgtgcccaacagctggacccaggacaatggctgcaccctgtgtgaatttgacacagtggacctgtctgctgtggatgtgcaccccaacgtgtccattggagtcttcatcgagcagcccacccccttcctgccccgcttcctggacatcctgctgaccctggactaccccaaggaggccctgaagctgttcatccacaacaaggaggtgtaccacgagaaggacatcaaggtgttctttgacaaggccaagcatgagatcaagaccatcaagatcgtgggccctgaggagaacctgagccaggccgaggccaggaacatgggcatggacttctgccggcaggatgagaagtgtgactactacttctctgtggatgctgatgtggtgctgaccaaccccaggaccctgaagatcctgattgagcagaacaggaagatcatcgcccccctggtgaccaggcatggcaagctgtggagcaacttctggggcgccctgagcccagatggctactatgcccggtctgaggactatgtggacatcgtgcagggcaacagagtgggcgtgtggaatgtgccctacatggccaacgtgtacctgatcaagggcaagaccctgcggtctgagatgaatgaaagaaactactttgtgcgggacaagctggaccctgacatggccctgtgcagaaatgcccgggagatgaccctgcagcgggagaaggacagccccaccccagagaccttccagatgctgagcccccccaagggcgtcttcatgtacatcagcaacagacatgaatttggccgcctgctgagcacagccaactacaacaccagccactacaacaatgacctgtggcagatctttgagaaccctgtggactggaaggagaagtacatcaacagagactacagcaagatcttcacagagaacatcgtggagcagccctgcccagatgtgttctggttccccatcttcagcgagaaggcctgtgatgagctggtggaggagatggagcactacggcaagtggagcggcggcaagcaccacgacagccgcatcagcggcggctatgaaaatgtgcccacagatgacatccacatgaagcaggtggacctggagaatgtgtggctgcacttcatccgggagttcatcgcccctgtgaccctgaaggtgtttgctggctactacaccaagggctttgccctgctgaactttgtggtgaagtacagccctgagcggcagaggagcctgcggccccaccatgatgccagcaccttcaccatcaacatcgccctgaacaacgtgggggaggacttccagggcggcggctgcaagttcctgcgctacaactgcagcattgagagccccaggaagggctggagcttcatgcaccctggccgcctgacccacctgcacgagggcctgcctgtgaagaatggcacccgctacatcgctgtgtccttcatcgacccctag

SEQ ID NO: 165273 - DNA, 2214 bp, Artificial Sequence
  Description of Artificial Sequence: Synthetic coding sequence
atgggcggctgcaccgtgaagccccagctgctgctgctggccctggtgctgcacccctggaacccctgcctgggcgctgacagcgagaagcccagcagcatccccacagacaagctgctggtgatcaccgtggccaccaaggagagtgatggcttccaccgcttcatgcagagcgccaagtacttcaactacacagtgaaggtgctgggccagggcgaggagtggagaggaggagatggcatcaacagcatcggcggcggccagaaggtgcggctgatgaaggaggtgatggagcactatgctgaccaggatgacctggtggtgatgttcacagagtgctttgatgtgatctttgctgggggccctgaggaggtgctgaagaagttccagaaggccaaccacaaggtggtgtttgctgctgatggcatcctgtggccagacaagaggctggccgacaagtaccctgtggtgcacatcggcaagcgctacctgaacagcggcggcttcatcggctacgccccctacgtgaacagaattgtgcagcagtggaacctgcaggacaatgatgatgaccagctgttctacaccaaggtgtacatcgaccccctgaagcgggaggccatcaacatcaccctggaccacaagtgcaagatcttccagaccctgaatggagctgtggatgaggtggtgctgaagtttgaaaatggcaaggcccgggccaagaacaccttctatgagaccctgcctgtggccatcaatggaaatggccccaccaagatcctgctgaactactttggaaactacgtgcccaacagctggacccaggacaatggctgcaccctgtgtgaatttgacacagtggacctgtctgctgtggatgtgcaccccaacgtgtccattggagtcttcatcgagcagcccacccccttcctgccccgcttcctggacatcctgctgaccctggactaccccaaggaggccctgaagctgttcatccacaacaaggaggtgtaccacgagaaggacatcaaggtgttctttgacaaggccaagcatgagatcaagaccatcaagatcgtgggccctgaggagaacctgagccaggccgaggccaggaacatgggcatggacttctgccggcaggatgagaagtgtgactactacttctctgtggatgctgatgtggtgctgaccaaccccaggaccctgaagatcctgattgagcagaacaggaagatcatcgcccccctggtgaccaggcatggcaagctgtggagcaacttctggggcgccctgagcccagatggctactatgcccggtctgaggactatgtggacatcgtgcagggcaacagagtgggcgtgtggaatgtgccctacatggccaacgtgtacctgatcaagggcaagaccctgcggtctgagatgaatgaaagaaactactttgtgcgggacaagctggaccctgacatggccctgtgcagaaatgcccgggagatgggcgtcttcatgtacatcagcaacagacatgaatttggccgcctgctgagcacagccaactacaacaccagccactacaacaatgacctgtggcagatctttgaaaatcctgtggactggaaggagaagtacatcaacagagactacagcaagatcttcacagaaaatattgtggagcagccctgcccagatgtgttctggttccccatcttcagcgagaaggcctgtgatgagctggtggaggagatggagcactacggcaagtggagcggcggcaagcaccacgacagccgcatcagcggcggctatgaaaatgtgcccacagatgacatccacatgaagcaggtggacctggagaatgtgtggctgcacttcatccgggagttcatcgcccctgtgaccctgaaggtgtttgctggctactacaccaagggctttgccctgctgaactttgtggtgaagtacagccctgagcggcagaggagcctgcggccccaccatgatgccagcaccttcaccatcaacatcgccctgaacaacgtgggggaggacttccagggcggcggctgcaagttcctgcgctacaactgcagcattgagagccccaggaagggctggagcttcatgcaccctggccgcctgacccacctgcacgagggcctgcctgtgaagaatggcacccgctacatcgctgtgtccttcatcgacccctag

SEQ ID NO: 165274 - DNA, 1257 bp, Artificial Sequence
  Description of Artificial Sequence: Synthetic coding sequence
atgctggagaaccacatcctgcacaagaggatctacatcctgaccttcttcagccagcagatcttcatcctgtgccacgcccacttcatcttcttcttcaccgtgcgggacttctgccggcaggatgagaagtgtgactactacttctctgtggatgctgatgtggtgctgaccaaccccaggaccctgaagatcctgattgagcagaacaggaagatcatcgcccccctggtgaccaggcatggcaagctgtggagcaacttctggggcgccctgagcccagatggctactatgcccggtctgaggactatgtggacatcgtgcagggcaacagagtgggcgtgtggaatgtgccctacatggccaacgtgtacctgatcaagggcaagaccctgcggtctgagatgaatgaaagaaactactttgtgcgggacaagctggaccctgacatggccctgtgcagaaatgcccgggagatgaccctgcagcgggagaaggacagccccaccccagagaccttccagatgctgagcccccccaagggcgtcttcatgtacatcagcaacagacatgaatttggccgcctgctgagcacagccaactacaacaccagccactacaacaatgacctgtggcagatctttgagaaccctgtggactggaaggagaagtacatcaacagagactacagcaagatcttcacagagaacatcgtggagcagccctgcccagatgtgttctggttccccatcttcagcgagaaggcctgtgatgagctggtggaggagatggagcactacggcaagtggagcggcggcaagcaccacgacagccgcatcagcggcggctatgaaaatgtgcccacagatgacatccacatgaagcaggtggacctggagaatgtgtggctgcacttcatccgggagttcatcgcccctgtgaccctgaaggtgtttgctggctactacaccaagggctttgccctgctgaactttgtggtgaagtacagccctgagcggcagaggagcctgcggccccaccatgatgccagcaccttcaccatcaacatcgccctgaacaacgtgggggaggacttccagggcggcggctgcaagttcctgcgctacaactgcagcattgagagccccaggaagggctggagcttcatgcaccctggccgcctgacccacctgcacgagggcctgcctgtgaagaatggcacccgctacatcgctgtgtccttcatcgacccctag

SEQ ID NO: 165275 - DNA, 2112 bp, Artificial Sequence
  Description of Artificial Sequence: Synthetic coding sequence
atgcagagcgccaagtacttcaactacacagtgaaggtgctgggccagggcgaggagtggagaggaggagatggcatcaacagcattggaggcggccagaaggtgcggctgatgaaggaggtgatggagcactacgccgaccaggatgacctggtggtgatgttcacagaatgttttgatgtgatctttgctgggggccctgaggaggtgctgaagaagttccagaaggccaaccacaaggtggtgtttgctgctgatggcatcctgtggccagacaagaggctggccgacaagtaccctgtggtgcacatcggcaagcgctacctgaacagcggcggcttcatcggctacgccccctacgtgaaccgcatcgtgcagcagtggaacctgcaggacaatgatgatgaccagctgttctacaccaaggtgtacatcgaccccctgaagcgggaggccatcaacatcaccctggaccacaagtgcaagatcttccagaccctgaatggagctgtggatgaggtggtgctgaagtttgaaaatggcaaggcccgggccaagaacaccttctatgagaccctgcctgtggccatcaatggaaatggccccaccaagatcctgctgaactacttcggcaactacgtgcccaacagctggacccaggacaatggctgcaccctgtgtgaatttgacacagtggacctgtctgctgtggatgtgcaccccaacgtgtccattggagtcttcatcgagcagcccacccccttcctgccccgcttcctggacatcctgctgaccctggactaccccaaggaggccctgaagctgttcatccacaacaaggaggtgtaccacgagaaggacatcaaggtgttctttgacaaggccaagcatgagatcaagaccatcaagatcgtgggccctgaggagaacctgagccaggccgaggccaggaacatgggcatggacttctgccggcaggatgagaagtgtgactactacttctctgtggatgctgatgtggtgctgaccaaccccaggaccctgaagatcctgattgagcagaacaggaagatcatcgcccccctggtgaccaggcatggcaagctgtggagcaacttctggggcgccctgagcccagatggctactatgcccggagtgaagattatgtggacatcgtgcagggcaacagagtgggcgtgtggaatgtgccctacatggccaacgtgtacctgatcaagggcaagaccctgcggtctgagatgaatgaaagaaactactttgtgcgggacaagctggaccctgacatggccctgtgcagaaatgcccgggagatgaccctgcagcgggagaaggacagccccaccccagagaccttccagatgctgagcccccccaagggcgtcttcatgtacatcagcaacagacatgaatttggccgcctgctgagcacagccaactacaacaccagccactacaacaatgacctgtggcagatctttgaaaatcctgtggactggaaggagaagtacatcaacagagactacagcaagatcttcacagaaaatattgtggagcagccctgcccagatgtgttctggttccccatcttcagcgagaaggcctgtgatgagctggtggaggagatggagcactacggcaagtggagcggcggcaagcaccacgacagccgcatcagcggcggctatgaaaatgtgcccacagatgacatccacatgaagcaggtggacctggagaatgtgtggctgcacttcatccgggagttcatcgcccctgtgaccctgaaggtgtttgctggctactacaccaagggctttgccctgctgaactttgtggtgaagtacagccctgagcggcagaggagcctgcggccccaccatgatgccagcaccttcaccatcaacatcgccctgaacaacgtgggggaggacttccagggcggcggctgcaagttcctgcgctacaactgcagcattgagagccccaggaagggctggagcttcatgcaccctggccgcctgacccacctgcacgagggcctgcctgtgaagaatggcacccgctacatcgctgtgtccttcatcgacccctag

SEQ ID NO: 165276 - DNA, 1092 bp, Artificial Sequence; identical to SEQ ID NO: 148441
  Description of Artificial Sequence: Synthetic coding sequence

SEQ ID NO: 165277 - DNA, 231 bp, Artificial Sequence
  Description of Artificial Sequence: Synthetic coding sequence
atgaccagcagcggccctggcccccgcttcctgctgctgctgcccctgctgctgcccccagctgccagcgccagtgaccggccccggggccgggaccctgtgaaccctgagaagctgctggtgatcaccgtggccacagctgagacagagggctacctgcgcttcctgcggtctgctgagttcttcaactacacagtgaggaccctgggcctgggggaggagtggaggtag

SEQ ID NO: 165278 - DNA, 732 bp, Artificial Sequence
  Description of Artificial Sequence: Synthetic coding sequence
atggagaagtatgctgaccgggaggacatgatcatcatgtttgtggacagctatgatgtgatcctggccggcagccccacagagctgctgaagaagtttgtgcagagcggcagccggctgctcttctctgctgagagcttctgctggccagagtggggcctggccgagcagtacccagaggtgggcaccgggaagcgcttcctgaacagcggcggcttcatcggctttgccaccaccatccaccagatcgtgcggcagtggaagtacaaggatgatgatgatgaccagctgttctacacccggctgtacctggaccccggcctgcgggagaagctgagcctgaacctggaccacaagagccgcatcttccagaacctgaatggagccctggatgaggtggtgctgaagtttgacaggaacagagtgcgcatcagaaatgtggcctatgacaccctgcccatcgtggtgcatggaaatggccccaccaagctgcagctgaactacctgggcaactacgtgcccaacggctggaccccagagggcggctgcggcttctgcaaccaggacaggaggaccctgcccggcggccctgccagccccccaggagtgtctggccgggtgtgtggcacagcctacagcgtgtctgcccccctgcctgctgctgctgccaccccaggcctgagcccccggcagggccaccccttccctgcccagcagaggggcctgccctag

SEQ ID NO: 165279 - DNA, 1740 bp, Artificial Sequence
  Description of Artificial Sequence: Synthetic coding sequence
atggccgccaagagtgatggagctgctgccagcgccagcccagaccctgagggcgccgccggcggggcccggggcagcgctgggggccgcggggaggccgctgctgctgctggccccccaggagtggtgggcgccggcggccctggccccaggtatgagctgcgggactgctgctgggtgctgtgtgccctgctggtgttcttcagtgatggagccacagacctgtggctggccgccagctactacctgcagaaccagcacacctacttcagcctgaccctgctgtttgtgctgctgcccagcctggtggtgcagctgctgtccttccgctggtttgtgtatgactacagcgagcccgccggcagccctggccctgctgtgtccaccaaggacagcgtggccggcggggccgccatcagcaccaaggacagcgctggggccttccgcaccaaggagggcagccctgagcccggcccccagcctgcccccagcagcgccagcgcctacagaagacgctgctgccgcctgtgcatctggctgctgcagaccctggtgcacctgctgcagctgggccaggtgtggagatacctgcgggccctgtacctgggcctgcagagccgctggagaggagagcggctgcggcggcacttctactggcagatgctgtttgaatctgcagatgtgtccatgctgcggctgctggagaccttcctgcggagcgccccccagctggtgctgcagctgagcctgctggtgcacagaggaggagccccagacctgctgcctgccctgagcaccagcgccagcctggtgtccctggcctggaccctggccagctaccagaaggtgctgcgggacagcagagatgacaagaggcccctgagctacaagggagctgtggcccaggtgctgtggcacctgttcagcattgctgcccggggcctggcctttgccctgtttgcctctgtgtacaagctgtacttcggcatcttcatcgtggcccactggtgtgtgatgaccttctgggtgatccagggcgagacagacttctgcatgagcaagtgggaggagatcatctacaacatggtggtgggcatcatctacatcttctgctggttcaacgtgaaggagggccgcagcagaagaaggatgaccctgtaccactgcatcgtgctgctggagaatgctgccctgaccggcttctggtacagcagcaggaacttcagcacagacttctacagcctcatcatggtgtgtgtggtggccagcagctttgccctgggcatcttcttcatgtgtgtgtactactgcctgctgcaccccaacggccccatgctgggcccccaggcccctggctgcatcttcaggaaggccagcgagccctgtggccccccagcagatgccatcaccagcccccccaggagcctgcccaggaccaccggggctgagagagatggagccagcgctggggagagagctggcacccccaccccacctgtgttccaggtgcggcccggcctgccccccacccctgtggcccggaccctgaggacagagggccctgtgatcagaattgacctgcccaggaagaagtacccagcctgggatgcccacttcatcgaccggcggctgaggaagaccatcctggccctggagtacagcagccctgccaccccccggctgcagtacagatctgtgggcaccagccaggagctgctggagtatgagaccaccgtgtag

SEQ ID NO: 165280 - DNA, 765 bp, Artificial Sequence
  Description of Artificial Sequence: Synthetic coding sequence
atggcctggcagggcctggtgctggccgcctgcctgctgatgttccccagcaccacagctgactgcctgagccgctgcagcctgtgtgctgtgaagacccaggacggccccaagcccatcaaccccctcatctgcagcctgcagtgccaggccgccctgctgcccagcgaggagtgggagcgctgccagagcttcctgtccttcttcacccccagcaccctgggcctgaatgacaaggaggacctgggcagcaagtctgtgggggagggcccctacagcgagctggccaagctgagcggcagcttcctgaaggagctggagaagagcaagttcctgcccagcatcagcaccaaggagaacaccctgagcaagagcctggaggagaagctgcggggcctgagtgatggcttccgggagggcgctgagagcgagctgatgagagatgcccagctgaatgatggagccatggagaccggcaccctgtacctggccgaggaggaccccaaggagcaggtgaagagatatggaggcttcctgaggaagtaccccaagaggagcagcgaggtggccggggagggagatggagacagcatgggccatgaagatctctacaagagatatggaggcttcctgcggcgcatccggcccaagctgaagtgggacaaccagaagagatatggaggcttcctgcggcggcagttcaaggtggtgaccaggagccaggaggaccccaatgcctacagcggggagctgtttgatgcctag

SEQ ID NO: 165281 - DNA, 765 bp, Artificial Sequence; identical to SEQ ID NO: 165280
  Description of Artificial Sequence: Synthetic coding sequence

SEQ ID NO: 165282 - DNA, 804 bp, Artificial Sequence
  Description of Artificial Sequence: Synthetic coding sequence
atggcccgcttcctgaccctgtgcacctggctgctgctgctgggccctggcctgctggccaccgtgcgggcagaatgttcccaggactgtgccacctgcagctaccgcctggtgcggcctgctgacatcaacttcctggcctgtgtgatggagtgtgagggcaagctgcccagcctgaagatctgggagacctgcaaggagctgctgcagctgagcaagccagagctgccccaggacggcaccagcaccctgcgggagaacagcaagccagaggagagccacctgctggccaagagatatggaggcttcatgaagagatatggaggcttcatgaagaagatggatgagctgtaccccatggagcctgaggaggaggccaatggaagtgagatcctggccaagagatatggaggcttcatgaagaaggatgctgaggaggatgacagcctggccaacagcagtgacctgctgaaggagctgctggagactggagacaaccgggagaggagccaccaccaggacggcagtgacaatgaggaggaggtgtccaagagatatggaggcttcatgaggggcctgaagaggagcccccagctggaggatgaggccaaggagctgcagaagagatatggaggcttcatgagaagagtgggccggcctgagtggtggatggactaccagaagagatatggaggcttcctgaagagatttgctgaggccctgcccagtgatgaggagggggagagctacagcaaggaggtgcctgagatggagaagagatatggaggcttcatgaggttctag

SEQ ID NO: 165283 - DNA, 804 bp, Artificial Sequence; identical to SEQ ID NO: 165282
  Description of Artificial Sequence: Synthetic coding sequence

SEQ ID NO: 165284 - DNA, 318 bp, Artificial Sequence
  Description of Artificial Sequence: Synthetic coding sequence
atggcccgcttcctgaccctgtgcacctggctgctgctgctgggccctggcctgctggccaccgtgcgggcagaatgttcccaggactgtgccacctgcagctaccgcctggtgcggcctgctgacatcaacttcctggcctgtgtgatggagtgtgagggcaagctgcccagcctgaagatctgggagacctgcaaggagctgctgcagctgagcaagccagagctgccccaggacggcaccagcaccctgcgggagaacagcaagccagaggagagccacctgctggccaagagatatggaggcttcatgaagtag

SEQ ID NO: 165285 - DNA, 570 bp, Artificial Sequence
  Description of Artificial Sequence: Synthetic coding sequence
atggcccgcttcctgaccctgtgcacctggctgctgctgctgggccctggcctgctggccaccgtgcgggcagaatgttcccaggactgtgccacctgcagctaccgcctggtgcggcctgctgacatcaacttcctggcctgtgtgatggagtgtgagggcaagctgcccagcctgaagatctgggagacctgcaaggagctgctgcagctgagcaagccagagctgccccaggacggcaccagcaccctgcgggagaacagcaagccagaggagagccacctgctggccaagagatatggaggcttcatgaagagatatggaggcttcatgaagaagatggatgagctgtaccccatggagcctgaggaggaggccaatggaagtgagatcctggccaagagatatggaggcttcatgaagaaggatgctgaggaggatgacagcctggccaacagcagtgacctgctgaaggagctgctggagactggagacaaccgggagaggagccaccaccaggacggcagtgacaatgaggaggagaagaagaagaagaagaggaaggagtag

SEQ ID NO: 165286 - DNA, 423 bp, Artificial Sequence
  Description of Artificial Sequence: Synthetic coding sequence
atggccggctggcagagctatgtggacaacctgatgtgtgatggctgctgccaggaggccgccatcgtgggctactgtgatgccaagtatgtgtgggccgccacagctgggggcgtcttccagagcatcacccccatcgagattgacatgattgtgggcaaggaccgggagggcttcttcaccaacggcctgaccctgggcgccaagaagtgcagcgtcatccgggacagcctgtatgtggatggagactgcaccatggacatccgcaccaagagccagggcggggagcccacctacaacgtggccgtgggccgggccggccgggtgctggtgtttgtgatgggcaaggagggcgtgcacggcggcggcctgaacaagaaggcctacagcatggccaagtacctgcgggacagcggcttctag

SEQ ID NO: 165287 - DNA, 423 bp, Artificial Sequence
  Description of Artificial Sequence: Synthetic coding sequence
atggccggctggcagagctatgtggacaacctgatgtgtgatggctgctgccaggaggccgccatcgtgggctactgtgatgccaagtatgtgtgggccgccacagctgggggcgtcttccagagcatcacccccatcgagattgacatgattgtgggcaaggaccgggagggcttcttcaccaacggcctgaccctgggcgccaagaagtgcagcgtcatccgggacagcctgtatgtggatggagactgcaccatggacatccgcaccaagagccagggcggggagcccacctacaacgtggccgtgggccgggccggccgggccctggtgattgtgatgggcaaggagggcgtgcacggcggcaccctgaacaagaaggcctatgagctggccctgtacctgcggcggagtgatgtgtag

SEQ ID NO: 165288 - DNA, 414 bp, Artificial Sequence
  Description of Artificial Sequence: Synthetic coding sequence
atgggagactggaaggtgtacatctctgctgtgctgcgggaccagagaattgatgatgtggccatcgtgggccacgccgacaacagctgtgtgtgggccagcaggcctgggggcctgctggccgccatcagcccccaggaggtgggcgtgctgaccggccctgacagacacaccttcctgcaggccggcctgtctgtgggcggccgccgctgctgcgtcatccgggaccacctgctggccgagggagatggagtgctggatgcccggaccaagggcctggatgcccgggctgtgtgtgtgggccgggccccccgggccctgctggtgctgatgggcagaagaggagtgcatggaggcatcctgaacaagacagtgcatgagctgatccggggcctgaggatgcagggcgcctag

SEQ ID NO: 165289 - DNA, 1167 bp, Artificial Sequence
  Description of Artificial Sequence: Synthetic coding sequence
atgaagtggatggtggtggtgctggtgtgcctgcagctgctggaggccgctgtggtgaaggtgcccctgaagaagttcaagagcatccgggagaccatgaaggagaagggcctgctgggggagttcctgcggacccacaagtatgaccctgcctggaagtacagatttggagacctgtctgtgacctatgagcccatggcctacatggatgctgcctactttggagagatcagcatcggcaccccaccccagaacttcctggtgctgtttgacaccggcagcagcaacctgtgggtgcccagcgtgtactgccagagccaggcctgcaccagccacagccgcttcaaccccagcgagagcagcacctacagcaccaacggccagaccttcagcctgcagtatggcagcggcagcctgaccggcttcttcggctatgacaccctgactgtgcagagcatccaggtgcccaaccaggagtttggcctgtctgaaaatgaacctggcaccaactttgtgtatgcccagtttgatggcatcatgggcctggcctacccagccctgtctgtggatgaggccaccacagccatgcagggcatggtgcaggagggcgccctgaccagccctgtgttttctgtgtacctgagcaaccagcagggcagcagtggaggagctgtggtgtttggaggagtggacagcagcctgtacacaggccagatctactgggcccctgtgacccaggagctgtactggcagatcggcatcgaggagttcctgattggaggccaggccagcggctggtgcagcgagggctgccaggccatcgtggacaccggcaccagcctgctgactgtgccccagcagtacatgtctgccctgctgcaggccaccggggcccaggaggatgaatatggccagttcctggtgaactgcaacagcatccagaacctgcccagcctgaccttcatcatcaacggggtggagttccccctgccccccagcagctacatcctgagcaacaacggctactgcaccgtgggcgtggagcccacctacctgagcagccagaatggccagcccctgtggatcctgggagatgtgttcctgcggagctactacagcgtgtatgacctgggcaacaacagagtgggctttgccacagctgcctag

SEQ ID NO: 165290 - DNA, 315 bp, Artificial Sequence
  Description of Artificial Sequence: Synthetic coding sequence
atgaagtggatggtggtggtgctggtgtgcctgcagctgctggaggccgctgtggtgaaggtgcccctgaagaagttcaagagcatccgggagaccatgaaggagaagggcctgctgggggagttcctgcggacccacaagtatgaccctgcctggaagtacagatttggagacctgtctgtgacctatgagcccatggcctacatggatgctgcctactttggagagatcagcatcggcaccccaccccagaacttcctggtgctgtttgacaccggcagcagccccctgcccctggaccctgcccccagctag

SEQ ID NO: 165291 - DNA, 411 bp, Artificial Sequence
  Description of Artificial Sequence: Synthetic coding sequence
atgaagtggatggtggtggtgctggtgtgcctgcagctgctggaggccgctgtggtgaaggtgcccctgaagaagttcaagagcatccgggagaccatgaaggagaagggcctgctgggggagttcctgcggacccacaagtatgaccctgcctggaagtacagatttggagacctgtctgtgacctatgagcccatggcctacatggatgtgcagagcatccaggtgcccaaccaggagtttggcctgtctgaaaatgagcccggcaccaactttgtgtatgcccagtttgatggcatcatgggcctggcctacccagccctgtctgtggatgaggccaccacagccatgcagggcatggtgcaggagggcgccctgaccagccctgtgttttctgtgtacctgtcctag

SEQ ID NO: 165292 - DNA, 948 bp, Artificial Sequence
  Description of Artificial Sequence: Synthetic coding sequence
atgaagtggatggtggtggtgctggtgtgcctgcagctgctggaggccgctgtggtgaaggtgcccctgaagaagttcaagagcatccgggagaccatgaaggagaagggcctgctgggggagttcctgcggacccacaagtatgaccctgcctggaagtacagatttggagacctgtctgtgacctatgagcccatggcctacatggatgctgcctactttggagagatcagcatcggcaccccaccccagaacttcctggtgctgtttgacaccggcagcagcaacctgtgggtgcccagcgtgtactgccagagccaggcctgcaccagccacagccgcttcaaccccagcgagagcagcacctacagcaccaacggccagaccttcagcctgcagtatggcagcggcagcctgaccggcttcttcggctatgacaccctgactgtgcagagcatccaggtgcccaaccaggagtttggcctgtctgaaaatgaacctggcaccaactttgtgtatgcccagtttgatggcatcatgggcctggcctacccagccctgtctgtggatgaggccaccacagccatgcagggcatggtgcaggagggcgccctgaccagccctgtgttttctgtgtacctgagcaacctggtgctggagagcagcggcctgggccccctgctgacccccagcagagctgccccacccagcagcaccctgcagctgcctgagaagcccctggagcagacctggaacatcctgacccccttcaccaagaccctgcctgtgagcaacctgagcaggaaggtgacctcctgggccggcgtgggcatccctgtgacctgcctgcctgaggccggcagcggcggggagcggcgggcagaatgtggcctgggcgtgcccaccacccggggcccccccaggagccagcaccacagcggggcctag

SEQ ID NO: 165293 - DNA, 543 bp, Artificial Sequence
  Description of Artificial Sequence: Synthetic coding sequence
atgctgtgcctgctgctgaccctgggcgtggccctggtgtgtggggtgcctgccatggacatcccccagaccaagcaggacctggagctgcccaagctggccggcacctggcacagcatggccatggccaccaacaacatcagcctgatggccaccctgaaggcccccctgcgggtgcacatcaccagcctgctgcccaccccagaggacaacctggagatcgtgctgcaccgctgggagaacaacagctgtgtggagaagaaggtgctgggggagaagacagagaaccccaagaagttcaagatcaactacacagtggccaatgaggccaccctgctggacacagattatgacaacttcctgttcctgtgcctgcaggacaccaccacccccatccagagcatgatgtgccagtacctggcccgggtgctggtggaggatgatgagatcatgcagggcttcatccgggccttccggcccctgcccaggcacctgtggtacctgctggacctgaagcagatggaggagccctgccgcttctag

SEQ ID NO: 165294 - DNA, 261 bp, Artificial Sequence
  Description of Artificial Sequence: Synthetic coding sequence
atgctgtgcctgctgctgaccctgggcgtggccctggtgtgtggggtgcctgccatggacatcccccagaccaagcaggacctggagctgcccaaggacaccaccacccccatccagagcatgatgtgccagtacctggcccgggtgctggtggaggatgatgagatcatgcagggcttcatccgggccttccggcccctgcccaggcacctgtggtacctgctggacctgaagcagatggaggccccctgctggctgtag

SEQ ID NO: 165295 - DNA, 543 bp, Artificial Sequence; identical to SEQ ID NO: 165293
  Description of Artificial Sequence: Synthetic coding sequence

SEQ ID NO: 165296 - DNA, 438 bp, Artificial Sequence
  Description of Artificial Sequence: Synthetic coding sequence
atgctgtgcctgctgctgaccctgggcgtggccctggtgtgtggggtgcctgccatggacatcccccagaccaagcaggacctggagctgcccaaggcccccctgcgggtgcacatcaccagcctgctgcccaccccagaggacaacctggagatcgtgctgcaccgctgggagaacaacagctgtgtggagaagaaggtgctgggggagaagacagagaaccccaagaagttcaagatcaactgcaaggccagcggggccccccagctgtcctggaagccccagggccccaggacagatcctgccagcagcacagcccgggtgctggtggaggatgatgagatcatgcagggcttcatccgggccttccggcccctgcccaggcacctgtggtacctgctggacctgaagcagatggaggagccctgccgcttctag

SEQ ID NO: 165297 - DNA, 399 bp, Artificial Sequence
  Description of Artificial Sequence: Synthetic coding sequence
ctgatggccaccctgaaggcccccctgcgggtgcacatcaccagcctgctgcccaccccagaggacaacctggagatcgtgctgcaccgctgggagaacaacagctgtgtggagaagaaggtgctgggggagaagacagagaaccccaagaagttcaagatcaactacacagtggccaatgaggccaccctgctggacacagattatgacaacttcctgttcctgtgcctgcaggacaccaccacccccatccagagcatgatgtgccagtacctggcccgggtgctggtggaggatgatgagatcatgcagggcttcatccgggccttccggcccctgcccaggcacctgtggtacctgctggacctgaagcagatggaggagccctgccgcttctag

SEQ ID NO: 165298 - DNA, 396 bp, Artificial Sequence
  Description of Artificial Sequence: Synthetic coding sequence
tgagtgcctgccatggacatcccccagaccaagcaggacctggagctgcccaaggcccccctgcgggtgcacatcaccagcctgctgcccaccccagaggacaacctggagatcgtgctgcaccgctgggagaacaacagctgtgtggagaagaaggtgctgggggagaagacagagaaccccaagaagttcaagatcaactgcaaggccagcggggccccccagctgtcctggaagccccagggccccaggacagatcctgccagcagcacagcccgggtgctggtggaggatgatgagatcatgcagggcttcatccgggccttccggcccctgcccaggcacctgtggtacctgctggacctgaagcagatggaggagccctgccgcttctag

SEQ ID NO: 165299 - DNA, 381 bp, Artificial Sequence
  Description of Artificial Sequence: Synthetic coding sequence
tgacccctgcgggtgcacatcaccagcctgctgcccaccccagaggacaacctggagatcgtgctgcaccgctgggagaacaacagctgtgtggagaagaaggtgctgggggagaagacagagaaccccaagaagttcaagatcaactacacagtggccaatgaggccaccctgctggacacagattatgacaacttcctgttcctgtgcctgcaggacaccaccacccccatccagagcatgatgtgccagtacctggcccgggtgctggtggaggatgatgagatcatgcagggcttcatccgggccttccggcccctgcccaggcacctgtggtacctgctggacctgaagcagatggaggagccctgccgcttctag

SEQ ID NO: 165300 - DNA, 102 bp, Artificial Sequence
  Description of Artificial Sequence: Synthetic coding sequence
tgagaaatcatgcagggcttcatccgggccttccggcccctgcccaggcacctgtggtacctgctggacctgaagcagatggaggagccctgccgcttctag

SEQ ID NO: 165301 - DNA, 543 bp, Artificial Sequence; identical to SEQ ID NO: 165293
  Description of Artificial Sequence: Synthetic coding sequence

SEQ ID NO: 165302 - DNA, 510 bp, Artificial Sequence
  Description of Artificial Sequence: Synthetic coding sequence
atgctgtgcctgctgctgaccctgggcgtggccctggtgtgtggggtgcctgccatggacatcccccagaccaagcaggacctggagctgcccaagctggccggcacctggcacagcatggccatggccaccaacaacatcagcctgatggccaccctgaaggcccccctgcgggtgcacatcaccagcctgctgcccaccccagaggacaacctggagatcgtgctgcaccgctgggagaacaacagctgtgtggagaagaaggtgctgggggagaagacagagaaccccaagaagttcaagatcaactacacagtggccaatgaggccaccctgctggacacagattatgacaacttcctgttcctgtgcctgcaggacaccaccacccccatccagagcatgatgtgccagtacctggagagctggtggaggaccatgaggagctgccgggacagcagcggcctgagcggcccctgccccggcacctacggcacctgctggacctag

SEQ ID NO: 165303 - DNA, 2274 bp, Artificial Sequence
  Description of Artificial Sequence: Synthetic coding sequence
atgagcaggaagatcagcaaggagagcaagaaggtgaacatcagcagcagcctggagagcgaggacatcagcctggagaccaccgtgcccacagatgacatcagcagcagcgaggagcgggagggcaaggtgcgcatcacccggcagctgattgaaaggaaggagctgctgcacaacatccagctgctgaagattgagctgagccagaagaccatgatgattgacaacctgaaggtggactacctgaccaagattgaggagctggaggagaagctgaatgatgccctgcaccagaagcagctgctgaccctgcggctggacaaccagctggccttccagcagaaggatgccagcaagtaccaggagctgatgaagcaggagatggagaccatcctgctgcggcagaagcagctggaggagaccaacctgcagctgcgggagaaggctggagatgtgagaagaaacctgcgggactttgagctgacagaggagcagtacatcaagctgaaggccttccctgaggaccagctgagcatcccagaatatgtgtctgtgcgcttctatgagctggtgaaccccctgaggaaggagatctgtgagctgcaggtgaagaagaacatcctggccgaggagctgagcaccaacaagaaccagctgaagcagctgacagagacctatgaggaggacaggaagaactacagcgaggtgcagatccgctgccagaggctggccctggagctggccgacaccaagcagctgatccagcagggcgactaccggcaggagaactatgacaaggtgaagtcagaaagagatgccctggagcaggaggtgattgagctgcggaggaagcatgagatcctggaggccagccacatgatccagaccaaggagaggtctgagctgagcaaggaggtggtgaccctggagcagacagtgaccctgctgcagaaggacaaggagtacctgaaccggcagaacatggagctgtctgtgcgctgtgcccacgaggaggaccggctggagcggctgcaggcccagctggaggagagcaagaaggcccgggaggagatgtatgagaagtatgtggccagccgggaccactacaagacagaatatgagaacaagctgcatgatgagctggagcagatccggctgaagaccaaccaggagattgaccagctgagaaatgccagccgggagatgtatgagcgggagaacagaaacctgcgggaggcccgggacaatgctgtggccgagaaggagagagctgtgatggccgagaaggatgccctggagaagcatgaccagctgctggaccgctaccgggagctgcagctgagcacagagagcaaggtgacagagttcctgcaccagagcaagctgaagagctttgaaagtgagcgggtgcagctgctgcaggaggagacagccaggaacctgacccagtgccagctggagtgtgagaagtaccagaagaagctggaggtgctgaccaaggagttctacagcctgcaggccagcagcgagaagaggatcacagagctgcaggcccagaacagcgagcaccaggcccggctggacatctatgagaagctggagaaggagctggatgagatcatcatgcagacagctgagattgaaaatgaagatgaagctgagcgggtgctcttctcctatggctacggggccaacgtgcccaccacagccaagaggcggctgaagcagagcgtgcacctggcccggcgggtgctgcagctggagaagcagaacagcctcatcctgaaggacctggagcacaggaaggaccaggtgacccagctgagccaggagctggaccgggccaacagcctgctgaaccagacccagcagccctaccgctacctgattgagagcgtgcggcagagggacagcaagattgacagcctgacagagagcatcgcccagctggagaaggatgtgagcaacctgaacaaggagaagagcgccctgctgcagaccaagaaccagatggccctggacctggagcagctgctgaaccaccgggaggagctggccgccatgaagcagatcctggtgaagatgcacagcaagcacagcgagaacagcctgctgctgaccaagacagagcccaagcacgtgacagagaaccagaagagcaagaccctgaatgtgcccaaggagcacgaggacaacatcttcacccccaagcccaccctcttcaccaagaaggaggcccctgagtggagcaagaagcagaagatgaagacctag

SEQ ID NO: 165304 - DNA, 651 bp, Artificial Sequence
  Description of Artificial Sequence: Synthetic coding sequence
ttcagaacagccaaggtggagaatgaagatgaggccgagcgggtgctcttctcctatggctatggagccaacgtgcccaccacagccaagaggcggctgaagcagagcgtgcacctggccaggagagtgctgcagctggagaagcagaacagcctcatcctgaaggacctggagcacaggaaggaccaggtgacccagctgagccaggagctggaccgggccaacagcctgctgaaccagacccagcagccctaccgctacctgattgaatctgtgcggcagagggacagcaagattgacagcctgacagagagcatcgcccagctggagaaggatgtgagcaacctgaacaaggagaagagcgccctgctgcagaccaagaaccagatggccctggacctggagcagctgctgaaccaccgggaggagctggccgccatgaagcagatcctggtgaagatgcacagcaagcacagcgagaacagcctgctgctgaccaagacagagcccaagcacgtgacagagaaccagaagagcaagaccctgaatgtgcccaaggagcacgaggacaacatcttcacccccaagcccaccctcttcaccaagaaggaggcccctgagtggagcaagaagcagaagatgaagacctag

SEQ ID NO: 165305 - DNA, 1245 bp, Artificial Sequence
  Description of Artificial Sequence: Synthetic coding sequence
atgagcaggaagatcagcaaggagagcaagaaggtgaacatcagcagcagcctggagagcgaggacatcagcctggagaccaccgtgcccacagatgacatcagcagcagcgaggagcgggagggcaaggtgcgcatcacccggcagctgattgaaaggaaggagctgctgcacaacatccagctgctgaagattgagctgagccagaagaccatgatgattgacaacctgaaggtggactacctgaccaagattgaggagctggaggagaagctgaatgatgccctgcaccagaagcagctgctgaccctgcggctggacaaccagctggccttccagcagaaggatgccagcaagtaccaggagctgatgaagcaggagatggagaccatcctgctgcggcagaagcagctggaggagaccaacctgcagctgcgggagaaggctggagatgtgagaagaaacctgcgggactttgagctgacagaggagcagtacatcaagctgaaggccttccctgaggaccagctgagcatcccagaatatgtgtctgtgcgcttctatgagctggtgaaccccctgaggaaggagatctgtgagctgcaggtgaagaagaacatcctggccgaggagctgagcaccaacaagaaccagctgaagcagctgacagagacctatgaggaggacaggaagaactacagcgaggtgcagatccgctgccagaggctggccctggagctggccgacaccaagcagctgatccagcagggcgactaccggcaggagaactatgacaaggtgaagtcagaaagagatgccctggagcaggaggtgattgagctgcggaggaagcatgagatcctggaggccagccacatgatccagaccaaggagaggtctgagctgagcaaggaggtggtgaccctggagcagacagtgaccctgctgcagaaggacaaggagtacctgaaccggcagaacatggagctgtctgtgcgctgtgcccacgaggaggaccggctggagcggctgcaggcccagctggaggagagcaagaaggcccgggaggagatgtatgagaagtatgtggccagccgggaccactacaagacagaatatgagaacaagctgcatgatgagctggagcagatccggctgaagaccaaccaggagattgaccagctgagaaatgccagccgggagatgtatgagcgggagaacaggaagaagaggaagaagaagtag

SEQ ID NO: 165306 - DNA, 1734 bp, Artificial Sequence
  Description of Artificial Sequence: Synthetic coding sequence
atgacagagctggccggggccagcagcagctgctgccacaggcctgctggccgcggggccatgcagagcgtgctgcaccacttccagaggctgcggggccgggagggcggcagccacttcatcaacaccagcagccccagaggagaggccaagatgagcatcaccagtgatgaggtgaacttcctggtgtaccgctacctgcaggagagcggcttcagccacagcgccttcacctttggaattgagagccacatcagccagagcaacatcaatggcaccctggtgcccccagctgccctgatcagcatcctgcagaagggcctgcagtatgtggaggccgagatcagcatcaatgaagatggcaccgtgtttgatggccggcccatcgagagcctgagcctgattgatgctgtgatgccagatgtggtgcagacccggcagcaggccttccgggagaagctggcccagcagcaggccagcgctgctgctgctgctgctgctgccacagctgctgccacagctgccaccaccaccagcgctggggtgagccaccagaaccccagcaagaaccgggaggccaccgtgaatggagaagaaaatagagcccacagcgtgaacaaccacgccaagcccatggagattgatggagaggtggagatccccagcagcaaggccaccgtgctgcggggccatgaaagtgaggtgttcatctgtgcctggaaccctgtgtctgacctgctggccagcggcagcggggacagcacagcccgcatctggaacctgaatgaaaacagcaatggaggcagcacccagctggtgctgcggcactgcatccgggagggcggccatgatgtgcccagcaacaaggatgtgaccagcctggactggaacaccaacggcaccctgctggccaccggcagctatgatggctttgcccgcatctggacagaagatggcaacctggccagcaccctgggccagcacaagggccccatctttgccctgaagtggaacaggaagggcaactacatcctgtctgctggggtggacaagaccaccatcatctgggatgcccacactggagaggccaagcagcagttccccttccacagcgccccagccctggatgtggactggcagaacaacaccacctttgccagctgcagcacagacatgtgcatccacgtgtgccgcctgggctgtgacaggcctgtgaagaccttccagggccacaccaatgaggtgaatgccatcaagtgggaccccagcggcatgctgctggccagctgcagtgatgacatgaccctgaagatctggagcatgaagcaggaggtgtgcatccatgacctgcaggcccacaacaaggagatctacaccatcaagtggagccccactggacctgccaccagcaaccccaacagcaacatcatgctggccagcgccagctttgacagcacagtgcggctgtgggacatcgagcggggcgtgtgcacccacaccctgaccaagcaccaggagcctgtgtacagcgtggccttctccccagatggcaagtacctggccagcggcagctttgataaatgtgtgcacatctggaacacccagagcggcaacctggtgcacagctaccggggcaccggcggcatctttgaggtgtgctggaatgcccggggggacaaggtgggcgccagcgccagtgatggctctgtgtgtgtgctggacctgaggaagtag

SEQ ID NO: 165307 - DNA, 432 bp, Artificial Sequence
  Description of Artificial Sequence: Synthetic coding sequence
atggctgctgaagatgtggtggccactggagctgaccccagcgacctggagagcggcggcctgctgcacgagatcttcaccagccccctgaacctgctgctgctgggcctgtgcatcttcctgctgtacaagatcgtgcggggggaccagcctgctgccagcggggacagtgatgatgatgagcccccacccctgccccggctgaagaggcgggacttcaccccagctgagctgcggagatttgatggagtgcaggacccccgcatcctgatggccatcaacgggaaggtgtttgatgtgaccaagggcaggaagttctacggccctgtgaagtaccaccacgtgggcaagctgctgaaggagggggaggagcccaccgtgtacagtgatgaggaggagcccaaggatgagagcgccaggaagaatgactag

SEQ ID NO: 165308 - DNA, 672 bp, Artificial Sequence
  Description of Artificial Sequence: Synthetic coding sequence
atggctgctggagatggagatgtgaagctgggcaccctgggcagcggcagcgagagcagcaatgatggcggcagcgagagccctggagatgctggagctgctgctgagggcggcggctgggccgctgctgccctggccctgctgactggaggaggagagatgctgctgaatgtggccctggtggccctggtgctgctgggcgcctaccgcctgtgggtgcgctggggcagaagaggcctgggcgctggggccggggccggggaggagagccctgccaccagcctgcccaggatgaagaagagggacttcagcctggagcagctgcggcagtatgatggcagcaggaacccccgcatcctgctggccgtgaatggcaaggtgtttgatgtgaccaagggcagcaagttctacggccctgctggcccctacggcatctttgctggaagagatgccagccggggcctggccaccttctgcctggacaaggatgccctgagagatgaatatgatgacctgagtgacctgaatgctgtgcagatggagagcgtgcgggagtgggagatgcagttcaaggagaagtatgactatgtgggccgcctgctgaagccaggagaggagcccagcgagtacacagatgaggaggacaccaaggaccacaacaagcaggactag

SEQ ID NO: 165309 - DNA, 402 bp, Artificial Sequence
  Description of Artificial Sequence: Synthetic coding sequence
atggctgctggagatggagatgtgaagctgggcaccctgggcagcggcagcgagagcagcaatgatggcggcagcgagagccctggagatgctggagctgctgctgagggcggcggctgggccgctgctgccctggccctgctgactggaggaggagagatgctgctgaatgtggccctggtggccctggtgctgctgggcgcctaccgcctgtgggtgcgctggggcagaagaggcctgggcgctggggccggggccggcctgcagctgggcgctgctgcccctgtgcggcggctgccccagcctgcccacccagcccggggccagtgggagagcctgcggcgggaccagaggcagcaggtgctgcggcctgggggcagcatctggaacatctgctggtag

SEQ ID NO: 165310 - DNA, 744 bp, Artificial Sequence
  Description of Artificial Sequence: Synthetic coding sequence
atgggcggggccggccggggcgtgggggagggccggggccggggcggcggcggccgccgctggagggctgtgatggctgctggagatggagatgtgaagctgggcaccctgggcagcggcagcgagagcagcaatgatggcggcagcgagagccctggagatgctggagctgctgctgagggcggcggctgggccgctgctgccctggccctgctgactggaggaggagagatgctgctgaatgtggccctggtggccctggtgctgctgggcgcctaccgcctgtgggtgcgctggggcagaagaggcctgggcgctggggccggggccggggaggagagccctgccaccagcctgcccaggatgaagaagagggacttcagcctggagcagctgcggcagtatgatggcagcaggaacccccgcatcctgctggccgtgaatggcaaggtgtttgatgtgaccaagggcagcaagttctacggccctgctggcccctacggcatctttgctggaagagatgccagccggggcctggccaccttctgcctggacaaggatgccctgagagatgaatatgatgacctgagtgacctgaatgctgtgcagatggagagcgtgcgggagtgggagatgcagttcaaggagaagtatgactatgtgggccgcctgctgaagccaggagaggagcccagcgagtacacagatgaggaggacaccaaggaccacaacaagcaggactag

SEQ ID NO: 165311 - DNA, 1041 bp, Artificial Sequence
  Description of Artificial Sequence: Synthetic coding sequence
atggccatggcccagaagctgagccacctgctgcccagcctgcggcaggtgatccaggagccccagctgagcctgcagcctgagcctgtgttcaccgtggacagagctgaggtgcccccactcttctggaagccctacatctatgccggctaccggcccctgcaccagacctggaggttctacttccgcaccctcttccagcagcacaatgaggccgtgaatgtgtggacccacctgctggccgccctggtgctgctgctgcggctggccctgtttgtggagaccgtggacttctggggagacccccacgccctgcccctcttcatcatcgtgctggccagcttcacctacctgtccttcagcgccctggcccacctgctgcaggccaagtctgagttctggcactacagcttcttcttcctggactatgtgggcgtggccgtgtaccagtttggaagtgccctggcccacttctactatgccatcgagcccgcctggcacgcccaggtgcaggccgtgttcctgcccatggccgccttcctggcctggctgagctgcatcggcagctgctacaacaagtacatccagaagccaggcctgctgggccgcacctgccaggaggtgcccagcgtgctggcctatgccctggacatcagccctgtggtgcaccgcatctttgtgtccagtgaccccaccacagatgatcctgccctgctgtaccacaagtgccaggtggtgttcttcctgctggccgccgccttcttcagcaccttcatgcctgagcgctggttccctggcagctgccacgtgtttggccagggccaccagctgttccacatcttcctggtgctgtgcaccctggcccagctggaggccgtggccctggactatgaggcccggcggcccatctatgagcccctgcacacccactggccccacaacttcagcggcctcttcctgctgactgtgggcagcagcatcctgacagccttcctgctgagccagctggtgcagaggaagctggaccagaagaccaagtag

SEQ ID NO: 165312 - DNA, 867 bp, Artificial Sequence
  Description of Artificial Sequence: Synthetic coding sequence
atgcagatcccccaggccccctggcctgtggtgtgggccgtgctgcagctgggctggaggcctggctggttcctggacagcccagaccggccctggaacccccccaccttctccccagccctgctggtggtgacagaaggagacaatgccaccttcacctgcagcttcagcaacaccagcgagagctttgtgctgaactggtacaggatgagccccagcaaccagacagacaagctggccgccttccctgaggacaggagccagcccggccaggactgccgcttccgggtgacccagctgcccaacggccgggacttccacatgtctgtggtgcgggccaggagaaatgacagcggcacctacctgtgtggggccatcagcctggcccccaaggcccagatcaaggagagcctgcgggcagagctgcgggtgacagaaagaagagctgaggtgcccacagcccaccccagccccagccccaggcctgctggccagttccagaccctggtggtgggcgtggtgggcggcctgctgggcagcctggtgctgctggtgtgggtgctggccgtcatctgcagcagagctgcccggggcaccatcggggccaggagaacaggccagcccctgaaggaggaccccagcgctgtgcctgtgttttctgtggactatggagagctggacttccagtggagggagaagaccccagagccccctgtgccctgtgtgcctgagcagacagaatatgccaccatcgtgttccccagcggcatgggcaccagcagccctgcccggcggggcagcgcagatggccccaggtctgcccagcccctgcggccagaagatggccactgctcctggcccctgtag

SEQ ID NO: 165313 - DNA, 540 bp, Artificial Sequence
  Description of Artificial Sequence: Synthetic coding sequence
atgcagatcccccaggccccctggcctgtggtgtgggccgtgctgcagctgggctggaggcctggctggttcctggacagcccagaccggccctggaacccccccaccttctccccagccctgctggtggtgacagaaggagacaatgccaccttcacctgcagcttcagcaacaccagcgagagctttgtgctgaactggtacaggatgagccccagcaaccagacagacaagctggccgccttccctgaggacaggagccagcccggccaggactgccgcttccgggtgacccagctgcccaacggccgggacttccacatgtctgtggtgcgggccaggagaaatgacagcggcacctacctgtgtggggccatcagcctggcccccaaggcccagatcaaggagagcctgcgggcagagctgcgggtgacaggcaccatcggggccaggagaacaggccagcccctgaaggaggaccccagcgctgtgcctgtgttttctgtggactatggagagctggacttccagtggaggtag

SEQ ID NO: 165314 - DNA, 639 bp, Artificial Sequence
  Description of Artificial Sequence: Synthetic coding sequence
atgaggatgaccatggaggagatgaagaatgaggccgagaccacctccatggtgtccatgcccctgtatgctgtgatgtaccctgtgttcaatgagctggagcgggtgaacctgtctgctgcccagaccctgcgggccgccttcatcaaggccgagaaggagaaccctggcctgacccaggacatcatcatgaagatcctggagaagaagtctgtggaggtgaacttcacagagagcctgctgaggatggctgctgatgatgtggaggagtacatgattgaaagacctgagcctgagttccaggacctgaatgagaaggcccgggccctgaagcagatcctgagcaagatcccagatgagatcaatgacagagtgcgcttcctgcagaccatcaaggacatcgccagcgccatcaaggagctgctggacacagtgaacaacgtgttcaagaagtaccagtaccagaacagaagagccctggagcaccagaagaaggagtttgtgaagtacagcaagagcttcagtgacaccctgaagacctacttcaaggatggcaaggccatcaacgtgtttgtgtctgccaacagactcatccaccagaccaacctgatcctgcagaccttcaagacagtggcctag

SEQ ID NO: 165315 - DNA, 639 bp, Artificial Sequence; identical to SEQ ID NO: 165314
  Description of Artificial Sequence: Synthetic coding sequence

SEQ ID NO: 165316 - DNA, 441 bp, Artificial Sequence
  Description of Artificial Sequence: Synthetic coding sequence
atgaggatgaccatggaggagatgaagaatgaggccgagaccacctccatggtgtccatgcccctgtatgctgtgatgtaccctgtgttcaatgagctggagcgggtgaacctgtctgctgcccagaccctgcgggccgccttcatcaaggccgagaaggagaaccctggcctgacccaggacatcatcatgaagatcctggagaagaagtctgtggaggtgaacttcacagagagcctgctgaggatggctgctgatgatgtggaggagtacatgattgaaagacctgagcctgagttccaggacctgaatgagaaggcccgggccctgaagcagatcctgagcaagatcccagatgagatcaatgacagagtgcgcttcctgcagaccatcaaggacatcgccagcgccatcaaggagctgctggacacagtgaactag

SEQ ID NO: 165317 - DNA, 240 bp, Artificial Sequence
  Description of Artificial Sequence: Synthetic coding sequence
atgaggatgaccatggaggagatgaagaatgaggccgagaccacctccatggtgtccatgcccctgtatgctgtgatgtaccctgtgttcaatgagctggagcgggtgaacctgtctgctgcccagaccctgcgggccgccttcatcaaggccgagaaggagaaccctggcctgacccaggacatcatcatgaagatcctggagaagaagtctgtggaggtgaacttcacagagagctag

SEQ ID NO: 165318 - DNA, 639 bp, Artificial Sequence; identical to SEQ ID NO: 165314
  Description of Artificial Sequence: Synthetic coding sequence

SEQ ID NO: 165319 - DNA, 639 bp, Artificial Sequence; identical to SEQ ID NO: 165314
  Description of Artificial Sequence: Synthetic coding sequence

SEQ ID NO: 165320 - DNA, 609 bp, Artificial Sequence
  Description of Artificial Sequence: Synthetic coding sequence
atgaggatgaccatggaggagatgaagaatgaggccgagaccacctccatggtgtccatgcccctgtatgctgtgatgtaccctgtgttcaatgagctggagcgggtgaacctgtctgctgcccagaccctgcgggccgccttcatcaaggccgagaaggagaaccctggcctgacccaggacatcatcatgaagatcctggagaagaagtctgtggaggtgaacttcacagagagcctgctgaggatggctgctgatgatgtggaggagtacatgattgaaagacctgagcctgagttccaggacctgaatgagaaggcccgggccctgaagcagatcctgagcaagatcccagatgagatcaatgacagagtgcgcttcctgcagaccatcaaggacatcgccagcgccatcaaggagctgctggacacagtgaacaacgtgttcaagaagtaccagtaccagaacagaagagccctggagcaccagaagaaggagtttgtgaagtacagcaagagcttcagtgacaccctgaagacctacttcaaggatggcaaggccatcaacgtgtttgtgtctgccaacagactcatccaccagaccaactag

SEQ ID NO: 165321 - DNA, 561 bp, Artificial Sequence
  Description of Artificial Sequence: Synthetic coding sequence
atgaggatgaccatggaggagatgaagaatgaggccgagaccacctccatggtgtccatgcccctgtatgctgtgatgtaccctgtgttcaatgagctggagcgggtgaacctgtctgctgcccagaccctgcgggccgccttcatcaaggccgagaaggagaaccctggcctgacccaggacatcatcatgaagatcctggagaagaagtctgtggaggtgaacttcacagagagcctgctgaggatggctgctgatgatgtggaggagtacatgattgaaagacctgagcctgagttccaggacctgaatgagaaggcccgggccctgaagcagatcctgagcaagatcccagatgagatcaatgacagagtgcgcttcctgcagaccatcaaggacatcgccagcgccatcaaggagctgctggacacagtgaacaacgtgttcaagaagtaccagtaccagaacagaagagccctggagcaccagaagaaggagtttgtgaagtacagcaagagcttcagtgacaccctgaagacctacttcaaggatggcaagtag

SEQ ID NO: 165322 - DNA, 405 bp, Artificial Sequence
  Description of Artificial Sequence: Synthetic coding sequence
atgaggatgaccatggaggagatgaagaatgaggccgagaccacctccatggtgtccatgcccctgtatgctgtgatgtaccctgtgttcaatgagctggagcgggtgaacctgtctgctgcccagaccctgcgggccgccttcatcaaggccgagaaggagaaccctggcctgacccaggacatcatcatgaagatcctggagaagaagtctgtggaggtgaacttcacagagagcctgctgaggatggctgctgatgatgtggaggagtacatgattgaaagacctgagcctgagttccaggacctgaatgagaaggcccgggccctgaagcagatcctgagcaagatcccagatgagatcaatgacagagtgcgcttcctgcagaccatcaaggacatctag

SEQ ID NO: 165323 - DNA, 639 bp, Artificial Sequence; identical to SEQ ID NO: 165314
  Description of Artificial Sequence: Synthetic coding sequence

SEQ ID NO: 165324 - DNA, 5616 bp, Artificial Sequence
  Description of Artificial Sequence: Synthetic coding sequence
atggccaacctggaggagagcttcccccggggcggcaccaggaagatccacaagccagagaaggccttccagcagagcgtggagcaggacaacctgtttgacatcagcacagaggagggcagcaccaagaggaagaagagccagaagggccctgccaagaccaagaagctgaagattgagaagcgggagagcagcaagagcgcccgggagaagtttgagatcctgtctgtggagagcctgtgtgagggcatgaggatcctgggctgtgtgaaggaggtgaatgagctggagctggtgatcagcctgcccaacggcctgcagggctttgtgcaggtgacagagatctgtgatgcctacaccaagaagctgaatgagcaggtgacccaggagcagcccctgaaggacctgctgcacctgcctgagctgttcagccctggcatgctggtgcgctgtgtggtgagcagcctgggcatcacagaccggggcaagaagtctgtgaagctgagcctgaaccccaagaatgtgaacagagtgctgtctgctgaggccctgaagccaggcatgctgctgactggaacagtgagcagcctggaggaccacggctacctggtggacatcggcgtggatggcacccgggccttcctgcccctgctgaaggcccaggagtacatccggcagaagaacaagggggccaagctgaaggtgggccagtacctgaactgcatcgtggagaaggtgaagggaaatggaggagtggtgtccctgtctgtgggccacagcgaggtgtccacagccatcgccacagagcagcagagctggaacctgaacaacctgctgcccggcctggtggtgaaggcccaggtgcagaaggtgacccccttcggcctgaccctgaacttcctgaccttcttcaccggggtggtggacttcatgcacctggaccccaagaaggccggcacctacttcagcaaccaggccgtgcgggcctgcatcctgtgtgtgcaccccaggaccagggtggtgcacctgagcctgcggcccatcttcctgcagcccggccggcccctgacccggctgagctgccagaacctgggcgctgtgctggatgatgtgcctgtgcagggcttcttcaagaaggccggggccaccttccggctgaaggatggagtgctggcctatgcccggctgagccacctgagtgacagcaagaatgtgttcaaccctgaggccttcaagccaggcaacacccacaagtgccgcatcatcgactacagccagatggatgagctggccctgctgagcctgcggaccagcatcatcgaggcccagtacctgcgctaccatgacatcgagcccggggctgtggtgaagggcaccgtgctgaccatcaagagctatggcatgctggtgaaggtgggggagcagatgaggggcctggtgccccccatgcacctggccgacatcctgatgaagaaccctgagaagaagtaccacatcggagatgaggtgaagtgccgggtgctgctgtgtgaccctgaggccaagaagctgatgatgaccctgaagaagaccctcatcgagagcaagctgcctgtgatcacctgctacgcagatgccaagccaggcctgcagacccacggcttcatcatccgggtgaaggactatggctgcatcgtgaagttctacaacaacgtgcagggcctggtgcccaagcatgagctgagcacagagtacatcccagaccctgagagggtcttctacacaggccaggtggtgaaggtggtggtgctgaactgtgagcccagcaaggagaggatgctgctgtccttcaagctgagcagtgaccctgagcccaagaaggagcctgctggccacagccagaagaagggcaaggccatcaacatcggccagctggtggatgtgaaggtgctggagaagaccaaggatggcctggaggtggccgtgctgccccacaacatccgggccttcctgcccaccagccacctgagtgaccacgtggccaacggccccctgctgcaccactggctgcaggccggggacatcctgcaccgggtgctgtgcctgagccagagcgagggccgggtgctgctgtgcaggaagccagccctggtgtccacagtggagggcggccaggaccccaagaacttcagcgagatccaccctggcatgctgctgattggatttgtgaagagcatcaaggactatggagtcttcatccagttccccagcggcctgagcggcctggcccccaaggccatcatgtctgacaagtttgtgaccagcaccagtgaccactttgtggagggccagacagtggccgccaaggtgaccaacgtggatgaggagaagcagaggatgctgctgagcctgcggctgagtgactgtggcctgggggacctggccatcaccagcctgctgctgctgaaccagtgcctggaggagctgcagggcgtgcgcagcctgatgagcaacagagacagcgtgctgatccagaccctggccgagatgaccccaggcatgttcctggacctggtggtgcaggaggtgctggaggatggctctgtggtgttttctgggggccctgtgcctgacctggtgctgaaggccagccgctaccaccgggccggccaggaggtggagagcggccagaagaagaaggtggtgatcctgaatgtggacctgctgaagctggaggtgcacgtgtccctgcaccaggacctggtgaacaggaaggccaggaagctgaggaagggcagcgagcaccaggccatcgtgcagcacctggagaagagctttgccatcgccagcctggtggagaccggccacctggccgccttcagcctgaccagccacctgaatgacaccttccgctttgattctgagaagctgcaggtgggccagggcgtgtccctgaccctgaagaccacagagcccggggtgacaggcctgctgctggccgtggagggccctgctgccaagaggaccatgaggcccacccagaaggacagcgagaccgtggatgaagatgaggaggtggaccctgccctgactgtgggcaccatcaagaagcacaccctgagcattggagacatggtgacaggcaccgtgaagagcatcaagcccacccacgtggtggtgaccctggaggatggcatcatcggctgcatccacgccagccacatcctggatgatgtgcctgagggcaccagccccaccaccaagctgaaggtgggcaagacagtgacagcccgggtgattggaggccgggacatgaagaccttcaagtacctgcccatcagccaccccaggtttgtgaggaccatccctgagctgtctgtgcggcccagcgagctggaggatggccacacagccctgaacacccacagcgtgagccccatggagaagatcaagcagtaccaggccggccagacagtgacctgcttcctgaagaagtacaacgtggtgaagaagtggctggaggtggagatcgccccagacatccggggccgcatccccctgctgctgaccagcctgtccttcaaggtgctgaagcacccagacaagaagttccgggtgggccaggccctgcgggccaccgtggtgggccctgacagcagcaagaccctgctgtgcctgagcctgaccggcccccacaagctggaggagggggaggtggccatgggccgggtggtgaaggtgaccccaaatgaaggcctgactgtgtccttcccctttgggaagattggaacagtgtccatcttccacatgtctgacagctacagcgagacccccctggaggactttgtgccccagaaggtggtgcgctgctacatcctgagcacagctgacaacgtgctgaccctgagcctgcggagcagcaggaccaaccctgagaccaagagcaaggtggaggaccctgagatcaacagcatccaggacatcaaggagggccagctgctgcggggctacgtgggcagcatccagccccatggagtcttcttccggctgggccccagcgtggtgggcctggcccgctacagccacgtgtcccagcacagccccagcaagaaggccctgtacaacaagcacctgcctgagggcaagctgctgacagcccgggtgctgcggctgaaccaccagaagaacctggtggagctgtccttcctgcccggggacaccgggaagccagatgtgctgagcgccagcctggagggccagctgaccaagcaggaggagaggaagacagaggccgaggagcgggaccagaagggggagaagaagaaccagaagagaaatgagaagaagaaccagaagggccaggaggaggtggagatgcccagcaaggagaagcagcagccccagaagccccaggcccagaagagaggaggccgggagtgccgggagagcggcagcgagcaggagcgggtgtccaagaagcccaagaaggccggcctgtctgaagaagatgacagcctggtggatgtgtactaccgggagggcaaggaggaggccgaggagaccaacgtgctgcccaaggagaagcagaccaagccagctgaggccccccggctgcagctgagcagcggctttgcctggaatgtgggcctggacagcctgaccccagccctgccccccctggccgagagcagtgacagtgaagaagatgagaagccccaccaggccaccatcaagaagagcaagaaggagcgggagctggagaagcagaaggccgagaaggagctgagcagaattgaggaggccctgatggaccccggccggcagcctgagagcgcagatgactttgaccggctggtgctgagcagccccaacagcagcatcctgtggctgcagtacatggccttccacctgcaggccacagaaattgagaaggcccgggctgtggccgagcgggccctgaagaccatctccttccgggaggagcaggagaagctgaatgtgtgggtggccctgctgaacctggagaacatgtatggcagccaggagagcctgaccaaggtgtttgaaagagctgtgcagtacaatgagcccctgaaggtgttcctgcacctggccgacatctatgccaagtctgagaagttccaggaggccggggagctgtacaacaggatgctgaagcgcttccggcaggagaaggctgtgtggatcaagtatggagccttcctgctgcggcgcagccaggccgccgccagccaccgggtgctgcagagggccctggagtgcctgcccagcaaggagcacgtggatgtgattgccaagtttgcccagctggagttccagctgggagatgctgagcgggccaaggccatctttgagaacaccctgagcacctaccccaagaggacagatgtgtggagcgtgtacatcgacatgaccatcaagcacggcagccagaaggatgtgcgggacatctttgagagggtcatccacctgagcctggcccccaagaggatgaagttcttcttcaagcgctacctggactatgagaagcagcacggcacagagaaggatgtgcaggccgtgaaggccaaggccctggagtatgtggaggccaagagctctgtgctggaggactag

SEQ ID NO: 165325 - DNA, 3705 bp, Artificial Sequence
  Description of Artificial Sequence: Synthetic coding sequence
atggccaacctggaggagagcttcccccggggcggcaccaggaagatccacaagccagagaaggccttccagcagagcgtggagcaggacaacctgtttgacatcagcacagaggagggcagcaccaagaggaagaagagccagaagggccctgccaagaccaagaagctgaagattgagaagcgggagagcagcaagagcgcccgggagaagtttgagatcctgtctgtggagagcctgtgtgagggcatgaggatcctgggctgtgtgaaggaggtgaatgagctggagctggtgatcagcctgcccaacggcctgcagggctttgtgcaggtgacagagatctgtgatgcctacaccaagaagctgaatgagcaggtgacccaggagcagcccctgaaggacctgctgcacctgcctgagctgttcagccctggcatgctggtgcgctgtgtggtgagcagcctgggcatcacagaccggggcaagaagtctgtgaagctgagcctgaaccccaagaatgtgaacagagtgctgtctgctgaggccctgaagccaggcatgctgctgactggaacagtgagcagcctggaggaccacggctacctggtggacatcggcgtggatggcacccgggccttcctgcccctgctgaaggcccaggagtacatccggcagaagaacaagggggccaagctgaaggtgggccagtacctgaactgcatcgtggagaaggtgaagggaaatggaggagtggtgtccctgtctgtgggccacagcgaggtgtccacagccatcgccacagagcagcagagctggaacctgaacaacctgctgcccggcctggtggtgaaggcccaggtgcagaaggtgacccccttcggcctgaccctgaacttcctgaccttcttcaccggggtggtggacttcatgcacctggaccccaagaaggccggcacctacttcagcaaccaggccgtgcgggcctgcatcctgtgtgtgcaccccaggaccagggtggtgcacctgagcctgcggcccatcttcctgcagcccggccggcccctgacccggctgagctgccagaacctgggcgctgtgctggatgatgtgcctgtgcagggcttcttcaagaaggccggggccaccttccggctgaaggatggagtgctggcctatgcccggctgagccacctgagtgacagcaagaatgtgttcaaccctgaggccttcaagccaggcaacacccacaagtgccgcatcatcgactacagccagatggatgagctggccctgctgagcctgcggaccagcatcatcgaggcccagtacctgcgctaccatgacatcgagcccggggctgtggtgaagggcaccgtgctgaccatcaagagctatggcatgctggtgaaggtgggggagcagatgaggggcctggtgccccccatgcacctggccgacatcctgatgaagaaccctgagaagaagtaccacatcggagatgaggtgaagtgccgggtgctgctgtgtgaccctgaggccaagaagctgatgatgaccctgaagaagaccctcatcgagagcaagctgcctgtgatcacctgctacgcagatgccaagccaggcctgcagacccacggcttcatcatccgggtgaaggactatggctgcatcgtgaagttctacaacaacgtgcagggcctggtgcccaagcatgagctgagcacagagtacatcccagaccctgagagggtcttctacacaggccaggtggtgaaggtggtggtgctgaactgtgagcccagcaaggagaggatgctgctgtccttcaagctgagcagtgaccctgagcccaagaaggagcctgctggccacagccagaagaagggcaaggccatcaacatcggccagctggtggatgtgaaggtgctggagaagaccaaggatggcctggaggtggccgtgctgccccacaacatccgggccttcctgcccaccagccacctgagtgaccacgtggccaacggccccctgctgcaccactggctgcaggccggggacatcctgcaccgggtgctgtgcctgagccagagcgagggccgggtgctgctgtgcaggaagccagccctggtgtccacagtggagggcggccaggaccccaagaacttcagcgagatccaccctggcatgctgctgattggatttgtgaagagcatcaaggactatggagtcttcatccagttccccagcggcctgagcggcctggcccccaaggccatcatgtctgacaagtttgtgaccagcaccagtgaccactttgtggagggccagacagtggccgccaaggtgaccaacgtggatgaggagaagcagaggatgctgctgagcctgcggctgagtgactgtggcctgggggacctggccatcaccagcctgctgctgctgaaccagtgcctggaggagctgcagggcgtgcgcagcctgatgagcaacagagacagcgtgctgatccagaccctggccgagatgaccccaggcatgttcctggacctggtggtgcaggaggtgctggaggatggctctgtggtgttttctgggggccctgtgcctgacctggtgctgaaggccagccgctaccaccgggccggccaggaggtggagagcggccagaagaagaaggtggtgatcctgaatgtggacctgctgaagctggaggtgcacgtgtccctgcaccaggacctggtgaacaggaaggccaggaagctgaggaagggcagcgagcaccaggccatcgtgcagcacctggagaagagctttgccatcgccagcctggtggagaccggccacctggccgccttcagcctgaccagccacctgaatgacaccttccgctttgattctgagaagctgcaggtgggccagggcgtgtccctgaccctgaagaccacagagcccggggtgacaggcctgctgctggccgtggagggccctgctgccaagaggaccatgaggcccacccagaaggacagcgagaccgtggatgaagatgaggaggtggaccctgccctgactgtgggcaccatcaagaagcacaccctgagcattggagacatggtgacaggcaccgtgaagagcatcaagcccacccacgtggtggtgaccctggaggatggcatcatcggctgcatccacgccagccacatcctggatgatgtgcctgagggcaccagccccaccaccaagctgaaggtgggcaagacagtgacagcccgggtgattggaggccgggacatgaagaccttcaagtacctgcccatcagccaccccaggtttgtgaggaccatccctgagctgtctgtgcggcccagcgagctggaggatggccacacagccctgaacacccacagcgtgagccccatggagaagatcaagcagtaccaggccggcctgtctgaagaagatgacagcctggtggatgtgtactaccgggagggcaaggaggaggccgaggagaccaacgtgctgcccaaggagaagcagaccaagccagctgaggccccccggctgcagctgagcagcggctttgcctggaatgtgggcctggacagcctgaccccagccctgccccccctggccgagagcagtgacagtgaagaagatgagaagccccaccaggccacccagatcaagaagagcaagaagtag

SEQ ID NO: 165326 - DNA, 936 bp, Artificial Sequence
  Description of Artificial Sequence: Synthetic coding sequence
atggctgctgctggggcccggcctgtggagctgggctttgctgagagcgccccagcctggaggctgcggtctgagcagttccccagcaaggtgtatgcccccctgcccggccgcccagatgccttccaccgctgcatcttcctgttctgctgccgggagcagccctgctgtgccggcctgcgggtcttcaggaaccagctgcccaggaagaatgacttctacagctatgagcccccatctgaaaatcctcctcctgagactggagagagcgtgtgcctgcagctgaagagcggggcccacctgtgccgggtgtgtggctgcctgggccccaagacctgcagccgctgccacaaggcctactactgcagcaaggagcaccagaccctggactggaggctgggccacaagcaggcctgtgcccagcctgaccacctggaccacatcatcccagaccacaacttcctgtttcctgagtttgaaattgtgattgaaacagaagatgagatcatgcctgaggtggtggagaaggaggactacagcgagatcatcggctccatgggagaggccctggaggaggagctggacagcatggccaagcatgagagccgggaggacaagatcttccagaagttcaagacccagatcgccctggagcctgagcagatcctgcgctatggccggggcatcgcccccatctggatctctggagagaacatcccccaggagaaggacatcccagactgcccctgtggggccaagaggatcctggagttccaggtgatgccccagctgctgaactacctgaaggctgaccggctgggcaagagcattgactggggcatcctggccgtgttcacctgtgccgagagctgcagcctgggcaccggctacacagaggagtttgtgtggaagcaggatgtgacagacaccccctag

SEQ ID NO: 165327 - DNA, 687 bp, Artificial Sequence
  Description of Artificial Sequence: Synthetic coding sequence
atggctgctgctggggcccggcctgtggagctgggctttgctgagagcgccccagcctggaggctgcggtctgagcagttccccagcaaggtgggcggccgcccagcctggctgggcgctgctggcctgcccggcccccaggccctggcctgtgagctgtgtggccggcccctgtccttcctgctgcaggtgtatgcccccctgcccggccgcccagatgccttccaccgctgcatcttcctgttctgctgccgggagcagccctgctgtgccggcctgcgggtcttcaggaaccagctgcccaggaagaatgacttctacagctatgagcccccatctgagaaccccccacctgagaccggggagagcgtgtgcctgcagctgaagagcggggcccacctgtgccgggtgtgtggctgcctgggccccaagacctgcagccgctgccacaaggcctactactgcagcaaggagcaccagaccctggactggaggctgggccacaagcaggcctgtgcccagcctgaccacctggaccacatcatcccagaccacaacttcctgtttcctgagtttgagatcgtcatcgagacagaagatgagatcatgcctgaggtggtggagaaggaggactacagcgagatcatcggctccatgggcaagcagttccaggacttcatccactag

SEQ ID NO: 165328 - DNA, 1035 bp, Artificial Sequence
  Description of Artificial Sequence: Synthetic coding sequence
atggctgctgctggggcccggcctgtggagctgggctttgctgagagcgccccagcctggaggctgcggtctgagcagttccccagcaaggtgggcggccgcccagcctggctgggcgctgctggcctgcccggcccccaggccctggcctgtgagctgtgtggccggcccctgtccttcctgctgcaggtgtatgcccccctgcccggccgcccagatgccttccaccgctgcatcttcctgttctgctgccgggagcagccctgctgtgccggcctgcgggtcttcaggaaccagctgcccaggaagaatgacttctacagctatgagcccccatctgagaaccccccacctgagaccggggagagcgtgtgcctgcagctgaagagcggggcccacctgtgccgggtgtgtggctgcctgggccccaagacctgcagccgctgccacaaggcctactactgcagcaaggagcaccagaccctggactggaggctgggccacaagcaggcctgtgcccagcctgaccacctggaccacatcatcccagaccacaacttcctgtttcctgagtttgagatcgtcatcgagacagaagatgagatcatgcctgaggtggtggagaaggaggactacagcgagatcatcggctccatgggagaggccctggaggaggagctggacagcatggccaagcatgagagccgggaggacaagatcttccagaagttcaagacccagatcgccctggagcctgagcagatcctgcgctatggccggggcatcgcccccatctggatcagcggggagaacatcccccaggagaaggacatcccagactgcccctgtggggccaagaggatcctggagttccaggtgatgccccagctgctgaactacctgaaggctgaccggctgggcaagagcattgactggggcatcctggccgtgttcacctgtgccgagagctgcagcctgggcaccggctacacagaggagtttgtgtggaagcaggatgtgacagacaccccctag

SEQ ID NO: 165329 - DNA, 588 bp, Artificial Sequence
  Description of Artificial Sequence: Synthetic coding sequence
atggctgctgctggggcccggcctgtggagctgggctttgctgagagcgccccagcctggaggctgcggtctgagcagttccccagcaaggtgtatgcccccctgcccggccgcccagatgccttccaccgctgcatcttcctgttctgctgccgggagcagccctgctgtgccggcctgcgggtcttcaggaaccagctgcccaggaagaatgacttctacagctatgagcccccatctgaaaatcctcctcctgagactggagagagcgtgtgcctgcagctgaagagcggggcccacctgtgccgggtgtgtggctgcctgggccccaagacctgcagccgctgccacaaggcctactactgcagcaaggagcaccagaccctggactggaggctgggccacaagcaggcctgtgcccagcctgaccacctggaccacatcatcccagaccacaacttcctgtttcctgagtttgaaattgtgattgaaacagaagatgagatcatgcctgaggtggtggagaaggaggactacagcgagatcatcggctccatgggcaagcagttccaggacttcatccactag

SEQ ID NO: 165330 - DNA, 567 bp, Artificial Sequence
  Description of Artificial Sequence: Synthetic coding sequence
atggctgctgctggggcccggcctgtggagctgggctttgctgagagcgccccagcctggaggctgcggtctgagcagttccccagcaaggtgtatgcccccctgcccggccgcccagatgccttccaccgctgcatcttcctgttctgctgccgggagcagccctgctgtgccggcctgcgggtcttcaggaaccagctgcccaggaagaatgacttctacagctatgagcccccatctgaaaatcctcctcctgagactggagagagcgtgtgcctgcagctgaagagcggggcccacctgtgccgggtgtgtggctgcctgggccccaagacctgcagccgctgccacaaggcctactactgcagcaaggagcaccagaccctggactggaggctgggccacaagcaggcctgtgcccagcctgaccacctggaccacatcatcccagaccacaacttcctgtttcctgagtttgaaattgtgattgaaacagaagatgagatcatgcctgaggtggtggagaaggaggactacagcgagatcatcggctccatgggcatctag

SEQ ID NO: 165331 - DNA, 2607 bp, Artificial Sequence
  Description of Artificial Sequence: Synthetic coding sequence
atggccaccttcatctctgtgcagctgaagaagaccagcgaggtggacctggccaagcccctggtgaagttcatccagcagacctaccccagcggcggggaggagcaggcccagtactgcagagctgctgaggagctgagcaagctgcggcgggctgctgtgggccggcccctggacaagcatgaaggagccctggagaccctgctgcgctactatgaccagatctgcagcattgagcccaagttccccttcagcgagaaccagatctgcctgaccttcacctggaaggatgcctttgataaaggcagcctgtttggaggctctgtgaagctggccctggccagcctgggctatgagaagagctgtgtgctcttcaactgtgccgccctggccagccagattgctgctgagcagaacctggacaatgatgagggcctgaagattgctgccaagcactaccagtttgccagcggggccttcctgcacatcaaggagaccgtgctgagcgccctgagccgggagcccaccgtggacatcagcccagacacagtgggcaccctgagcctcatcatgctggcccaggcccaggaggtgttcttcctgaaggccacccgggacaagatgaaggatgccatcatcgccaagctggccaaccaggccgctgactactttggagatgccttcaagcagtgccagtacaaggacaccctgcccaaggaggtgtttcctgtgctggccgccaagcactgcatcatgcaggccaatgctgagtaccaccagagcatcctggccaagcagcagaagaagtttggagaggagatcgcccggctgcagcacgccgctgagctgatcaagacagtggccagccgctatgatgaatatgtgaatgtgaaggacttcagtgacaagatcaacagagccctggccgccgccaagaaggacaatgacttcatctaccatgacagagtgcctgacctgaaggacctggaccccatcggcaaggccaccctggtgaagagcacccctgtgaatgtgcccatcagccagaagttcacagacctgtttgagaagatggtgcctgtgtctgtgcagcagagcctggccgcctacaaccagaggaaggctgacctggtgaacagaagcatcgcccagatgagggaggccaccaccctggccaatggagtgctggccagcctgaacctgcctgctgccattgaagatgtgtctggggacacagtgccccagagcatcctgaccaagagccgctctgtgattgagcagggcggcatccagacagtggaccagctgatcaaggagctgcctgagctgctgcagaggaaccgggagatcctggatgagagcctgcggctgctggatgaggaggaggccacagacaatgacctgcgggccaagttcaaggagcgctggcagaggacccccagcaatgagctgtacaagcccctgcgggcagagggcaccaacttcagaacagtgctggacaaggctgtgcaggctgatggccaggtgaaggagtgctaccagagccaccgggacaccatcgtgctgctgtgcaagccagagcctgagctgaatgctgccatccccagcgccaacccagccaagaccatgcagggcagcgaggtggtgaatgtgctgaagagcctgctgagcaacctggatgaggtgaagaaggagcgggagggcctggagaatgacctgaagtctgtgaactttgacatgaccagcaagttcctgacagccctggcccaggatggagtcatcaatgaggaggccctgtctgtgacagagctggacagagtgtatggaggcctgaccaccaaggtgcaggagagcctgaagaagcaggagggcctgctgaagaacatccaggtgagccaccaggagttcagcaagatgaagcagagcaacaatgaggccaacctgcgggaggaggtgctgaagaacctggccacagcctatgacaactttgtggagctggtggccaacctgaaggagggcaccaagttctacaatgagctgacagagatcctggtgcgcttccagaacaagtgcagcgacatcgtgtttgccaggaagacagaaagagatgagctgctgaaggacctgcagcagagcatcgcccgggagcccagcgcccccagcatccccaccccagcctaccagagcagccctgctgggggccacgcccccaccccacccaccccagcccccaggaccatgccacccaccaagccccagcccccagcccggcccccacctcctgtgctgcctgccaacagagcccccagcgccacagcccccagccctgtgggcgccggcacagctgccccagcccccagccagaccccaggcagcgcccccccaccccaggcccagggccccccctaccccacctacccaggctacccaggctactgccagatgcccatgcccatgggctacaacccctatgcctacggccagtacaacatgccctacccacctgtgtaccaccagagccctggccaggccccctacccaggcccccagcagcccagctaccccttcccccagcccccccagcagagctactacccccagcagtag

SEQ ID NO: 165332 - DNA, 2622 bp, Artificial Sequence
  Description of Artificial Sequence: Synthetic coding sequence
atggccaccttcatctctgtgcagctgaagaagaccagcgaggtggacctggccaagcccctggtgaagttcatccagcagacctaccccagcggcggggaggagcaggcccagtactgcagagctgctgaggagctgagcaagctgcggcgggctgctgtgggccggcccctggacaagcatgaaggagccctggagaccctgctgcgctactatgaccagatctgcagcattgagcccaagttccccttcagcgagaaccagatctgcctgaccttcacctggaaggatgcctttgataaaggcagcctgtttggaggctctgtgaagctggccctggccagcctgggctatgagaagagctgtgtgctcttcaactgtgccgccctggccagccagattgctgctgagcagaacctggacaatgatgagggcctgaagattgctgccaagcactaccagtttgccagcggggccttcctgcacatcaaggagaccgtgctgagcgccctgagccgggagcccaccgtggacatcagcccagacacagtgggcaccctgagcctcatcatgctggcccaggcccaggaggtgttcttcctgaaggccacccgggacaagatgaaggatgccatcatcgccaagctggccaaccaggccgctgactactttggagatgccttcaagcagtgccagtacaaggacaccctgcccaagtacttctacttccaggaggtgtttcctgtgctggccgccaagcactgcatcatgcaggccaatgctgagtaccaccagagcatcctggccaagcagcagaagaagtttggagaggagatcgcccggctgcagcacgccgctgagctgatcaagacagtggccagccgctatgatgaatatgtgaatgtgaaggacttcagtgacaagatcaacagagccctggccgccgccaagaaggacaatgacttcatctaccatgacagagtgcctgacctgaaggacctggaccccatcggcaaggccaccctggtgaagagcacccctgtgaatgtgcccatcagccagaagttcacagacctgtttgagaagatggtgcctgtgtctgtgcagcagagcctggccgcctacaaccagaggaaggctgacctggtgaacagaagcatcgcccagatgagggaggccaccaccctggccaacggggtgctggccagcctgaacctgcctgctgccattgaagatgtgtctggggacacagtgccccagagcatcctgaccaagagccgcagcgtcatcgagcagggcggcatccagacagtggaccagctgatcaaggagctgcctgagctgctgcagaggaaccgggagatcctggatgagagcctgcggctgctggatgaggaggaggccacagacaatgacctgcgggccaagttcaaggagcgctggcagaggacccccagcaatgagctgtacaagcccctgcgggcagagggcaccaacttcagaacagtgctggacaaggctgtgcaggctgatggccaggtgaaggagtgctaccagagccaccgggacaccatcgtgctgctgtgcaagccagagcctgagctgaatgctgccatccccagcgccaacccagccaagaccatgcagggcagcgaggtggtgaatgtgctgaagagcctgctgagcaacctggatgaggtgaagaaggagcgggagggcctggagaatgacctgaagtctgtgaactttgacatgaccagcaagttcctgacagccctggcccaggatggagtcatcaatgaggaggccctgtctgtgacagagctggacagagtgtatggaggcctgaccaccaaggtgcaggagagcctgaagaagcaggagggcctgctgaagaacatccaggtgagccaccaggagttcagcaagatgaagcagagcaacaatgaggccaacctgcgggaggaggtgctgaagaacctggccacagcctatgacaactttgtggagctggtggccaacctgaaggagggcaccaagttctacaatgagctgacagagatcctggtgcgcttccagaacaagtgcagcgacatcgtgtttgccaggaagacagaaagagatgagctgctgaaggacctgcagcagagcatcgcccgggagcccagcgcccccagcatccccaccccagcctaccagagcagccctgctgggggccacgcccccaccccacccaccccagcccccaggaccatgccacccaccaagccccagcccccagcccggcccccacctcctgtgctgcctgccaacagagcccccagcgccacagcccccagccctgtgggcgccggcacagctgccccagcccccagccagaccccaggcagcgcccccccaccccaggcccagggccccccctaccccacctacccaggctacccaggctactgccagatgcccatgcccatgggctacaacccctatgcctacggccagtacaacatgccctacccacctgtgtaccaccagagccctggccaggccccctacccaggcccccagcagcccagctaccccttcccccagcccccccagcagagctactacccccagcagtag

SEQ ID NO: 165333 - DNA, 1458 bp, Artificial Sequence
  Description of Artificial Sequence: Synthetic coding sequence
atggccctgccccccttcttcggccagggccggcccggccccccaccaccccagcccccacctccagcccccttcggctgccccccaccacccctgcccagccctgccttccccccacccctgccccagaggcctggccccttccctggggccagcgcccccttcctgcagccccccctggccctgcagccccgggccagcgctgaggccagcagaggaggcggcggggccggggccttctaccctgtgcccccaccacccctgcccccacctccaccccagtgccggcccttccctggaacagatgctggggagcggcccaggcctcctcctcctggccctggccccccctggagcccccgctggccagaggcccctcctcctccagcagatgtgctgggagatgctgccctgcagaggctgcgggaccggcagtggctggaggccgtgtttggcaccccaagaagagctggctgccctgtgccccagaggacccatgctggccccagcctgggggaggtgcgggcccggctgctgcgggccctgcggctggtgcggcggctgcggggcctgagccaggccctgcgggaggccgaggctgatggagctgcctgggtgctgctgtacagccagacagcccccctgcgggcagagctggccgagcggctgcagcccctgacccaggccgcctacgtgggggaggcccggcggcggctggagcgggtgagaagaagaaggctgcggctgcgggagcgggcccgggagcgggaggccgagcgggaggccgaggccgcccgggctgtggagcgggagcaggagattgaccgctggagggtgaagtgtgtgcaggaggtggaggagaagaagcgggagcaggagctgaaggctgctgctgatggagtgctgtctgaggtgaggaagaagcaggccgacaccaagaggatggtggacatcctgcgggccctggagaagctgaggaagctgaggaaggaggccgccgccaggaagggcgtgtgccccccagccagcgcagatgagaccttcacccaccacctgcagaggctgaggaagctgatcaagaagaggtctgagctgtatgaggccgaggagcgggccctgcgggtgatgctggagggggagcaggaggaggagaggaagcgggagctggagaagaagcagaggaaggagaaggagaagatcctgctgcagaagcgggagattgagagcaagctgtttggagaccctgatgagttccccctggcccacctgctggagcccttccggcagtactacctgcaggccgagcacagcctgcctgccctgatccagatcagacatgactgggaccagtacctggtgcccagcgaccaccccaagggcaactttgtgccccagggctgggtgctgccccccctgcccagcaatgacatctgggccacagctgtgaagctgcactag

SEQ ID NO: 165334 - DNA, 840 bp, Artificial Sequence
  Description of Artificial Sequence: Synthetic coding sequence
ctgatgaggagccacagcgacagctgccacttcagcaagcacctgcggcgggagcacggccctgccaccatcctgcggcccggcagcccccggcccccacctcctccttccttcagcctgcggcggctgcgggagcgggcccgggagcgggaggccgagcgggaggccgaggccgcccgggctgtggagcgggagcaggagattgaccgctggagggtgaagtgtgtgcaggaggtggaggagaagaagcgggagcaggagctgaaggctgctgctgatggagtgctgtctgaggtgaggaagaagcaggccgacaccaagaggatggtggacatcctgcgggccctggagaagctgaggaagctgaggaaggaggccgccgccaggaagggcgtgtgccccccagccagcgcagatgagaccttcacccaccacctgcagaggctgaggaagctgatcaagaagaggtctgagctgtatgaggccgaggagcgggccctgcgggtgatgctggagggggagcaggaggaggagaggaagcgggagctggagaagaagcagaggaaggagaaggagaagatcctgctgcagaagcgggagattgagagcaagctgtttggagaccctgatgagttccccctggcccacctgctggagcccttccggcagtactacctgcaggccgagcacagcctgcctgccctgatccagatcagacatgactgggaccagtacctggtgcccagcgaccaccccaagggcaactttgtgccccagggctgggtgctgccccccctgcccagcaatgacatctgggccacagctgtgaagctgcactag

SEQ ID NO: 165335 - DNA, 813 bp, Artificial Sequence
  Description of Artificial Sequence: Synthetic coding sequence
agccacagcgacagctgccacttcagcaagcacctgcggcgggagcacggccctgccaccatcctgcggcccggcagccccaggagaagaaggctgcggctgcgggagcgggcccgggagcgggaggccgagcgggaggccgaggccgcccgggctgtggagcgggagcaggagattgaccgctggagggtgaagtgtgtgcaggaggtggaggagaagaagcgggagcaggagctgaaggctgctgctgatggagtgctgtctgaggtgaggaagaagcaggccgacaccaagaggatggtggacatcctgcgggccctggagaagctgaggaagctgaggaaggaggccgccgccaggaaaggagtgtgccccccagccagcgcagatgagaccttcacccaccacctgcagaggctgaggaagctgatcaagaagaggtctgagctgtatgaagctgaggagcgggccctgcgggtgatgctggagggggagcaggaggaggagaggaagcgggagctggagaagaagcagaggaaggagaaggagaagatcctgctgcagaagcgggagattgagagcaagctgtttggagaccctgatgagttccccctggcccacctgctggagcccttccggcagtactacctgcaggccgagcacagcctgcctgccctgatccagatcagacatgactgggaccagtacctggtgcccagcgaccaccccaagggcaactttgtgccccagggctgggtgctgccccccctgcccagcaatgacatctgggccacagctgtgaagctgcactag

SEQ ID NO: 165336 - DNA, 165 bp, Artificial Sequence
  Description of Artificial Sequence: Synthetic coding sequence
atgtgcaccaccctcttcctgctgagcaccctggccatgctgtggaggagaagatttgccaacagagtgcagcctgagcccagtgatgtggatggagctgcccggggcagcagcctggatgctgacccccagagcagcggccgggagaaggagcccctgaagtag

SEQ ID NO: 165337 - DNA, 246 bp, Artificial Sequence
  Description of Artificial Sequence: Synthetic coding sequence
atgaccaggacagagagccctgccacctggatgggccagctgggcgctgctgcctggatgaggaccctgagcccccaggccgcccaggtgctggtgcggcccctggcccaggaggatgctgtgggcgctgctgctgctgcccggggccgcatgggcggcagcagcacccgggaggtgccccgggcccaccctgtgacaggctgcagcgctgagatcatcaacaagaagtgccagctggacctgtag

SEQ ID NO: 165338 - DNA, 819 bp, Artificial Sequence
  Description of Artificial Sequence: Synthetic coding sequence
atggccgccaaggtgtttgagagcatcggcaagtttggcctggccctggccgtggccggcggcgtggtgaacagcgccctgtacaacgtggatgctggccaccgggccgtcatctttgaccgcttccggggcgtgcaggacatcgtggtgggggagggcacccacttcctgatcccctgggtgcagaagcccatcatctttgactgccgcagccggcccagaaatgtgcctgtgatcaccggcagcaaggacctgcagaatgtgaacatcaccctgcgcatcctcttccggcctgtggccagccagctgccccgcatcttcaccagcatcggggaggactatgatgagcgggtgctgcccagcatcaccacagagatcctgaagtctgtggtggccaggtttgatgctggggagctgatcacccagcgggagctggtgtcccggcaggtgtctgatgacctgacagagcgggccgccaccttcggcctcatcctggatgatgtgtccctgacccacctgaccttcggcaaggagttcacagaggccgtggaggccaagcaggtggcccagcaggaggccgagcgggccaggtttgtggtggagaaggccgagcagcagaagaaggccgccatcatctctgctgagggggacagcaaggctgctgagctgattgccaacagcctggccacagctggagatggcctcatcgagctgaggaagctggaggccgcagaagatattgcctaccagctgagccgcagcaggaacatcacctacctgcctgctggccagagcgtgctgctgcagctgccccagtag

SEQ ID NO: 165339 - DNA, 741 bp, Artificial Sequence
  Description of Artificial Sequence: Synthetic coding sequence
atggccgccaaggtgtttgagagcatcggcaagtttggcctggccctggccgtggccggcggcgtggtgaacagcgccctgtacaacgtggatgctggccaccgggccgtcatctttgaccgcttccggggcgtgcaggacatcgtggtgggggagggcacccacttcctgatcccctgggtgcagaagcccatcatctttgactgccgcagccggcccagaaatgtgcctgtgatcaccggcagcaaggacctgcagaatgtgaacatcaccctgcgcatcctcttccggcctgtggccagccagctgccccgcatcttcaccagcatcggggaggactatgatgagcgggtgctgcccagcatcaccacagagatcctgaagtctgtggtggccaggtttgatgctggggagctgatcacccagcgggagctggtgtcccggcaggtgtctgatgacctgacagagcgggccgccaccttcggcctcatcctggatgatgtgtccctgacccacctgaccttcggcaaggagttcacagaggccgtggaggccaagcaggtggcccagcaggaggccgagcgggccaggtttgtggtggagaaggccgagcagcagaagaaggccgccatcatctctgctgagggggacagcaaggctgctgagctgattgccaacagcctggccacagctggagatggcctcatcgagctgaggaagctggaggccgcagaagattag

SEQ ID NO: 165340 - DNA, 375 bp, Artificial Sequence
  Description of Artificial Sequence: Synthetic coding sequence
atggccgccaaggtgtttgagagcatcggcaagtttggcctggccctggccgtggccggcggcgtggtgaacagcgccctgtacaacgtggatgctggccaccgggccgtcatctttgaccgcttccggggcgtgcaggacatcgtggtgggggagggcacccacttcctgatcccctgggtgcagaagcccatcatctttgactgccgcagccggcccagaaatgtgcctgtgatcaccggcagcaaggacctgcagaatgtgaacatcaccctgcgcatcctcttccggcctgtggccagccagctgccccgcatcttcaccagcatcggggaggactatgatgagcgggtgctgcccagcatcaccacctag

SEQ ID NO: 165341 - DNA, 606 bp, Artificial Sequence
  Description of Artificial Sequence: Synthetic coding sequence
atggccgccaaggtgtttgagagcatcggcaagtttggcctggccctggccgtggccggcggcgtggtgaacagcgccctgtacaacgtggatgctggccaccgggccgtcatctttgaccgcttccggggcgtgcaggacatcgtggtgggggagggcacccacttcctgatcccctgggtgcagaagcccatcatctttgactgccgcagccggcccagaaatgtgcctgtgatcaccggcagcaaggacctgcagaatgtgaacatcaccctgcgcatcctcttccggcctgtggccagccagctgccccgcatcttcaccagcatcggggaggactatgatgagcgggtgctgcccagcatcaccacagagatcctgaagtctgtggtggccaggtttgatgctggggagctgatcacccagcgggagctggtgtcccggcaggtgtctgatgacctgacagagcgggccgccaccttcggcctcatcctggatgatgtgtccctgacccacctgaccttcggcaaggagttcacagaggccgtggaggccaagcaggtggcccagcaggaggccgagcgggccaggtttgtggtggagtag

SEQ ID NO: 165342 - DNA, 645 bp, Artificial Sequence
  Description of Artificial Sequence: Synthetic coding sequence
atggccgccaaggtgtttgagagcatcggcaagtttggcctggccctggccgtggccggcggcgtggtgaacagcgccctgtacaacgtggatgctggccaccgggccgtcatctttgaccgcttccggggcgtgcaggacatcgtggtgggggagggcacccacttcctgatcccctgggtgcagaagcccatcatctttgactgccgcagccggcccagaaatgtgcctgtgatcaccggcagcaaggacctgcagaatgtgaacatcaccctgcgcatcctcttccggcctgtggccagccagctgccccgcatcttcaccagcatcggggaggactatgatgagcgggtgctgcccagcatcaccacagagatcctgaagtctgtggtggccaggtttgatgctggggagctgatcacccagcgggagctggtgtcccggcaggtgtctgatgacctgacagagcgggccgccaccttcggcctcatcctggatgatgtgtccctgacccacctgaccttcggcaaggagttcacagaggccgtggaggccaagcaggtggcccagcaggaggccgagcgggccaggtttgtggtggagaaggccgagcagcagaagaaggccgccatcatcagcgcctag

SEQ ID NO: 165343 - DNA, 468 bp, Artificial Sequence
  Description of Artificial Sequence: Synthetic coding sequence
atggccgccaaggtgtttgagagcatcggcaagtttggcctggccctggccgtggccggcggcgtggtgaacagcgccctgtacaacgtggatgctggccaccgggccgtcatctttgaccgcttccggggcgtgcaggacatcgtggtgggggagggcacccacttcctgatcccctgggtgcagaagcccatcatctttgactgccgcagccggcccagaaatgtgcctgtgatcaccggcagcaaggacctgcagaatgtgaacatcaccctgcgcatcctcttccggcctgtggccagccagctgccccgcatcttcaccagcatcggggaggactatgatgagcgggtgctgcccagcatcaccacagagatcctgaagtctgtggtggccaggtttgatgctggggagctgatcacctacctgcctgctggccagagcgtgctgctgcagctgccccagtag

SEQ ID NO: 165344 - DNA, 615 bp, Artificial Sequence
  Description of Artificial Sequence: Synthetic coding sequence
atggccgccaaggtgtttgagagcatcggcaagtttggcctggccctggccgtggccggcggcgtggtgaacagcgccctgtacaacgtggatgctggccaccgggccgtcatctttgaccgcttccggggcgtgcaggacatcgtggtgggggagggcacccacttcctgatcccctgggtgcagaagcccatcatctttgactgccgcagccggcccagaaatgtgcctgtgatcaccggcagcaaggacctgcagaatgtgaacatcaccctgcgcatcctcttccggcctgtggccagccagctgccccgcatcttcaccagcatcggggaggactatgatgagcgggtgctgcccagcatcaccacagagatcctgaagtctgtggtggccaggtttgatgctggggagctgatcacccagcgggagctggtgtcccggcaggtgtctgatgacctgacagagcgggccgccaccttcggcctcatcctggatgatgtgtccctgacccacctgaccttcggcaaggagttcacagaggccgtggaggccaagcaggtggcccagcaggaggccgagcgggccaggtttgtggtggagaaggtgtcctag

SEQ ID NO: 165345 - DNA, 900 bp, Artificial Sequence
  Description of Artificial Sequence: Synthetic coding sequence
atggcccagaacctgaaggacctggccggccgcctgcctgctggcccccggggcatgggcacagccctgaagctgctgctgggcgctggagctgtggcctacggcgtgcgggagagcgtcttcaccgtggagggcggccaccgggccatcttcttcaacagaattggaggagtgcagcaggacaccatcctggccgagggcctgcacttccgcatcccctggttccagtaccccatcatctatgacatccgggcccggcccaggaagatcagcagccccaccggcagcaaggacctgcagatggtgaacatcagcctgcgggtgctgagccggcccaatgcccaggagctgcccagcatgtaccagaggctgggcctggactatgaggagcgggtgctgcccagcatcgtgaatgaggtgctgaagtctgtggtggccaagttcaatgccagccagctgatcacccagagggcccaggtgtccctgctgatcagaagagagctgacagagcgggccaaggacttcagcctcatcctggatgatgtggccatcacagagctgtccttcagccgggagtacacagctgctgtggaggccaagcaggtggcccagcaggaggcccagagggcccagttcctggtggagaaggccaagcaggagcagaggcagaagatcgtgcaggccgagggggaggccgaggccgccaagatgctgggggaggccctgagcaagaaccctggctacatcaagctgaggaagatccgggccgcccagaacatcagcaagaccatcgccaccagccagaaccgcatctacctgacagctgacaacctggtgctgaacctgcaggatgagagcttcacccgctacagcgacagcctcatcaagggcaagaagtag

SEQ ID NO: 165346 - DNA, 786 bp, Artificial Sequence
  Description of Artificial Sequence: Synthetic coding sequence
atggcccagaacctgaaggacctggccggccgcctgcctgctggcccccggggcatgggcacagccctgaagctgctgctgggcgctggagctgtggcctacggcgtgcgggagagcgtcttcaccgtggagggcggccaccgggccatcttcttcaacagaattggaggagtgcagcaggacaccatcctggccgagggcctgcacttccgcatcccctggttccagtaccccatcatctatgacatccgggcccggcccaggaagatcagcagccccaccggcagcaaggacctgcagatggtgaacatcagcctgcgggtgctgagccggcccaatgcccaggagctgcccagcatgtaccagaggctgggcctggactatgaggagcgggtgctgcccagcatcgtgaatgaggtgctgaagtctgtggtggccaagttcaatgccagccagctgatcacccagagggcccaggtgtccctgctgatcagaagagagctgacagagcgggccaaggacttcagcctcatcctggatgatgtggccatcacagagctgtccttcagccgggagtacacagctgctgtggaggccaagcaggtggccctgagcaagaaccctggctacatcaagctgaggaagatccgggccgcccagaacatcagcaagaccatcgccaccagccagaaccgcatctacctgacagctgacaacctggtgctgaacctgcaggatgagagcttcacccggggcagtgacagcctcatcaagggcaagaagtag

SEQ ID NO: 165347 - DNA, 900 bp, Artificial Sequence
  Description of Artificial Sequence: Synthetic coding sequence
atggcccagaacctgaaggacctggccggccgcctgcctgctggcccccggggcatgggcacagccctgaagctgctgctgggcgctggagctgtggcctacggcgtgcgggagagcgtcttcaccgtggagggcggccaccgggccatcttcttcaacagaattggaggagtgcagcaggacaccatcctggccgagggcctgcacttccgcatcccctggttccagtaccccatcatctatgacatccgggcccggcccaggaagatcagcagccccaccggcagcaaggacctgcagatggtgaacatcagcctgcgggtgctgagccggcccaatgcccaggagctgcccagcatgtaccagaggctgggcctggactatgaggagcgggtgctgcccagcatcgtgaatgaggtgctgaagtctgtggtggccaagttcaatgccagccagctgatcacccagagggcccaggtgtccctgctgatcagaagagagctgacagagcgggccaaggacttcagcctcatcctggatgatgtggccatcacagagctgtccttcagccgggagtacacagctgctgtggaggccaagcaggtggcccagcaggaggcccagagggcccagttcctggtggagaaggccaagcaggagcagaggcagaagatcgtgcaggccgagggggaggccgaggccgccaagatgctgggggaggccctgagcaagaaccctggctacatcaagctgaggaagatccgggccgcccagaacatcagcaagaccatcgccaccagccagaaccgcatctacctgacagctgacaacctggtgctgaacctgcaggatgagagcttcacccggggcagtgacagcctcatcaagggcaagaagtag

SEQ ID NO: 165348 - DNA, 642 bp, Artificial Sequence
  Description of Artificial Sequence: Synthetic coding sequence
atggcccagaacctgaaggacctggccggccgcctgcctgctggcccccggggcatgggcacagccctgaagctgctgctgggcgctggagctgtggcctacggcgtgcgggagagcgtcttcaccgtggagggcggccaccgggccatcttcttcaacagaattggaggagtgcagcaggacaccatcctggccgagggcctgcacttccgcatcccctggttccagtaccccatcatctatgacatccgggcccggcccaggaagatcagcagccccaccggcagcaaggacctgcagatggtgaacatcagcctgcgggtgctgagccggcccaatgcccaggagctgcccagcatgtaccagaggctgggcctggactatgaggagcgggtgctgcccagcatcgtgaatgaggtgctgaagtctgtggtggccaagttcaatgccagccagctgatcacccagagggcccaggtgtccctgctgatcagaagagagctgacagagcgggccaaggacttcagcctcatcctggatgatgtggccatcacagagctgtccttcagccgggagtacacagctgctgtggaggccaagcaggtgggggagagccaggagccctggggcgagggcttctag

SEQ ID NO: 165349 - DNA, 318 bp, Artificial Sequence
  Description of Artificial Sequence: Synthetic coding sequence
atgagaggagccaccagggtgtccatcatgctgctgctggtgacagtgtctgactgtgccgtcatcactggagcctgtgaaagagatgtgcagtgtggggccggcacctgctgtgccatcagcctgtggctgcggggcctgaggatgtgcacccccctgggccgggagggggaggagtgccaccctggcagccacaaggtgcccttcttcaggaagaggaagcaccacacctgcccctgcctgcccaacctgctgtgcagccgcttcccagatggccgctaccgctgcagcatggacctgaagaacatcaacttctag

SEQ ID NO: 165350 - DNA, 390 bp, Artificial Sequence
  Description of Artificial Sequence: Synthetic coding sequence
atgaggagcctgtgctgtgcccccctgctgctgctgctgctgctgccccccctgctgctgacccccagggctggagatgctgctgtgatcactggagcctgtgacaaggacagccagtgtggcggcggcatgtgctgtgctgtgtccatctgggtgaagagcatccgcatctgcacccccatgggcaagctgggggacagctgccaccccctgaccaggaagaacaactttggaaatggccggcaggagaggaggaagaggaagaggagcaagaggaagaaggaggtgcccttctttggaagaaggatgcaccacacctgcccctgcctgcccggcctggcctgcctgcggaccagcttcaaccgcttcatctgcctggcccagaagtag

SEQ ID NO: 165351 - DNA, 327 bp, Artificial Sequence
  Description of Artificial Sequence: Synthetic coding sequence
atgaggagcctgtgctgtgcccccctgctgctgctgctgctgctgccccccctgctgctgacccccagggctggagatgctgctgtgatcactggagcctgtgacaaggacagccagtgtggcggcggcatgtgctgtgctgtgtccatctgggtgaagagcatccgcatctgcacccccatgggcaagctgggggacagctgccaccccctgaccaggaaggtgcccttcttcggccgcaggatgcaccacacctgcccctgcctgcccggcctggcctgcctgcggaccagcttcaaccgcttcatctgcctggcccagaagtag

SEQ ID NO: 165352 - DNA, 705 bp, Artificial Sequence
  Description of Artificial Sequence: Synthetic coding sequence
atgagggcccccctgtgcctgctgctgctggtggcccatgctgtggacatgctggccctgaacagaaggaagaagcaggtgggcaccggcctgggcggcaactgcaccggctgcatcatctgcagcgaggagaatggctgcagcacctgccagcagaggctcttcctgttcatcagaagagagggcatccggcagtatggcaagtgcctgcatgactgccccccaggctacttcggcatccggggccaggaggtgaaccgctgcaagaagtgtggggccacctgtgagagctgcttcagccaggacttctgcatccgctgcaagaggcagttctacctgtacaagggcaagtgcctgcccacctgccccccaggcaccctggcccaccagaacacccgggagtgccagggagaatgtgagctgggcccctggggcggctggagcccctgcacccacaacgggaagacctgtggcagcgcctggggcctggagagccgggtgcgggaggccggccgggccggccacgaggaggccgccacctgccaggtgctgtctgagagcaggaaatgtcccatccagaggccctgccctggagagaggagccctggccagaagaagggcaggaaggacagaagacccaggaaggacaggaagctggaccggcggctggatgtgcggccccggcagcccggcctgcagccctag

SEQ ID NO: 165353 - DNA, 1155 bp, Artificial Sequence
  Description of Artificial Sequence: Synthetic coding sequence
atggccgcccagaatggaaacaccagcttcacccccaacttcaaccccccccaggaccacgccagcagcctgtccttcaacttctcctatggagactatgacctgcccatggatgaagatgaggacatgaccaagaccaggaccttctttgctgccaagatcgtcatcggcatcgccctggccggcatcatgctggtgtgtggcatcggcaactttgtgttcatcgccgccctgacccgctacaagaagctgaggaacctgaccaacctgctgattgccaacctggccatcagtgacttcctggtggccatcatctgctgcccctttgagatggactactacgtggtgcggcagctgtcctgggagcacggccacgtgctgtgtgcctctgtgaactacctgaggacagtgtccctgtatgtgtccaccaatgccctgctggccatcgccatcgaccgctacctggccatcgtgcaccccctgaagcccaggatgaactaccagacagccagcttcctgattgccctggtgtggatggtgtccatcctgattgccatccccagcgcctactttgccacagaaacagtgctcttcatcgtgaagagccaggagaagatcttctgtggccagatctggcctgtggaccagcagctgtactacaagagctacttcctgttcatcttcggcgtggagtttgtgggccctgtggtgaccatgaccctgtgctacgcccgcatcagccgggagctgtggttcaaggctgtgcccggcttccagacagagcagatcaggaagaggctgcgctgcaggaggaagacagtgctggtgctgatgtgcatcctgacagcctacgtgctgtgctgggcccccttctacggcttcaccatcgtgcgggacttcttccccaccgtgtttgtgaaggagaagcactacctgacagccttctacgtggtggagtgcatcgccatgagcaacagcatgatcaacacagtgtgctttgtgacagtgaagaacaacaccatgaagtacttcaagaagatgatgctgctgcactggaggcccagccagaggggcagcaagagcagcgctgacctggacctgcggaccaacggggtgcccaccacagaggaggtggactgcatccggctgaagtag

SEQ ID NO: 165354 - DNA, 684 bp, Artificial Sequence
  Description of Artificial Sequence: Synthetic coding sequence
atgaacatcaagggcagcccctggaagggcagcctgctgctgctgctggtgagcaacctgctgctgtgccagagcgtggcccccctgcccatctgccctggaggagctgcccgctgccaggtgaccctgcgggacctgtttgacagagctgtggtgctgagccactacatccacaacctgagcagcgagatgttcagcgagtttgacaagcgctacacccacggccggggcttcatcaccaaggccatcaacagctgccacaccagcagcctggccaccccagaggacaaggagcaggcccagcagatgaaccagaaggacttcctgagcctcatcgtgtccatcctgcgctcctggaatgagcccctgtaccacctggtgacagaggtgcggggcatgcaggaggcccctgaggccatcctgagcaaggctgtggagattgaggagcagaccaagaggctgctggagggcatggagctgattgtgtcccaggtgcaccctgagaccaaggaaaatgagatctaccctgtgtggagcggcctgcccagcctgcagatggctgatgaggagagccggctgagcgcctactacaacctgctgcactgcctgcggcgggacagccacaagattgacaactacctgaagctgctgaagtgccgcatcatccacaacaacaactgctag

SEQ ID NO: 165355 - DNA, 591 bp, Artificial Sequence
  Description of Artificial Sequence: Synthetic coding sequence
atgaacatcaagggcagcccctggaagggcagcctgctgctgctgctggtgagcaacctgctgctgagccactacatccacaacctgagcagcgagatgttttctgaatttgacaagcgctacacccacggccggggcttcatcaccaaggccatcaacagctgccacaccagcagcctggccaccccagaggacaaggagcaggcccagcagatgaaccagaaggacttcctgagcctgattgtgtccatcctgcgctcctggaatgagcccctgtaccacctggtgacagaggtgcggggcatgcaggaggcccctgaggccatcctgagcaaggctgtggagattgaggagcagaccaagaggctgctggagggcatggagctgattgtgtcccaggtgcaccctgagaccaaggaaaatgagatctaccctgtgtggagcggcctgcccagcctgcagatggctgatgaggagagccggctgagcgcctactacaacctgctgcactgcctgcggcgggacagccacaagattgacaactacctgaagctgctgaagtgccgcatcatccacaacaacaactgctag

SEQ ID NO: 165356 - DNA, 1545 bp, Artificial Sequence
  Description of Artificial Sequence: Synthetic coding sequence
atgaccctcatctggaggcacctgctgcggcccctgtgcctggtgaccagcgccccccgcatcctggagatgcaccccttcctgagcctgggcaccagcaggacctctgtgaccaagctgagcctgcacaccaagcccaggatgccaccctgtgacttcatgcctgagcgctaccagagcctgggctacaacagagtgctggagatccacaaggagcacctgagccctgtggtgacagcctacttccagaagcccctgctgctgcaccagggccacatggagtggctgtttgatgctgagggcagccgctacctggacttcttctctggaattgtgacagtgtctgtgggccactgccaccccaaggtgaatgctgtggcccagaagcagctgggccgcctgtggcacaccagcacagtgttcttccacccccccatgcatgaatatgcagagaagctggccgccctgctgcctgagcccctgaaggtgatcttcctggtgaacagcggcagcgaggccaatgagctggccatgctgatggcccgggcccacagcaacaacatcgacatcatctccttccggggggcctaccacggctgcagcccctacaccctgggcctgaccaacgtgggcacctacaagatggagctgcccggcggcaccggctgccagcccaccatgtgcccagatgtgttccggggcccctggggcggcagccactgccgggacagccctgtgcagaccatcaggaagtgcagctgtgccccagactgctgccaggccaaggaccagtacatcgagcagttcaaggacaccctgagcacctctgtggccaagagcattgctggcttctttgctgagcccatccagggcgtgaatggagtggtgcagtaccccaagggcttcctgaaggaggcctttgagctggtgcgggcccggggcggcgtgtgcatcgcagatgaggtgcagacaggcttcggccgcctgggcagccacttctggggcttccagacccatgatgtgctgcctgacatcgtgaccatggccaagggcattggaaatggcttccccatggccgccgtcatcaccaccccagaaattgccaagagcctggccaagtgcctgcagcacttcaacacctttggaggcaaccccatggcctgtgccatcggcagcgctgtgctggaggtgatcaaggaggagaacctgcaggagaacagccaggaggtgggcacctacatgctgctgaagtttgccaagctgagagatgaatttgaaattgtgggagatgtgcggggcaagggcctgatgattggcatcgagatggtgcaggacaagatcagctgccggcccctgccccgggaggaggtgaaccagatccacgaggactgcaagcacatgggcctgctggtgggccggggcagcatcttcagccagaccttcagaattgcccccagcatgtgcatcaccaagccagaggtggactttgctgtggaggtgttccgcagcgccctgacccagcacatggagcggcgggccaagtag

SEQ ID NO: 165357 - DNA, 1050 bp, Artificial Sequence
  Description of Artificial Sequence: Synthetic coding sequence
atgaaggaaaatgtggccagcgccaccgtcttcaccctgctgctcttcctgaacacctgcctgctgaatggccagctgcccccaggcaagccagagatcttcaagtgccgcagccccaacaaggagaccttcacctgctggtggaggcctggaacagatggcggcctgcccaccaactacagcctgacctaccaccgggagggggagaccctgatgcatgagtgcccagactacatcaccggcggccccaacagctgccactttgggaagcagtacacctccatgtggaggacctacatcatgatggtgaatgccaccaaccagatgggcagcagcttcagtgatgagctgtatgtggatgtgacctacatcgtgcagcctgacccccccctggagctggccgtggaggtgaagcagcctgaggacaggaagccctacctgtggatcaagtggagcccccccaccctgattgacctgaagacaggctggttcaccctgctgtatgagatccggctgaagccagagaaggctgctgagtgggagatccactttgctggccagcagacagagttcaagatcctgagcctgcaccctggccagaagtacctggtgcaggtgcgctgcaagccagaccacggctactggagcgcctggagccctgccaccttcatccagatccccagcgacttcaccatgaatgacaccaccgtgtggatctctgtggccgtgctgtctgctgtgatctgcctgatcatcgtgtgggccgtggccctgaagggctacagcatggtgacctgcatcttcccccctgtgcccggccccaagatcaagggctttgatgcccacctgctggagaagggcaagtctgaggagctgctgagcgccctgggctgccaggacttcccccccaccagtgactatgaggacctgctggtggagtacctggaggtggatgacagcgaggaccagcacctgatgtctgtgcacagcaaggagcaccccagccaggagcgggagcagaggcaggcccaggaggcccgggacagctag

SEQ ID NO: 165358 - DNA, 1566 bp, Artificial Sequence
  Description of Artificial Sequence: Synthetic coding sequence
atgaaggaaaatgtggccagcgccaccgtcttcaccctgctgctcttcctgaacacctgcctgctgaatgtgcagcctgacccccccctggagctggccgtggaggtgaagcagcctgaggacaggaagccctacctgtggatcaagtggagcccccccaccctgattgacctgaagacaggctggttcaccctgctgtatgagatccggctgaagccagagaaggctgctgagtgggagatccactttgctggccagcagacagagttcaagatcctgagcctgcaccctggccagaagtacctggtgcaggtgcgctgcaagccagaccacggctactggagcgcctggagccctgccaccttcatccagatccccagcgacttcaccatgaatgacaccaccgtgtggatctctgtggccgtgctgtctgctgtgatctgcctgatcatcgtgtgggccgtggccctgaagggctacagcatggtgacctgcatcttcccccctgtgcccggccccaagatcaagggctttgatgcccacctgctggagaagggcaagtctgaggagctgctgagcgccctgggctgccaggacttcccccccaccagtgactatgaggacctgctggtggagtacctggaggtggatgattctgaggaccagcacctgatgtctgtgcacagcaaggagcaccccagccagggcatgaagcccacctacctggaccctgacacagacagcggccggggcagctgtgacagccccagcctgctgtctgagaagtgtgaggagccccaggccaaccccagcaccttctatgaccctgaggtgattgagaagccagaaaatcctgagaccacccacacctgggacccccagtgcatctccatggagggcaagatcccctacttccacgccggcggcagcaagtgcagcacctggcccctgccccagcccagccagcacaaccccaggagcagctaccacaacatcacagatgtgtgtgagctggccgtgggccctgctggggccccagccaccctgctgaatgaagctgggaaggatgccctgaagagcagccagaccatcaagagccgggaggagggcaaggccacccagcagcgggaggtggagagcttccacagcgagacagaccaggacaccccctggctgctgccccaggagaagacccccttcggcagcgccaagcccctggactatgtggagatccacaaggtgaacaaggatggagccctgagcctgctgcccaagcagcgggagaacagcggcaagcccaagaagccaggcaccccagagaacaacaaggagtatgccaaggtgtctggagtgatggacaacaacatcctggtgctggtgcctgacccccacgccaagaatgtggcctgctttgaggagagcgccaaggaggccccacccagcctggagcagaaccaggccgagaaggccctggccaacttcaccgccaccagcagcaagtgccgcctgcagctgggcggcctggactacctggaccctgcctgcttcacccacagcttccactag

SEQ ID NO: 165359 - DNA, 807 bp, Artificial Sequence
  Description of Artificial Sequence: Synthetic coding sequence
atgaaggaaaatgtggccagcgccaccgtcttcaccctgctgctcttcctgaacacctgcctgctgaatggccagctgcccccaggcaagccagagatcttcaagtgccgcagccccaacaaggagaccttcacctgctggtggaggcctggaacagatggcggcctgcccaccaactacagcctgacctaccaccgggagggggagaccctgatgcatgagtgcccagactacatcaccggcggccccaacagctgccactttgggaagcagtacacctccatgtggaggacctacatcatgatggtgaatgccaccaaccagatgggcagcagcttcagtgatgagctgtatgtggatgtgacctacatcgtgcagcctgacccccccctggagctggccgtggaggtgaagcagcctgaggacaggaagccctacctgtggatcaagtggagcccccccaccctgattgacctgaagacaggctggttcaccctgctgtatgagatccggctgaagccagagaaggctgctgagtgggagatccactttgctggccagcagacagagttcaagatcctgagcctgcaccctggccagaagtacctggtgcaggtgcgctgcaagccagaccacggctactggagcgcctggagccctgccaccttcatccagatccccagcggggaccccctgatgctgggcgccagccactacaagaacctgaagagctaccggcccaggaagatcagcagccagggccgcctggccgtgttcaccaaggccaccctgaccaccgtgcagtag

SEQ ID NO: 165360 - DNA, 1869 bp, Artificial Sequence
  Description of Artificial Sequence: Synthetic coding sequence
atgaaggaaaatgtggccagcgccaccgtcttcaccctgctgctcttcctgaacacctgcctgctgaatggccagctgcccccaggcaagccagagatcttcaagtgccgcagccccaacaaggagaccttcacctgctggtggaggcctggaacagatggcggcctgcccaccaactacagcctgacctaccaccgggagggggagaccctgatgcatgagtgcccagactacatcaccggcggccccaacagctgccactttgggaagcagtacacctccatgtggaggacctacatcatgatggtgaatgccaccaaccagatgggcagcagcttcagtgatgagctgtatgtggatgtgacctacatcgtgcagcctgacccccccctggagctggccgtggaggtgaagcagcctgaggacaggaagccctacctgtggatcaagtggagcccccccaccctgattgacctgaagacaggctggttcaccctgctgtatgagatccggctgaagccagagaaggctgctgagtgggagatccactttgctggccagcagacagagttcaagatcctgagcctgcaccctggccagaagtacctggtgcaggtgcgctgcaagccagaccacggctactggagcgcctggagccctgccaccttcatccagatccccagcgacttcaccatgaatgacaccaccgtgtggatctctgtggccgtgctgtctgctgtgatctgcctgatcatcgtgtgggccgtggccctgaagggctacagcatggtgacctgcatcttcccccctgtgcccggccccaagatcaagggctttgatgcccacctgctggagaagggcaagtctgaggagctgctgagcgccctgggctgccaggacttcccccccaccagtgactatgaggacctgctggtggagtacctggaggtggatgacagcgaggaccagcacctgatgtctgtgcacagcaaggagcaccccagccagggcatgaagcccacctacctggaccctgacacagattctggccggggcagctgtgacagccccagcctgctgtctgagaagtgtgaggagccccaggccaaccccagcaccttctatgaccctgaggtgattgagaagccagagaaccctgagaccacccacacctgggacccccagtgcatctccatggagggcaagatcccctacttccacgccggcggcagcaagtgcagcacctggcccctgccccagcccagccagcacaaccccaggagcagctaccacaacatcacagatgtgtgtgagctggccgtgggccctgctggggccccagccaccctgctgaatgaggccggcaaggatgccctgaagagcagccagaccatcaagagccgggaggagggcaaggccacccagcagcgggaggtggagagcttccacagcgagacagaccaggacaccccctggctgctgccccaggagaagaccccatttggaagtgccaagcccctggactatgtggagatccacaaggtgaacaaggatggagccctgagcctgctgcccaagcagagagaaaattctgggaagcccaagaagccaggcaccccagagaacaacaaggagtatgccaaggtgtctggagtgatggacaacaacatcctggtgctggtgcctgacccccacgccaagaatgtggcctgctttgaggagagcgccaaggaggccccacccagcctggagcagaaccaggccgagaaggccctggccaacttcaccgccaccagcagcaaatgtcggctgcagctgggcggcctggactacctggaccctgcctgcttcacccacagcttccactag

SEQ ID NO: 165361 - DNA, 594 bp, Artificial Sequence
  Description of Artificial Sequence: Synthetic coding sequence
atgcatgaatgtcctgactacatcactggaggccccaacagctgccactttgggaagcagtacacctccatgtggaggacctacatcatgatggtgaatgccaccaaccagatgggcagcagcttcagtgatgagctgtatgtggatgtgacctacatcgtgcagcctgacccccccctggagctggccgtggaggtgaagcagcctgaggacaggaagccctacctgtggatcaagtggagcccccccaccctgattgacctgaagacaggctggttcaccctgctgtatgagatccggctgaagccagagaaggctgctgagtgggagatccactttgctggccagcagacagagttcaagatcctgagcctgcaccctggccagaagtacctggtgcaggtgcgctgcaagccagaccacggctactggagcgcctggagccctgccaccttcatccagatccccagcggggaccccctgatgctgggcgccagccactacaagaacctgaagagctaccggcccaggaagatcagcagccagggccgcctggccgtgttcaccaaggccaccctgaccaccgtgcagtag

SEQ ID NO: 165362 - DNA, 312 bp, Artificial Sequence
  Description of Artificial Sequence: Synthetic coding sequence
atgaaggaaaatgtggccagcgccaccgtcttcaccctgctgctcttcctgaacacctgcctgctgaatggccagctgcccccaggcaagccagagatcttcaagtgccgcagccccaacaaggagaccttcacctgctggtggaggcctggaacagatggcggcctgcccaccaactacagcctgacctaccaccgggagggggagaccctgatgcatgagtgcccagactacatcaccggcggccccaacagctgccactttgggaagcagtacacctccatgtggaggacctacatcatgatggtgtag

SEQ ID NO: 165363 - DNA, 189 bp, Artificial Sequence
  Description of Artificial Sequence: Synthetic coding sequence
atgaaggaaaatgtggccagcgccaccgtcttcaccctgctgctcttcctgaacacctgcctgctgaatggccagctgcccccaggcaagccagagatcttcaagtgccgcagccccaacaaggagaccttcacctgctggtggaggcctggaacagatggcggcctgcccaccaactacagcctgtag

SEQ ID NO: 165364 - DNA, 336 bp, Artificial Sequence
  Description of Artificial Sequence: Synthetic coding sequence
atgaaggaaaatgtggccagcgccaccgtcttcaccctgctgctcttcctgaacacctgcctgctgaatggccagctgcccccaggcaagccagagatcttcaagtgccgcagccccaacaaggagaccttcacctgctggtggaggcctggaacagatggcggcctgcccaccaactacagcctgacctaccaccgggagggggagaccctgatgcatgagtgcccagactacatcaccggcggccccaacagctgccactttgggaagcagtacacctccatgtggaggacctacatcatgatggtgaatgccaccaaccagatgggcagctag

SEQ ID NO: 165365 - DNA, 1566 bp, Artificial Sequence; identical to SEQ ID NO: 165358
  Description of Artificial Sequence: Synthetic coding sequence

SEQ ID NO: 165366 - DNA, 867 bp, Artificial Sequence
  Description of Artificial Sequence: Synthetic coding sequence
atgaaggaaaatgtggccagcgccaccgtcttcaccctgctgctcttcctgaacacctgcctgctgaatggccagctgcccccaggcaagccagagatcttcaagtgccgcagccccaacaaggagaccttcacctgctggtggaggcctggaacagatggcggcctgcccaccaactacagcctgacctaccaccgggagggggagaccctgatgcatgagtgcccagactacatcaccggcggccccaacagctgccactttgggaagcagtacacctccatgtggaggacctacatcatgatggtgaatgccaccaaccagatgggcagcagcttcagtgatgagctgtatgtggatgtgacctacatcgtgcagcctgacccccccctggagctggccgtggaggtgaagcagcctgaggacaggaagccctacctgtggatcaagtggagcccccccaccctgattgacctgaagacaggctggttcaccctgctgtatgagatccggctgaagccagagaaggctgctgagtgggagatccactttgctggccagcagacagagttcaagatcctgagcctgcaccctggccagaagtacctggtgcaggtgcgctgcaagccagaccacggctactggagcgcctggagccctgccaccttcatccagatccccagcgacttcaccatgaatgacaccaccgtgtggatctctgtggccgtgctgtctgctgtgatctgcctgatcatcgtgtgggccgtggccctgaagggctacagcatggtgacctgcatcttcccccctgtgcccggccccaagatcaagggctttgatgcccacctgctggaggtgaccccctag

SEQ ID NO: 165367 - DNA, 363 bp, Artificial Sequence
  Description of Artificial Sequence: Synthetic coding sequence
atgaaggaaaatgtggccagcgccaccgtcttcaccctgctgctcttcctgaacacctgcctgctgaatggccagctgcccccaggcaagccagagatcttcaagtgccgcagccccaacaaggagaccttcacctgctggtggaggcctggaacagatggcggcctgcccaccaactacagcctgacctaccaccgggagggggagaccctgatgcatgagtgcccagactacatcaccggcggccccaacagctgccactttgggaagcagtacacctccatgtggaggacctacatcatgatggtgaatgccaccaaccagatgggcagcagcttcagtgatgagctgtatgtggactag

SEQ ID NO: 165368 - DNA, 105 bp, Artificial Sequence
  Description of Artificial Sequence: Synthetic coding sequence
atgaaggaaaatgtggccagcgccaccgtcttcaccctgctgctcttcctgaacacctgcctgctgaatggccagctgcccccaggcaagccagagatcttctag

SEQ ID NO: 165369 - DNA, 930 bp, Artificial Sequence
  Description of Artificial Sequence: Synthetic coding sequence
atgaaggaaaatgtggccagcgccaccgtcttcaccctgctgctcttcctgaacacctgcctgctgaatggccagctgcccccaggcaagccagagatcttcaagtgccgcagccccaacaaggagaccttcacctgctggtggaggcctggaacagatggcggcctgcccaccaactacagcctgacctaccaccgggagggggagaccctgatgcatgagtgcccagactacatcaccggcggccccaacagctgccactttgggaagcagtacacctccatgtggaggacctacatcatgatggtgaatgccaccaaccagatgggcagcagcttcagtgatgagctgtatgtggatgtgacctacatcgtgcagcctgacccccccctggagctggccgtggaggtgaagcagcctgaggacaggaagccctacctgtggatcaagtggagcccccccaccctgattgacctgaagacaggctggttcaccctgctgtatgagatccggctgaagccagagaaggctgctgagtgggagatccactttgctggccagcagacagagttcaagatcctgagcctgcaccctggccagaagtacctggtgcaggtgcgctgcaagccagaccacggctactggagcgcctggagccctgccaccttcatccagatccccagcgacttcaccatgaatgacaccaccgtgtggatctctgtggccgtgctgtctgctgtgatctgcctgatcatcgtgtgggccgtggccctgaagggctacagcatggtgacctgcatcttcccccctgtgcccggccccaagatcaagggctttgatgcccacctgctggaggaccggctgtgcaccccaggccgctgctgcgtgtccacaggcctgacagacctggactacagctgcagcacctag

SEQ ID NO: 165370 - DNA, 1254 bp, Artificial Sequence
  Description of Artificial Sequence: Synthetic coding sequence
atgggcagaagaagagcccctgagctgtaccgggcccccttccccctgtatgccctgcaggtggaccccagcacaggcctgctgattgctgctgggggcggcggggccgccaagacaggcatcaagaatggagtgcacttcctgcagctggagctgatcaatggccgcctgagcgccagcctgctgcacagccatgacacagagacccgggccaccatgaacctggccctggccggggacatcctggccgccggccaggatgcccactgccagctgctgcgcttccaggcccaccagcagcagggcaacaaggccgagaaggccggcagcaaggagcagggcccccggcagaggaaaggagctgccccagctgagaagaagtgtggggctgagacccagcacgagggcctggagctgcgggtggagaacctgcaggccgtgcagacagacttcagcagtgaccccctgcagaaggtggtgtgcttcaaccacgacaacaccctgctggccactggaggaacagatggctacgtgcgggtgtggaaggtgcccagcctggagaaggtgctggagttcaaggcccatgaaggagaaattgaggacctggccctgggcccagatggcaagctggtgacagtgggccgggacctgaaggcctctgtgtggcagaaggaccagctggtgacccagctgcactggcaggagaatggccccaccttcagcagcaccccctaccgctaccaggcctgccgcttcggccaggtgcctgaccagcctgctggcctgcggctcttcaccgtgcagatcccccacaagaggctgcggcagcccccaccctgctacctgacagcctgggatggcagcaacttcctgcccctgcggaccaagagctgtggccacgaggtggtgtcctgcctggatgtgtctgagagcggcaccttcctgggcctgggcaccgtgactggatctgtggccatctacatcgccttcagcctgcagtgcctgtactacgtgcgggaggcccacggcatcgtggtgacagatgtggccttcctgcctgagaagggccggggccctgagctgctgggcagccatgaaacagccctcttctctgtggccgtggacagccgctgccagctgcacctgctgcccagccgccgctctgtgcctgtgtggctgctgctgctgctgtgtgtgggcctcatcatcgtgaccatcctgctgctgcagagcgccttccctggcttcctgtag

SEQ ID NO: 165371 - DNA, 1254 bp, Artificial Sequence; identical to SEQ ID NO: 165370
  Description of Artificial Sequence: Synthetic coding sequence

SEQ ID NO: 165372 - DNA, 441 bp, Artificial Sequence
  Description of Artificial Sequence: Synthetic coding sequence
atgaggctgctgcagctgctcttccgggccagccctgccaccctgctgctggtgctgtgcctgcagctgggcgccaacaaggcccaggacaacaccaggaagatcatcatcaagaactttgacatccccaagtctgtgcggcccaatgatgaggtgacagctgtgctggccgtgcagacagagctgaaggagtgcatggtggtgaagacctacctgatcagcagcatccccctgcagggcgccttcaactacaagtacacagcctgcctgtgtgatgacaaccccaagaccttctactgggacttctacaccaacagaacagtgcagattgctgctgtggtggatgtgatccgggagctgggcatctgcccagatgatgctgctgtgatccccatcaagaacaaccgcttctacaccatcgagatcctgaaggtggagtag

SEQ ID NO: 165373 - DNA, 1185 bp, Artificial Sequence
  Description of Artificial Sequence: Synthetic coding sequence
atgtctggagaagatgagcagcaggagcagaccatcgccgaggacctggtggtgaccaagtacaagatgggcggggacatcgccaacagagtgctgcggagcctggtggaggccagcagcagtggagtgtctgtgctgagcctgtgtgagaagggagatgccatgatcatggaggagaccgggaagatcttcaagaaggagaaggagatgaagaagggcatcgccttccccaccagcatctctgtgaacaactgtgtgtgccacttcagccccctgaagagtgaccaggactacatcctgaaggagggggacctggtgaagattgacctgggcgtgcacgtggatggcttcatcgccaacgtggcccacacctttgtggtggatgtggcccagggcacccaggtgacaggcaggaaggcagatgtgatcaaggccgcccacctgtgtgccgaggccgccctgcggctggtgaagccaggcaaccagaacacccaggtgacagaggcctggaacaaggtggcccacagcttcaactgcacccccatcgagggcatgctgagccaccagctgaagcagcacgtgattgatggagagaagaccatcatccagaaccccacagaccagcagaagaaggaccacgagaaggccgagtttgaggtgcatgaggtgtatgctgtggatgtgctggtgagcagcggggagggcaaggccaaggatgctggccagaggaccaccatctacaagagggaccccagcaagcagtatggcctgaagatgaagaccagccgggccttcttcagcgaggtggagaggagatttgatgccatgcccttcaccctgcgggcctttgaagatgagaagaaggccaggatgggcgtggtggagtgtgccaagcatgagctgctgcagcccttcaacgtgctgtatgagaaggagggggagtttgtggcccagttcaagttcaccgtgctgctgatgcccaacggccccatgaggatcaccagcggcccctttgagccagacctgtacaagtctgagatggaggtgcaggatgctgagctgaaggccctgctgcagagcagcgccagcaggaagacccagaagaagaagaagaagaaggccagcaagacagcagaaaatgccaccagcggggagaccctggaggagaatgaggccggggactag

SEQ ID NO: 165374 - DNA, 1218 bp, Artificial Sequence
  Description of Artificial Sequence: Synthetic coding sequence
gcctgcccagccccccagcctgcccggagccagctgctggccctggcctgcctgcctgcccccctgctggcccgggcctttgcccggcccctgctggaggacagaggagacagcgaccacagccctgaggacctggtggtgaccaagtacaagatgggcggggacatcgccaacagagtgctgcggagcctggtggaggccagcagcagcggcgtgtctgtgctgagcctgtgtgagaagggagatgccatgatcatggaggagaccgggaagatcttcaagaaggagaaggagatgaagaagggcatcgccttccccaccagcatctctgtgaacaactgtgtgtgccacttcagccccctgaagagtgaccaggactacatcctgaaggagggggacctggtgaagattgacctgggcgtgcacgtggatggcttcatcgccaacgtggcccacacctttgtggtggatgtggcccagggcacccaggtgactggaaggaaggcagatgtgatcaaggccgcccacctgtgtgccgaggccgccctgcggctggtgaagccaggcaaccagaacacccaggtgacagaggcctggaacaaggtggcccacagcttcaactgcacccccatcgagggcatgctgagccaccagctgaagcagcacgtgattgatggagagaagaccatcatccagaaccccacagaccagcagaagaaggaccacgagaaggccgagtttgaggtgcatgaggtgtatgctgtggatgtgctggtgtcctctggagagggcaaggccaaggatgctggccagaggaccaccatctacaagagggaccccagcaagcagtatggcctgaagatgaagaccagccgggccttcttcagcgaggtggagaggagatttgatgccatgcccttcaccctgcgggcctttgaagatgagaagaaggccaggatgggcgtggtggagtgtgccaagcatgagctgctgcagcccttcaacgtgctgtatgagaaggagggggagtttgtggcccagttcaagttcaccgtgctgctgatgcccaacggccccatgaggatcaccagcggcccctttgagccagacctgtacaagtctgagatggaggtgcaggatgctgagctgaaggccctgctgcagagcagcgccagcaggaagacccagaagaagaagaagaagaagaagaagaagtag

SEQ ID NO: 165375 - DNA, 738 bp, Artificial Sequence
  Description of Artificial Sequence: Synthetic coding sequence
atgaccaggatgctgcagaggatggatgtgctggccaagaaggccacagagatgggcgtgcggctgatggtggatgctgagcagacctacttccagcctgccatcagccggctgaccctggagatgcagaggaagttcaacgtggagaagcccctcatcttcaacacctaccagtgctacctgaaggatgcctatgacaacgtgaccctggatgtggagctggcccggcgggagggctggtgcttcggggccaagctggtgcggggggcctacctggcccaggagcgggcccgggctgctgagatcggctatgaggaccccatcaaccccacctatgaggccaccaatgccatgtaccaccgctgcctggactatgtgctggaggagctgaagcacaatgccaaggccaaggtgatggtggccagccacaatgaagatactgtgcgctttgccctgcggaggatggaggagctgggcctgcaccctgctgaccaccgggtgtacttcggccagctgctgggcatgtgtgaccagatctccttccccctgggccaggccggctaccctgtgtacaagtatgtgccctacggccctgtgatggaggtgctgccctacctgagccggcgggccctggagaacagcagcctgatgaagggcacccaccgggagcggcagctgctgtggctggagctgctgcggcggctgaggactggaaacctcttccacaggcctgcctag

SEQ ID NO: 165376 - DNA, 1803 bp, Artificial Sequence
  Description of Artificial Sequence: Synthetic coding sequence
atggccctgcggcgggccctgcctgccctgcggccctgcatccccaggtttgtgcccctgagcacagccccagccagccgggagcagcctgctgctggccctgctgctgtgcctgggggcggcagcgccacagctgtgcggccccctgtgcctgctgtggactttggaaatgcccaggaggcctaccgcagcaggaggacctgggagctggcccggagcctgctggtgctgcggctgtgtgcctggccagccctgctggcccggcatgagcagctgctgtatgtgtccaggaagctgctgggccagaggctcttcaacaagctgatgaagatgaccttctacggccactttgtggccggggaggaccaggagagcatccagcccctgctgcggcactaccgggccttcggcgtgtctgccatcctggactatggagtggaggaggacctgagccctgaggaggccgagcacaaggagatggagagctgcaccagcgctgctgagagagatggcagcggcaccaacaagagggacaagcagtaccaggcccactgggcctttggagacagaagaaatggagtcatcagcgcccggacctacttctacgccaatgaggccaagtgtgacagccacatggagaccttcctgcgctgcatcgaggccagcggccgggtgtctgatgatggcttcatcgccatcaagctgacagccctgggccggccccagttcctgctgcagttcagcgaggtgctggccaagtggcgctgcttcttccaccagatggctgtggagcagggccaggccggcctggccgccatggacaccaagctggaggtggccgtgctgcaggagagcgtggccaagctgggcatcgccagcagagctgagattgaggactggttcaccgctgagaccctgggcgtgtctggcaccatggacctgctggactggagcagcctgattgacagcaggaccaagctgagcaagcacctggtggtgcccaatgcccagacaggccagctggagcccctgctgagccgcttcacagaggaggaggagctgcagatgaccaggatgctgcagaggatggatgtgctggccaagaaggccacagagatgggcgtgcggctgatggtggatgctgagcagacctacttccagcctgccatcagccggctgaccctggagatgcagaggaagttcaacgtggagaagcccctcatcttcaacacctaccagtgctacctgaaggatgcctatgacaacgtgaccctggatgtggagctggcccggcgggagggctggtgctttggagccaagctggtgcggggggcctacctggcccaggagcgggcccgggctgctgagatcggctatgaggaccccatcaaccccacctatgaggccaccaatgccatgtaccaccgctgcctggactatgtgctggaggagctgaagcacaatgccaaggccaaggtgatggtggccagccacaatgaagacacagtgcgctttgccctgcggaggatggaggagctgggcctgcaccctgctgaccaccgggtgtacttcggccagctgctgggcatgtgtgaccagatctccttccccctgggccaggccggctaccctgtgtacaagtatgtgccctacggccctgtgatggaggtgctgccctacctgagcagaagagccctggagaacagcagcctgatgaagggcacccaccgggagcggcagctgctgtggctggagctgctgcggcggctgaggacaggcaacctcttccacaggcctgcctag

SEQ ID NO: 165377 - DNA, 1479 bp, Artificial Sequence
  Description of Artificial Sequence: Synthetic coding sequence
atgaagatgaccttctacggccactttgtggccggggaggaccaggagagcatccagcccctgctgcggcactaccgggccttcggcgtgtctgccatcctggactatggagtggaggaggacctgagccctgaggaggccgagcacaaggagatggagagctgcaccagcgctgctgagagagatggcagcggcaccaacaagagggacaagcagtaccaggcccactgggcctttggagacagaagaaatggagtcatcagcgcccggacctacttctacgccaatgaggccaagtgtgacagccacatggagaccttcctgcgctgcatcgaggccagcggccgggtgtctgatgatggcttcatcgccatcaagctgacagccctgggccggccccagttcctgctgcagttcagcgaggtgctggccaagtggcgctgcttcttccaccagatggctgtggagcagggccaggccggcctggccgccatggacaccaagctggaggtggccgtgctgcaggagagcgtggccaagctgggcatcgccagcagagctgagattgaggactggttcaccgctgagaccctgggcgtgtctggcaccatggacctgctggactggagcagcctgattgacagcaggaccaagctgagcaagcacctggtggtgcccaatgcccagacaggccagctggagcccctgctgagccgcttcacagaggaggaggagctgcagatgaccaggatgctgcagaggatggatgtgctggccaagaaggccacagagatgggcgtgcggctgatggtggatgctgagcagacctacttccagcctgccatcagccggctgaccctggagatgcagaggaagttcaacgtggagaagcccctcatcttcaacacctaccagtgctacctgaaggatgcctatgacaacgtgaccctggatgtggagctggcccggcgggagggctggtgctttggagccaagctggtgcggggggcctacctggcccaggagcgggcccgggctgctgagatcggctatgaggaccccatcaaccccacctatgaggccaccaatgccatgtaccaccgctgcctggactatgtgctggaggagctgaagcacaatgccaaggccaaggtgatggtggccagccacaatgaagacacagtgcgctttgccctgcggaggatggaggagctgggcctgcaccctgctgaccaccgggtgtacttcggccagctgctgggcatgtgtgaccagatctccttccccctgggccaggccggctaccctgtgtacaagtatgtgccctacggccctgtgatggaggtgctgccctacctgagcagaagagccctggagaacagcagcctgatgaagggcacccaccgggagcggcagctgctgtggctggagctgctgcggcggctgaggacaggcaacctcttccacaggcctgcctag

SEQ ID NO: 165378 - DNA, 1611 bp, Artificial Sequence
  Description of Artificial Sequence: Synthetic coding sequence
atgagcccccgggtggtgagcaacagctctgtgctggccagccagagcgtgggcatcaccaacgtgaggacagtgttcagcaatgtgttcaacaacaccacagccttccccatcctgcggggcagcaactgccacaagatcacagcccctggcctgggcaagggccagctggtgaacctgctgcccccagagaacctgccctggtgtggcggcagccagggccccaggatgctgcggacctgctacgtgctgtgcagccaggccggcccccccagccggggctggcagagcctgagctttgatggaggagccttccacctgaagggcaccggggagctgacccgggccctgctggtgctgcggctgtgtgcctggccacccctggtgacccacggcctgctgctgcaggcctggagccggcggctgctgggcagccggctgagcggggccttcctgcgggcctctgtgtatggccagtttgtggccggggagacagctgaggaggtgaagggctgtgtgcagcagctgcggaccctgagcctgcggcccctgctggccgtgcccacagaggaggagccagattctgctgccaagtctggagaggcctggtatgagggcaacctgggcgccatgctgcgctgtgtggacctgagccggggcctgctggagccccccagcctggccgaggccagcctgatgcagctgaaggtgacagccctgaccagcacccggctgtgcaaggagctggcctcctgggtgcggcggcctggggccagcctggagctgagccctgagcggctggccgaggccatggattctggccagaacctgcaggtgtcctgcctgaatgctgagcagaaccagcacctgcgggccagcctgagccggctgcaccgggtggcccagtatgcccgggcccagcacgtgcggctgctggtggatgctgagtacaccagcctgaacccagccctgagcctgctggtggccgccctggccgtgcgctggaacagccctggagagggcggcccctgggtgtggaacacctaccaggcctgcctgaaggacacctttgagcggctgggcagagatgctgaggccgcccaccgggccggcctggccttcggcgtgaagctggtgcggggggcctacctggacaaggagagagctgtggcccagctgcacggcatggaggaccccacccagcctgactatgaggccaccagccagagctacagccgctgcctggagctgatgctgacccacgtggcccggcacggccccatgtgccacctgatggtggccagccacaatgaggagagcgtgcggcaggccaccaagaggatgtgggagctgggcatccccctggatggcaccgtgtgcttcggccagctgctgggcatgtgtgaccacgtgtccctggccctgggccaggccggctacgtggtgtacaagagcatcccctacggcagcctggaggaggtgatcccctacctgatccggcgggcccaggagaacagatctgtgctgcagggcgcccggcgggagcaggagctgctgagccaggagctgtggaggcggctgctgcccggctgccgccgcatcccccactag

SEQ ID NO: 165379 - DNA, 762 bp, Artificial Sequence
  Description of Artificial Sequence: Synthetic coding sequence
atgcctggccgcacagaaggaggctcctggctgagaaatgctgctgctgctgatgtgctgaggaacctgcctgaggtggagtggagggagccccagcactgctgcccccccacccccaggaagaggaagcagaacccccgggtgcccctgccccactacccacccaacccagctgctgccatcgctgctgacaccatgcccaagaggaagaagcagaaccaccaccagccccccacccagcagcagccccccctgcctgagcgggaggagactggagatgaagaagatggcagccccatcggcccccccagcctgctgggccccccacccatggccaacgggaagccaggggaccccaagagcgccctgcaccggggccccccaggcagccggggccccctcatcccccccctgctgagcctgcccccaccaccctggggccggggccccatccggcggggcctgggccccaggagcagcccctacggccggggctggtggggcgtgaatgctgagccccccttccctggccctggccacggcggccccacccggggcagcttccacaaggagcagaggaacccccggcggctgaagtcctggagcctcatcaagaacacctgcccccccaaggatgacccccaggtgatggaggacaagagtgacaggcctgtgtgccgccactttgccaagaagggccactgccgctatgaggacctgtgtgccttctaccaccctggggtgaatggaccacccctgtag

SEQ ID NO: 165380 - DNA, 504 bp, Artificial Sequence
  Description of Artificial Sequence: Synthetic coding sequence
atgcccaagaggaagaagcagaaccaccaccagccccccacccagcagcagccccccctgcctgagcgggaggagactggagatgaggaggatggcagccccatcgccctgcaccggggccccccaggcagccggggccccctcatcccccccctgctgagcctgcccccaccaccctggggccggggccccatccggcggggcctgggccccaggagcagcccctacggccggggctggtggggcgtgaatgctgagccccccttccctggccctggccacggcggccccacccggggcagcttccacaaggagcagaggaacccccggcggctgaagtcctggagcctcatcaagaacacctgcccccccaaggatgacccccaggtgatggaggacaagagtgacaggcctgtgtgccgccactttgccaagaagggccactgccgctatgaggacctgtgtgccttctaccaccctggggtgaatggaccacccctgtag

SEQ ID NO: 165381 - DNA, 567 bp, Artificial Sequence
  Description of Artificial Sequence: Synthetic coding sequence
atgcccaagaggaagaagcagaaccaccaccagccccccacccagcagcagccccccctgcctgagcgggaggagactggagatgaggaggatggcagccccatcggcccccccagcctgctgggccccccacccatggccaacgggaagccaggggaccccaagagcgccctgcaccggggccccccaggcagccggggccccctcatcccccccctgctgagcctgcccccaccaccctggggccggggccccatcagaagaggcctgggccccaggagcagcccctacggccggggctggtggggcgtgaatgctgagccccccttccctggccctggccatggaggccccacccggggcagcttccacaaggagcagaggaacccccggcggctgaagtcctggagcctcatcaagaacacctgcccccccaaggatgacccccaggtgatggaggacaagagtgacaggcctgtgtgccgccactttgccaagaagggccactgccgctatgaggacctgtgtgccttctaccaccctggggtgaatggcccccccctgtag

SEQ ID NO: 165382 - DNA, 567 bp, Artificial Sequence; identical to SEQ ID NO: 165381
  Description of Artificial Sequence: Synthetic coding sequence

SEQ ID NO: 165383 - DNA, 504 bp, Artificial Sequence; identical to SEQ ID NO: 165380
  Description of Artificial Sequence: Synthetic coding sequence

SEQ ID NO: 165384 - DNA, 504 bp, Artificial Sequence; identical to SEQ ID NO: 165380
  Description of Artificial Sequence: Synthetic coding sequence

SEQ ID NO: 165385 - DNA, 504 bp, Artificial Sequence; identical to SEQ ID NO: 165380
  Description of Artificial Sequence: Synthetic coding sequence

SEQ ID NO: 165386 - DNA, 567 bp, Artificial Sequence; identical to SEQ ID NO: 165381
  Description of Artificial Sequence: Synthetic coding sequence

SEQ ID NO: 165387 - DNA, 567 bp, Artificial Sequence; identical to SEQ ID NO: 165381
  Description of Artificial Sequence: Synthetic coding sequence

SEQ ID NO: 165388 - DNA, 504 bp, Artificial Sequence; identical to SEQ ID NO: 165380
  Description of Artificial Sequence: Synthetic coding sequence

SEQ ID NO: 165389 - DNA, 504 bp, Artificial Sequence; identical to SEQ ID NO: 165380
  Description of Artificial Sequence: Synthetic coding sequence

SEQ ID NO: 165390 - DNA, 504 bp, Artificial Sequence; identical to SEQ ID NO: 165380
  Description of Artificial Sequence: Synthetic coding sequence

SEQ ID NO: 165391 - DNA, 567 bp, Artificial Sequence; identical to SEQ ID NO: 165381
  Description of Artificial Sequence: Synthetic coding sequence

SEQ ID NO: 165392 - DNA, 567 bp, Artificial Sequence; identical to SEQ ID NO: 165381
  Description of Artificial Sequence: Synthetic coding sequence

SEQ ID NO: 165393 - DNA, 567 bp, Artificial Sequence; identical to SEQ ID NO: 165381
  Description of Artificial Sequence: Synthetic coding sequence

SEQ ID NO: 165394 - DNA, 762 bp, Artificial Sequence; identical to SEQ ID NO: 165379
  Description of Artificial Sequence: Synthetic coding sequence

SEQ ID NO: 165395 - DNA, 762 bp, Artificial Sequence; identical to SEQ ID NO: 165379
  Description of Artificial Sequence: Synthetic coding sequence

SEQ ID NO: 165396 - DNA, 762 bp, Artificial Sequence; identical to SEQ ID NO: 165379
  Description of Artificial Sequence: Synthetic coding sequence

SEQ ID NO: 165397 - DNA, 762 bp, Artificial Sequence; identical to SEQ ID NO: 165379
  Description of Artificial Sequence: Synthetic coding sequence

SEQ ID NO: 165398 - DNA, 762 bp, Artificial Sequence; identical to SEQ ID NO: 165379
  Description of Artificial Sequence: Synthetic coding sequence

SEQ ID NO: 165399 - DNA, 762 bp, Artificial Sequence; identical to SEQ ID NO: 165379
  Description of Artificial Sequence: Synthetic coding sequence

SEQ ID NO: 165400 - DNA, 1344 bp, Artificial Sequence
  Description of Artificial Sequence: Synthetic coding sequence
atgaggtctgtgtcctatgtgcagagggtggccctggagttcagcggcagcctcttcccccacgccatctgcctgggagatgtggacaatgacaccctgaatgagctggtggtgggggacaccagcggcaaggtgtctgtgtacaagaatgatgacagccggccctggctgacctgcagctgccagggcatgctgacctgtgtgggcgtgggagatgtgtgcaacaagggcaagaacctgctggtggccgtgtctgctgagggctggttccacctgtttgacctgaccccagccaaggtgctggatgccagcggccaccacgagaccctgattggagaggagcagaggcctgtgttcaagcagcacatcccagccaacaccaaggtgatgctgatcagtgacattgatggagatggctgccgggagctggtggtgggctacacagacagagtggtgcgggccttccgctgggaggagctgggggagggccctgagcacctgaccggccagctggtgtccctgaagaagtggatgctggagggccaggtggacagcctgtctgtgaccctgggccccctgggcctgcctgagctgatggtgtcccagcccggctgtgcctatgccatcctgctgtgcacctggaagaaggacaccggcagccccccagccagcgagggccccacagatggcagccgggagaccccagctgccagagatgtggtgctgcaccagaccagcggccgcatccacaacaagaatgtgtccacccacctgattggcaacatcaagcagggccacggcacagagagcagcggcagcggcctgtttgccctgtgcaccctggatggcaccctgaagctgatggaggagatggaggaggccgacaagctgctgtggagcgtgcaggtggaccaccagctgtttgccctggagaagctggatgtgactggaaatggccacgaggaggtggtggcctgtgcctgggatggccagacctacatcatcgaccacaacagaacagtggtgcgcttccaggtggatgagaacatccgggccttctgtgccggcctgtatgcctgcaaggagggcaggaacagcccctgcctggtgtatgtgaccttcaaccagaagatctacgtgtactgggaggtgcagctggagaggatggagagcaccaacctggtgaagctgctggagaccaagccagagtaccacagcctgctgcaggagctgggcgtggaccctgatgacctgcctgtgacccgggccctgctgcaccagaccctgtaccacccagaccagcccccccagtgtgcccccagcagcctgcaggaccccacctag

SEQ ID NO: 165401 - DNA, 381 bp, Artificial Sequence
  Description of Artificial Sequence: Synthetic coding sequence
atgctgctggtgctgctgtctgtggtgctgctggccctgagcagcgcccagagcacagacaatgatgtgaactatgaggacttcaccttcaccatcccagatgtggaggacagctacctggaccccctggtgattgtggtgaccaagatgatggtgctgagccgggaccaccagaaccaggaggccatcacagccatcctgccccacctgctcttcaagatcagcaatgaccacccagatgaagatactgtgaacagcctgtacccagacttcctgctgagcgcctgcaggaagcaccaccacagcagccggggcacagaccagcaggacatccccaggagcaaccacagcggcaacctggagttcagcggcaggaagtag

SEQ ID NO: 165402 - DNA, 198 bp, Artificial Sequence
  Description of Artificial Sequence: Synthetic coding sequence
atgctgctggtgctgctgtctgtggtgctgctggccctgagcagcgcccagagcacagacaatgatgtgaactatgaggacttcaccttcaccatcccagcctgcaggaagcaccaccacagcagccggggcacagaccagcaggacatccccaggagcaaccacagcggcaacctggagttcagcggcaggaagtag

SEQ ID NO: 165403 - DNA, 696 bp, Artificial Sequence
  Description of Artificial Sequence: Synthetic coding sequence
atggctgtgttcctggaggccaaggatgcccacagcgtgctgaagcgcttcccccgggccaatgagttcctggaggagctgcggcagggcaccatcgagcgggagtgcatggaggagatctgcagctatgaggaggtgaaggaggtgtttgagaacaaggagaagaccatggagttctggaagggctacccaaatgctgtgtacagcgtgcgggaccccagccagagcagtgatgccatgtatgtggtggtgcccctgctgggcgtggccctgctgattgtgattgccctcttcatcatctggcgctgccagctgcagaaggccaccaggcaccaccccagctatgcccagaaccgctacctggccagcagagctggccacaccctgccccgggtgatggtgtaccggggcaccgtgcacagccagggcgagcccagcggccaccgggaggccgccaacagcccccaggtggtgctgggccccagccggggcggccgcaccaccgtgcggctggagagcaccctgtacctgcctgagctgagcctgagccggctgagcagcaccaccccacctccttcctatgaggaggtgacagccccccaggagagcagcagcgaggaggcctctgtgtcctacagcgaccccccacccaagtatgaggagatcgtggccgccaaccctggagctgacaagtag

SEQ ID NO: 165404 - DNA, 309 bp, Artificial Sequence
  Description of Artificial Sequence: Synthetic coding sequence
atggccggcctgagccgggccctgagcagcgtcttcctggaggccaaggatgcccacagcgtgctgaagcgcttcccccgggccaatgagttcctggaggagctgcggcagggcaccatcgagcgggagtgcatggaggagatctgcagctatgaggaggtgaaggaggtgtttgagaacaaggagaagacagcctgcaccaccctgggcctggtgctgggcgtgggcgtggccagcggcatcgccaggacaggccctggaaatgctgaccagagcgaggccaggaaggacacccagcccaaggcctag

SEQ ID NO: 165405 - DNA, 276 bp, Artificial Sequence
  Description of Artificial Sequence: Synthetic coding sequence
gaccccagccagagcagtgatgccatgtatgtggtggtgcccctgctgggcgtggccctgctgattgtcatcgccctcttcatcatctggcgctgccagctgcagaaggccaccaggcaccaccccagctatgcccagaacagacgctgctttgctgtgcggctggccgcccccagctttgccagcaagtacagcaatgtgggcgccttccccttccggctgtgggccgccagcctgagcctggcccgcatctacctgaccaacatccccaagtag

SEQ ID NO: 165406 - DNA, 159 bp, Artificial Sequence
  Description of Artificial Sequence: Synthetic coding sequence
atggctgtgttcctggaggccaaggatgcccacagcgtgctgaagcgcttcccccgggccaatgagttcctggaggagctgcggcagggcaccatcgagcgggagtgcatggaggagatctgcagctatgaggaggtgaaggaggtgtttgaaaattag

SEQ ID NO: 165407 - DNA, 696 bp, Artificial Sequence; identical to SEQ ID NO: 165403
  Description of Artificial Sequence: Synthetic coding sequence

SEQ ID NO: 165408 - DNA, 681 bp, Artificial Sequence
  Description of Artificial Sequence: Synthetic coding sequence
atgttcaccctgctggtgctgctgagccagctgcccaccgtgaccctgggcttcccccactgtgcccggggccccaaggccagcaagcatgctggggaggaggtgttcaccagcaaggaggaggccaacttcttcatccaccggcggctgctgtacaacagatttgacctggagctgttcaccccaggcaacctggagcgggagtgcaatgaggagctgtgcaactatgaggaggcccgggagatctttgtggatgaggacaagaccatcgccttctggcaggagtacagcgccaagggccccaccaccaagagtgatggcaaccgggagaagattgatgtgatgggcctgctgaccggcctgattgctgctggggtcttcctggtgatcttcggcctgctgggctactacctgtgcatcaccaagtgcaaccggctgcagcacccctgcagcagcgctgtgtatgagcggggccgccacacccccagcatcatcttcagaagacctgaggaggccgccctgagccccctgccccccagcgtggaggatgctggcctgcccagctatgagcaggccgtggccctgaccaggaagcacagcgtgtccccacctccaccctacccaggccacaccaagggcttccgggtcttcaagaagtccatgagcctgcccagccactag

SEQ ID NO: 165409 - DNA, 375 bp, Artificial Sequence
  Description of Artificial Sequence: Synthetic coding sequence
atgctgctgcgggacctggtgctgcggcggggctgctgctggagcagcctgctgctgcactgtgccctgcaccccctgtggggctttgtgcaggtgacccacggggagccccagaagagctgcagcaaggtgacagacagctgccgccacgtgtgccagtgccggcccccaccacccctgcccccacctcctcctcctcctcctccaccccggctgctgagcgccccagcccccaacagcaccagctgccccacagaggagagctggtggagcggcctggtgatcatcatcgctgtgtgctgtgccagcctggtgttcctgactgtgctggtgatcatctgctacaaggccatcaagaggaaccacgccatctag

SEQ ID NO: 165410 - DNA, 462 bp, Artificial Sequence
  Description of Artificial Sequence: Synthetic coding sequence
atgctgctgcgggacctggtgctgcggcggggctgctgctggagcagcctgctgctgcactgtgccctgcaccccctgtggggctttgtgcaggtgacccacggggagccccagaagagctgcagcaaggtgacagacagctgccgccacgtgtgccagtgccggcccccaccacccctgcccccacctcctcctcctcctcctccaccccggctgctgagcgccccagcccccaacagcaccagctgccccacagaggagagctggtggagcggcctggtgatcatcatcgctgtgtgctgtgccagcctggtgttcctgactgtgctggtgatcatctgctacaaggccatcaagaggaagcccctgaggaaggatgaaaatggcacctctgtggccgagtaccccatgtctgccagccagagcaacaagggcgtggatgtgaacaatgctgtggtgtag

SEQ ID NO: 165411 - DNA, 462 bp, Artificial Sequence; identical to SEQ ID NO: 165410
  Description of Artificial Sequence: Synthetic coding sequence

SEQ ID NO: 165412 - DNA, 828 bp, Artificial Sequence
  Description of Artificial Sequence: Synthetic coding sequence
atgtggagggctggctccatgtctgctgagctgggcgtgggctgtgccctgcgggctgtgaatgaaagagtgcagcaggccgtggcccggcggccccgggacctgcctgccatccagccccggctggtggccgtgtccaagaccaagccagctgacatggtgattgaggcctacggccacggccagaggacctttggagaaaattatgtgcaggagctgctggagaaggccagcaaccccaagatcctgagcctgtgcccagagatcaagtggcacttcatcggccacctgcagaagcagaatgtgaacaagctgatggctgtgcccaacctcttcatgctggagaccgtggacagcgtgaagctggccgacaaggtgaacagctcctggcagaggaagggcagccctgagcggctgaaggtgatggtgcagatcaacaccagcggggaggagagcaagcacggcctgcccccatctgagaccatcgccatcgtggagcacatcaatgccaagtgccccaacctggagtttgtgggcctgatgaccatcggcagctttggacatgacctgagccagggccccaacccagacttccagctgctgctgagcctgcgggaggagctgtgcaagaagctgaacatcccagctgaccaggtggagctgtccatgggcatgtctgctgacttccagcacgctgtggaggtgggcagcaccaacgtgcgcatcggcagcaccatctttggagagcgggactacagcaagaagcccaccccagacaagtgtgccgcagatgtgaaggcccccctggaggtggcccaggagcactag

SEQ ID NO: 165413 - DNA, 1149 bp, Artificial Sequence
  Description of Artificial Sequence: Synthetic coding sequence
atgaggagccccctgtgctggctgctgcccctgctgatcctggcctctgtggcccagggccagcccacccggcggccccggcccggcaccggccctggccggcggccccggccccggccccggcccacccccagcttcccccagccagatgagcctgctgagcccacagacctgcccccacccctgcccccaggcccccccagcatcttcccagactgcccccgggagtgctactgccccccagacttccccagcgccctgtactgtgacagcaggaacctgaggaaggtgcctgtgattcctccccgcatccactacctgtacctgcagaacaacttcatcacagagctgcctgtggagagcttccagaatgccaccggcctgcgctggatcaacctggacaacaaccgcatcaggaagattgaccagagggtgctggagaagctgcccggcctggtgttcctgtacatggagaagaaccagctggaggaggtgcccagcgccctgcccaggaacctggagcagctgcggctgagccagaaccacatcagccgcatccccccaggagtcttcagcaagctggagaacctgctgctgctggacctgcagcacaaccggctgagtgatggagtcttcaagccagacaccttccacggcctgaagaacctgatgcagctgaacctggcccacaacatcctgaggaagatgccaccccgggtgcccacagccatccaccagctgtacctggacagcaacaagattgagaccatccccaacggctacttcaagagcttccccaacctggccttcatccggctgaactacaacaagctgacagaccggggcctgcccaagaacagcttcaacatcagcaacctgctggtgctgcacctgagccacaaccgcatcagctctgtgcctgccatcaacaaccggctggagcacctgtacctgaacaacaacagcattgagaagatcaatggcacccagatctgccccaatgacctggtggccttccatgacttcagcagtgacctggagaatgtgccccacctgcgctacctgcggctggatggcaactacctgaagccacccatccccctggacctgatgatgtgcttccggctgctgcagagcgtggtgatctag

SEQ ID NO: 165414 - DNA, 1002 bp, Artificial Sequence
  Description of Artificial Sequence: Synthetic coding sequence
atggaggacctggaggaggatgtgcgcttcatcgtggatgagaccctggactttggaggcctgagccccagcgacagccgggaggaggaggacatcaccgtgctggtgaccccagagaagcccctgcggcggggcctgagccacagaagtgaccccaatgctgtggccccagccccccagggcgtgcggctgagcctgggccccctgagccctgagaagctggaggagatcctggatgaggccaaccggctggccgcccagctggagcagtgtgccctgcaggaccgggagagcgctggggagggcctgggcccccggcgggtgaagcccagcccccggcgggagacctttgtgctgaaggacagccctgtgcgggacctgctgcccaccgtgaacagcctgaccaggagcacccccagccccagcagcctgaccccccggctgcggagcaatgacaggaagggctctgtgcgggccctgcgggccaccagcggcaagaggcccagcaacatgaagcgggagagccccacctgcaacctcttccctgccagcaagagccctgccagcagccccctgaccaggagcaccccacctgtgcggggccgggccggccccagcggccgggccgccgccagcccccccacccccatccgctctgtgctggccccccagcccagcaccagcaacagccagaggctgccccggccccagggcgccgccgccaagagcagcagccagctgcccatccccagcgccatccccaggcctgccagcaggatgcccctgaccagccgctctgtgcccccaggccgcggggccctgcccccagacagcctgagcaccaggaagggcctgccccggcccagcacagctggccaccgggtgcgggagagcggccacaaggtgcctgtgtcccagaggctgaacctgcctgtgatgggcgccaccaggagcaacctgcagccccccaggaaggtggccgtgcccggccccaccaggtag

SEQ ID NO: 165415 - DNA, 933 bp, Artificial Sequence
  Description of Artificial Sequence: Synthetic coding sequence
atggaggacctggaggaggatgtgcgcttcatcgtggatgagaccctggactttggaggcctgagccccagcgacagccgggaggaggaggacatcaccgtgctggtgaccccagagaagcccctgcggcggggcctgagccacagaagtgaccccaatgctgtggccccagccccccagggcgtgcggctgagcctgggccccctgagccctgagaagctggaggagatcctggatgaggccaaccggctggccgcccagctggagcagtgtgccctgcaggaccgggagagcgctggggagggcctgggcccccggcgggtgaagcccagcccccggcgggagacctttgtgctgaaggacagccctgtgcgggacctgctgcccaccgtgaacagcctgaccaggagcacccccagccccagcagcctgaccccccggctgcggagcaatgacaggaagggctctgtgcgggccctgcgggccaccagcggcaagaggcccagcaacatgaagcgggagagccccacctgcaacctcttccctgccagcaagagccctgccagcagccccctgaccaggagcaccccacctgtgcggggccgggccggccccagcggccgggccgccgccagcgaggagaccagggctgccaagctgcgggcctgccagcccaatgccacccaccagccagaatgtgccacctggcagcgctgccccaccagcggcttctctgtgaacagcaagagggccagcaagaccaagcactgcaggacccagagcgctgggaagtggacccagggcagctgcttccctgccaccaagagcagctgccacggctgccacagccagcagagcgctgccccccaggagagcggcagccccaggacctaccaggtgaagaggagcggccagcaggcccggctgcagtag

SEQ ID NO: 165416 - DNA, 1002 bp, Artificial Sequence; identical to SEQ ID NO: 165414
  Description of Artificial Sequence: Synthetic coding sequence

SEQ ID NO: 165417 - DNA, 1002 bp, Artificial Sequence; identical to SEQ ID NO: 165414
  Description of Artificial Sequence: Synthetic coding sequence

SEQ ID NO: 165418 - DNA, 1002 bp, Artificial Sequence; identical to SEQ ID NO: 165414
  Description of Artificial Sequence: Synthetic coding sequence

SEQ ID NO: 165419 - DNA, 666 bp, Artificial Sequence
  Description of Artificial Sequence: Synthetic coding sequence
atggaggacctggaggaggatgtgcgcttcatcgtggatgagaccctggactttggaggcctgagccccagcgacagccgggaggaggaggacatcaccgtgctggtgaccccagagaagcccctgcggcggggcctgagccacagaagtgaccccaatgctgtggccccagccccccagggcgtgcggctgagcctgggccccctgagccctgagaagctggaggagatcctggatgaggccaaccggctggccgcccagctggagcagtgtgccctgcaggaccgggagagcgctggggagggcctgggcccccggcgggtgaagcccagcccccggcgggagacctttgtgctgaaggacagccctgtgcgggacctgctgcccaccgtgaacagcctgaccaggagcacccccagccccagcagcctgaccccccggctgcggagcaatgacaggaagggctctgtgcgggccctgcgggccaccagcggcaagaggcccagcaacatgaagcgggagagccccacctgcaacctcttccctgccagcaagagccctgccagcagccccctgaccaggagcaccccacctgtgcggggccgggccggccccagcggccgggccgccgccagcgaggagaccagggctgccaagctgaggtag

SEQ ID NO: 165420 - DNA, 699 bp, Artificial Sequence
  Description of Artificial Sequence: Synthetic coding sequence
atggaggacctggaggaggatgtgcgcttcatcgtggatgagaccctggactttggaggcctgagccccagcgacagccgggaggaggaggacatcaccgtgctggtgaccccagagaagcccctgcggcggggcctgagccacagaagtgaccccaatgctgtggccccagccccccagggcgtgcggctgagcctgggccccctgagccctgagaagctggaggagatcctggatgaggccaaccggctggccgcccagctggagcagtgtgccctgcaggaccgggagagcgctggggagggcctgggcccccggcgggtgaagcccagcccccggcgggagacctttgtgctgaaggacagccctgtgcgggacctgctgcccaccgtgaacagcctgaccaggagcacccccagccccagcagcctgaccccccggctgcggagcaatgacaggaagggctctgtgcgggccctgcgggccaccagcggcaagaggcccagcaacatgaagcgggagagccccacctgcaacctcttccctgccagcaagagccctgccagcagccccctgaccaggagcaccccacctgtgcggggccgggccggccccagcggccgggccgccgccagcccccccacccccatccgctctgtgctggccccccagcccagcaccagcaacagccagaggtag

SEQ ID NO: 165421 - DNA, 1092 bp, Artificial Sequence
  Description of Artificial Sequence: Synthetic coding sequence
atggaggacctggaggaggatgtgcgcttcatcgtggatgagaccctggactttggaggcctgagccccagcgacagccgggaggaggaggacatcaccgtgctggtgaccccagagaagcccctgcggcggggcctgagccacagaagtgaccccaatgctgtggccccagccccccagggcgtgcggctgagcctgggccccctgagccctgagaagctggaggagatcctggatgaggccaaccggctggccgcccagctggagcagtgtgccctgcaggaccgggagagcgctggggagggcctgggcccccggcgggtgaagcccagcccccggcgggagacctttgtgctgaaggacagccctgtgcgggacctgctgcccaccgtgaacagcctgaccaggagcacccccagccccagcagcctgaccccccggctgcggagcaatgacaggaagggctctgtgcgggccctgcgggccaccagcggcaagaggcccagcaacatgaagcgggagagccccacctgcaacctcttccctgccagcaagagccctgccagcagccccctgaccaggagcaccccacctgtgcggggccgggccggccccagcggccgggccgccgccagcgaggagaccagggctgccaagctgcgggtgtctggcagcggggagtttgtgggcctgaccctgaagttcctgcaccccagccccccaggcccccccacccccatccgctctgtgctggccccccagcccagcaccagcaacagccagaggctgccccggccccagggcgccgccgccaagagcagcagccagctgcccatccccagcgccatccccaggcctgccagcaggatgcccctgaccagccgctctgtgcccccaggccgcggggccctgcccccagacagcctgagcaccaggaagggcctgccccggcccagcacagctggccaccgggtgcgggagagcggccacaaggtgcctgtgtcccagaggctgaacctgcctgtgatgggcgccaccaggagcaacctgcagccccccaggaaggtggccgtgcccggccccaccaggtag

SEQ ID NO: 165422 - DNA, 273 bp, Artificial Sequence
  Description of Artificial Sequence: Synthetic coding sequence
atgaggcggctgctgctggtgaccagcctggtggtggtgctgctgtgggaggccggggctgtgcctgcccccaaggtgcccatcaagatgcaggtgaagcactggcccagcgagcaggaccctgagaaggcctggggcgcccgggtggtggagcccccagagaaggatgaccagctggtggtgctcttccctgtgcagaagcccaagctgctgaccacagaggagaagccccggggcaccaaggcctggatggagagccgggcccggccctag

SEQ ID NO: 165423 - DNA, 459 bp, Artificial Sequence
  Description of Artificial Sequence: Synthetic coding sequence
atgaggcggctgctgctggtgaccagcctggtggtggtgctgctgtgggaggccggggctgtgcctgcccccaaggtgcccatcaagatgcaggtgaagcactggcccagcgagcaggaccctgagaacagagcctggggcgcccgggtggtggagcccccagagaaggatgaccagctggtggtgctcttccctgtgcagaagcccaagctgctgaccacagaggagaagccccggggccagggccggggccccatcctgcccggcaccaaggcctggatggagacagaggacaccctgggccacgtgctgagccctgagccagaccatgacagcctgtaccaccccccacctgaggaggaccagggcgaggagcggccccggctgtgggtgatgcccaaccaccaggtgctgctgggccctgaggaggaccaggaccacatctaccacccccagtag

SEQ ID NO: 165424 - DNA, 456 bp, Artificial Sequence
  Description of Artificial Sequence: Synthetic coding sequence
atgaggcggctgctgctggtgaccagcctggtggtggtgctgctgtgggaggccggggctgtgcctgcccccaaggtgcccatcaagatgcaggtgaagcactggcccagcgagcaggaccctgagaaggcctggggcgcccgggtggtggagcccccagagaaggatgaccagctggtggtgctcttccctgtgcagaagcccaagctgctgaccacagaggagaagccccggggccagggccggggccccatcctgcccggcaccaaggcctggatggagacagaggacaccctgggccacgtgctgagccctgagccagaccatgacagcctgtaccaccccccacctgaggaggaccagggcgaggagcggccccggctgtgggtgatgcccaaccaccaggtgctgctgggccctgaggaggaccaggaccacatctaccacccccagtag

SEQ ID NO: 165425 - DNA, 429 bp, Artificial Sequence
  Description of Artificial Sequence: Synthetic coding sequence
atgaggcggctgctgctggtgaccagcctggtggtggtgctgctgtgggaggccggggctgtgcctgcccccaaggtgcccatcaagatgcaggtgaagcactggcccagcgagcaggaccctgagaaggcctggggcgcccgggtggtggagcccccagagaaggatgaccagctggtggtgctcttccctgtgcagaagcccaagctgctgaccacagaggagaagccccggggcaccaaggcctggatggagacagaggacaccctgggccacgtgctgagccctgagccagaccatgacagcctgtaccaccccccacctgaggaggaccagggcgaggagcggccccggctgtgggtgatgcccaaccaccaggtgctgctgggccctgaggaggaccaggaccacatctaccacccccagtag

SEQ ID NO: 165426 - DNA, 6474 bp, Artificial Sequence
  Description of Artificial Sequence: Synthetic coding sequence
atgtctgacagaagtggccccacagccaagggcaaggatggcaagaagtacagcagcctgaacctgtttgacacctacaagggcaagagcctggagatccagaagccagctgtggcccccaggcatggcctgcagagcctgggcaaggtggccatcgcccggaggatgcctcctccagccaacctgcccagcctgaaggccgagaacaagggaaatgaccccaacgtgtccctggtgcccaaggatggcaccggctgggccagcaagcaggagcagagcgaccccaagagcagtgatgccagcacagcccagcccccagagagccagcccctgcctgccagccagaccccagccagcaaccagcccaagaggcctcctgctgcccctgagaacacccccctggtgcccagcggcgtgaagtcctgggcccaggcctctgtgacccatggagcccatggagatggcggccgggccagcagcctgctgagccgcttcagccgggaggagttccccaccctgcaggccgccggggaccaggacaaggccgccaaggagcgggagagcgctgagcagagcagcggccctggccccagcctgcggccccagaacagcaccacctggagagatggcggcggccggggcccagatgagctggagggccctgacagcaagctgcaccacggccatgacccccggggcggcctgcagcccagcggccccccccagttccccccctaccggggcatgatgccacccttcatgtacccaccctacctgcccttccccccaccctacggcccccagggcccctaccgctaccccaccccagatggccccagccgcttcccccgggtggccggcccccggggcagcggcccccccatgaggctggtggagcctgtgggccggcccagcatcctgaaggaggacaacctgaaggagtttgaccagctggaccaggagaatgatgatggctgggccggggcccacgaggaggtggactacacagagaagctgaagttcagtgatgaagaagatggccgggacagtgatgaggagggcgctgagggccaccgggacagccagagcgccagcggggaggagcggcccccagaggctgatggcaagaagggcaacagccccaacagcgagccccccacccccaagacagcctgggccgagaccagccggcccccagagacagagcccggccccccagcccccaagccacccctgcccccaccccaccggggccctgctggcaactggggccccccaggggactacccagacagaggaggccccccctgcaagcccccagccccagaagatgaagatgaggcctggaggcagaggaggaagcagagcagcagcgagatcagcctggccgtggagcgggccaggagaagaagagaggaggaggagaggaggatgcaggaggagcggcgggccgcctgtgccgagaagctgaagaggctggatgagaagtttggagccccagacaagaggctgaaggccgagcctgctgcccctcctgctgcccccagcaccccagcccctcctcctgctgtgcccaaggagctgcctgcccccccagcccctcctccagccagcgcccccaccccagagacagagcctgaggagcccgcccaggcccccccagcccagagcacccccaccccaggagtggccgccgcccccaccctggtgtctgggggcggcagcaccagcagcaccagcagcggcagctttgaggccagccctgtggagccccagctgcccagcaaggagggccctgagcccccagaggaggtgcccccacccaccaccccacctgtgcccaaggtggagcccaagggagatggcatcggccccacccggcagccccccagccagggcctgggctaccccaagtaccagaagagcctgcccccacgcttccagaggcagcagcaggagcagctgctgaagcagcagcagcagcaccagtggcagcagcaccagcagggcagcgccccacccacccctgtgccccccagccccccccagcctgtgaccctgggcgctgtgcctgccccccaggcccctcctcctccacccaaggccctgtacccaggggccctgggccggcccccacccatgccacccatgaactttgacccccgctggatgatgatccccccctacgtggacccccggctgctgcagggccggccccccctggacttctacccacctggggtgcaccccagcggcctggtgccccgggagaggagtgacagcggcggcagcagcagcgagccctttgacagacatgccccagccatgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgaccggccctgaggccggcaggaagccagcccggggcgtgggcagcggcggccagggccccccacctccaagaagagagagcaggacagagacccgctggggcccccggcccggcagcagccggcggggcatccccccagaggagcccggggcccccccaagaagagctggccccatcaagaagcccccaccacccaccaaggtggaggagctgccccccaagcccctggagcagggagatgagacccccaagccacccaagccagaccccctgaagatcaccaagggcaagctgggcggccccaaggagaccccacccaacggcaacctgagccctgccccccggctgcggcgggactacagctatgagcgggtgggccccaccagctgccggggccggggccgcggggagtactttgcccggggccggggcttccggggcacctacggcggccggggccgcggggcccggagccgggagttccgcagctaccgggagttcagaggagatgatggccggggcggcggcaccggcggccccaaccaccccccagccccccggggccgcacagccagcgagaccaggtctgagggctctgaatatgaggagatccccaagagaagacggcagaggggcagcgagaccggcagcgagacccatgaaagtgacctggcccccagcgacaaggaggcccccacccccaaggagggcaccctgacccaggtgcccctggcccctcctcctcctggggccccacccagccctgccccagcccgcttcaccgcccggggcggccgggtcttcaccccccggggcgtgcccagcagaagaggccggggcggcggccggcccccaccccaggtgtgccccggctggagccccccagccaagagcctggcccccaagaagcccccaacaggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagccaccccgcttccggcggctgaagcaggagagagaaaatgctgcccggggcagcgagggcaagcccagcctgaccctgcctgccagcgcccctggccctgaggaggccctgaccaccgtgacagtggccccagccccccggcgggctgctgccaagagcccagacctgagcaaccagaacagcgaccaggccaatgaggagtgggagacagccagcgagagcagtgacttcaccagcgagcggcggggggacaaggaggcccctcctcctgtgctgctgacccccaaggctgtgggcacccctgggggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcactggacctggccgcggggacaagaggtcctggcccagccccaagaacagaagccggcccccagaggagaggcctcctggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggcctgccccaggccccccagggccccagcccccggccccccaccaggtatgagccccagagggtgaacagcggcctgagcagtgacccccactttgaggagcccggccccatggtgcggggcgtgggcggcaccccccgggacagcgctggggtgagccccttcccccccaagaggcgggagcggccccccaggaagccagagctgctgcaggaggagagcctgcccccaccccacagcagcggcttcctgggcagcaagccagagggccctggcccccaggccgagagccgggacacaggaacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccccggcggcccccaccagcccctcatgatggagacaggaaggagctgccccgggagcagcccctgcccccaggccccatcggcacagagaggagccagaggacagaccggggcacagagcccggccccatccggcccagccaccggcccggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatctctggaggagccatggacagccagctgcaccccaacagcggcggcttccggcccggcacccccagcctgcacccctaccgcagccagcccctgtacctgcccccaggccctgcccctccttctgccctgctgagcggcctggccctgaagggccagttcctggacttcagcaccatgcaggccacagagctgggcaagctgcctgctggaggagtgctgtaccccccacccagcttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagcccccccacccctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggacaggccccccaccccgggagggccccagccggcgggcagaggagcccggcagcagaggagacaaggagcccggcctgcccccaccaagatag

SEQ ID NO: 165427 - DNA, 4149 bp, Artificial Sequence
  Description of Artificial Sequence: Synthetic coding sequence
atgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgactggacctgaggccggcaggaagccagcccggggcgtgggcagcggcggccagggccccccaccaccccggcgggagagcaggacagagacccgctggggccccaggcctggcagcagcagaagaggcatccccccagaggagcccggggccccaccccggcgggccggccccatcaagaagcccccaccacccaccaaggtggaggagctgccccccaagcccctggagcagggagatgagacccccaagccacccaagccagaccccctgaagatcaccaagggcaagctgggcggccccaaggagaccccaccaaatggaaacctgagccctgccccccggctgcggcgggactacagctatgaaagagtgggccccaccagctgccggggccggggccgcggggagtactttgcccggggccggggcttccggggcacctatggaggccggggccgcggggcccggagccgggagttccgcagctaccgggagttcagaggagatgatggccggggcggcggcactggaggccccaaccaccccccagccccccggggccgcacagccagcgagaccaggtctgagggctctgaatatgaggagatccccaagagaagacggcagaggggcagcgagactggaagtgagacccatgaaagtgacctggcccccagcgacaaggaggcccccacccccaaggagggcaccctgacccaggtgcccctggcccctcctcctcctggggccccacccagccctgccccagcccgcttcaccgcccggggcggccgggtcttcaccccccggggcgtgcccagccggcggggccggggcggcggccggcccccaccccaggtgtgccccggctggagccccccagccaagagcctggcccccaagaagccacccaccggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagcccccacgcttccggcggctgaagcaggagcgggagaatgctgcccggggcagcgagggcaagcccagcctgaccctgcctgccagcgcccctggccctgaggaggccctgaccaccgtgacagtggccccagcccccaggagagctgctgccaagagcccagacctgagcaaccagaacagcgaccaggccaatgaggagtgggagacagccagcgagagcagtgacttcaccagcgagaggagaggagacaaggaggcccctcctcctgtgctgctgacccccaaggctgtgggcaccccaggcggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcacaggccctggccgcggggacaagaggtcctggcccagccccaagaacagaagcaggcctcctgaggagcggcccccaggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggcctgccccaggccccccagggccccagccccaggcctcccaccaggtatgagccccagagggtgaacagcggcctgagcagtgacccccactttgaggagcccggccccatggtgcggggcgtgggcggcaccccccgggacagcgctggggtgagccccttcccccccaagagaagagagaggcctcccaggaagccagagctgctgcaggaggagagcctgcccccaccccacagcagcggcttcctgggcagcaagccagagggccctggcccccaggccgagagccgggacaccggcacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccaagaagacctcctccagcccctcatgatggagacaggaaggagctgccccgggagcagcccctgcccccaggccccatcggcacagagaggagccagaggacagaccggggcacagagcccggccccatccggcccagccacaggcctggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatcagcggcggggccatggacagccagctgcaccccaacagcggcggcttccggcccggcacccccagcctgcacccctaccgcagccagcccctgtacctgcccccaggccctgccccacccagcgccctgctgagcggcctggccctgaagggccagttcctggacttcagcaccatgcaggccacagagctgggcaagctgcctgctgggggcgtgctgtacccacctccttccttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagcccccccacccctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggactggacctccaccccgggagggccccagcagaagagctgaggagcccggcagcagaggagacaaggagcccggcctgcccccacccaggtag

SEQ ID NO: 165428 - DNA, 6474 bp, Artificial Sequence; identical to SEQ ID NO: 165426
  Description of Artificial Sequence: Synthetic coding sequence

SEQ ID NO: 165429 - DNA, 6474 bp, Artificial Sequence
  Description of Artificial Sequence: Synthetic coding sequence
atgtctgacagaagtggccccacagccaagggcaaggatggcaagaagtacagcagcctgaacctgtttgacacctacaagggcaagagcctggagatccagaagccagctgtggcccccaggcatggcctgcagagcctgggcaaggtggccatcgcccggaggatgcctcctccagccaacctgcccagcctgaaggccgagaacaagggaaatgaccccaacgtgtccctggtgcccaaggatggcaccggctgggccagcaagcaggagcagagcgaccccaagagcagtgatgccagcacagcccagcccccagagagccagcccctgcctgccagccagaccccagccagcaaccagcccaagaggcctcctgctgcccctgagaacacccccctggtgcccagcggcgtgaagtcctgggcccaggcctctgtgacccatggagcccatggagatggcggccgggccagcagcctgctgagccgcttcagccgggaggagttccccaccctgcaggccgccggggaccaggacaaggccgccaaggagcgggagagcgctgagcagagcagcggccctggccccagcctgcggccccagaacagcaccacctggagagatggcggcggccggggcccagatgagctggagggccctgacagcaagctgcaccacggccatgacccccggggcggcctgcagcccagcggccccccccagttccccccctaccggggcatgatgccacccttcatgtacccaccctacctgcccttccccccaccctacggcccccagggcccctaccgctaccccaccccagatggccccagccgcttcccccgggtggccggcccccggggcagcggcccccccatgaggctggtggagcctgtgggccggcccagcatcctgaaggaggacaacctgaaggagtttgaccagctggaccaggagaatgatgatggctgggccggggcccacgaggaggtggactacacagagaagctgaagttcagtgatgaagaagatggccgggacagtgatgaggagggcgctgagggccaccgggacagccagagcgccagcggggaggagcggcccccagaggctgatggcaagaagggcaacagccccaacagcgagccccccacccccaagacagcctgggccgagaccagccggcccccagagacagagcccggccccccagcccccaagccacccctgcccccaccccaccggggccctgctggcaactggggccccccaggggactacccagacagaggaggccccccctgcaagcccccagccccagaagatgaagatgaggcctggaggcagaggaggaagcagagcagcagcgagatcagcctggccgtggagcgggccaggagaagaagagaggaggaggagaggaggatgcaggaggagcggcgggccgcctgtgccgagaagctgaagaggctggatgagaagtttggagccccagacaagaggctgaaggccgagcctgctgcccctcctgctgcccccagcaccccagcccctcctcctgctgtgcccaaggagctgcctgcccccccagcccctcctccagccagcgcccccaccccagagaaggagcctgaggagcccgcccaggcccccccagcccagagcacccccaccccaggagtggccgccgcccccaccctggtgtctgggggcggcagcaccagcagcaccagcagcggcagctttgaggccagccctgtggagccccagctgcccagcaaggagggccctgagcccccagaggaggtgcccccacccaccaccccacctgtgcccaaggtggagcccaagggagatggcatcggccccacccggcagccccccagccagggcctgggctaccccaagtaccagaagagcctgcccccacgcttccagaggcagcagcaggagcagctgctgaagcagcagcagcagcaccagtggcagcagcaccagcagggcagcgccccacccacccctgtgccccccagccccccccagcctgtgaccctgggcgctgtgcctgccccccaggcccctcctcctccacccaaggccctgtacccaggggccctgggccggcccccacccatgccacccatgaactttgacccccgctggatgatgatccccccctacgtggacccccggctgctgcagggccggccccccctggacttctacccacctggggtgcaccccagcggcctggtgccccgggagaggagtgacagcggcggcagcagcagcgagccctttgacagacatgccccagccatgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgaccggccctgaggccggcaggaagccagcccggggcgtgggcagcggcggccagggccccccacctccaagaagagagagcaggacagagacccgctggggcccccggcccggcagcagccggcggggcatccccccagaggagcccggggcccccccaagaagagctggccccatcaagaagcccccaccacccaccaaggtggaggagctgccccccaagcccctggagcagggagatgagacccccaagccacccaagccagaccccctgaagatcaccaagggcaagctgggcggccccaaggagaccccacccaacggcaacctgagccctgccccccggctgcggcgggactacagctatgagcgggtgggccccaccagctgccggggccggggccgcggggagtactttgcccggggccggggcttccggggcacctacggcggccggggccgcggggcccggagccgggagttccgcagctaccgggagttcagaggagatgatggccggggcggcggcaccggcggccccaaccaccccccagccccccggggccgcacagccagcgagaccaggtctgagggctctgaatatgaggagatccccaagagaagacggcagaggggcagcgagaccggcagcgagacccatgaaagtgacctggcccccagcgacaaggaggcccccacccccaaggagggcaccctgacccaggtgcccctggcccctcctcctcctggggccccacccagccctgccccagcccgcttcaccgcccggggcggccgggtcttcaccccccggggcgtgcccagcagaagaggccggggcggcggccggcccccaccccaggtgtgccccggctggagccccccagccaagagcctggcccccaagaagcccccaacaggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagccaccccgcttccggcggctgaagcaggagagagaaaatgctgcccggggcagcgagggcaagcccagcctgaccctgcctgccagcgcccctggccctgaggaggccctgaccaccgtgacagtggccccagccccccggcgggctgctgccaagagcccagacctgagcaaccagaacagcgaccaggccaatgaggagtgggagacagccagcgagagcagtgacttcaccagcgagcggcggggggacaaggaggcccctcctcctgtgctgctgacccccaaggctgtgggcacccctgggggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcactggacctggccgcggggacaagaggtcctggcccagccccaagaacagaagccggcccccagaggagaggcctcctggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggccccccccaggccccccagggccccagcccccggccccccaccaggtatgagccccagagggtgaacagcggcctgagcagtgacccccactttgaggagcccggccccatggtgcggggcgtgggcggcaccccccgggacagcgctggggtgagccccttcccccccaagaggcgggagcggccccccaggaagccagagctgctgcaggaggagagcctgcccccaccccacagcagcggcttcctgggcagcaagccagagggccctggcccccaggccgagagccgggacacaggaacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccccggcggcccccaccagcccctcatgatggagacaggaaggagctgccccgggagcagcccctgcccccaggccccatcggcacagagaggagccagcacacagaccggggcacagagcccggccccatccggcccagccaccggcccggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatctctggaggagccatggacagccagctgcaccccaacagcggcggcttccggcccggcacccccagcctgcacccctaccgcagccagcccctgtacctgcccccaggccctgcccctccttctgccctgctgtctggagtggccctgaagggccagttcctggacttcagcaccatgcaggccacagagctgggcaagctgcctgctggaggagtgctgtaccccccacccagcttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagccccacccagcctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggacaggccccccaccccgggagggccccagccggcgggcagaggagcccggcagcagaggagacaaggagcccggcctgcccccaccaagatag

SEQ ID NO: 165430 - DNA, 6474 bp, Artificial Sequence; identical to SEQ ID NO: 165429
  Description of Artificial Sequence: Synthetic coding sequence

SEQ ID NO: 165431 - DNA, 6474 bp, Artificial Sequence
  Description of Artificial Sequence: Synthetic coding sequence
atgtctgacagaagtggccccacagccaagggcaaggatggcaagaagtacagcagcctgaacctgtttgacacctacaagggcaagagcctggagatccagaagccagctgtggcccccaggcatggcctgcagagcctgggcaaggtggccatcgcccggaggatgcctcctccagccaacctgcccagcctgaaggccgagaacaagggaaatgaccccaacgtgtccctggtgcccaaggatggcaccggctgggccagcaagcaggagcagagcgaccccaagagcagtgatgccagcacagcccagcccccagagagccagcccctgcctgccagccagaccccagccagcaaccagcccaagaggcctcctgctgcccctgagaacacccccctggtgcccagcggcgtgaagtcctgggcccaggcctctgtgacccatggagcccatggagatggcggccgggccagcagcctgctgagccgcttcagccgggaggagttccccaccctgcaggccgccggggaccaggacaaggccgccaaggagcgggagagcgctgagcagagcagcggccctggccccagcctgcggccccagaacagcaccacctggagagatggcggcggccggggcccagatgagctggagggccctgacagcaagctgcaccacggccatgacccccggggcggcctgcagcccagcggccccccccagttccccccctaccggggcatgatgccacccttcatgtacccaccctacctgcccttccccccaccctacggcccccagggcccctaccgctaccccaccccagatggccccagccgcttcccccgggtggccggcccccggggcagcggcccccccatgaggctggtggagcctgtgggccggcccagcatcctgaaggaggacaacctgaaggagtttgaccagctggaccaggagaatgatgatggctgggccggggcccacgaggaggtggactacacagagaagctgaagttcagtgatgaagaagatggccgggacagtgatgaggagggcgctgagggccaccgggacagccagagcgccagcggggaggagcggcccccagaggctgatggcaagaagggcaacagccccaacagcgagccccccacccccaagacagcctgggccgagaccagccggcccccagagacagagcccggccccccagcccccaagccacccctgcccccaccccaccggggccctgctggcaactggggccccccaggggactacccagacagaggaggccccccctgcaagcccccagccccagaagatgaagatgaggcctggaggcagaggaggaagcagagcagcagcgagatcagcctggccgtggagcgggccaggagaagaagagaggaggaggagaggaggatgcaggaggagcggcgggccgcctgtgccgagaagctgaagaggctggatgagaagtttggagccccagacaagaggctgaaggccgagcctgctgcccctcctgctgcccccagcaccccagcccctcctcctgctgtgcccaaggagctgcctgcccccccagcccctcctccagccagcgcccccaccccagagacagagcctgaggagcccgcccaggcccccccagcccagagcacccccaccccaggagtggccgccgcccccaccctggtgtctgggggcggcagcaccagcagcaccagcagcggcagctttgaggccagccctgtggagccccagctgcccagcaaggagggccctgagcccccagaggaggtgcccccacccaccaccccacctgtgcccaaggtggagcccaagggagatggcatcggccccacccggcagccccccagccagggcctgggctaccccaagtaccagaagagcctgcccccacgcttccagaggcagcagcaggagcagctgctgaagcagcagcagcagcaccagtggcagcagcaccagcagggcagcgccccacccacccctgtgccccccagccccccccagcctgtgaccctgggcgctgtgcctgccccccaggcccctcctcctccacccaaggccctgtacccaggggccctgggccggcccccacccatgccacccatgaactttgacccccgctggatgatgatccccccctacgtggacccccggctgctgcagggccggccccccctggacttctacccacctggggtgcaccccagcggcctggtgccccgggagaggagtgacagcggcggcagcagcagcgagccctttgacagacatgccccagccatgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgaccggccctgaggccggcaggaagccagcccggggcgtgggcagcggcggccagggccccccacctccaagaagagagagcaggacagagacccgctggggcccccggcccggcagcagccggcggggcatccccccagaggagcccggggcccccccaagaagagctggccccatcaagaagcccccaccacccaccaaggtggaggagctgccccccaagcccctggagcagggagatgagacccccaagccacccaagccagaccccctgaagatcaccaagggcaagctgggcggccccaaggagaccccacccaacggcaacctgagccctgccccccggctgcggcgggactacagctatgagcgggtgggccccaccagctgccggggccggggccgcggggagtactttgcccggggccggggcttccggggcacctacggcggccggggccgcggggcccggagccgggagttccgcagctaccgggagttcagaggagatgatggccggggcggcggcaccggcggccccaaccaccccccagccccccggggccgcacagccagcgagaccaggtctgagggctctgaatatgaggagatccccaagagaagacggcagaggggcagcgagaccggcagcgagacccatgaaagtgacctggcccccagcgacaaggaggcccccacccccaaggagggcaccctgacccaggtgcccctggcccctcctcctcctggggccccacccagccctgccccagcccgcttcaccgcccggggcggccgggtcttcaccccccggggcgtgcccagcagaagaggccggggcggcggccggcccccaccccaggtgtgccccggctggagccccccagccaagagcctggcccccaagaagcccccaacaggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagccaccccgcttccggcggctgaagcaggagagagaaaatgctgcccggggcagcgagggcaagcccagcctgaccctgcctgccagcgcccctggccctgaggaggccctgaccaccgtgacagtggccccagccccccggcgggctgctgccaagagcccagacctgagcaaccagaacagcgaccaggccaatgaggagtgggagacagccagcgagagcagtgacttcaccagcgagcggcggggggacaaggaggcccctcctcctgtgctgctgacccccaaggctgtgggcacccctgggggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcactggacctggccgcggggacaagaggtcctggcccagccccaagaacagaagccggcccccagaggagaggcctcctggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggcctgccccaggccccccagggccccagcccccggccccccaccaggtatgagccccagagggtgaacagcggcctgagcagtgacccccactttgaggagcccggccccatggtgcggggcgtgggcggcaccccccgggacagcgctggggtgagccccttcccccccaagaggcgggagcggccccccaggaagccagagctgctgcaggaggagagcctgcccccaccccacagcagcggcttcctgggcagcaagccagagggccctggcccccaggccgagagccgggacacaggaacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccccggcggcccccaccagcccctcatgatggagacaggaaggagctgccccgggagcagcccctgcccccaggccccatcggcacagagaggagccagaggacagaccggggcacagagcccggccccatccggcccagccaccggcccggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatctctggaggagccatggacagccagctgcaccccaacagcggcggcttccggcccggcacccccagcctgcacccctaccgcagccagcccctgtacctgcccccaggccctgcccctccttctgccctgctgtctggagtggccctgaagggccagttcctggacttcagcaccatgcaggccacagagctgggcaagctgcctgctggaggagtgctgtaccccccacccagcttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagcccccccacccctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggacaggccccccaccccgggagggccccagccggcgggcagaggagcccggcagcagaggagacaaggagcccggcctgcccccaccaagatag

SEQ ID NO: 165432 - DNA, 6474 bp, Artificial Sequence
  Description of Artificial Sequence: Synthetic coding sequence
atgtctgacagaagtggccccacagccaagggcaaggatggcaagaagtacagcagcctgaacctgtttgacacctacaagggcaagagcctggagatccagaagccagctgtggcccccaggcatggcctgcagagcctgggcaaggtggccatcgcccggaggatgcctcctccagccaacctgcccagcctgaaggccgagaacaagggaaatgaccccaacgtgtccctggtgcccaaggatggcaccggctgggccagcaagcaggagcagagcgaccccaagagcagtgatgccagcacagcccagcccctggagagccagcccctgcctgccagccagaccccagccagcaaccagcccaagaggcctcctgctgcccctgagaacacccccctggtgcccagcggcgtgaagtcctgggcccaggcctctgtgacccatggagcccatggagatggcggccgggccagcagcctgctgagccgcttcagccgggaggagttccccaccctgcaggccgccggggaccaggacaaggccgccaaggagcgggagagcgctgagcagagcagcggccctggccccagcctgcggccccagaacagcaccacctggagagatggcggcggccggggcccagatgagctggagggccctgacagcaagctgcaccacggccatgacccccggggcggcctgcagcccagcggccccccccagttccccccctaccggggcatgatgccacccttcatgtacccaccctacctgcccttccccccaccctacggcccccagggcccctaccgctaccccaccccagatggccccagccgcttcccccgggtggccggcccccggggcagcggcccccccatgaggctggtggagcctgtgggccggcccagcatcctgaaggaggacaacctgaaggagtttgaccagctggaccaggagaatgatgatggctgggccggggcccacgaggaggtggactacacagagaagctgaagttcagtgatgaagaagatggccgggacagtgatgaggagggcgctgagggccaccgggacagccagagcgccagcggggaggagcggcccccagaggctgatggcaagaagggcaacagccccaacagcgagccccccacccccaagacagcctgggccgagaccagccggcccccagagacagagcccggccccccagcccccaagccacccctgcccccaccccaccggggccctgctggcaactggggccccccaggggactacccagacagaggaggccccccctgcaagcccccagccccagaagatgaagatgaggcctggaggcagaggaggaagcagagcagcagcgagatcagcctggccgtggagcgggccaggagaagaagagaggaggaggagaggaggatgcaggaggagcggcgggccgcctgtgccgagaagctgaagaggctggatgagaagtttggagccccagacaagaggctgaaggccgagcctgctgcccctcctgctgcccccagcaccccagcccctcctcctgctgtgcccaaggagctgcctgcccccccagcccctcctccagccagcgcccccaccccagagaaggagcctgaggagcccgcccaggcccccccagcccagagcacccccaccccaggagtggccgccgcccccaccctggtgtctgggggcggcagcaccagcagcaccagcagcggcagctttgaggccagccctgtggagccccagctgcccagcaaggagggccctgagcccccagaggaggtgcccccacccaccaccccacctgtgcccaaggtggagcccaagggagatggcatcggccccacccggcagccccccagccagggcctgggctaccccaagtaccagaagagcctgcccccacgcttccagaggcagcagcaggagcagctgctgaagcagcagcagcagcaccagtggcagcagcaccagcagggcagcgccccacccacccctgtgccccccagccccccccagcctgtgaccctgggcgctgtgcctgccccccaggcccctcctcctccacccaaggccctgtacccaggggccctgggccggcccccacccatgccacccatgaactttgacccccgctggatgatgatccccccctacgtggacccccggctgctgcagggccggccccccctggacttctacccacctggggtgcaccccagcggcctggtgccccgggagaggagtgacagcggcggcagcagcagcgagccctttgacagacatgccccagccatgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgaccggccctgaggccggcaggaagccagcccggggcgtgggcagcggcggccagggccccccacctccaagaagagagagcaggacagagacccgctggggcccccggcccggcagcagccggcggggcatccccccagaggagcccggggcccccccaagaagagctggccccatcaagaagcccccaccacccaccaaggtggaggagctgccccccaagcccctggagcagggagatgagacccccaagccacccaagccagaccccctgaagatcaccaagggcaagctgggcggccccaaggagaccccacccaacggcaacctgagccctgccccccggctgcggcgggactacagctatgagcgggtgggccccaccagctgccggggccggggccgcggggagtactttgcccggggccggggcttccggggcacctacggcggccggggccgcggggcccggagccgggagttccgcagctaccgggagttcagaggagatgatggccggggcggcggcaccggcggccccaaccaccccccagccccccggggccgcacagccagcgagaccaggtctgagggctctgaatatgaggagatccccaagagaagacggcagaggggcagcgagaccggcagcgagacccatgaaagtgacctggcccccagcgacaaggaggcccccacccccaaggagggcaccctgacccaggtgcccctggcccctcctcctcctggggccccacccagccctgccccagcccgcttcaccgcccggggcggccgggtcttcaccccccggggcgtgcccagcagaagaggccggggcggcggccggcccccaccccaggtgtgccccggctggagccccccagccaagagcctggcccccaagaagcccccaacaggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagccaccccgcttccggcggctgaagcaggagagagaaaatgctgcccggggcagcgagggcaagcccagcctgaccctgcctgccagcgcccctggccctgaggaggccctgaccaccgtgacagtggccccagccccccggcgggctgctgccaagagcccagacctgagcaaccagaacagcgaccaggccaatgaggagtgggagacagccagcgagagcagtgacttcaccagcgagcggcggggggacaaggaggcccctcctcctgtgctgctgacccccaaggctgtgggcacccctgggggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcactggacctggccgcggggacaagaggtcctggcccagccccaagaacagaagccggcccccagaggagaggcctcctggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggccccccccaggccccccagggccccagcccccggccccccaccaggtatgagccccagagggtgaacagcggcctgagcagtgacccccactttgaggagcccggccccatggtgcggggcgtgggcggcaccccccgggacagcgctggggtgagccccttcccccccaagaggcgggagcggccccccaggaagccagagctgctgcaggaggagagcctgcccccaccccacagcagcggcttcctgggcagcaagccagagggccctggcccccaggccgagagccgggacacaggaacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccccggcggcccccaccagcccctcatgatggagacaggaaggagctgccccgggagcagcccctgcccccaggccccatcggcacagagaggagccagaggacagaccggggcacagagcccggccccatccggcccagccaccggcccggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatctctggaggagccatggacagccagctgcaccccaacagcggcggcttccggcccggcacccccagcctgcacccctaccgcagccagcccctgtacctgcccccaggccctgcccctccttctgccctgctgtctggagtggccctgaagggccagttcctggacttcagcaccatgcaggccacagagctgggcaagctgcctgctggaggagtgctgtaccccccacccagcttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagcccccccacccctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggacaggccccccaccccgggagggccccagccggcgggcagaggagcccggcagcagaggagacaaggagcccggcctgcccccaccaagatag

SEQ ID NO: 165433 - DNA, 6474 bp, Artificial Sequence; identical to SEQ ID NO: 165429
  Description of Artificial Sequence: Synthetic coding sequence

SEQ ID NO: 165434 - DNA, 6450 bp, Artificial Sequence
  Description of Artificial Sequence: Synthetic coding sequence
atgtctgacagaagtggccccacagccaagggcaaggatggcaagaagtacagcagcctgaacctgtttgacacctacaagggcaagagcctggagatccagaagccagctgtggcccccaggcatggcctgcagagcctgggcaaggtggccatcgcccggaggatgcctcctccagccaacctgcccagcctgaaggccgagaacaagggaaatgaccccaacgtgtccctggtgcccaaggatggcaccggctgggccagcaagcaggagcagagcgaccccaagagcagtgatgccagcacagcccagcccccagagagccagcccctgcctgccagccagaccccagccagcaaccagcccaagaggcctcctgctgcccctgagaacacccccctggtgcccagcggcgtgaagtcctgggcccaggcctctgtgacccatggagcccatggagatggcggccgggccagcagcctgctgagccgcttcagccgggaggagttccccaccctgcaggccgccggggaccaggacaaggccgccaaggagcgggagagcgctgagcagagcagcggccctggccccagcctgcggccccagaacagcaccacctggagagatggcggcggccggggcccagatgagctggagggccctgacagcaagctgcaccacggccatgacccccggggcggcctgcagcccagcggccccccccagttccccccctaccggggcatgatgccacccttcatgtacccaccctacctgcccttccccccaccctacggcccccagggcccctaccgctaccccaccccagatggccccagccgcttcccccgggtggccggcccccggggcagcggcccccccatgaggctggtggagcctgtgggccggcccagcatcctgaaggaggacaacctgaaggagtttgaccagctggaccaggagaatgatgatggctgggccggggcccacgaggaggtggactacacagagaagctgaagttcagtgatgaagaagatggccgggacagtgatgaggagggcgctgagggccaccgggacagccagagcgccagcggggaggagcggcccccagaggctgatggcaagaagggcaacagccccaacagcgagccccccacccccaagacagcctgggccgagaccagccggcccccagagacagagcccggccccccagcccccaagccacccctgcccccaccccaccggggccctgctggcaactggggccccccaggggactacccagacagaggaggccccccctgcaagcccccagccccagaagatgaagatgaggcctggaggcagaggaggaagcagagcagcagcgagatcagcctggccgtggagcgggccaggagaagaagagaggaggaggagaggaggatgcaggaggagcggcgggccgcctgtgccgagaagctgaagaggctggatgagaagtttggagccccagacaagaggctgaaggccgagcctgctgcccctcctgctgcccccagcaccccagcccctcctcctgctgtgcccaaggagctgcctgcccccccagcccctcctccagccagcgcccccaccccagagacagagcctgaggagcccgcccaggcccccccagcccagagcacccccaccccaggagtggccgccgcccccaccctggtgtctgggggcggcagcaccagcagcaccagcagcggcagctttgaggccagccctgtggagccccagctgcccagcaaggagggccctgagcccccagaggaggtgcccccacccaccaccccacctgtgcccaaggtggagcccaagggagatggcatcggccccacccggcagccccccagccagggcctgggctaccccaagtaccagaagagcctgcccccacgcttccagaggcagcagcaggagcagctgctgaagcagcagcagcagcaccagtggcagcagcaccagcagggcagcgccccacccacccctgtgccccccagccccccccagcctgtgaccctgggcgctgtgcctgccccccaggcccctcctcctccacccaaggccctgtacccaggggccctgggccggcccccacccatgccacccatgaactttgacccccgctggatgatgatccccccctacgtggacccccggctgctgcagggccggccccccctggacttctacccacctggggtgcaccccagcggcctggtgccccgggagaggagtgacagcggcggcagcagcagcgagccctttgacagacatgccccagccatgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgaccggccctgaggccggcaggaagccagcccggggcgtgggcagcggcggccagggccccccacctccaagaagagagagcaggacagagacccgctggggcccccggcccggcagcagccggcggggcatccccccagaggagcccggggcccccccaagaagagctggccccatcaagaagcccccaccacccaccaaggtggaggagctgccccccaagcccctggagcagggagatgagacccccaagccacccaagccagaccccctgaagatcaccaagggcaagctgggcggccccaaggagaccccacccaacggcaacctgagccctgccccccggctgcggcgggactacagctatgagcgggtgggccccaccagctgccggggccggggccgcggggagtactttgcccggggccggggcttccggggcacctacggcggccggggcagaggagctgctggcaacagcgctgtgacagagagctttgaggagatgatgggcgtggaggtgggccagggcgaccagaccaccctgctgctgcctgaggccgccctgcctgcccggcacggggcccgggtgcagagcatgaggaagagccccagcggggccggcagcggggcccagaagcaggccgcccggcccatgagggtcatctggctgctgcagacccggcggctgccccacccccggcgggagcacagccccaggagccgcagccccaccaccaggagccccaccttccctgccccagcccgcttcaccccaggagtgggggagagcagcctgcctgagggcatcagccctggccccaggagaagagagcccccccaggtgtgccccggctggagccccccagccaagagcctggcccccaagaagcccccaacaggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagccaccccgcttccggcggctgaagcaggagagagaaaatgctgcccggggcagcgagggcaagcccagcctgaccctgcctgccagcgcccctggccctgaggaggccctgaccaccgtgacagtggccccagccccccggcgggctgctgccaagagcccagacctgagcaaccagaacagcgaccaggccaatgaggagtgggagacagccagcgagagcagtgacttcaccagcgagcggcggggggacaaggaggcccctcctcctgtgctgctgacccccaaggctgtgggcacccctgggggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcactggacctggccgcggggacaagaggtcctggcccagccccaagaacagaagccggcccccagaggagaggcctcctggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggcctgccccaggccccccagggccccagcccccggccccccaccaggtatgagccccagagggtgaacagcggcctgagcagtgacccccactttgaggagcccggccccatggtgcggggcgtgggcggcaccccccgggacagcgctggggtgagccccttcccccccaagaggcgggagcggccccccaggaagccagagctgctgcaggaggagagcctgcccccaccccacagcagcggcttcctgggcagcaagccagagggccctggcccccaggccgagagccgggacacaggaacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccccggcggcccccaccagcccctcatgatggagacaggaaggagctgccccgggagcagcccctgcccccaggccccatcggcacagagaggagccagaggacagaccggggcacagagcccggccccatccggcccagccaccggcccggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatcagcggcggccacggcctgagcatcaccagcaagcagtggaggcggcccggcacccccagcctgcacccctaccgcagccagcccctgtacctgcccccaggccctgcccctccttctgccctgctgagcggcctggccctgaagggccagttcctggacttcagcaccatgcaggccacagagctgggcaagctgcctgctggaggagtgctgtaccccccacccagcttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagcccccccacccctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggacaggccccccaccccgggagggccccagccggcgggcagaggagcccggcagcagaggagacaaggagcccggcctgcccccaccaagatag

SEQ ID NO: 165435 - DNA, 6474 bp, Artificial Sequence; identical to SEQ ID NO: 165429
  Description of Artificial Sequence: Synthetic coding sequence

SEQ ID NO: 165436 - DNA, 6474 bp, Artificial Sequence; identical to SEQ ID NO: 165429
  Description of Artificial Sequence: Synthetic coding sequence

SEQ ID NO: 165437 - DNA, 6474 bp, Artificial Sequence
  Description of Artificial Sequence: Synthetic coding sequence
atgtctgacagaagtggccccacagccaagggcaaggatggcaagaagtacagcagcctgaacctgtttgacacctacaagggcaagagcctggagatccagaagccagctgtggcccccaggcatggcctgcagagcctgggcaaggtggccatcgcccggaggatgcctcctccagccaacctgcccagcctgaaggccgagaacaagggaaatgaccccaacgtgtccctggtgcccaaggatggcaccggctgggccagcaagcaggagcagagcgaccccaagagcagtgatgccagcacagcccagcccccagagagccagcccctgcctgccagccagaccccagccagcaaccagcccaagaggcctcctgctgcccctgagaacacccccctggtgcccagcggcgtgaagtcctgggcccaggcctctgtgacccatggagcccatggagatggcggccgggccagcagcctgctgagccgcttcagccgggaggagttccccaccctgcaggccgccggggaccaggacaaggccgccaaggagcgggagagcgctgagcagagcagcggccctggccccagcctgcggccccagaacagcaccacctggagagatggcggcggccggggcccagatgagctggagggccctgacagcaagctgcaccacggccatgacccccggggcggcctgcagcccagcggccccccccagttccccccctaccggggcatgatgccacccttcatgtacccaccctacctgcccttccccccaccctacggcccccagggcccctaccgctaccccaccccagatggccccagccgcttcccccgggtggccggcccccggggcagcggcccccccatgaggctggtggagcctgtgggccggcccagcatcctgaaggaggacaacctgaaggagtttgaccagctggaccaggagaatgatgatggctgggccggggcccacgaggaggtggactacacagagaagctgaagttcagtgatgaagaagatggccgggacagtgatgaggagggcgctgagggccaccgggacagccagagcgccagcggggaggagcggcccccagaggctgatggcaagaagggcaacagccccaacagcgagccccccacccccaagacagcctgggccgagaccagccggcccccagagacagagcccggccccccagcccccaagccacccctgcccccaccccaccggggccctgctggcaactggggccccccaggggactacccagacagaggaggccccccctgcaagcccccagccccagaagatgaagatgaggcctggaggcagaggaggaagcagagcagcagcgagatcagcctggccgtggagcgggccaggagaagaagagaggaggaggagaggaggatgcaggaggagcggcgggccgcctgtgccgagaagctgaagaggctggatgagaagtttggagccccagacaagaggctgaaggccgagcctgctgcccctcctgctgcccccagcaccccagcccctcctcctgctgtgcccaaggagctgcctgcccccccagcccctcctccagccagcgcccccaccccagagaaggagcctgaggagcccgcccaggcccccccagcccagagcacccccaccccaggagtggccgccgcccccaccctggtgtctgggggcggcagcaccagcagcaccagcagcggcagctttgaggccagccctgtggagccccagctgcccagcaaggagggccctgagcccccagaggaggtgcccccacccaccaccccacctgtgcccaaggtggagcccaagggagatggcatcggccccacccggcagccccccagccagggcctgggctaccccaagtaccagaagagcctgcccccacgcttccagaggcagcagcaggagcagctgctgaagcagcagcagcagcaccagtggcagcagcaccagcagggcagcgccccacccacccctgtgccccccagccccccccagcctgtgaccctgggcgctgtgcctgccccccaggcccctcctcctccacccaaggccctgtacccaggggccctgggccggcccccacccatgccacccatgaactttgacccccgctggatgatgatccccccctacgtggacccccggctgctgcagggccggccccccctggacttctacccacctggggtgcaccccagcggcctggtgccccgggagaggagtgacagcggcggcagcagcagcgagccctttgacagacatgccccagccatgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgaccggccctgaggccggcaggaagccagcccggggcgtgggcagcggcggccagggccccccacctccaagaagagagagcaggacagagacccgctggggcccccggcccggcagcagccggcggggcatccccccagaggagcccggggcccccccaagaagagctggccccatcaagaagcccccaccacccaccaaggtggaggagctgccccccaagcccctggagcagggagatgagacccccaagccacccaagccagaccccctgaagatcaccaagggcaagctgggcggccccaaggagaccccacccaacggcaacctgagccctgccccccggctgcggcgggactacagctatgagcgggtgggccccaccagctgccggggccggggccgcggggagtactttgcccggggccggggcttccggggcacctacggcggccggggccgcggggcccggagccgggagttccgcagctaccgggagttcagaggagatgatggccggggcggcggcaccggcggccccaaccaccccccagccccccggggccgcacagccagcgagaccaggtctgagggctctgaatatgaggagatccccaagagaagacggcagaggggcagcgagaccggcagcgagacccatgaaagtgacctggcccccagcgacaaggaggcccccacccccaaggagggcaccctgacccaggtgcccctggcccctcctcctcctggggccccacccagccctgccccagcccgcttcaccgcccggggcggccgggtcttcaccccccggggcgtgcccagcagaagaggccggggcggcggccggcccccaccccaggtgtgccccggctggagccccccagccaagagcctggcccccaagaagcccccaacaggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagccaccccgcttccggcggctgaagcaggagagagaaaatgctgcccggggcagcgagggcaagcccagcctgaccctgcctgccagcgcccctggccctgaggaggccctgaccaccgtgacagtggccccagccccccggcgggctgctgccaagagcccagacctgagcaaccagaacagcgaccaggccaatgaggagtgggagacagccagcgagagcagtgacttcaccagcgagcggcggggggacaaggaggcccctcctcctgtgctgctgacccccaaggctgtgggcacccctgggggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcactggacctggccgcggggacaagaggtcctggcccagccccaagaacagaagccggcccccagaggagaggcctcctggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggccccccccaggccccccagggccccagcccccggccccccaccaggtatgagccccagagggtgaacagcggcctgagcagtgacccccactttgaggagcccggccccatggtgcggggcgtgggcggcaccccccgggacagcgctggggtgagccccttcccccccaagaggcgggagcggccccccaggaagccagagctgctgcaggaggagagcctgcccccaccccacagcagcggcttcctgggcagcaagccagagggccctggcccccaggccgagagccgggacacaggaacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccccggcggcccccaccagcccctcatgatggagacaggaaggagctgccccgggagcagcccctgcccccaggccccatcggcacagagaggagccagaggacagaccggggcacagagcccggccccatccggcccagccaccggcccggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatctctggaggagccatggacagccagctgcaccccaacagcggcggcttccggcccggcacccccagcctgcacccctaccgcagccagcccctgtacctgcccccaggccctgcccctccttctgccctgctgtctggagtggccctgaagggccagttcctggacttcagcaccatgcaggccacagagctgggcaagctgcctgctggaggagtgctgtaccccccacccagcttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagcccccccacccctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggacaggccccccaccccgggagggccccagccggcgggcagaggagcccggcagcagaggagacaaggagcccggcctgcccccaccaagatag

SEQ ID NO: 165438 - DNA, 6417 bp, Artificial Sequence
  Description of Artificial Sequence: Synthetic coding sequence
atgtctgacagaagtggccccacagccaagggcaaggatggcaagaagtacagcagcctgaacctgtttgacacctacaagggcaagagcctggagatccagaagccagctgtggcccccaggcatggcctgcagagcctgggcaaggtggccatcgcccggaggatgcctcctccagccaacctgcccagcctgaaggccgagaacaagggaaatgaccccaacgtgtccctggtgcccaaggatggcaccggctgggccagcaagcaggagcagagcgaccccaagagcagtgatgccagcacagcccagcccccagagagccagcccctgcctgccagccagaccccagccagcaaccagcccaagaggcctcctgctgcccctgagaacacccccctggtgcccagcggcgtgaagtcctgggcccaggcctctgtgacccatggagcccatggagatggcggccgggccagcagcctgctgagccgcttcagccgggaggagttccccaccctgcaggccgccggggaccaggacaaggccgccaaggagcgggagagcgctgagcagagcagcggccctggccccagcctgcggccccagaacagcaccacctggagagatggcggcggccggggcccagatgagctggagggccctgacagcaagctgcaccacggccatgacccccggggcggcctgcagcccagcggccccccccagttccccccctaccggggcatgatgccacccttcatgtacccaccctacctgcccttccccccaccctacggcccccagggcccctaccgctaccccaccccagatggccccagccgcttcccccgggtggccggcccccggggcagcggcccccccatgaggctggtggagcctgtgggccggcccagcatcctgaaggaggacaacctgaaggagtttgaccagctggaccaggagaatgatgatggctgggccggggcccacgaggaggtggactacacagagaagctgaagttcagtgatgaagaagatggccgggacagtgatgaggagggcgctgagggccaccgggacagccagagcgccagcggggaggagcggcccccagaggctgatggcaagaagggcaacagccccaacagcgagccccccacccccaagacagcctgggccgagaccagccggcccccagagacagagcccggccccccagcccccaagccacccctgcccccacctggggactacccagaccggggcggccccccctgcaagcccccagccccagaagatgaagatgaggcctggaggcagaggaggaagcagagcagcagcgagatcagcctggccgtggagcgggccaggagaagaagagaggaggaggagaggaggatgcaggaggagaggagagctgcctgtgccgagaagctgaagaggctggatgagaagtttggagccccagacaagaggctgaaggccgagcctgctgcccccccagctgcccccagcaccccagcccctcctcctgctgtgcccaaggagctgcctgcccccccagcccctcctccagccagcgcccccaccccagagacagagcctgaggagcccgcccaggcccccccagcccagagcacccccaccccaggagtggccgccgcccccaccctggtgtctgggggcggcagcaccagcagcaccagcagcggcagctttgaggccagccctgtggagccccagctgcccagcaaggagggccctgagcccccagaggaggtgcccccacccaccaccccacctgtgcccaaggtggagcccaagggagatggcatcggccccacccggcagccccccagccagggcctgggctaccccaagtaccagaagagcctgcccccacgcttccagaggcagcagcaggagcagctgctgaagcagcagcagcagcaccagtggcagcagcaccagcagggcagcgccccacccacccctgtgccccccagccccccccagcctgtgaccctgggcgctgtgcctgccccccaggcccctcctcctccacccaaggccctgtacccaggggccctgggccggcccccacccatgccacccatgaactttgacccccgctggatgatgatccccccctacgtggacccccggctgctgcagggccggccccccctggacttctacccacctggggtgcaccccagcggcctggtgccccgggagaggagtgacagcggcggcagcagcagcgagccctttgacagacatgccccagccatgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgactggacctgaggccggcaggaagccagcccggggcgtgggcagcggcggccagggccccccaccaccccggcgggagagcaggacagagacccgctggggccccaggcctggcagcagcagaagaggcatccccccagaggagcccggggccccaccccggcgggccggccccatcaagaagcccccaccacccaccaaggtggaggagctgccccccaagcccctggagcagggagatgagacccccaagccacccaagccagaccccctgaagatcaccaagggcaagctgggcggccccaaggagaccccaccaaatggaaacctgagccctgccccccggctgcggcgggactacagctatgaaagagtgggccccaccagctgccggggccggggccgcggggagtactttgcccggggccggggcttccggggcacctatggaggccggggccgcggggctgctggcaacagcgctgtgacagagagctttgaggagatgatgggcgtggaggtgggccagggcgaccagaccaccctgctgctgcctgaggccgccctgcctgcccggcatggagcccgggtgcagagcatgaggaagagccccagcggggccggcagcggggcccagaagcaggccgcccggcccatgagggtcatctggctgctgcagacccggcggctgccccacccccggcgggagcacagccccaggagccgcagccccaccaccaggagccccaccttccctgccccagcccgcttcaccccaggagtgggggagagcagcctgcctgagggcatcagccctggcccccggcggcgggagcccccccaggtgtgccccggctggagccccccagccaagagcctggcccccaagaagccacccaccggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagcccccacgcttccggcggctgaagcaggagcgggagaatgctgcccggggcagcgagggcaagcccagcctgaccctgcctgccagcgcccctggccctgaggaggccctgaccaccgtgacagtggccccagcccccaggagagctgctgccaagagcccagacctgagcaaccagaacagcgaccaggccaatgaggagtgggagacagccagcgagagcagtgacttcaccagcgagaggagaggagacaaggaggcccctcctcctgtgctgctgacccccaaggctgtgggcaccccaggcggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcacaggccctggccgcggggacaagaggtcctggcccagccccaagaacagaagcaggcctcctgaggagcggcccccaggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggcctgccccaggccccccagggccccagccccaggcctcccaccaggtatgagccccagagggtgaacagcggcctgagcagtgacccccactttgaggagcccggccccatggtgcggggcgtgggcggcaccccccgggacagcgctggggtgagccccttcccccccaagagaagagagaggcctcccaggaagccagagctgctgcaggaggagagcctgcccccaccccacagcagcggcttcctgggcagcaagccagagggccctggcccccaggccgagagccgggacaccggcacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccaagaagacctcctccagcccctcatgatggagacaggaaggagctgccccgggagcagcccctgcccccaggccccatcggcacagagaggagccagaggacagaccggggcacagagcccggccccatccggcccagccacaggcctggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatcagcggcggccacggcctgagcatcaccagcaagcagtggaggaggcctggcacccccagcctgcacccctaccgcagccagcccctgtacctgcccccaggccctgccccacccagcgccctgctgagcggcctggccctgaagggccagttcctggacttcagcaccatgcaggccacagagctgggcaagctgcctgctgggggcgtgctgtacccacctccttccttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagcccccccacccctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggactggacctccaccccgggagggccccagcagaagagctgaggagcccggcagcagaggagacaaggagcccggcctgcccccacccaggtag

SEQ ID NO: 165439 - DNA, 6474 bp, Artificial Sequence; identical to SEQ ID NO: 165429
  Description of Artificial Sequence: Synthetic coding sequence

SEQ ID NO: 165440 - DNA, 6474 bp, Artificial Sequence; identical to SEQ ID NO: 165432
  Description of Artificial Sequence: Synthetic coding sequence

SEQ ID NO: 165441 - DNA, 6474 bp, Artificial Sequence; identical to SEQ ID NO: 165437
  Description of Artificial Sequence: Synthetic coding sequence

SEQ ID NO: 165442 - DNA, 6474 bp, Artificial Sequence; identical to SEQ ID NO: 165431
  Description of Artificial Sequence: Synthetic coding sequence

SEQ ID NO: 165443 - DNA, 6450 bp, Artificial Sequence
  Description of Artificial Sequence: Synthetic coding sequence
atgtctgacagaagtggccccacagccaagggcaaggatggcaagaagtacagcagcctgaacctgtttgacacctacaagggcaagagcctggagatccagaagccagctgtggcccccaggcatggcctgcagagcctgggcaaggtggccatcgcccggaggatgcctcctccagccaacctgcccagcctgaaggccgagaacaagggaaatgaccccaacgtgtccctggtgcccaaggatggcaccggctgggccagcaagcaggagcagagcgaccccaagagcagtgatgccagcacagcccagcccccagagagccagcccctgcctgccagccagaccccagccagcaaccagcccaagaggcctcctgctgcccctgagaacacccccctggtgcccagcggcgtgaagtcctgggcccaggcctctgtgacccatggagcccatggagatggcggccgggccagcagcctgctgagccgcttcagccgggaggagttccccaccctgcaggccgccggggaccaggacaaggccgccaaggagcgggagagcgctgagcagagcagcggccctggccccagcctgcggccccagaacagcaccacctggagagatggcggcggccggggcccagatgagctggagggccctgacagcaagctgcaccacggccatgacccccggggcggcctgcagcccagcggccccccccagttccccccctaccggggcatgatgccacccttcatgtacccaccctacctgcccttccccccaccctacggcccccagggcccctaccgctaccccaccccagatggccccagccgcttcccccgggtggccggcccccggggcagcggcccccccatgaggctggtggagcctgtgggccggcccagcatcctgaaggaggacaacctgaaggagtttgaccagctggaccaggagaatgatgatggctgggccggggcccacgaggaggtggactacacagagaagctgaagttcagtgatgaagaagatggccgggacagtgatgaggagggcgctgagggccaccgggacagccagagcgccagcggggaggagcggcccccagaggctgatggcaagaagggcaacagccccaacagcgagccccccacccccaagacagcctgggccgagaccagccggcccccagagacagagcccggccccccagcccccaagccacccctgcccccaccccaccggggccctgctggcaactggggccccccaggggactacccagacagaggaggccccccctgcaagcccccagccccagaagatgaagatgaggcctggaggcagaggaggaagcagagcagcagcgagatcagcctggccgtggagcgggccaggagaagaagagaggaggaggagaggaggatgcaggaggagcggcgggccgcctgtgccgagaagctgaagaggctggatgagaagtttggagccccagacaagaggctgaaggccgagcctgctgcccctcctgctgcccccagcaccccagcccctcctcctgctgtgcccaaggagctgcctgcccccccagcccctcctccagccagcgcccccaccccagagacagagcctgaggagcccgcccaggcccccccagcccagagcacccccaccccaggagtggccgccgcccccaccctggtgtctgggggcggcagcaccagcagcaccagcagcggcagctttgaggccagccctgtggagccccagctgcccagcaaggagggccctgagcccccagaggaggtgcccccacccaccaccccacctgtgcccaaggtggagcccaagggagatggcatcggccccacccggcagccccccagccagggcctgggctaccccaagtaccagaagagcctgcccccacgcttccagaggcagcagcaggagcagctgctgaagcagcagcagcagcaccagtggcagcagcaccagcagggcagcgccccacccacccctgtgccccccagccccccccagcctgtgaccctgggcgctgtgcctgccccccaggcccctcctcctccacccaaggccctgtacccaggggccctgggccggcccccacccatgccacccatgaactttgacccccgctggatgatgatccccccctacgtggacccccggctgctgcagggccggccccccctggacttctacccacctggggtgcaccccagcggcctggtgccccgggagaggagtgacagcggcggcagcagcagcgagccctttgacagacatgccccagccatgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgaccggccctgaggccggcaggaagccagcccggggcgtgggcagcggcggccagggccccccacctccaagaagagagagcaggacagagacccgctggggcccccggcccggcagcagccggcggggcatccccccagaggagcccggggcccccccaagaagagctggccccatcaagaagcccccaccacccaccaaggtggaggagctgccccccaagcccctggagcagggagatgagacccccaagccacccaagccagaccccctgaagatcaccaagggcaagctgggcggccccaaggagaccccacccaacggcaacctgagccctgccccccggctgcggcgggactacagctatgagcgggtgggccccaccagctgccggggccggggccgcggggagtactttgcccggggccggggcttccggggcacctacggcggccggggcagaggagctgctggcaacagcgctgtgacagagagctttgaggagatgatgggcgtggaggtgggccagggcgaccagaccaccctgctgctgcctgaggccgccctgcctgcccggcacggggcccgggtgcagagcatgaggaagagccccagcggggccggcagcggggcccagaagcaggccgcccggcccatgagggtcatctggctgctgcagacccggcggctgccccacccccggcgggagcacagccccaggagccgcagccccaccaccaggagccccaccttccctgccccagcccgcttcaccccaggagtgggggagagcagcctgcctgagggcatcagccctggccccaggagaagagagcccccccaggtgtgccccggctggagccccccagccaagagcctggcccccaagaagcccccaacaggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagccaccccgcttccggcggctgaagcaggagagagaaaatgctgcccggggcagcgagggcaagcccagcctgaccctgcctgccagcgcccctggccctgaggaggccctgaccaccgtgacagtggccccagccccccggcgggctgctgccaagagcccagacctgagcaaccagaacagcgaccaggccaatgaggagtgggagacagccagcgagagcagtgacttcaccagcgagcggcggggggacaaggaggcccctcctcctgtgctgctgacccccaaggctgtgggcacccctgggggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcactggacctggccgcggggacaagaggtcctggcccagccccaagaacagaagccggcccccagaggagaggcctcctggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggcctgccccaggccccccagggccccagcccccggccccccaccaggtatgagccccagagggtgaacagcggcctgagcagtgacccccactttgaggagcccggccccatggtgcggggcgtgggcggcaccccccgggacagcgctggggtgagccccttcccccccaagaggcgggagcggccccccaggaagccagagctgctgcaggaggagagcctgcccccaccccacagcagcggcttcctgggcagcaagccagagggccctggcccccaggccgagagccgggacacaggaacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccccggcggcccccaccagcccctcatgatggagacaggaaggagctgccccgggagcagcccctgcccccaggccccatcggcacagagaggagccagaggacagaccggggcacagagcccggccccatccggcccagccaccggcccggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatcagcggcggccacggcctgagcatcaccagcaagcagtggaggcggcccggcacccccagcctgcacccctaccgcagccagcccctgtacctgcccccaggccctgcccctccttctgccctgctgtctggagtggccctgaagggccagttcctggacttcagcaccatgcaggccacagagctgggcaagctgcctgctggaggagtgctgtaccccccacccagcttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagcccccccacccctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggacaggccccccaccccgggagggccccagccggcgggcagaggagcccggcagcagaggagacaaggagcccggcctgcccccaccaagatag

SEQ ID NO: 165444 - DNA, 1650 bp, Artificial Sequence
  Description of Artificial Sequence: Synthetic coding sequence
atgtctgacagaagtggccccacagccaagggcaaggatggcaagaagtacagcagcctgaacctgtttgacacctacaagggcaagagcctggagatccagaagccagctgtggcccccaggcatggcctgcagagcctgggcaaggtggccatcgcccggaggatgcctcctccagccaacctgcccagcctgaaggccgagaacaagggaaatgaccccaacgtgtccctggtgcccaaggatggcaccggctgggccagcaagcaggagcagagcgaccccaagagcagtgatgccagcacagcccagcccccagagagccagcccctgcctgccagccagaccccagccagcaaccagcccaagaggcctcctgctgcccctgagaacacccccctggtgcccagcggcgtgaagtcctgggcccaggcctctgtgacccatggagcccatggagatggcggccgggccagcagcctgctgagccgcttcagccgggaggagttccccaccctgcaggccgccggggaccaggacaaggccgccaaggagcgggagagcgctgagcagagcagcggccctggccccagcctgcggccccagaacagcaccacctggagagatggcggcggccggggcccagatgagctggagggccctgacagcaagctgcaccacggccatgacccccggggcggcctgcagcccagcggccccccccagttccccccctaccggggcatgatgccacccttcatgtacccaccctacctgcccttccccccaccctacggcccccagggcccctaccgctaccccaccccagatggccccagccgcttcccccgggtggccggcccccggggcagcggcccccccatgaggctggtggagcctgtgggccggcccagcatcctgaaggaggacaacctgaaggagtttgaccagctggaccaggagaatgatgatggctgggccggggcccacgaggaggtggactacacagagaagctgaagttcagtgatgaagaagatggccgggacagtgatgaggagggcgctgagggccaccgggacagccagagcgccagcggggaggagcggcccccagaggctgatggcaagaagggcaacagccccaacagcgagccccccacccccaagacagcctgggccgagaccagccggcccccagagacagagcccggccccccagcccccaagccacccctgcccccaccccaccggggccctgctggcaactggggccccccaggggactacccagacagaggaggccccccctgcaagcccccagccccagaagatgaagatgaggcctggaggcagaggaggaagcagagcagcagcgagatcagcctggccgtggagcgggccaggagaagaagagaggaggaggagaggaggatgcaggaggagcggcgggccgcctgtgccgagaagctgaagaggctggatgagaagtttggagccccagacaagaggctgaaggccgagcctgctgcccctcctgctgcccccagcaccccagcccctcctcctgctgccagcgaggtgcccctgatggaggacagccggggccagcagagggaccccccccggggcctggaggccccccacccctag

SEQ ID NO: 165445 - DNA, 6417 bp, Artificial Sequence
  Description of Artificial Sequence: Synthetic coding sequence
atgtctgacagaagtggccccacagccaagggcaaggatggcaagaagtacagcagcctgaacctgtttgacacctacaagggcaagagcctggagatccagaagccagctgtggcccccaggcatggcctgcagagcctgggcaaggtggccatcgcccggaggatgcctcctccagccaacctgcccagcctgaaggccgagaacaagggaaatgaccccaacgtgtccctggtgcccaaggatggcaccggctgggccagcaagcaggagcagagcgaccccaagagcagtgatgccagcacagcccagcccccagagagccagcccctgcctgccagccagaccccagccagcaaccagcccaagaggcctcctgctgcccctgagaacacccccctggtgcccagcggcgtgaagtcctgggcccaggcctctgtgacccatggagcccatggagatggcggccgggccagcagcctgctgagccgcttcagccgggaggagttccccaccctgcaggccgccggggaccaggacaaggccgccaaggagcgggagagcgctgagcagagcagcggccctggccccagcctgcggccccagaacagcaccacctggagagatggcggcggccggggcccagatgagctggagggccctgacagcaagctgcaccacggccatgacccccggggcggcctgcagcccagcggccccccccagttccccccctaccggggcatgatgccacccttcatgtacccaccctacctgcccttccccccaccctacggcccccagggcccctaccgctaccccaccccagatggccccagccgcttcccccgggtggccggcccccggggcagcggcccccccatgaggctggtggagcctgtgggccggcccagcatcctgaaggaggacaacctgaaggagtttgaccagctggaccaggagaatgatgatggctgggccggggcccacgaggaggtggactacacagagaagctgaagttcagtgatgaagaagatggccgggacagtgatgaggagggcgctgagggccaccgggacagccagagcgccagcggggaggagcggcccccagaggctgatggcaagaagggcaacagccccaacagcgagccccccacccccaagacagcctgggccgagaccagccggcccccagagacagagcccggccccccagcccccaagccacccctgcccccacctggggactacccagaccggggcggccccccctgcaagcccccagccccagaagatgaagatgaggcctggaggcagaggaggaagcagagcagcagcgagatcagcctggccgtggagcgggccaggagaagaagagaggaggaggagaggaggatgcaggaggagaggagagctgcctgtgccgagaagctgaagaggctggatgagaagtttggagccccagacaagaggctgaaggccgagcctgctgcccccccagctgcccccagcaccccagcccctcctcctgctgtgcccaaggagctgcctgcccccccagcccctcctccagccagcgcccccaccccagagaaggagcctgaggagcccgcccaggcccccccagcccagagcacccccaccccaggagtggccgccgcccccaccctggtgtctgggggcggcagcaccagcagcaccagcagcggcagctttgaggccagccctgtggagccccagctgcccagcaaggagggccctgagcccccagaggaggtgcccccacccaccaccccacctgtgcccaaggtggagcccaagggagatggcatcggccccacccggcagccccccagccagggcctgggctaccccaagtaccagaagagcctgcccccacgcttccagaggcagcagcaggagcagctgctgaagcagcagcagcagcaccagtggcagcagcaccagcagggcagcgccccacccacccctgtgccccccagccccccccagcctgtgaccctgggcgctgtgcctgccccccaggcccctcctcctccacccaaggccctgtacccaggggccctgggccggcccccacccatgccacccatgaactttgacccccgctggatgatgatccccccctacgtggacccccggctgctgcagggccggccccccctggacttctacccacctggggtgcaccccagcggcctggtgccccgggagaggagtgacagcggcggcagcagcagcgagccctttgacagacatgccccagccatgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgactggacctgaggccggcaggaagccagcccggggcgtgggcagcggcggccagggccccccaccaccccggcgggagagcaggacagagacccgctggggccccaggcctggcagcagcagaagaggcatccccccagaggagcccggggccccaccccggcgggccggccccatcaagaagcccccaccacccaccaaggtggaggagctgccccccaagcccctggagcagggagatgagacccccaagccacccaagccagaccccctgaagatcaccaagggcaagctgggcggccccaaggagaccccaccaaatggaaacctgagccctgccccccggctgcggcgggactacagctatgaaagagtgggccccaccagctgccggggccggggccgcggggagtactttgcccggggccggggcttccggggcacctatggaggccggggccgcggggctgctggcaacagcgctgtgacagagagctttgaggagatgatgggcgtggaggtgggccagggcgaccagaccaccctgctgctgcctgaggccgccctgcctgcccggcatggagcccgggtgcagagcatgaggaagagccccagcggggccggcagcggggcccagaagcaggccgcccggcccatgagggtcatctggctgctgcagacccggcggctgccccacccccggcgggagcacagccccaggagccgcagccccaccaccaggagccccaccttccctgccccagcccgcttcaccccaggagtgggggagagcagcctgcctgagggcatcagccctggcccccggcggcgggagcccccccaggtgtgccccggctggagccccccagccaagagcctggcccccaagaagccacccaccggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagcccccacgcttccggcggctgaagcaggagcgggagaatgctgcccggggcagcgagggcaagcccagcctgaccctgcctgccagcgcccctggccctgaggaggccctgaccaccgtgacagtggccccagcccccaggagagctgctgccaagagcccagacctgagcaaccagaacagcgaccaggccaatgaggagtgggagacagccagcgagagcagtgacttcaccagcgagaggagaggagacaaggaggcccctcctcctgtgctgctgacccccaaggctgtgggcaccccaggcggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcacaggccctggccgcggggacaagaggtcctggcccagccccaagaacagaagcaggcctcctgaggagcggcccccaggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggccccccccaggccccccagggccccagccccaggcctcccaccaggtatgagccccagagggtgaacagcggcctgagcagtgacccccactttgaggagcccggccccatggtgcggggcgtgggcggcaccccccgggacagcgctggggtgagccccttcccccccaagagaagagagaggcctcccaggaagccagagctgctgcaggaggagagcctgcccccaccccacagcagcggcttcctgggcagcaagccagagggccctggcccccaggccgagagccgggacaccggcacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccaagaagacctcctccagcccctcatgatggagacaggaaggagctgccccgggagcagcccctgcccccaggccccatcggcacagagaggagccagcacacagaccggggcacagagcccggccccatccggcccagccacaggcctggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatcagcggcggccacggcctgtctgtgaccagcaagcagtggaggaggcctggcacccccagcctgcacccctaccgcagccagcccctgtacctgcccccaggccctgccccacccagcgccctgctgagcggcgtggccctgaagggccagttcctggacttcagcaccatgcaggccacagagctgggcaagctgcctgctgggggcgtgctgtacccacctccttccttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagccccacccagcctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggactggacctccaccccgggagggccccagcagaagagctgaggagcccggcagcagaggagacaaggagcccggcctgcccccacccaggtag

SEQ ID NO: 165446 - DNA, 6450 bp, Artificial Sequence
  Description of Artificial Sequence: Synthetic coding sequence
atgtctgacagaagtggccccacagccaagggcaaggatggcaagaagtacagcagcctgaacctgtttgacacctacaagggcaagagcctggagatccagaagccagctgtggcccccaggcatggcctgcagagcctgggcaaggtggccatcgcccggaggatgcctcctccagccaacctgcccagcctgaaggccgagaacaagggaaatgaccccaacgtgtccctggtgcccaaggatggcaccggctgggccagcaagcaggagcagagcgaccccaagagcagtgatgccagcacagcccagcccccagagagccagcccctgcctgccagccagaccccagccagcaaccagcccaagaggcctcctgctgcccctgagaacacccccctggtgcccagcggcgtgaagtcctgggcccaggcctctgtgacccatggagcccatggagatggcggccgggccagcagcctgctgagccgcttcagccgggaggagttccccaccctgcaggccgccggggaccaggacaaggccgccaaggagcgggagagcgctgagcagagcagcggccctggccccagcctgcggccccagaacagcaccacctggagagatggcggcggccggggcccagatgagctggagggccctgacagcaagctgcaccacggccatgacccccggggcggcctgcagcccagcggccccccccagttccccccctaccggggcatgatgccacccttcatgtacccaccctacctgcccttccccccaccctacggcccccagggcccctaccgctaccccaccccagatggccccagccgcttcccccgggtggccggcccccggggcagcggcccccccatgaggctggtggagcctgtgggccggcccagcatcctgaaggaggacaacctgaaggagtttgaccagctggaccaggagaatgatgatggctgggccggggcccacgaggaggtggactacacagagaagctgaagttcagtgatgaagaagatggccgggacagtgatgaggagggcgctgagggccaccgggacagccagagcgccagcggggaggagcggcccccagaggctgatggcaagaagggcaacagccccaacagcgagccccccacccccaagacagcctgggccgagaccagccggcccccagagacagagcccggccccccagcccccaagccacccctgcccccaccccaccggggccctgctggcaactggggccccccaggggactacccagacagaggaggccccccctgcaagcccccagccccagaagatgaagatgaggcctggaggcagaggaggaagcagagcagcagcgagatcagcctggccgtggagcgggccaggagaagaagagaggaggaggagaggaggatgcaggaggagcggcgggccgcctgtgccgagaagctgaagaggctggatgagaagtttggagccccagacaagaggctgaaggccgagcctgctgcccctcctgctgcccccagcaccccagcccctcctcctgctgtgcccaaggagctgcctgcccccccagcccctcctccagccagcgcccccaccccagagaaggagcctgaggagcccgcccaggcccccccagcccagagcacccccaccccaggagtggccgccgcccccaccctggtgtctgggggcggcagcaccagcagcaccagcagcggcagctttgaggccagccctgtggagccccagctgcccagcaaggagggccctgagcccccagaggaggtgcccccacccaccaccccacctgtgcccaaggtggagcccaagggagatggcatcggccccacccggcagccccccagccagggcctgggctaccccaagtaccagaagagcctgcccccacgcttccagaggcagcagcaggagcagctgctgaagcagcagcagcagcaccagtggcagcagcaccagcagggcagcgccccacccacccctgtgccccccagccccccccagcctgtgaccctgggcgctgtgcctgccccccaggcccctcctcctccacccaaggccctgtacccaggggccctgggccggcccccacccatgccacccatgaactttgacccccgctggatgatgatccccccctacgtggacccccggctgctgcagggccggccccccctggacttctacccacctggggtgcaccccagcggcctggtgccccgggagaggagtgacagcggcggcagcagcagcgagccctttgacagacatgccccagccatgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgaccggccctgaggccggcaggaagccagcccggggcgtgggcagcggcggccagggccccccacctccaagaagagagagcaggacagagacccgctggggcccccggcccggcagcagccggcggggcatccccccagaggagcccggggcccccccaagaagagctggccccatcaagaagcccccaccacccaccaaggtggaggagctgccccccaagcccctggagcagggagatgagacccccaagccacccaagccagaccccctgaagatcaccaagggcaagctgggcggccccaaggagaccccacccaacggcaacctgagccctgccccccggctgcggcgggactacagctatgagcgggtgggccccaccagctgccggggccggggccgcggggagtactttgcccggggccggggcttccggggcacctacggcggccggggcagaggagctgctggcaacagcgctgtgacagagagctttgaggagatgatgggcgtggaggtgggccagggcgaccagaccaccctgctgctgcctgaggccgccctgcctgcccggcacggggcccgggtgcagagcatgaggaagagccccagcggggccggcagcggggcccagaagcaggccgcccggcccatgagggtcatctggctgctgcagacccggcggctgccccacccccggcgggagcacagccccaggagccgcagccccaccaccaggagccccaccttccctgccccagcccgcttcaccccaggagtgggggagagcagcctgcctgagggcatcagccctggccccaggagaagagagcccccccaggtgtgccccggctggagccccccagccaagagcctggcccccaagaagcccccaacaggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagccaccccgcttccggcggctgaagcaggagagagaaaatgctgcccggggcagcgagggcaagcccagcctgaccctgcctgccagcgcccctggccctgaggaggccctgaccaccgtgacagtggccccagccccccggcgggctgctgccaagagcccagacctgagcaaccagaacagcgaccaggccaatgaggagtgggagacagccagcgagagcagtgacttcaccagcgagcggcggggggacaaggaggcccctcctcctgtgctgctgacccccaaggctgtgggcacccctgggggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcactggacctggccgcggggacaagaggtcctggcccagccccaagaacagaagccggcccccagaggagaggcctcctggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggccccccccaggccccccagggccccagcccccggccccccaccaggtatgagccccagagggtgaacagcggcctgagcagtgacccccactttgaggagcccggccccatggtgcggggcgtgggcggcaccccccgggacagcgctggggtgagccccttcccccccaagaggcgggagcggccccccaggaagccagagctgctgcaggaggagagcctgcccccaccccacagcagcggcttcctgggcagcaagccagagggccctggcccccaggccgagagccgggacacaggaacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccccggcggcccccaccagcccctcatgatggagacaggaaggagctgccccgggagcagcccctgcccccaggccccatcggcacagagaggagccagcacacagaccggggcacagagcccggccccatccggcccagccaccggcccggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatcagcggcggccacggcctgtctgtgaccagcaagcagtggaggcggcccggcacccccagcctgcacccctaccgcagccagcccctgtacctgcccccaggccctgcccctccttctgccctgctgtctggagtggccctgaagggccagttcctggacttcagcaccatgcaggccacagagctgggcaagctgcctgctggaggagtgctgtaccccccacccagcttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagccccacccagcctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggacaggccccccaccccgggagggccccagccggcgggcagaggagcccggcagcagaggagacaaggagcccggcctgcccccaccaagatag

SEQ ID NO: 165447 - DNA, 1650 bp, Artificial Sequence; identical to SEQ ID NO: 165444
  Description of Artificial Sequence: Synthetic coding sequence

SEQ ID NO: 165448 - DNA, 1650 bp, Artificial Sequence; identical to SEQ ID NO: 165444
  Description of Artificial Sequence: Synthetic coding sequence

SEQ ID NO: 165449 - DNA, 4149 bp, Artificial Sequence
  Description of Artificial Sequence: Synthetic coding sequence
atgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgactggacctgaggccggcaggaagccagcccggggcgtgggcagcggcggccagggccccccaccaccccggcgggagagcaggacagagacccgctggggccccaggcctggcagcagcagaagaggcatccccccagaggagcccggggccccaccccggcgggccggccccatcaagaagcccccaccacccaccaaggtggaggagctgccccccaagcccctggagcagggagatgagacccccaagccacccaagccagaccccctgaagatcaccaagggcaagctgggcggccccaaggagaccccaccaaatggaaacctgagccctgccccccggctgcggcgggactacagctatgaaagagtgggccccaccagctgccggggccggggccgcggggagtactttgcccggggccggggcttccggggcacctatggaggccggggccgcggggcccggagccgggagttccgcagctaccgggagttcagaggagatgatggccggggcggcggcactggaggccccaaccaccccccagccccccggggccgcacagccagcgagaccaggtctgagggctctgaatatgaggagatccccaagagaagacggcagaggggcagcgagactggaagtgagacccatgaaagtgacctggcccccagcgacaaggaggcccccacccccaaggagggcaccctgacccaggtgcccctggcccctcctcctcctggggccccacccagccctgccccagcccgcttcaccgcccggggcggccgggtcttcaccccccggggcgtgcccagccggcggggccggggcggcggccggcccccaccccaggtgtgccccggctggagccccccagccaagagcctggcccccaagaagccacccaccggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagcccccacgcttccggcggctgaagcaggagcgggagaatgctgcccggggcagcgagggcaagcccagcctgaccctgcctgccagcgcccctggccctgaggaggccctgaccaccgtgacagtggccccagcccccaggagagctgctgccaagagcccagacctgagcaaccagaacagcgaccaggccaatgaggagtgggagacagccagcgagagcagtgacttcaccagcgagaggagaggagacaaggaggcccctcctcctgtgctgctgacccccaaggctgtgggcaccccaggcggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcacaggccctggccgcggggacaagaggtcctggcccagccccaagaacagaagcaggcctcctgaggagcggcccccaggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggccccccccaggccccccagggccccagccccaggcctcccaccaggtatgagccccagagggtgaacagcggcctgagcagtgacccccactttgaggagcccggccccatggtgcggggcgtgggcggcaccccccgggacagcgctggggtgagccccttcccccccaagagaagagagaggcctcccaggaagccagagctgctgcaggaggagagcctgcccccaccccacagcagcggcttcctgggcagcaagccagagggccctggcccccaggccgagagccgggacaccggcacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccaagaagacctcctccagcccctcatgatggagacaggaaggagctgccccgggagcagcccctgcccccaggccccatcggcacagagaggagccagcacacagaccggggcacagagcccggccccatccggcccagccacaggcctggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatcagcggcggggccatggacagccagctgcaccccaacagcggcggcttccggcccggcacccccagcctgcacccctaccgcagccagcccctgtacctgcccccaggccctgccccacccagcgccctgctgagcggcgtggccctgaagggccagttcctggacttcagcaccatgcaggccacagagctgggcaagctgcctgctgggggcgtgctgtacccacctccttccttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagccccacccagcctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggactggacctccaccccgggagggccccagcagaagagctgaggagcccggcagcagaggagacaaggagcccggcctgcccccacccaggtag

SEQ ID NO: 165450 - DNA, 6417 bp, Artificial Sequence
  Description of Artificial Sequence: Synthetic coding sequence
atgtctgacagaagtggccccacagccaagggcaaggatggcaagaagtacagcagcctgaacctgtttgacacctacaagggcaagagcctggagatccagaagccagctgtggcccccaggcatggcctgcagagcctgggcaaggtggccatcgcccggaggatgcctcctccagccaacctgcccagcctgaaggccgagaacaagggaaatgaccccaacgtgtccctggtgcccaaggatggcaccggctgggccagcaagcaggagcagagcgaccccaagagcagtgatgccagcacagcccagcccctggagagccagcccctgcctgccagccagaccccagccagcaaccagcccaagaggcctcctgctgcccctgagaacacccccctggtgcccagcggcgtgaagtcctgggcccaggcctctgtgacccatggagcccatggagatggcggccgggccagcagcctgctgagccgcttcagccgggaggagttccccaccctgcaggccgccggggaccaggacaaggccgccaaggagcgggagagcgctgagcagagcagcggccctggccccagcctgcggccccagaacagcaccacctggagagatggcggcggccggggcccagatgagctggagggccctgacagcaagctgcaccacggccatgacccccggggcggcctgcagcccagcggccccccccagttccccccctaccggggcatgatgccacccttcatgtacccaccctacctgcccttccccccaccctacggcccccagggcccctaccgctaccccaccccagatggccccagccgcttcccccgggtggccggcccccggggcagcggcccccccatgaggctggtggagcctgtgggccggcccagcatcctgaaggaggacaacctgaaggagtttgaccagctggaccaggagaatgatgatggctgggccggggcccacgaggaggtggactacacagagaagctgaagttcagtgatgaagaagatggccgggacagtgatgaggagggcgctgagggccaccgggacagccagagcgccagcggggaggagcggcccccagaggctgatggcaagaagggcaacagccccaacagcgagccccccacccccaagacagcctgggccgagaccagccggcccccagagacagagcccggccccccagcccccaagccacccctgcccccacctggggactacccagaccggggcggccccccctgcaagcccccagccccagaagatgaagatgaggcctggaggcagaggaggaagcagagcagcagcgagatcagcctggccgtggagcgggccaggagaagaagagaggaggaggagaggaggatgcaggaggagaggagagctgcctgtgccgagaagctgaagaggctggatgagaagtttggagccccagacaagaggctgaaggccgagcctgctgcccccccagctgcccccagcaccccagcccctcctcctgctgtgcccaaggagctgcctgcccccccagcccctcctccagccagcgcccccaccccagagaaggagcctgaggagcccgcccaggcccccccagcccagagcacccccaccccaggagtggccgccgcccccaccctggtgtctgggggcggcagcaccagcagcaccagcagcggcagctttgaggccagccctgtggagccccagctgcccagcaaggagggccctgagcccccagaggaggtgcccccacccaccaccccacctgtgcccaaggtggagcccaagggagatggcatcggccccacccggcagccccccagccagggcctgggctaccccaagtaccagaagagcctgcccccacgcttccagaggcagcagcaggagcagctgctgaagcagcagcagcagcaccagtggcagcagcaccagcagggcagcgccccacccacccctgtgccccccagccccccccagcctgtgaccctgggcgctgtgcctgccccccaggcccctcctcctccacccaaggccctgtacccaggggccctgggccggcccccacccatgccacccatgaactttgacccccgctggatgatgatccccccctacgtggacccccggctgctgcagggccggccccccctggacttctacccacctggggtgcaccccagcggcctggtgccccgggagaggagtgacagcggcggcagcagcagcgagccctttgacagacatgccccagccatgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgactggacctgaggccggcaggaagccagcccggggcgtgggcagcggcggccagggccccccaccaccccggcgggagagcaggacagagacccgctggggccccaggcctggcagcagcagaagaggcatccccccagaggagcccggggccccaccccggcgggccggccccatcaagaagcccccaccacccaccaaggtggaggagctgccccccaagcccctggagcagggagatgagacccccaagccacccaagccagaccccctgaagatcaccaagggcaagctgggcggccccaaggagaccccaccaaatggaaacctgagccctgccccccggctgcggcgggactacagctatgaaagagtgggccccaccagctgccggggccggggccgcggggagtactttgcccggggccggggcttccggggcacctatggaggccggggccgcggggctgctggcaacagcgctgtgacagagagctttgaggagatgatgggcgtggaggtgggccagggcgaccagaccaccctgctgctgcctgaggccgccctgcctgcccggcatggagcccgggtgcagagcatgaggaagagccccagcggggccggcagcggggcccagaagcaggccgcccggcccatgagggtcatctggctgctgcagacccggcggctgccccacccccggcgggagcacagccccaggagccgcagccccaccaccaggagccccaccttccctgccccagcccgcttcaccccaggagtgggggagagcagcctgcctgagggcatcagccctggcccccggcggcgggagcccccccaggtgtgccccggctggagccccccagccaagagcctggcccccaagaagccacccaccggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagcccccacgcttccggcggctgaagcaggagcgggagaatgctgcccggggcagcgagggcaagcccagcctgaccctgcctgccagcgcccctggccctgaggaggccctgaccaccgtgacagtggccccagcccccaggagagctgctgccaagagcccagacctgagcaaccagaacagcgaccaggccaatgaggagtgggagacagccagcgagagcagtgacttcaccagcgagaggagaggagacaaggaggcccctcctcctgtgctgctgacccccaaggctgtgggcaccccaggcggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcacaggccctggccgcggggacaagaggtcctggcccagccccaagaacagaagcaggcctcctgaggagcggcccccaggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggccccccccaggccccccagggccccagccccaggcctcccaccaggtatgagccccagagggtgaacagcggcctgagcagtgacccccactttgaggagcccggccccatggtgcggggcgtgggcggcaccccccgggacagcgctggggtgagccccttcccccccaagagaagagagaggcctcccaggaagccagagctgctgcaggaggagagcctgcccccaccccacagcagcggcttcctgggcagcaagccagagggccctggcccccaggccgagagccgggacaccggcacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccaagaagacctcctccagcccctcatgatggagacaggaaggagctgccccgggagcagcccctgcccccaggccccatcggcacagagaggagccagaggacagaccggggcacagagcccggccccatccggcccagccacaggcctggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatcagcggcggccacggcctgagcatcaccagcaagcagtggaggaggcctggcacccccagcctgcacccctaccgcagccagcccctgtacctgcccccaggccctgccccacccagcgccctgctgagcggcgtggccctgaagggccagttcctggacttcagcaccatgcaggccacagagctgggcaagctgcctgctgggggcgtgctgtacccacctccttccttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagcccccccacccctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggactggacctccaccccgggagggccccagcagaagagctgaggagcccggcagcagaggagacaaggagcccggcctgcccccacccaggtag

SEQ ID NO: 165451 - DNA, 6417 bp, Artificial Sequence; identical to SEQ ID NO: 165445
  Description of Artificial Sequence: Synthetic coding sequence

SEQ ID NO: 165452 - DNA, 6417 bp, Artificial Sequence
  Description of Artificial Sequence: Synthetic coding sequence
atgtctgacagaagtggccccacagccaagggcaaggatggcaagaagtacagcagcctgaacctgtttgacacctacaagggcaagagcctggagatccagaagccagctgtggcccccaggcatggcctgcagagcctgggcaaggtggccatcgcccggaggatgcctcctccagccaacctgcccagcctgaaggccgagaacaagggaaatgaccccaacgtgtccctggtgcccaaggatggcaccggctgggccagcaagcaggagcagagcgaccccaagagcagtgatgccagcacagcccagcccccagagagccagcccctgcctgccagccagaccccagccagcaaccagcccaagaggcctcctgctgcccctgagaacacccccctggtgcccagcggcgtgaagtcctgggcccaggcctctgtgacccatggagcccatggagatggcggccgggccagcagcctgctgagccgcttcagccgggaggagttccccaccctgcaggccgccggggaccaggacaaggccgccaaggagcgggagagcgctgagcagagcagcggccctggccccagcctgcggccccagaacagcaccacctggagagatggcggcggccggggcccagatgagctggagggccctgacagcaagctgcaccacggccatgacccccggggcggcctgcagcccagcggccccccccagttccccccctaccggggcatgatgccacccttcatgtacccaccctacctgcccttccccccaccctacggcccccagggcccctaccgctaccccaccccagatggccccagccgcttcccccgggtggccggcccccggggcagcggcccccccatgaggctggtggagcctgtgggccggcccagcatcctgaaggaggacaacctgaaggagtttgaccagctggaccaggagaatgatgatggctgggccggggcccacgaggaggtggactacacagagaagctgaagttcagtgatgaagaagatggccgggacagtgatgaggagggcgctgagggccaccgggacagccagagcgccagcggggaggagcggcccccagaggctgatggcaagaagggcaacagccccaacagcgagccccccacccccaagacagcctgggccgagaccagccggcccccagagacagagcccggccccccagcccccaagccacccctgcccccacctggggactacccagaccggggcggccccccctgcaagcccccagccccagaagatgaagatgaggcctggaggcagaggaggaagcagagcagcagcgagatcagcctggccgtggagcgggccaggagaagaagagaggaggaggagaggaggatgcaggaggagaggagagctgcctgtgccgagaagctgaagaggctggatgagaagtttggagccccagacaagaggctgaaggccgagcctgctgcccccccagctgcccccagcaccccagcccctcctcctgctgtgcccaaggagctgcctgcccccccagcccctcctccagccagcgcccccaccccagagacagagcctgaggagcccgcccaggcccccccagcccagagcacccccaccccaggagtggccgccgcccccaccctggtgtctgggggcggcagcaccagcagcaccagcagcggcagctttgaggccagccctgtggagccccagctgcccagcaaggagggccctgagcccccagaggaggtgcccccacccaccaccccacctgtgcccaaggtggagcccaagggagatggcatcggccccacccggcagccccccagccagggcctgggctaccccaagtaccagaagagcctgcccccacgcttccagaggcagcagcaggagcagctgctgaagcagcagcagcagcaccagtggcagcagcaccagcagggcagcgccccacccacccctgtgccccccagccccccccagcctgtgaccctgggcgctgtgcctgccccccaggcccctcctcctccacccaaggccctgtacccaggggccctgggccggcccccacccatgccacccatgaactttgacccccgctggatgatgatccccccctacgtggacccccggctgctgcagggccggccccccctggacttctacccacctggggtgcaccccagcggcctggtgccccgggagaggagtgacagcggcggcagcagcagcgagccctttgacagacatgccccagccatgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgactggacctgaggccggcaggaagccagcccggggcgtgggcagcggcggccagggccccccaccaccccggcgggagagcaggacagagacccgctggggccccaggcctggcagcagcagaagaggcatccccccagaggagcccggggccccaccccggcgggccggccccatcaagaagcccccaccacccaccaaggtggaggagctgccccccaagcccctggagcagggagatgagacccccaagccacccaagccagaccccctgaagatcaccaagggcaagctgggcggccccaaggagaccccaccaaatggaaacctgagccctgccccccggctgcggcgggactacagctatgaaagagtgggccccaccagctgccggggccggggccgcggggagtactttgcccggggccggggcttccggggcacctatggaggccggggccgcggggctgctggcaacagcgctgtgacagagagctttgaggagatgatgggcgtggaggtgggccagggcgaccagaccaccctgctgctgcctgaggccgccctgcctgcccggcatggagcccgggtgcagagcatgaggaagagccccagcggggccggcagcggggcccagaagcaggccgcccggcccatgagggtcatctggctgctgcagacccggcggctgccccacccccggcgggagcacagccccaggagccgcagccccaccaccaggagccccaccttccctgccccagcccgcttcaccccaggagtgggggagagcagcctgcctgagggcatcagccctggcccccggcggcgggagcccccccaggtgtgccccggctggagccccccagccaagagcctggcccccaagaagccacccaccggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagcccccacgcttccggcggctgaagcaggagcgggagaatgctgcccggggcagcgagggcaagcccagcctgaccctgcctgccagcgcccctggccctgaggaggccctgaccaccgtgacagtggccccagcccccaggagagctgctgccaagagcccagacctgagcaaccagaacagcgaccaggccaatgaggagtgggagacagccagcgagagcagtgacttcaccagcgagaggagaggagacaaggaggcccctcctcctgtgctgctgacccccaaggctgtgggcaccccaggcggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcacaggccctggccgcggggacaagaggtcctggcccagccccaagaacagaagcaggcctcctgaggagcggcccccaggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggcctgccccaggccccccagggccccagccccaggcctcccaccaggtatgagccccagagggtgaacagcggcctgagcagtgacccccactttgaggagcccggccccatggtgcggggcgtgggcggcaccccccgggacagcgctggggtgagccccttcccccccaagagaagagagaggcctcccaggaagccagagctgctgcaggaggagagcctgcccccaccccacagcagcggcttcctgggcagcaagccagagggccctggcccccaggccgagagccgggacaccggcacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccaagaagacctcctccagcccctcatgatggagacaggaaggagctgccccgggagcagcccctgcccccaggccccatcggcacagagaggagccagaggacagaccggggcacagagcccggccccatccggcccagccacaggcctggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatcagcggcggccacggcctgagcatcaccagcaagcagtggaggaggcctggcacccccagcctgcacccctaccgcagccagcccctgtacctgcccccaggccctgccccacccagcgccctgctgagcggcgtggccctgaagggccagttcctggacttcagcaccatgcaggccacagagctgggcaagctgcctgctgggggcgtgctgtacccacctccttccttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagcccccccacccctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggactggacctccaccccgggagggccccagcagaagagctgaggagcccggcagcagaggagacaaggagcccggcctgcccccacccaggtag

SEQ ID NO: 165453 - DNA, 6417 bp, Artificial Sequence; identical to SEQ ID NO: 165445
  Description of Artificial Sequence: Synthetic coding sequence

SEQ ID NO: 165454 - DNA, 6417 bp, Artificial Sequence
  Description of Artificial Sequence: Synthetic coding sequence
atgtctgacagaagtggccccacagccaagggcaaggatggcaagaagtacagcagcctgaacctgtttgacacctacaagggcaagagcctggagatccagaagccagctgtggcccccaggcatggcctgcagagcctgggcaaggtggccatcgcccggaggatgcctcctccagccaacctgcccagcctgaaggccgagaacaagggaaatgaccccaacgtgtccctggtgcccaaggatggcaccggctgggccagcaagcaggagcagagcgaccccaagagcagtgatgccagcacagcccagcccccagagagccagcccctgcctgccagccagaccccagccagcaaccagcccaagaggcctcctgctgcccctgagaacacccccctggtgcccagcggcgtgaagtcctgggcccaggcctctgtgacccatggagcccatggagatggcggccgggccagcagcctgctgagccgcttcagccgggaggagttccccaccctgcaggccgccggggaccaggacaaggccgccaaggagcgggagagcgctgagcagagcagcggccctggccccagcctgcggccccagaacagcaccacctggagagatggcggcggccggggcccagatgagctggagggccctgacagcaagctgcaccacggccatgacccccggggcggcctgcagcccagcggccccccccagttccccccctaccggggcatgatgccacccttcatgtacccaccctacctgcccttccccccaccctacggcccccagggcccctaccgctaccccaccccagatggccccagccgcttcccccgggtggccggcccccggggcagcggcccccccatgaggctggtggagcctgtgggccggcccagcatcctgaaggaggacaacctgaaggagtttgaccagctggaccaggagaatgatgatggctgggccggggcccacgaggaggtggactacacagagaagctgaagttcagtgatgaagaagatggccgggacagtgatgaggagggcgctgagggccaccgggacagccagagcgccagcggggaggagcggcccccagaggctgatggcaagaagggcaacagccccaacagcgagccccccacccccaagacagcctgggccgagaccagccggcccccagagacagagcccggccccccagcccccaagccacccctgcccccacctggggactacccagaccggggcggccccccctgcaagcccccagccccagaagatgaagatgaggcctggaggcagaggaggaagcagagcagcagcgagatcagcctggccgtggagcgggccaggagaagaagagaggaggaggagaggaggatgcaggaggagaggagagctgcctgtgccgagaagctgaagaggctggatgagaagtttggagccccagacaagaggctgaaggccgagcctgctgcccccccagctgcccccagcaccccagcccctcctcctgctgtgcccaaggagctgcctgcccccccagcccctcctccagccagcgcccccaccccagagaaggagcctgaggagcccgcccaggcccccccagcccagagcacccccaccccaggagtggccgccgcccccaccctggtgtctgggggcggcagcaccagcagcaccagcagcggcagctttgaggccagccctgtggagccccagctgcccagcaaggagggccctgagcccccagaggaggtgcccccacccaccaccccacctgtgcccaaggtggagcccaagggagatggcatcggccccacccggcagccccccagccagggcctgggctaccccaagtaccagaagagcctgcccccacgcttccagaggcagcagcaggagcagctgctgaagcagcagcagcagcaccagtggcagcagcaccagcagggcagcgccccacccacccctgtgccccccagccccccccagcctgtgaccctgggcgctgtgcctgccccccaggcccctcctcctccacccaaggccctgtacccaggggccctgggccggcccccacccatgccacccatgaactttgacccccgctggatgatgatccccccctacgtggacccccggctgctgcagggccggccccccctggacttctacccacctggggtgcaccccagcggcctggtgccccgggagaggagtgacagcggcggcagcagcagcgagccctttgacagacatgccccagccatgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgactggacctgaggccggcaggaagccagcccggggcgtgggcagcggcggccagggccccccaccaccccggcgggagagcaggacagagacccgctggggccccaggcctggcagcagcagaagaggcatccccccagaggagcccggggccccaccccggcgggccggccccatcaagaagcccccaccacccaccaaggtggaggagctgccccccaagcccctggagcagggagatgagacccccaagccacccaagccagaccccctgaagatcaccaagggcaagctgggcggccccaaggagaccccaccaaatggaaacctgagccctgccccccggctgcggcgggactacagctatgaaagagtgggccccaccagctgccggggccggggccgcggggagtactttgcccggggccggggcttccggggcacctatggaggccggggccgcggggctgctggcaacagcgctgtgacagagagctttgaggagatgatgggcgtggaggtgggccagggcgaccagaccaccctgctgctgcctgaggccgccctgcctgcccggcatggagcccgggtgcagagcatgaggaagagccccagcggggccggcagcggggcccagaagcaggccgcccggcccatgagggtcatctggctgctgcagacccggcggctgccccacccccggcgggagcacagccccaggagccgcagccccaccaccaggagccccaccttccctgccccagcccgcttcaccccaggagtgggggagagcagcctgcctgagggcatcagccctggcccccggcggcgggagcccccccaggtgtgccccggctggagccccccagccaagagcctggcccccaagaagccacccaccggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagcccccacgcttccggcggctgaagcaggagcgggagaatgctgcccggggcagcgagggcaagcccagcctgaccctgcctgccagcgcccctggccctgaggaggccctgaccaccgtgacagtggccccagcccccaggagagctgctgccaagagcccagacctgagcaaccagaacagcgaccaggccaatgaggagtgggagacagccagcgagagcagtgacttcaccagcgagaggagaggagacaaggaggcccctcctcctgtgctgctgacccccaaggctgtgggcaccccaggcggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcacaggccctggccgcggggacaagaggtcctggcccagccccaagaacagaagcaggcctcctgaggagcggcccccaggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggccccccccaggccccccagggccccagccccaggcctcccaccaggtatgagccccagagggtgaacagcggcctgagcagtgacccccactttgaggagcccggccccatggtgcggggcgtgggcggcaccccccgggacagcgctggggtgagccccttcccccccaagagaagagagaggcctcccaggaagccagagctgctgcaggaggagagcctgcccccaccccacagcagcggcttcctgggcagcaagccagagggccctggcccccaggccgagagccgggacaccggcacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccaagaagacctcctccagcccctcatgatggagacaggaaggagctgccccgggagcagcccctgcccccaggccccatcggcacagagaggagccagaggacagaccggggcacagagcccggccccatccggcccagccacaggcctggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatcagcggcggccacggcctgagcatcaccagcaagcagtggaggaggcctggcacccccagcctgcacccctaccgcagccagcccctgtacctgcccccaggccctgccccacccagcgccctgctgagcggcgtggccctgaagggccagttcctggacttcagcaccatgcaggccacagagctgggcaagctgcctgctgggggcgtgctgtacccacctccttccttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagcccccccacccctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggactggacctccaccccgggagggccccagcagaagagctgaggagcccggcagcagaggagacaaggagcccggcctgcccccacccaggtag

SEQ ID NO: 165455 - DNA, 4149 bp, Artificial Sequence
  Description of Artificial Sequence: Synthetic coding sequence
atgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgactggacctgaggccggcaggaagccagcccggggcgtgggcagcggcggccagggccccccaccaccccggcgggagagcaggacagagacccgctggggccccaggcctggcagcagcagaagaggcatccccccagaggagcccggggccccaccccggcgggccggccccatcaagaagcccccaccacccaccaaggtggaggagctgccccccaagcccctggagcagggagatgagacccccaagccacccaagccagaccccctgaagatcaccaagggcaagctgggcggccccaaggagaccccaccaaatggaaacctgagccctgccccccggctgcggcgggactacagctatgaaagagtgggccccaccagctgccggggccggggccgcggggagtactttgcccggggccggggcttccggggcacctatggaggccggggccgcggggcccggagccgggagttccgcagctaccgggagttcagaggagatgatggccggggcggcggcactggaggccccaaccaccccccagccccccggggccgcacagccagcgagaccaggtctgagggctctgaatatgaggagatccccaagagaagacggcagaggggcagcgagactggaagtgagacccatgaaagtgacctggcccccagcgacaaggaggcccccacccccaaggagggcaccctgacccaggtgcccctggcccctcctcctcctggggccccacccagccctgccccagcccgcttcaccgcccggggcggccgggtcttcaccccccggggcgtgcccagccggcggggccggggcggcggccggcccccaccccaggtgtgccccggctggagccccccagccaagagcctggcccccaagaagccacccaccggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagcccccacgcttccggcggctgaagcaggagcgggagaatgctgcccggggcagcgagggcaagcccagcctgaccctgcctgccagcgcccctggccctgaggaggccctgaccaccgtgacagtggccccagcccccaggagagctgctgccaagagcccagacctgagcaaccagaacagcgaccaggccaatgaggagtgggagacagccagcgagagcagtgacttcaccagcgagaggagaggagacaaggaggcccctcctcctgtgctgctgacccccaaggctgtgggcaccccaggcggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcacaggccctggccgcggggacaagaggtcctggcccagccccaagaacagaagcaggcctcctgaggagcggcccccaggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggcctgccccaggccccccagggccccagccccaggcctcccaccaggtatgagccccagagggtgaacagcggcctgagcagtgacccccactttgaggagcccggccccatggtgcggggcgtgggcggcaccccccgggacagcgctggggtgagccccttcccccccaagagaagagagaggcctcccaggaagccagagctgctgcaggaggagagcctgcccccaccccacagcagcggcttcctgggcagcaagccagagggccctggcccccaggccgagagccgggacaccggcacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccaagaagacctcctccagcccctcatgatggagacaggaaggagctgccccgggagcagcccctgcccccaggccccatcggcacagagaggagccagaggacagaccggggcacagagcccggccccatccggcccagccacaggcctggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatcagcggcggggccatggacagccagctgcaccccaacagcggcggcttccggcccggcacccccagcctgcacccctaccgcagccagcccctgtacctgcccccaggccctgccccacccagcgccctgctgagcggcgtggccctgaagggccagttcctggacttcagcaccatgcaggccacagagctgggcaagctgcctgctgggggcgtgctgtacccacctccttccttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagcccccccacccctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggactggacctccaccccgggagggccccagcagaagagctgaggagcccggcagcagaggagacaaggagcccggcctgcccccacccaggtag

SEQ ID NO: 165456 - DNA, 6450 bp, Artificial Sequence
  Description of Artificial Sequence: Synthetic coding sequence
atgtctgacagaagtggccccacagccaagggcaaggatggcaagaagtacagcagcctgaacctgtttgacacctacaagggcaagagcctggagatccagaagccagctgtggcccccaggcatggcctgcagagcctgggcaaggtggccatcgcccggaggatgcctcctccagccaacctgcccagcctgaaggccgagaacaagggaaatgaccccaacgtgtccctggtgcccaaggatggcaccggctgggccagcaagcaggagcagagcgaccccaagagcagtgatgccagcacagcccagcccccagagagccagcccctgcctgccagccagaccccagccagcaaccagcccaagaggcctcctgctgcccctgagaacacccccctggtgcccagcggcgtgaagtcctgggcccaggcctctgtgacccatggagcccatggagatggcggccgggccagcagcctgctgagccgcttcagccgggaggagttccccaccctgcaggccgccggggaccaggacaaggccgccaaggagcgggagagcgctgagcagagcagcggccctggccccagcctgcggccccagaacagcaccacctggagagatggcggcggccggggcccagatgagctggagggccctgacagcaagctgcaccacggccatgacccccggggcggcctgcagcccagcggccccccccagttccccccctaccggggcatgatgccacccttcatgtacccaccctacctgcccttccccccaccctacggcccccagggcccctaccgctaccccaccccagatggccccagccgcttcccccgggtggccggcccccggggcagcggcccccccatgaggctggtggagcctgtgggccggcccagcatcctgaaggaggacaacctgaaggagtttgaccagctggaccaggagaatgatgatggctgggccggggcccacgaggaggtggactacacagagaagctgaagttcagtgatgaagaagatggccgggacagtgatgaggagggcgctgagggccaccgggacagccagagcgccagcggggaggagcggcccccagaggctgatggcaagaagggcaacagccccaacagcgagccccccacccccaagacagcctgggccgagaccagccggcccccagagacagagcccggccccccagcccccaagccacccctgcccccaccccaccggggccctgctggcaactggggccccccaggggactacccagacagaggaggccccccctgcaagcccccagccccagaagatgaagatgaggcctggaggcagaggaggaagcagagcagcagcgagatcagcctggccgtggagcgggccaggagaagaagagaggaggaggagaggaggatgcaggaggagcggcgggccgcctgtgccgagaagctgaagaggctggatgagaagtttggagccccagacaagaggctgaaggccgagcctgctgcccctcctgctgcccccagcaccccagcccctcctcctgctgtgcccaaggagctgcctgcccccccagcccctcctccagccagcgcccccaccccagagaaggagcctgaggagcccgcccaggcccccccagcccagagcacccccaccccaggagtggccgccgcccccaccctggtgtctgggggcggcagcaccagcagcaccagcagcggcagctttgaggccagccctgtggagccccagctgcccagcaaggagggccctgagcccccagaggaggtgcccccacccaccaccccacctgtgcccaaggtggagcccaagggagatggcatcggccccacccggcagccccccagccagggcctgggctaccccaagtaccagaagagcctgcccccacgcttccagaggcagcagcaggagcagctgctgaagcagcagcagcagcaccagtggcagcagcaccagcagggcagcgccccacccacccctgtgccccccagccccccccagcctgtgaccctgggcgctgtgcctgccccccaggcccctcctcctccacccaaggccctgtacccaggggccctgggccggcccccacccatgccacccatgaactttgacccccgctggatgatgatccccccctacgtggacccccggctgctgcagggccggccccccctggacttctacccacctggggtgcaccccagcggcctggtgccccgggagaggagtgacagcggcggcagcagcagcgagccctttgacagacatgccccagccatgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgaccggccctgaggccggcaggaagccagcccggggcgtgggcagcggcggccagggccccccacctccaagaagagagagcaggacagagacccgctggggcccccggcccggcagcagccggcggggcatccccccagaggagcccggggcccccccaagaagagctggccccatcaagaagcccccaccacccaccaaggtggaggagctgccccccaagcccctggagcagggagatgagacccccaagccacccaagccagaccccctgaagatcaccaagggcaagctgggcggccccaaggagaccccacccaacggcaacctgagccctgccccccggctgcggcgggactacagctatgagcgggtgggccccaccagctgccggggccggggccgcggggagtactttgcccggggccggggcttccggggcacctacggcggccggggcagaggagctgctggcaacagcgctgtgacagagagctttgaggagatgatgggcgtggaggtgggccagggcgaccagaccaccctgctgctgcctgaggccgccctgcctgcccggcacggggcccgggtgcagagcatgaggaagagccccagcggggccggcagcggggcccagaagcaggccgcccggcccatgagggtcatctggctgctgcagacccggcggctgccccacccccggcgggagcacagccccaggagccgcagccccaccaccaggagccccaccttccctgccccagcccgcttcaccccaggagtgggggagagcagcctgcctgagggcatcagccctggccccaggagaagagagcccccccaggtgtgccccggctggagccccccagccaagagcctggcccccaagaagcccccaacaggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagccaccccgcttccggcggctgaagcaggagagagaaaatgctgcccggggcagcgagggcaagcccagcctgaccctgcctgccagcgcccctggccctgaggaggccctgaccaccgtgacagtggccccagccccccggcgggctgctgccaagagcccagacctgagcaaccagaacagcgaccaggccaatgaggagtgggagacagccagcgagagcagtgacttcaccagcgagcggcggggggacaaggaggcccctcctcctgtgctgctgacccccaaggctgtgggcacccctgggggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcactggacctggccgcggggacaagaggtcctggcccagccccaagaacagaagccggcccccagaggagaggcctcctggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggccccccccaggccccccagggccccagcccccggccccccaccaggtatgagccccagagggtgaacagcggcctgagcagtgacccccactttgaggagcccggccccatggtgcggggcgtgggcggcaccccccgggacagcgctggggtgagccccttcccccccaagaggcgggagcggccccccaggaagccagagctgctgcaggaggagagcctgcccccaccccacagcagcggcttcctgggcagcaagccagagggccctggcccccaggccgagagccgggacacaggaacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccccggcggcccccaccagcccctcatgatggagacaggaaggagctgccccgggagcagcccctgcccccaggccccatcggcacagagaggagccagaggacagaccggggcacagagcccggccccatccggcccagccaccggcccggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatcagcggcggccacggcctgagcatcaccagcaagcagtggaggcggcccggcacccccagcctgcacccctaccgcagccagcccctgtacctgcccccaggccctgcccctccttctgccctgctgtctggagtggccctgaagggccagttcctggacttcagcaccatgcaggccacagagctgggcaagctgcctgctggaggagtgctgtaccccccacccagcttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagcccccccacccctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggacaggccccccaccccgggagggccccagccggcgggcagaggagcccggcagcagaggagacaaggagcccggcctgcccccaccaagatag

SEQ ID NO: 165457 - DNA, 6450 bp, Artificial Sequence
  Description of Artificial Sequence: Synthetic coding sequence
atgtctgacagaagtggccccacagccaagggcaaggatggcaagaagtacagcagcctgaacctgtttgacacctacaagggcaagagcctggagatccagaagccagctgtggcccccaggcatggcctgcagagcctgggcaaggtggccatcgcccggaggatgcctcctccagccaacctgcccagcctgaaggccgagaacaagggaaatgaccccaacgtgtccctggtgcccaaggatggcaccggctgggccagcaagcaggagcagagcgaccccaagagcagtgatgccagcacagcccagcccctggagagccagcccctgcctgccagccagaccccagccagcaaccagcccaagaggcctcctgctgcccctgagaacacccccctggtgcccagcggcgtgaagtcctgggcccaggcctctgtgacccatggagcccatggagatggcggccgggccagcagcctgctgagccgcttcagccgggaggagttccccaccctgcaggccgccggggaccaggacaaggccgccaaggagcgggagagcgctgagcagagcagcggccctggccccagcctgcggccccagaacagcaccacctggagagatggcggcggccggggcccagatgagctggagggccctgacagcaagctgcaccacggccatgacccccggggcggcctgcagcccagcggccccccccagttccccccctaccggggcatgatgccacccttcatgtacccaccctacctgcccttccccccaccctacggcccccagggcccctaccgctaccccaccccagatggccccagccgcttcccccgggtggccggcccccggggcagcggcccccccatgaggctggtggagcctgtgggccggcccagcatcctgaaggaggacaacctgaaggagtttgaccagctggaccaggagaatgatgatggctgggccggggcccacgaggaggtggactacacagagaagctgaagttcagtgatgaagaagatggccgggacagtgatgaggagggcgctgagggccaccgggacagccagagcgccagcggggaggagcggcccccagaggctgatggcaagaagggcaacagccccaacagcgagccccccacccccaagacagcctgggccgagaccagccggcccccagagacagagcccggccccccagcccccaagccacccctgcccccaccccaccggggccctgctggcaactggggccccccaggggactacccagacagaggaggccccccctgcaagcccccagccccagaagatgaagatgaggcctggaggcagaggaggaagcagagcagcagcgagatcagcctggccgtggagcgggccaggagaagaagagaggaggaggagaggaggatgcaggaggagcggcgggccgcctgtgccgagaagctgaagaggctggatgagaagtttggagccccagacaagaggctgaaggccgagcctgctgcccctcctgctgcccccagcaccccagcccctcctcctgctgtgcccaaggagctgcctgcccccccagcccctcctccagccagcgcccccaccccagagaaggagcctgaggagcccgcccaggcccccccagcccagagcacccccaccccaggagtggccgccgcccccaccctggtgtctgggggcggcagcaccagcagcaccagcagcggcagctttgaggccagccctgtggagccccagctgcccagcaaggagggccctgagcccccagaggaggtgcccccacccaccaccccacctgtgcccaaggtggagcccaagggagatggcatcggccccacccggcagccccccagccagggcctgggctaccccaagtaccagaagagcctgcccccacgcttccagaggcagcagcaggagcagctgctgaagcagcagcagcagcaccagtggcagcagcaccagcagggcagcgccccacccacccctgtgccccccagccccccccagcctgtgaccctgggcgctgtgcctgccccccaggcccctcctcctccacccaaggccctgtacccaggggccctgggccggcccccacccatgccacccatgaactttgacccccgctggatgatgatccccccctacgtggacccccggctgctgcagggccggccccccctggacttctacccacctggggtgcaccccagcggcctggtgccccgggagaggagtgacagcggcggcagcagcagcgagccctttgacagacatgccccagccatgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgaccggccctgaggccggcaggaagccagcccggggcgtgggcagcggcggccagggccccccacctccaagaagagagagcaggacagagacccgctggggcccccggcccggcagcagccggcggggcatccccccagaggagcccggggcccccccaagaagagctggccccatcaagaagcccccaccacccaccaaggtggaggagctgccccccaagcccctggagcagggagatgagacccccaagccacccaagccagaccccctgaagatcaccaagggcaagctgggcggccccaaggagaccccacccaacggcaacctgagccctgccccccggctgcggcgggactacagctatgagcgggtgggccccaccagctgccggggccggggccgcggggagtactttgcccggggccggggcttccggggcacctacggcggccggggcagaggagctgctggcaacagcgctgtgacagagagctttgaggagatgatgggcgtggaggtgggccagggcgaccagaccaccctgctgctgcctgaggccgccctgcctgcccggcacggggcccgggtgcagagcatgaggaagagccccagcggggccggcagcggggcccagaagcaggccgcccggcccatgagggtcatctggctgctgcagacccggcggctgccccacccccggcgggagcacagccccaggagccgcagccccaccaccaggagccccaccttccctgccccagcccgcttcaccccaggagtgggggagagcagcctgcctgagggcatcagccctggccccaggagaagagagcccccccaggtgtgccccggctggagccccccagccaagagcctggcccccaagaagcccccaacaggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagccaccccgcttccggcggctgaagcaggagagagaaaatgctgcccggggcagcgagggcaagcccagcctgaccctgcctgccagcgcccctggccctgaggaggccctgaccaccgtgacagtggccccagccccccggcgggctgctgccaagagcccagacctgagcaaccagaacagcgaccaggccaatgaggagtgggagacagccagcgagagcagtgacttcaccagcgagcggcggggggacaaggaggcccctcctcctgtgctgctgacccccaaggctgtgggcacccctgggggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcactggacctggccgcggggacaagaggtcctggcccagccccaagaacagaagccggcccccagaggagaggcctcctggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggccccccccaggccccccagggccccagcccccggccccccaccaggtatgagccccagagggtgaacagcggcctgagcagtgacccccactttgaggagcccggccccatggtgcggggcgtgggcggcaccccccgggacagcgctggggtgagccccttcccccccaagaggcgggagcggccccccaggaagccagagctgctgcaggaggagagcctgcccccaccccacagcagcggcttcctgggcagcaagccagagggccctggcccccaggccgagagccgggacacaggaacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccccggcggcccccaccagcccctcatgatggagacaggaaggagctgccccgggagcagcccctgcccccaggccccatcggcacagagaggagccagaggacagaccggggcacagagcccggccccatccggcccagccaccggcccggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatcagcggcggccacggcctgagcatcaccagcaagcagtggaggcggcccggcacccccagcctgcacccctaccgcagccagcccctgtacctgcccccaggccctgcccctccttctgccctgctgtctggagtggccctgaagggccagttcctggacttcagcaccatgcaggccacagagctgggcaagctgcctgctggaggagtgctgtaccccccacccagcttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagcccccccacccctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggacaggccccccaccccgggagggccccagccggcgggcagaggagcccggcagcagaggagacaaggagcccggcctgcccccaccaagatag

SEQ ID NO: 165458 - DNA, 4149 bp, Artificial Sequence
  Description of Artificial Sequence: Synthetic coding sequence
atgctgcgggagcggggcaccccacctgtggaccccaagctggcctgggtgggagatgtgttcaccgccaccccagctgagccccggcccctgaccagccccctgcggcaggccgcagatgaagatgacaagggcatgaggtctgagaccccacctgtgcccccacctccaccctacctggccagctacccaggcttcccagaaaatggagcccctggcccccccatcagccgcttccccctggaggagcccggcccccggcccctgccctggcccccaggcagtgatgaggtggccaagatccagaccccaccacccaagaaggagccccccaaggaggagacagcccagctgactggacctgaggccggcaggaagccagcccggggcgtgggcagcggcggccagggccccccaccaccccggcgggagagcaggacagagacccgctggggccccaggcctggcagcagcagaagaggcatccccccagaggagcccggggccccaccccggcgggccggccccatcaagaagcccccaccacccaccaaggtggaggagctgccccccaagcccctggagcagggagatgagacccccaagccacccaagccagaccccctgaagatcaccaagggcaagctgggcggccccaaggagaccccaccaaatggaaacctgagccctgccccccggctgcggcgggactacagctatgaaagagtgggccccaccagctgccggggccggggccgcggggagtactttgcccggggccggggcttccggggcacctatggaggccggggccgcggggcccggagccgggagttccgcagctaccgggagttcagaggagatgatggccggggcggcggcactggaggccccaaccaccccccagccccccggggccgcacagccagcgagaccaggtctgagggctctgaatatgaggagatccccaagagaagacggcagaggggcagcgagactggaagtgagacccatgaaagtgacctggcccccagcgacaaggaggcccccacccccaaggagggcaccctgacccaggtgcccctggcccctcctcctcctggggccccacccagccctgccccagcccgcttcaccgcccggggcggccgggtcttcaccccccggggcgtgcccagccggcggggccggggcggcggccggcccccaccccaggtgtgccccggctggagccccccagccaagagcctggcccccaagaagccacccaccggccccctgccccccagcaaggagcccctgaaggagaagctgatccctggccccctgagccctgtggcccggggcggcagcaatggaggcagcaatgtgggcatggaggatggagagcggcccaggagaagaagacatggccgggcccagcagcaggacaagcccccacgcttccggcggctgaagcaggagcgggagaatgctgcccggggcagcgagggcaagcccagcctgaccctgcctgccagcgcccctggccctgaggaggccctgaccaccgtgacagtggccccagcccccaggagagctgctgccaagagcccagacctgagcaaccagaacagcgaccaggccaatgaggagtgggagacagccagcgagagcagtgacttcaccagcgagaggagaggagacaaggaggcccctcctcctgtgctgctgacccccaaggctgtgggcaccccaggcggcggcggcggcggcgctgtgcccggcatcagcgccatgagcagaggagacctgagccagagggccaaggacctgagcaagaggagcttcagcagccagaggcctggcatggagcggcagaacagaagacctggccctgggggcaaggccggcagcagcggcagcagcagcggcggcggcggcggcggccctgggggccgcacaggccctggccgcggggacaagaggtcctggcccagccccaagaacagaagcaggcctcctgaggagcggcccccaggcctgcccctgcccccacctccacccagcagcagcgctgtgttccggctggaccaggtgatccacagcaacccagctggcatccagcaggccctggcccagctgagcagccggcagggctctgtgacagcccctgggggccaccccaggcacaagccaggccccccccaggccccccagggccccagccccaggcctcccaccaggtatgagccccagagggtgaacagcggcctgagcagtgacccccactttgaggagcccggccccatggtgcggggcgtgggcggcaccccccgggacagcgctggggtgagccccttcccccccaagagaagagagaggcctcccaggaagccagagctgctgcaggaggagagcctgcccccaccccacagcagcggcttcctgggcagcaagccagagggccctggcccccaggccgagagccgggacaccggcacagaggccctgaccccccacatctggaaccggctgcacacagccaccagcaggaagagctaccggcccagctccatggagccctggatggagcccctgagcccctttgaagatgtggccggcacagagatgagccagagcgacagcggcgtggacctgagcggggacagccaggtgagcagcggcccctgcagccagaggagcagcccagatggcggcctgaagggagctgctgagggcccccccaagaggcctgggggcagcagccccctgaatgctgtgccctgtgagggccccccaggcagcgagcccccaagaagacctcctccagcccctcatgatggagacaggaaggagctgccccgggagcagcccctgcccccaggccccatcggcacagagaggagccagaggacagaccggggcacagagcccggccccatccggcccagccacaggcctggcccccctgtgcagtttggcaccagtgacaaggacagcgacctgcggctggtggtgggggacagcctgaaggccgagaaggagctgacagcctctgtgacagaggccatccctgtgtcccgggactgggagctgctgcccagcgctgctgccagcgctgagccccagagcaagaacctggacagcggccactgtgtgcctgagcccagcagcagcggccagaggctgtacccagaggtgttctacggcagcgctggccccagcagcagccagatcagcggcggggccatggacagccagctgcaccccaacagcggcggcttccggcccggcacccccagcctgcacccctaccgcagccagcccctgtacctgcccccaggccctgccccacccagcgccctgctgagcggcgtggccctgaagggccagttcctggacttcagcaccatgcaggccacagagctgggcaagctgcctgctgggggcgtgctgtacccacctccttccttcctgtacagccctgccttctgccccagccccctgcctgacaccagcctgctgcaggtgcggcaggacctgcccagccccagcgacttctacagcacccccctgcagcccggcggccagagcggcttcctgcccagcggggccccagcccagcagatgctgctgcccatggtggacagccagctgcctgtggtgaactttggcagcctgcccccagcccctcctccagcccccccacccctgagcctgctgcctgtgggccctgccctgcagccccccagcctggccgtgcggcccccaccagccccagccaccagggtgctgcccagccctgcccggcccttccctgccagcctgggccgggcagagctgcaccctgtggagctgaagcccttccaggactaccagaagctgagcagcaacctgggcggccctggcagcagcaggaccccacccaccggccgctccttcagcggcctgaacagccggctgaaggccacccccagcacctacagcggggtcttccgcacccagagggtggacctgtaccagcaggccagccccccagatgccctgcgctggatccccaagccctgggagaggactggacctccaccccgggagggccccagcagaagagctgaggagcccggcagcagaggagacaaggagcccggcctgcccccacccaggtag

SEQ ID NO: 165459 - DNA, 4149 bp, Artificial Sequence; identical to SEQ ID NO: 165458
  Description of Artificial Sequence: Synthetic coding sequence

SEQ ID NO: 165460 - DNA, 6450 bp, Artificial Sequence; identical to SEQ ID NO: 165446
  Description of Artificial Sequence: Synthetic coding sequence

SEQ ID NO: 165461 - DNA, 4149 bp, Artificial Sequence; identical to SEQ ID NO: 165449
  Description of Artificial Sequence: Synthetic coding sequence

SEQ ID NO: 165462 - DNA, 6450 bp, Artificial Sequence; identical to SEQ ID NO: 165446
  Description of Artificial Sequence: Synthetic coding sequence

SEQ ID NO: 165463 - DNA, 1650 bp, Artificial Sequence; identical to SEQ ID NO: 165444
  Description of Artificial Sequence: Synthetic coding sequence

SEQ ID NO: 165464 - DNA, 1650 bp, Artificial Sequence; identical to SEQ ID NO: 165444
  Description of Artificial Sequence: Synthetic coding sequence

SEQ ID NO: 165465 - DNA, 4149 bp, Artificial Sequence; identical to SEQ ID NO: 165449
  Description of Artificial Sequence: Synthetic coding sequence

SEQ ID NO: 165466 - DNA, 984 bp, Artificial Sequence
  Description of Artificial Sequence: Synthetic coding sequence
atgacagtggtgtctgtgccccagcgggagcccctggtgctgggcggccgcctggcccccctgggcttcagcagccggggctactttggagccctgcccatggtgaccacagcccccccacccctgccccgcatcccagacccccgggccctgccccccaccctcttcctgccccacttcctgggcggagatggcccctgcctgaccccccagccccgggccccagctgccctgcccaacagaagcctggccgtggccggcggcaccccccgggccgcccccaagaagaggaggaagaagaaggtgcgggccagccctgctggccagctgcccagccgcttccaccagtaccagcagcaccggcccagcctggagggcggccgcagccctgccaccggccccagcggggcccaggaggtgcccggccctgctgctgccctggcccccagccctgctgctgctgctggaacagaaggagccagcccagacctggcccccctgcggcctgctgcccctggccagacccccctgaggaaggaggtgctgaagagcaagatgggcaagtctgagaagatcgccctgccccacggccagctggtgcacggcatccacctgtatgagcagcccaagatcaaccggcagaagagcaagtacaacctgcccctgaccaagatcaccagcgccaagagaaatgaaaacaacttctggcaggacagcgtgtccagtgaccgcatccagaagcaggagaagaagcccttcaagaacacagagaacatcaagaacagccacctgaagaagagcgccttcctgacagaggtgtcccagaaggaaaattatgctggggccaagttcagtgacccccccagccccagcgtgctgcccaagccacccagccactggatgggcagcacagtggagaacagcaaccagaaccgggagctgatggctgtgcacctgaagaccctgctgaaggtgcagacctag

SEQ ID NO: 165467 - DNA, 429 bp, Artificial Sequence
  Description of Artificial Sequence: Synthetic coding sequence
atgggcaagtctgagaagatcgccctgccccacggccagctggtgcacggcatccacctgtatgagcagcccaagatcaaccggcagaagagcaagtacaacctgcccctgaccaagatcaccagcgccaagagaaatgaaaacaacttctggcaggacagcgtgtccagtgaccgcatccagaagcaggagaagaagcccttcaagaacacagagaacatcaagaacagccacctgaagaagagcgccttcctgacagaggtgtcccagaaggagaactatgctggggccaagttcagtgacccccccagccccagcgtgctgcccaagccacccagccactggatgggcagcacagtggagaacagcaaccagaaccgggagctgatggctgtgcacctgaagaccctgctgaaggtgcagacctag

SEQ ID NO: 165468 - DNA, 429 bp, Artificial Sequence; identical to SEQ ID NO: 165467
  Description of Artificial Sequence: Synthetic coding sequence

SEQ ID NO: 165469 - DNA, 420 bp, Artificial Sequence
  Description of Artificial Sequence: Synthetic coding sequence
atgggcggcggggagcgctacaacatcccagccccccagagcagaaatgtgtccaagaaccagcagcagctgaaccggcagaagaccaaggagcagaacagccagatgaagatcgtgcacaagaagaaggagcggggccacggctacaacagcagcgctgctgcctggcaggccatgcagaatggaggcaagaacaagaacttccccaacaaccagagctggaacagcagcctgagcggcccccggctgctcttcaagagccaggccaaccagaactatgctggggccaagttcagcgagccccccagccccagcgtgctgcccaagccacccagccactgggtgcctgtgtccttcaaccccagcgacaaggagatcatgaccttccagctgaagaccctgctgaaggtgcaggtgtag

SEQ ID NO: 165470 - DNA, 420 bp, Artificial Sequence; identical to SEQ ID NO: 165469
  Description of Artificial Sequence: Synthetic coding sequence

SEQ ID NO: 165471 - DNA, 597 bp, Artificial Sequence
  Description of Artificial Sequence: Synthetic coding sequence
atgctgctgatcctgctgtctgtggccctgctggccctgagcagcgcccagaacctgaatgaagatgtgtcccaggaggagagccccagcctgattgctggcaacccccagggccccagcccccagggcggcaacaagccccagggccccccacctcctcctgggaagccccagggccccccaccccagggcggcaacaagccccagggccccccacctcctgggaagccccagggccccccaccccagggcgacaagagccgcagccccaggagccccccaggcaagccccagggccccccaccccagggcggcaagccccagggccccccaccccagggcggcaacaagccccagggccccccacctcctgggaagccccagggccccccagcccagggcggcagcaagagccagagcgcccggagccccccaggcaagccccagggccccccccagcaggagggcaacaacccccagggccccccacctcctgctgggggcaacccccagcagccccaggcccccccagctggccagccccagggcccccccaggcctccccagggcggccggcccagccggcccccccagtag

SEQ ID NO: 165472 - DNA, 537 bp, Artificial Sequence
  Description of Artificial Sequence: Synthetic coding sequence
atgctgctgatcctgctgtctgtggccctgctggccctgagcagcgcccagaacctgaatgaagatgtgtcccaggaggagagccccagcctgattgctggcaacccccagggccccagcccccagggcggcaacaagccccagggccccccacctcctcctgggaagccccagggccccccaccccagggcggcaacaagccccagggccccccacctcctgggaagccccagggccccccaccccagggcgacaagagccgcagccccaggagccccccaggcaagccccagggccccccaccccagggcggcaagccccagggccccccagcccagggcggcagcaagagccagagcgcccggagccccccaggcaagccccagggccccccccagcaggagggcaacaacccccagggccccccacctcctgctgggggcaacccccagcagccccaggcccccccagctggccagccccagggcccccccaggcctccccagggcggccggcccagccggcccccccagtag

SEQ ID NO: 165473 - DNA, 597 bp, Artificial Sequence; identical to SEQ ID NO: 165471
  Description of Artificial Sequence: Synthetic coding sequence

SEQ ID NO: 165474 - DNA, 1251 bp, Artificial Sequence
  Description of Artificial Sequence: Synthetic coding sequence
atgctgctgatcctgctgtctgtggccctgctggccctgagcagcgcccagaacctgaatgaagatgtgtcccaggaggagagccccagcctgattgctggcaacccccagggcgccccaccccagggcggcaacaagccccagggcccccccagccccccaggcaagccccagggccccccaccccagggcggcaaccagccccagggccccccacctcctcctgggaagccccagggccccccaccccagggcggcaacaagccccagggccccccacctcctgggaagccccagggccccccaccccagggcgacaagagccgcagccccaggagccccccaggcaagccccagggccccccaccccagggcggcaaccagccccagggccccccacctcctcctgggaagccccagggccccccaccccagggcggcaacaagccccagggccccccacctcctgggaagccccagggccccccaccccagggcgacaacaagagccgcagcagccgcagccccccaggcaagccccagggccccccaccccagggcggcaaccagccccagggccccccacctcctcctgggaagccccagggccccccaccccagggcggcaacaagccccagggccccccacctcctgggaagccccagggccccccaccccagggcgacaacaagagccagagcgcccggagccccccaggcaagccccagggccccccaccccagggcggcaaccagccccagggccccccacctcctcctgggaagccccagggccccccaccccagggcggcaacaagccccagggccccccacctcctgggaagccccagggccccccaccccagggcggcagcaagagccgcagcagccgcagccccccaggcaagccccagggccccccaccccagggcggcaaccagccccagggccccccacctcctcctgggaagccccagggccccccaccccagggcggcaacaagccccagggccccccacctcctgggaagccccagggccccccaccccagggcggcagcaagagccgcagcgcccggagccccccaggcaagccccagggccccccccagcaggagggcaacaacccccagggccccccacctcctgctgggggcaacccccagcagccccaggcccccccagctggccagccccagggcccccccaggcctccccagggcggccggcccagccggcccccccagtag

SEQ ID NO: 165475 - DNA, 744 bp, Artificial Sequence
  Description of Artificial Sequence: Synthetic coding sequence
atgctgctgatcctgctgtctgtggccctgctggccctgagcagcgctgagagcagcagtgaagatgtgtcccaggaggagagcctcttcctgatcagcggcaagccagagggcagaagaccccagggcggcaaccagccccagaggcctcctcctcctcctgggaagccccagggccccccaccccagggcggcaaccagagccagggccccccacctcctcctgggaagccagagggccggcccccccagggcggcaaccagagccagggccccccaccccaccctgggaagccagagcggcccccaccccagggcggcaaccagagccagggcaccccacctcctcctgggaagccagagcggcccccaccccagggcggcaaccagagccaccggcccccacctcctcctgggaagccagagcggcccccaccccagggcggcaaccagagccagggccccccaccccaccctgggaagccagagggccccccaccccaggagggcaacaagagccgcagcgcccggagccccccaggcaagccccagggccccccccagcaggagggcaacaagccccagggccccccacctcctgggaagccccagggccccccacctgctgggggcaacccccagcagccccaggcccctcctgctgggaagccccagggccccccacctccaccccagggcggccggccccccaggcctgcccagggccagcagcccccccagtag

SEQ ID NO: 165476 - DNA, 744 bp, Artificial Sequence; identical to SEQ ID NO: 165475
  Description of Artificial Sequence: Synthetic coding sequence

SEQ ID NO: 165477 - DNA, 537 bp, Artificial Sequence
  Description of Artificial Sequence: Synthetic coding sequence
atgctgctgatcctgctgtctgtggccctgctggccctgagcagcgctgagagcagcagtgaagatgtgtcccaggaggagagcctcttcctgatcagcggcaagccagagggcagaagaccccagggcggcaaccagccccagaggcctcctcctcctcctgggaagccccagggccccccaccccagggcggcaaccagagccagggccccccacctcctcctgggaagccagagggccggcccccccagggcggcaaccagagccagggccccccaccccaccctgggaagccagagcggcccccaccccagggcggcaaccagagccagggcaagccccagggccccccccagcaggagggcaacaagccccagggccccccacctcctgggaagccccagggccccccacctgctgggggcaacccccagcagccccaggcccccccagctgggaagccccagggccccccacctccaccccagggcggccggccccccaggcctgcccagggccagcagcccccccagtag

SEQ ID NO: 165478 - DNA, 501 bp, Artificial Sequence
  Description of Artificial Sequence: Synthetic coding sequence
atgctgctgatcctgctgtctgtggccctgctggccttcagcagcgcccaggacctgaatgaagatgtgtcccaggaggatgtgcccctggtgatcagtgatggaggagacagcgagcagttcctggatgaggagcggcagggcccccccctgggcggccagcagagccagcccagcgctggagatggcaaccaggatgatggcccccagcagggccccccccagcagggcggccagcagcagcagggccccccaccaccccagggcaagccccagggccccccccagcagggcggccaccccccaccaccccagggccggccccagggccccccccagcagggcggccacccccggcccccccggggccggccccagggccccccccagcagggcggccaccagcagggccccccacctcctcctcctgggaagccccagggccccccaccccagggcggccggccccagggccccccccagggccagagcccccagtag

SEQ ID NO: 165479 - DNA, 291 bp, Artificial Sequence
  Description of Artificial Sequence: Synthetic coding sequence
atgctgctgatcctgctgtctgtggccctgctggccttcagcagcgcccaggacctggatgaagatgtgtcccaggaggatgtgcccctggtgatcagtgatggaggagacagcgagcagttcattgatgaggagggccacaaggaccaccccaaccgggaggccatcagcaaggtgctgccccacctgctgctggagagcccccgggaccacctgcccaagggggccgcccacaaggacctgcaccggggcagcctgctgagcaacctgggcttcaatgacaggaagtag

SEQ ID NO: 165480 - DNA, 501 bp, Artificial Sequence
  Description of Artificial Sequence: Synthetic coding sequence
atgctgctgatcctgctgtctgtggccctgctggccttcagcagcgcccaggacctggatgaagatgtgtcccaggaggatgtgcccctggtgatcagtgatggaggagacagcgagcagttcattgatgaggagcggcagggcccccccctgggcggccagcagagccagcccagcgctggagatggcaaccagaatgatggcccccagcagggccccccccagcagggcggccagcagcagcagggccccccaccaccccagggcaagccccagggccccccccagcagggcggccaccccccaccaccccagggccggccccagggccccccccagcagggcggccacccccggcccccccggggccggccccagggccccccccagcagggcggccaccagcagggccccccacctcctcctcctgggaagccccagggccccccaccccagggcggccggccccagggccccccccagggccagagcccccagtag

SEQ ID NO: 165481 - DNA, 501 bp, Artificial Sequence; identical to SEQ ID NO: 165480
  Description of Artificial Sequence: Synthetic coding sequence

SEQ ID NO: 165482 - DNA, 900 bp, Artificial Sequence
  Description of Artificial Sequence: Synthetic coding sequence
atggccgccagcagcagcgagatcagcgagatgaagggcgtggaggagagccccaaggtgcctggagagggccctggccacagcgaggccgagaccggccccccccaggtgctggccggcgtgcctgaccagcctgaggccccccagcccggccccaacaccacagctgcccctgtggacagcggccccaaggccggcctggcccctgagaccacagagaccccagctggggccagcgagacagcccaggccacagacctgagcctgagccctggaggagagagcaaggccaactgcagccctgaggacccctgccaggagaccgtgtccaagccagaggtgtccaaggaggccacagctgaccagggcagccggctggagagcgctgcccctcctgagcccgcccctgagcccgccccccagcctgaccccaggccagacagccagcccacccccaagccagccctgcagcctgagctgcccacccaggaggaccccaccccagagatcctgtctgagagcgtgggggagaagcaggagaatggagctgtggtgcccctgcaggccggagatggagaggagggccctgcccctgagccccacagcccccccagcaagaagagccccccagccaacggggccccaccccgggtgctgcagcagctggtggaggaggacaggatgagaagagcccacagcggccaccctggcagcccccggggcagcctgagccgccaccccagcagccagctggccggccctggggtggagggcggggagggcacccagaagccccgggactacatcatcctggccatcctgagctgcttctgccccatgtggcctgtgaacatcgtggcctttgcctatgctgtgatggtgagccccatgggcccctag

SEQ ID NO: 165483 - DNA, 1023 bp, Artificial Sequence
  Description of Artificial Sequence: Synthetic coding sequence
atggccgccagcagcagcgagatcagcgagatgaagggcgtggaggagagccccaaggtgcctggagagggccctggccacagcgaggccgagaccggccccccccaggtgctggccggcgtgcctgaccagcctgaggccccccagcccggccccaacaccacagctgcccctgtggacagcggccccaaggccggcctggcccctgagaccacagagaccccagctggggccagcgagacagcccaggccacagacctgagcctgagccctggaggagagagcaaggccaactgcagccctgaggacccctgccaggagaccgtgtccaagccagaggtgtccaaggaggccacagctgaccagggcagccggctggagagcgctgcccctcctgagcccgcccctgagcccgccccccagcctgaccccaggccagacagccagcccacccccaagccagccctgcagcctgagctgcccacccaggaggaccccaccccagagatcctgtctgagagcgtgggggagaagcaggagaatggagctgtggtgcccctgcaggccggagatggagaggagggccctgcccctgagccccacagcccccccagcaagaagagccccccagccaacggggccccaccccgggtgctgcagcagctggtggaggaggacaggatgagaagagcccacagcggccaccctggcagcccccggggcagcctgagccgccaccccagcagccagctggccggccctggggtggagggcggggagggcacccagaagccccgggactacatcatcctggccatcctgagctgcttctgccccatgtggcctgtgaacatcgtggcctttgcctatgctgtgatgagcaggaacagcctgcagcagggagatgtggatggagcccagaggctgggccgggtggccaagctgctgagcatcgtggccctggtgggcggcgtgctgatcatcatcgccagctgtgtgatcaacctgggcgtgtacaagtag

SEQ ID NO: 165484 - DNA, 1191 bp, Artificial Sequence
  Description of Artificial Sequence: Synthetic coding sequence
atgccccagctgcagttcaaggatgccttctggtgccgggacttcaccgcccacacaggctatgaggtgctgctgcagaggctgctggatggcaggaagatgtgcaaggacatggaggagctgctgcggcagagggcccaggccgaggagagatatggcaaggagctggtgcagatcgccaggaaggccggcggccagacagagatcaacagcctgcgggccagctttgacagcctgaagcagcagatggagaatgtgggcagcagccacatccagctggccctgaccctgcgggaggagctgcggagcctggaggagttccgggagcggcagaaggagcagaggaagaagtatgaggccgtgatggacagagtgcagaagagcaagctgagcctgtacaagaaggccatggagagcaagaagacctatgagcagaagtgcagagatgctgatgatgctgagcaggcctttgagcgcatcagcgccaacggccaccagaagcaggtggagaagagccagaacaaggcccggcagtgcaaggacagcgccacagaggccgagcgggtgtaccggcagagcatcgcccagctggagaaggtgcgggcagagtgggagcaggagcacaggaccacctgtgaggccttccagctgcaggagtttgaccggctgaccatcctgagaaatgccctgtgggtgcacagcaaccagctgtccatgcagtgtgtgaaggatgatgagctgtatgaggaggtgcggctgaccctggagggctgcagcattgatgctgacatcgacagcttcatccaggccaagagcactggaacagagcccccaggagaggtgcggctggccgacagcgctgccagccgcttcagcggcctgctgcacggcagccccaagaccaccagcctggccgccagcgctgccagcacagagaccctgacccccaccccagagagaaatgaaggagtgtacacagccatcgctgtgcaggagatccagggcaacccagccagccctgcccaggagtaccgggccctgtatgactacacagcccagaacccagatgagctggacctgtctgctggggacatcctggaggtgatcctggagggagaagatggctggtggacagtggagagaaatggccagaggggctttgtgcccggcagctacctggagaagctgtag

SEQ ID NO: 165485 - DNA, 1251 bp, Artificial Sequence
  Description of Artificial Sequence: Synthetic coding sequence
atgatgccccagctgcagttcaaggatgccttctggtgccgggacttcaccgcccacacaggctatgaggtgctgctgcagaggctgctggatggcaggaagatgtgcaaggacatggaggagctgctgcggcagagggcccaggccgaggagagatatggcaaggagctggtgcagatcgccaggaaggccggcggccagacagagatcaacagcctgcgggccagctttgacagcctgaagcagcagatggagaatgtgggcagcagccacatccagctggccctgaccctgcgggaggagctgcggagcctggaggagttccgggagcggcagaaggagcagaggaagaagtatgaagctgtgatggacagagtgcagaagagcaagctgagcctgtacaagaaggccatggagagcaagaagacctatgagcagaagtgcagagatgctgatgatgctgagcaggcctttgagcgcatcagcgccaacggccaccagaagcaggtggagaagagccagaacaaggcccggcagtgcaaggacagcgccacagaagctgagcgggtgtaccggcagagcatcgcccagctggagaaggtgcgggcagagtgggagcaggagcacaggaccacctgtgaggccttccagctgcaggagtttgaccggctgaccatcctgagaaatgccctgtgggtgcacagcaaccagctgtccatgcagtgtgtgaaggatgatgagctgtatgaggaggtgcggctgaccctggagggctgcagcattgatgctgacatcgacagcttcatccaggccaagagcactggaacagagcccccagcccctgtgccctaccagaactactatgaccgggaggtgacccccctgaccagcagccctggcatccagcccagctgtggcatgatcaagcgcttcagcggcctgctgcacggcagccccaagaccaccagcctggccgccagcgctgccagcacagagaccctgacccccaccccagagagaaatgaaggagtgtacacagccatcgctgtgcaggagatccagggcaacccagccagccctgcccaggagtaccgggccctgtatgactacacagcccagaacccagatgagctggacctgtctgctggggacatcctggaggtgatcctggagggagaagatggctggtggacagtggagagaaatggccagaggggctttgtgcccggcagctacctggagaagctgtag
